United States Patent 7,625,699 (GENETIC POLYMORPHISMS ASSOCIATED WITH CORONARY STENOSIS, METHODS OF DETECTION AND USES THEREOF) - sequence listing, part 7

SEQ ID NO: 12323 - DNA, 325446 bp, Homo sapiens
  misc_feature (1)...(325446): n = A,T,C or G, or insertion/deletion polymorphism (see Tables 1-2)
atttttaattatatttacataaagatgagtgattatttaactcattttaaaattccattctaattttaaacatgcattctccttagatagttataaaggaaaagagcagtaggtgatcaattactcagggtagattttcaattagtaaattatctgtgttctttgtttctattttcccttctattaactgcctaattttagacatttggctgcttattagaatttcctccaaaatgataaggtagcttaaaacactccattaatacttagaaaccttggtagatttcatgcaaaagagcatcacatttatagatcaaggaagtttctacgctgtatataaattttgccctggaatccttctgtcacatatataaaaagtagcagtttgggtgctattataacacttacaggtaagtaaaactaactttaaaatgtagaggtgttgaaatataacaaagaaataggctatacttatattttcctttctatcaacaaccttcatagtttttctcaataatacactctagcttaaaaatgcaaatcatccttaatttctaacattttagactggcctgtacatcagtagctgctgtaaacctgaactatttgctcatgaagtcaataagagctcagcctttgactgtttatcagcaatttattgggcaggcactgcattttaagtggcagcattaaaaaaaaaaaaggcagatgatacatctaaaaatgcaaggtttctgcattttttccctgactatatgtgaaataataagtattaataaggtccatgttggcaaaatgtttacttttttaaatcttaagttaatcccctattgttgttaattggcacagttggagactatgtcataaatcgtgatgtgagctatgacatcttagtcactcatatttaggtatctcctaatttctcagcttacatattactgaaatgcagctttacattgctttatccctaagcctaccagaaaactgctaaggattgtagacatttcatcaggtaatcaatacaaagttttcaaaactttgacaattacctatttctctaatagatgagtaatttaagtattgatataggcccgcactgctaacaatgttttggtcaatgacaaaccacatataccacagtggtcccatatgattataatatggtactttgtgccctttctatgtttagatacacaaagatttaccattgtgttacagttgcctagagtatttaatacagtaacatgctgtacacgtttgtagcctaggggcaataggctataccatataaccgaggtgtgtagtaggtcacacatctggtttgtgtcagtatactctgtgatgttcacatgatgaaatcacctgatgacgcattacccaatctcaggtattctttcatagcaacagtaaacagactaagacaagcttccaccatgtgccaggcactattctggtaattggagatacacagcaaacaagacagctattcagagtccttgttcacatggcactaacaccctagtgaacagagataaatgataagtgagaaaacaaataaacgaacaagaccattttgtatagtgataagtgctataaatacaatgaaacagggtagtatgatagtgaaagaaaaagtgtgtatgtgtacatggggtgtccaaaaatttttgataagattcttggaaaaaaagcctttctaaaataaagtaacatttgaggttagacttgatggagcacaaggggccagctatgtgaaaatctctggataccaaggccctgaacagggtttcccatttcacatgtatgaagaacacaaaggtggcctgaggtattagagatgcattctccattcctttagacactagccaagtgaatgtattaaaatttaaattaaaataaaatacaaaagttcagctcctcagtgacaccaaccatggttcaagtattcaatggccacatgtggttagtggcaaccatgttggacagcagagggtctatttgtcattgaagaaagttctaataaatagtacttcaccagtgaagtaggagcattggaataggaggagaggtcagagagaattacttggaaagatcatgaaggtccttgtaggactgtcatgaggactgtgatgaggactgcattctgcaagtacgatgggtagcctttgggtagttttaaataggggagggacataattcaatttatatttttaaagtgttactctgctatatagaaaatgaattataagtagggcaagatcagttagttactgcacttgtcctggccaaggaagatgatgggtctttggcaggttattataagagggacagtgaaaagtaaatggatttagaatatattttagagacaggatcaagtggatttcctaatcgactaaaagtaaracaagataaacaaaggaaagaatcaagacccgttccctcttctggggcctgagcaactaggtagatggttatgttctttactgggatgtaacaagattgagaaaatatagtttgggtgggtaggggataggtaggaagggaattgtaagttaagaattttgttttggataccttatgttttaggtacctattagatataaatatataataatcagataggtagcagagaatgattgaacccatactacggaacgtaaacttactgaattttacaatagaatcccctgacgcttaactatatttaataaagctcaaatgtgaagggttagatccttttcccaaaaaactgtaaaaacatgtttgctagatttgactaagtggaagatttatcaagtaaaacttaaatttttatttctgttgtccatgctctactatttttctgcacgtacaacattttccttattctttggctgtgttgtcactttcttgaactaggactcaccactatctgtagaaaagaggcagtgtttatatgtgattgctccctatccagtttatgtattgcagcttatttcatttaatatactctgttaaaggtacattattagtcgcttctttcagttagtatagccctgcaggtttctgcatctctctaacattagcattttgttgtctttgttcacttgcctctgggttctggatggtatggggagaaaaatctaccttctttccttttgatgggacaaataactttttgattatgatttgttaaagaaacctggatgccaggacattgcctccttattttattgaagagttccaggatgttattaacacatggatttagaatattcttgttttgctgccattagcaaatgccattttttcctgttacaacttttaaaaaacatctgcttcccataccttaagtgttcagtttttatgataatattatattaaattttctaaagaactgagataattgtgggggtaggggacagataaaattgaaatattctaaaatttcccttactatgcttttctttttaaccttgatatatgccagatttttggtttattattttaatatgttatttttgatgccaacagatatgaatgattttccaatcaaggtttttcactccgatgtgtcccaggtaggatctggcatatgaatcatatgtctaaaaaggaaactcatgaaagtatgtgtgcgtgctagggggctcatttgtctttggcaaagacattgctgctcctgtttccttaattattaaacagatggtgcccactgccattgactagctgcccaactcatactcctgtgtggtagcacaattctggacatctgacagagagaagctatacctttatagtttctcatatctacttatgtcataatattaatatctgccttctactagaacaggctgcttcccatgaagctgtttaaaacttaagtcatcttctccccctgtccccataaattaattttatctcaaggatctccttttggctttttttattgcttcatgtctacatacaaaatacagtggcatattgaatcaattatctaaatgctctaggctgtaaatacactttaacctggaatgtcaagataattaagacaaaattggattattaagattattattagtgagggcaaatgacatctaagatagccatgttaaaagtggagtatcatattaaaaagacaactagatcccagggaacatcaatagagtttaagtccattgaacagatactgaattctttttcataatctgccaaaaaaaggttagcttgaaaattttcttttagtttctcaaatatcacactgctgcagtacacgaacctttactcattaataactaaggtcctgatttttttcatatgctttgctcgaagatgtagtattttgcagccatagacagtcttctaagatctctcctagtgttaacccacctatcctcacctctcccttgagatttttctttattttttgatgaactatctgggcttttaaactttgttaaccttttttgaggatacggtcacttaatctcaatgtaattttactttccacagtcaaaaactattgtgtaatactcatgcactggatttaaatgactgctgcctctccttcctttctttttatactattgtggtctaggtaaggctgattcttccatcatttgaaccaacaggccaggcttgggttctcataaagcagaccttccagcaggagcgaccaaaggatgacactgtcacctgaaattggactgctgttgtacctgacttgggaacatctttgaatcagacagtagaagtggctgtcattttcagggacagtagaaagtatgttggctctcatctgccaagtaggcaaacacaatcttttttttttttttttccttccaacgttctagggagctcagcctcagggctagccgcagccccccacaccccggggctgcggtgggctgcgcggtggatcagcctcagcagcccctgctccagcctgtagggtgaaccggccgctttcccagcaaaggagcaatcgagctgagggtagcgcctcctccgcaggagggggcgggagctcggctgagaaagctttcctagggagttgccttaaagaaagaaagcggaattgtcgatcactccagttgccagttttatacaattttaagcagtcgtcgccactcgtttcccctttgcaaaactgcaaatcaccaccaaccttgcatcaaatagaagtggggagggaaaaaaaaagcaaatctccttctcccttctcaccctccctttcttctcaccctcccttcctctcttactcgctccttctccctccctcccttctgcggctgccgctagtctctcggtctggctctctctccgacgggacttagcaacttcttatttctcagccccttgtccatttttttttttccatcctttgccatgaattggattgacagaggcgggggaggctttgctttctgccccagggaatggcgattcgcgtcctggggccgtgccggggagaatcggcagaggagaaagaaagagtgatagaaaaagagctgcaggaaggaggagaagggagacctccatctgccgcgggcccggcgcgctgcagcgcagcgcagcgccgagctgcgcctcggaatggcccggagcccgccctgcgcccccggctcctccagcgtcagcggctcctgcgcgcgggatgcattgggcaatttttgaaatcctgaagtaggaagagaccccggaggatataagtcgggggtgggggtggagcagagaatctgtgaaagatattcaaagagagaaaaggggaatcctgatcgtttctgcccgtgcttgttttcaacttgagcgtgctagcctttaacttgaagaagtctcattggagcatctagcattctccaggagttattcgaaagctgaaactttcagtggattgtgggcctggggagaagaaggattccgagggtggaattgggaagabcgtgcgtgcgtktgtgtgtgtgtgtgtgygcgcgcgcgcgtgggtcggggcgggggcgtcggggggccactgggaattcagtgaagagggcaccctataccatggcagtgcccggcgacgctgcacgagtcaggracaagcccgtccacagtggggtgagtcaagcccccacggcgggccgggactgccaccatcgtgcggaccccgcatcgccgcgggactcgggctgccgtggctgctggggagacctggtgctgcagccgctccggagctctcggaaactttcctccgcgctgtgcgcgggctccctgtcctttctgctggcgctgctggtgaggctggtccgcggggaggtcggctgtgacctggagcagtgtaaggaggcggcggcggcggaggaggaggaagcagccccgggagcagaagggggcgtcttcccggggcctcggggaggtgctcccgggggcggtgcgcggctcagcccctggctgcagccctcggcgctgctcttcagtctcctgtgtgccttcttctggatgggcttgtacctcctgcgcgccggggtgcgcctgcctctggctgtcgcgctgctggccgcctgctgcgggggggaagcgctcgtccagattgggctgggcgtcggggaggatcacttactctcactccccgccgcgggggtggtgctcagctgcttggccgccgcgacatggctggtgctgaggctgaggctgggcgtcctcatgatcgccttgactagcgckgtcaggaccgtgtccctcatttccttagagaggttcaaggtcgcctggagaccttacctggcgtacctggccggcgtgctggggatcctcttggccaggtacgtggaacaaatcttgccgcagtccgcggaggcggctccaagggagcatttggggtcccagctgattgctgggaccaaggaagatatcccggtgtttaagaggaggaggcggtccagctccgtcgtgtccgccgagatgtccggctgcagcagcaagtcccatcggaggacctccctgccctgtataccgagggaacaggtaagcactggcaactcctctctcggctcttggaaacttgaaacacttggcaaccggcgcagagtggagagaatccgagcgctgggaactaaagggaagatagcctagaaaactggtctaacttcagaattaagaaactagcaggttttttttttgttttttttgtttttttttttttgtttttttgccctctctttcacacagtagttttataacctgaacgactgaaacacaattaacaaaactagatggcatgtgtagggtcttccacagctgggccaactttttagatctgctacacctggtgtatggcttgcctactcttttcagtactcttacgctttccttccttagcagaaattttagaattaagtttagattttagcaatgagtgatttttttaacacatagattttactagatttctactttttaaaaagtaaaatctttttaatgaaatgatattaaacatttatgaaaaccagtaaaaagattctagagcaaagcaagctgtgcttgaaggtgaggaattgatacacattttctggttttgcagtaagttttatttggagagactgcagctgatggtgcccaatttgtttttaaatataatttaggggcatacattattacatgctagtgtgttttgtatcacaaacttcaacttggggaataatatgtctgaactttggaattgttcaaaattgtcaactgcgttttagtgtcaactaaaaacaaaagagttctctttagtatgtgcatacttaagtggatatttataaattcaaatggatttatgcagattttacaggaaatactaattcgggaggccatttctaagattgctggagatgtatatcttcccacaacgtgggaggaggaggaacctgggattataaagttgtaaataaaactttagtcacttttggggatgagtctccttattatcattaagtgatttaaaactatagaacagttgctataaagggcataaaggaacaaatcccaattttaaatgcatactgtgtctaaaaaagcataccgaagggtatgcctccctagttgaagcagatttgttcacctctctatttgaagtggatttgacacttgatggggaggaggagctggttggatacagcaagtggaaatttacatttttccctttaaattaatgcctacctgtggtactattaggacaactttagggagcaagagaatatcctaagataaagtaagctttttctttttaggttattctgtggataatcatttgggtatttctaagaaatagcagtcaccatatggtgtgggtggctagttggtttctgaaatggagttgattacacagatctatggctgtttgacattattgagcagagtagatgacagcatcatagtctgtttattttaaagcaaatgtagttatttgctttttgtttcgataaaacaaatgtttcttgtctttaagcttactctaagagtggaggggaaaacaggccactgactgatagttttggtaaaaatttggaaattgttaaaatggagtaagttatctatttgagggtaaactaaccattttaatttcttttcacagttatgggagagaatgtcttaaatgaaaacaccaccgctttaagtatgttcagaatacactattcattaacttatagggaaataggatgttactattgcaaaattcacaaccataatttctaaggaaaatctgggatttaatcacaacttgattccaaattgatatcatttaccctgtggaattattttttaaaattttatattaacatttataagttaagaaattaagggtggatagaagataagaaggtggttaggtaaattaaccagcagcattcatttaacccacacatttttattgggtttctctggtttaaattgataaatggagaatttgaattatctacgaagttatcaaaataagcattgcatatttaatgttttgctgattaatgctgttggaaaatgcataatcgcaatctatttctgtaattttctttggtcactattttttttaaagactgtgttaatgaagattattctaaagtgggaaactttgtcttatgcttgatggaaacacaagaatacatttagcagaaattgagatacttgaagttttaatgagggcatgggtgagtgtgtgcgtgtcactgaagactggtttttatatatgacccattaaaagttgttgctgagcataattgtggggagtgggtggaaactaacacagtgtactatcttataagataggacagtatctcatatacgttagccttactgtgtgaaaagttcaggagctacccacagtaaatggcttatctgttttatcataaggaaacaaacttctgattaagggtgcaaagtgtaccactgtcatttgcatactttgtgaagtcaaacatcaaaataattataaaataagtatataacactcccctgaatgtcatctgctttttttctgaaggaatgtctactttcaactcaagacaatactcataggcaacaagtgaattttaaatagtcatttaagaacttaaacgcacagtctgtcagagtcctcttgagaatttatttgcactttgctcattgtgaggcttaccagtgagagaatttcatcattttcttctctgtatgaatggcagtggctggttactgatgaactatccctcttcagtgaccctcagttccaaaagtgcaaagagaatatatgataaaaattctcataagagaaaccaattgacagatacatttttctctctccctccctttttttctttcaagaactgtaagtctgtagcactggtgtctgtgaatgcaagtggaaatatctttattctcaggaaaaaacaaagtttatagttctttaaagtttaaagaactataaagtttgtttagcttttagtttagtcctgacaacccagtgtccgcaatactgaggctgattttgtagatgagtgtgtcaaactactyttttggctgccagtgttaagaaggcaagtgtctgttaaggtgtgtgtatcttttctaagtggactttcgcatcccagagcagatatgtctctctcaaagtaccactgtgccctcggcccgaaacatgggaatatacagaggtacctagactttcttggagtattagatattatgcatgattaatatgttatttttcaatgtaaaattttaattttgcaatttttttgttattgcaaattgtatttgaaggggtgtctctccattctctttataaataaagaactataattggctgctcattcttctctaattactgagaycaccttacacattcacttttgaaagatttcaaaccaatgcaattttattttagttacytgttaaggaaaattttatatttttacctgtggtttcaggtaaatacaaaggcatatgactgtctccrttaatgcatttgtaccacttaatgacarcatttttttgggatggatacaacatcatccattttgatcttagttgtcgaaagaagagtcaagtttttcaccactgatgtgagaaagacacttttaggagagaaagcaaacaacagcaaagcaaaaataggagaaatgggtatggtgtttgatggtaggcactggatgggaggcattgttattctttgacaaaaaacttgcttatttcttctcaaaatgtagaatacattgtttaaattcctaaatgcctgtcaatgtaacatattgttcaaattgagtaagtttcagaaataatcacggacttttaattaaattgtagcttctacatttcagtagtgttactcagtttatggtgattcaaagagcaatmttgattacttatgacttggtgacagaattaaaattaattaatgtcaatttctgaaaatactgaaaagggaaaacaagatttccttatcccttgggaaaggtgaaggaaaagaattttttgtgtgtcggggggacaaaaattgtaattttactttgtgaatacagatatttaaagcatactgaaaaagttttttaagtgacataaatagtcagtgaatctatataaatttacagaggctggaaggagtgaaaacagtaattttactctttctgtattgagtcgaaagtgtaaaaagttaaaactgtagaactgaaagaaatgctgtgtatgctgggctgtcatgttaattaaataaacaaccagaacagtgactctgtgtatgaaatacattttgaaaagccttgggggagggggtgcaggcaggcaagggtgagtgacactggcatgaaaaaacattcattctatctgcagtgacatttgtgtgaatttgttgtagtctattagaaaattcagatctgagaaataatctcttcagagcgctagttgaataaaggctttaccaaattgaattttacttctattttaagcaagttctcattctgtcaaggtaggatgtttataaacctcaaaattagaagtatgcctatatattttaagatttttccattaatatggtttgtgtcagtcagcccagtagagtcaatgttgacttcattgaaaacgtgtgttattttatctatcaaaagaaagagtttattttgggattaggataggagttgtgtttttgagaaagagttattgttgtgagttatactgtcctggatgtgtgaagataatcaatgcaactattgtatcatgcctttgcattgggcgatggggaaatgtctyatgctcccggaagtgatgcataaccctacaggtttatggtgaattgtttacttagctgccatatgtctcctcttcagtggagtcttcctgctccatttctgtgtggtgtttatatcttcttaaaaaaaccctcaaattgagattaaaaaatattatgcttatattctgcattcatgtgtttaatgaacctctgtgaaataattctgaagaccctcagaaagtccagtctcctattcttgcacctaaagatgtgttccattaatgttcaaatgaagataattcctttatatagaaacttgaatccttttggtaattacctatatatactttcatgataggtagtattttttattaaaggagattttttgttgytgtttgtttttttagtaaggctactatggaattgttttaactttgaactgagaatgtatgtttgtgctgttattgatataaaatatacagatttgatcactgagaaaaaagtctaacagatgtgcctgagttgtagtttagaggaagatgtgttgtatracaatcgtaaaaaatattagttgaccatacctgttcattgtgaatgtataccactgttttaaaagaagatgctacccatagctaatgttacccattatccataaaggcctttgatcaatcaacctaccaggtctcaaatcaacacattttatctgtgcattagtccttgtgctaaaaatcaaaaataatatacagatagatgtgacacagcatttgtctctgcaaagtttagagcctagtgagattaaygagaagtgaacataagaaaaagggaagtcacagtgaaatatcttagataatggagaaatgcatataataacttggagcaggtttttaacctggctccaggactcattcatctcctctctgaaattgtatgcagaacttcatttgttcattcttaggagcaaaaagtcttagtgtcataggttttcagaaggtcctcaacacatagatggttaaacataaatggcttagattttaagcaactttacattttgaagacatggagaatgtttttgaaaatggaaattactttggtgtacctttacagtctgctctgaaacaaaggtaaaataatatttcatttaggacatgttacacttcaaaatagtacactgattgattgtatttatgtcgagttagtttatgactgtaaatagctggttgcactgatattttaaatgcttaattctgaaaaggctgtagttagtagactacaattagtctgattttagagagaaggaaactgagagttagctatatgtgtgaagatagcccaaggcaagatggcttttgtccatttcctctttgacttgactgtgctactgaggaaacagtaggaaaggagtcaggctgctaactttaaccctgggtatcatttktaatttttcccatggagccaactctaaattctcattcagcattagaagactgaataatcagattgagtgtcagatgtgtaaataacacaaaacttgttaataccaggtagcctctggaatgaattattcttgactttgtcacgtaaatgaatatcagttgcactgaaaagtctaactttgtggagtcttatcaaacaaaagtatttagcagtggcttaaatattgaatatttttattttagattttcaatatgtttatttttgtatgttcaggatttccaaattcaaggcaaagcataatctgcagattggtaaggcatttcttcattagcaaaaacagctggtaatttttttcacctgttattttgcagtgtttccttagaatttcattaaaatataagtaaatagggtawaatatcagaggaggtcatgaagaacattaccatttcgaagatggaaagctatttgagagaagtcacaaactaagcaatgtctgtgtttttgatttgattagagctgtcatttgttatttaggaatctgtgaatgattattaaagctttcaagtatagccagtcctgctaacataataataayattacattaagggcactcatgttctttcctcctgagaagatgactggttacagggggcacatattgtttgctgaagtgtgtgtatgtgcatgtgcatgtgtgtacctgtatgtgcatttatgatttgtgtgtgtgcatgtgtgattttcccctggcagaaaattgctttggttgtrtcaatttagtgaagaaacagtgtcacccagtggctttgatgaaaacagtcctataaacattatagataagcactgtccagtagaaatacaacacaagccatacatttgattttacattttctagaggccatacacacccaagaaacagatgaaatgaattataataatatgctttatttaacccagcatagcatgtcaacatgtaatcggtgtaaaaaaaatgaaatattttgcattctgtttttttgtgagtctaaatatcttgtgtgtgttttacacttaaagcacatttcagtttggcctagccccatttcaagtattaaatagacacaggtggctaatggctaccatattggacagtgcagctctatatttttaaagatttgtaatatttgagatactaatgtcacctcttcagttataatgaaaagtctttgtagatttaataacaatatacagtctttaaaattatatgtgtaatcttgatagctcatttttgtaccactctaatagttgccaagtctatttgcccttttttcttcatttctcattattgcatttattttaaaatatgattattttcatcggagggggagatttagcagagttccttaataaaagacctttatattaacctgatttataacacagtatcaatatttccagttaattatgaatttgcctttaggagtttggtatgtaacagggattgcttatggatacactgtaaacacaacacatgttcatgatgattagtctataattgggttatctaatgtctctttagaaatgaaagtgcttatgtttgtaggtcattatctttgtaacttaggaaactaaaagtcacaagcctgctcctagctttaatggatgaaaattgtaacagtgtctgtaaagggctaacttttcactactgtttatwtaaataccactttcatggaaacacaatgaaaatggttcattctgtgtatagagcagattggagattttgatagtgtggaatttttaaagtaggaatttagattaggtgagttttggagccattttctgagttcactcyggtttgcaatttcaaactgatttcagatgaaaaagtctggaaatgtttaatgtcatgtcctctccatcacctttccttatactctatgaattcgttaacaatagccgtaattccaattctacatcaagaaataaagagaaaattatatatggcattttactttatatatagatatatagattaacttttaaaaatacatttattatgtgtataacgtttatatctgtgtgtgatgcttttagtgattgggacagggtatattacttatttttacactgcagattaatatagacagattttatatcatagatacatagattttcacttactagaaattctaaaaagatcaaaaggcaatagaatcatggtatacaaagaagcacatttggacaaaatgaaataatgtggatgctggctcgcttctggtaaaagctgacttaatttagagttcttgaagaagctagctgaagaatgaaaygtcatygtaacacacatctgtttcttgaaagagtttatacttgaatgtaactagtcactgttagctctggctaattttgaagttgatttaaattaatatagaggttgttctggtacttttytttttggtcagtctttttctgttctccatctctatctacatgcacattttctttcatttcattttctttttacctaatagagtcttctccctccgaatgtgtttaaaattttaaggaatgccattctgtctctcccagtaccttgttagaatattgaaataattttatgcaagaatcttgtggttttggtttaataggattttagtaaaaattttccatcttgtgaagtaagtttaaataactgaatatttatgctatgtctgtggcaagtgtttcctcctctccaggtataaaccacttaaagagacctaatggaagtttgaagtcatagagatattattcagtgggtaatgtttaattctgtggcaacagttatacagctatgtggaatcagcatccttagcccatttttaagctagcatgaacacaaataaatgaaatagtttttatttttatcgtattttagagatccacttcagaaatgctctttagtgagcagtgtttgtcctcgtgatatgaaacatccccttgtttgggagttattatttcagggtccagcctcagcagcagtctctcaggaagtttggaagggagagagcctgctgaactgcttatgctgtattgagaatttgctttctagtctcaggaactaaggaagtcagattcagattaagacaatttttattataaaaggaatcaaatttttgtagcttccttttctcagccataagcatttcatttagaaaattctggcccagtgtcttgcttattgtaagtgctggctggatggtaggaaaaatggatgaaaaagaaataaaagacttttaacctgaaatatttatctccccattctcctgaggttgaggtagtgactaagttgatttaaggaaatttctatgggaagaagagaagaaataagactatcaacaaagctatacattttcagttttaatatggtgtttacatttttgttacttaaatattttcttgcatatgttacataaggggttgcatttgcctgtgcccttactggtaggaaatcccatgttcagcatgagtcctagataattatttttagctcactctcaactgaaaataaccaaagctaccaccaagatcattgtagtgtaaacctttgaaaaatttctgaaatttgggttcatattttagaaaaataaaatgtcaagtgtttttcacattcaactaataaattgagagagaacaaactctgactttattttcttccattccatcccacagggctctgacaggtgctcttcagctatcaccttttttatactctagtagtctgcattcttgttagaggttcttactgaatagctgtattttctgaaaagtctaatgtaaagcaaatgttatctccttagcttttaattgtgatcaattacaaaacaaagtttgagatggttgcttccagagatgacattgtgaaattgactttttaaaaatgtcatccaactgccgtgctrgttccatcatgtggaatgatctagaaatttggtagcataattgcagaatcaagttgaactgaaaaatcagaagcttatagggttttattgcagtgataaatttagcttttcagtcatttttctttggtccacctactttttaatagaacttgacttgtgaaaatcaaaaaatttaagtcaaataagaatgttttgttgttgcagttttaatacttagagaagatacagtattgttatatcctctcactgaaatcagagacatatcttttgagtatgttaggcagatgatcatgacattagatgaactaggaatacaatatttaggaaaaaagtgatttcgaaccttayggtgtcaagtttctttttatctgtacatgtcaagtgttctcacaggcagactttttagagagattgctatcactgacaacttccagagtttgagagttttttgaatatactacttaaaaaaatctccatatggttttcatttgaaaaaayatattacaaactgagacattcactataaattaaattgaaataatcaaaatataattaagctatttgtgagtttacattttgyaaaacattttagaagcaaaatcatttaactttgtttgcattttgagacaaggagctaactgtgtgtatcatcttgagtagtgtctgtttttattcctagggaytgttttccctataattggagttgttttttgctaggtaagtaggatccaaataacagcatagttattaaggcagtagcctcgttttgtccacttctcgtcattcctttttacttaaataacaattagatttgctcatcttaacccctttacagagctacagctagagcttttaagtgtttttggtggaacttccttaagcaattaactagtcctaataaaaagtgtgagaattagattgggaatgttggatacatatataactaaacaccgattaagtaagttatctaaaaaataaagtggcattcagatatgaaaaccaccataaaaatgagtgccaaaaactaatggtagtatttttgcttgtgcacaaagaagactagatcaaaatcaaatgaataattcctcagttttcaaaaaatattttatggtcttttgagggcataatattagtgcatgtaaaaactagaacsctttatgatttgaaaagaggagaagatgctragagagacactcttggaagctgggcaggaaatccagccatgcattgcctcaaggtctgtcattagatcaaaagcactcaggggacgatggtctgtgtaagaggtcctaatgctattcacgaactctcctgacattcattagtttccaagacattgattcttattctttaactttttagcacatttatcattttcacttatacatgtatgctaatagcaatcttatgtgaacttttacctcttatatgaccagaattgattaaaaatgtyggcaagtaagtttgttatttaatatctctgaactttctctattttacattgaatatttgctacattgtaagcattacagtatgactagattcttctttttttctaacttctcccctgttgatrattattcttatataactataatgccatgttaatcaaactattgtttatgaattataacagtaaatgcccctggttaatagattaatcaacctgccttagatgcttttgaagtctgtgaggacattgcttaatttcacctacatataattacatatcatttgacactctctaaatcgagctgtttattgtagttctcaaaatttagtgtgaataaaaattayttgggaaaactattaaaatgcagacgtttaaatactagattatagatcctgtaaccttccagatactctgatttagttaagtgtagagtgggatcctgaaatctgtggttttaaggaacacctcagttgcttctgttgagaatcacaggactataaacttgtgtctactgaaactgtacaggaagttctgacttttgcaatccaattcaacaaacagtttaaaagtgcttggctcagacaagaagggtcagtatcatgggraaaaactatacacacgcactatagtttatgaacctatgacattcataaatgtttcactttgatttcatttctttgaagttcaaaaaaacttcattgatgatacctcaaagaagttttcttaaccaccctggatatcaatttcctcatctgtaaaataggaataggaatatcagcttcactacctatctcatatggctgttttaaaggctaaatcaaaataaattgctatacaaatgttaaatagaaagaatatatgcactctctagactgtcacagaccaaagcttgtaatatataccagtttcttaaactttcaaaactttagtgaccctgtctgtaccataagaataatataactgatttcttaacgttgcaaaggttaaattaatgtaataatggacagaggttcttgttaaacactgtgcccagctgaacatgaataatacatattcttgcccattagggccaggtcattgaaggttataatctaaatttcagaaagcactatgtaaaacaatgcaaacaaatttgcatttgattacaaaaactcacaagtcttacaaaatatgaaaatttaatggaagttaattaaaacagtattagggagttaaaktgtaagcaaagccactgccaaatgaggcatcctaggagccagataaggcaacagtagaaggagagagatctgatagggacttcagatgcttcgggtgcttcattgaaaaaggcttaagagagatatttaaaaaaattggtggagtctttgaatgtcttcgtaaaaatgatgcttttgagggtcggttgtgtagtgtgtcctataaccccacgtacagaaacttgatttgtgctttaaatttgacttgtactctagctgccattataacctatattttgtcttgaaaaacaaaattattttcaaaaattttagtttcatttttcatggtaaaatatcagtcattcccaacccttttctcattatataccagtggtgccattattctcaaatgacagggactttctgcttattaactgtataatacagctaagccctggctcagctgtggccctcartggaaggtagtgagtgtttattttatcacataaaaatattcctcaggatgctgtctctttttaccagcttccacagggctttactctaggccttaaccctcagaccactcttcttccagatttttccacttattgaatgatctttcagtctagtctgaggtagttattttggtttggccctaggagcagcaggagtcctgtggagtctcagtctactcctrttggtttcagtttataaattctgcctggagtggtcatctctttcctaacttggttacagacagtccatggatttccacttttgtgayagaagatggaaaaaggtgaggaggaggggacagcagatcacataggccatgaggggtcactgcaagactcgttctgaggcagatgggataccatcaaagggttttgagcaaagaaaggatgttaccagccttatgttgaatagggtgtctcatattctctgtgttgagtgagagtaggtgttacgatgtaagaaggaaaccaattaagattgttgcaataatccagagatggttgggagttggaccaaaatgataatgtcaggggcagattttaaatatatattgaaatcagtactgccaagttgggtattgatgggctggtatttcctttgaggacagacagagagttcctttaatgttttctcttattttagagaccaaataataaaggaatatttatctttatttcttgctttaaaaatatctgattgggttgacatttttttttttttttctctaattttatcttctgcctacaccttccggaagatatacaaactggagacctgacattcgggaaagtcatgaaatctgcttacatggaaataaattctaatcaagcatctcaaactcttcaaaagttttttagtttgttaggatactataacgttttgtgtaataaaagttggttttgaaattttattttgatataaatgtctttatattttaaaatctgttttaacaagatgaaattttaatmaatttgtgtcattcacatgctcttccttttaaagagatgtatttgcagctgatactctacctatcttttttaaaaattttaatttaatttaattttaaaattccagaatacatgtgcaggatgtgcaggtttgctatgtaggtaaacatatactatggtgctttgctgcatctatcaacctgtcacctaagtattaaacccagcaagcattaactatttatcctgctttttttcaccctgtcgccccacccgacagactccagcatgttgttcccctccccatgtccatgtgttatcattgttcagctcccacttataagtgaaaacatgtggtgtttgsttttctgtttctgcattagtttgctaagaataatggcttccagctccatccgtgtccctgcaaaggagacgacctcattcctctttatggctgcatagtattccatggtgtatatgtaccacattttctttatctagtctatcgttgatgggcatttgagttgattccatgtctttgctattgtgaatagtactgctgtgaacataaacatgcaygtatttttataatagaatgactcacattcctttgggtgtattcccagtaatgggattgctgagtaaaatggtattactggttctaggtctttgaggaatcaccacactgtcttccacaatggttgagccaatttacattcccaccaccagtgtaaacgcgttgttatttctccacagcctcaccagcacctgttgtttcttgactttttagtaaatgcaaatcaaaaccacaatgagataccatctcacaccagttagaatggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcactcataggtgggaattgaacaataagaacacttggacacaggaaggggaacatcacacatcggggcctgttgtggggtggggggagtggggaggtatagcattaggagatatacctaatgtaaatgacgagttaatgggtgcagcacaccaacatggcacatgtatacatatggaacaaagctgcacgttgtgtacaagtaccctagaacttaaagtataatacaaagtattatattaattattaattatattaattattaatatataawatataaaatatatatataaatatatataaaatatatatataaatatatataaaatatatataaatatatataaatatatataaaatatatataaatatataaawatatatawatatatatataaatatatataaatatatataaatatatataaatatatatataaatatatataaatatataaaaatatatataaatatataaaaatatatataaatatataaaaaataaaaatataaatataaatatattaattatattaatatattatattatattatagtataktatagtataataaaaaaatactaaaaaaaaattgccattctgactggcatgtgatggtatctcaatgtggttttggtttgcatttctctaatgatcggtgatgttgagctttttttcatgtttgttggccacataaatgtcttcttttgagaaatgtctgtttatggcctttgtccactttttaatggggttggggttgtttgtttttttcttttttcttctttctttttttctggtagagttggggtttcaccatgttggccagactggtctccgtctcctgacstcaagtgatccacctgccttggcctcccamaatgtgggattataagtgagagccactgcgcctggcctttttcttgtaaatttaaattccttgtagattctggatattagacctttgtcagatgaatagattgcaaaaattttctcccattctataggttgtttgttcactctgatgattgttttgctatggagaagctctttaattagatccatttctcaatttttgcttttgttgcaattgcttttgatgtttttgtcatgaaatctttgcccatgcctatgtcctaaatgatattgtccagattgtcttctagggtttttatagtttttggctttgcatttaagtctttaatccatcttgagttaatttttgtataagttataagaaaggggtccagtttcaattttctgggtatggctagccagttcttccaggaccatgtgttaaatagggaatcctttgcccattgcttgtttttgtcaggtttgttgaagatcagatggttgtagatgtgcagtcatatttctgagttctgtattggttccattggtctatgtgtctgtttttgtaccagtaccatgctgatttggttactgtggccttgtagtatagtttgaaatcaggtagcacaatgcctgctgctttgttctttttgcttaggattgtcttggctgtgtgggctcttttttttggtttcatatgaattttaaagtagctttttctaattttgtgaagaatgtcaatggtagtttaatgggaatagctttgaatctataaattactttgggcagtatggccagtttcacaatattgattctccctatctatgagcatagaatgtttttccatttgtttgtgtcctctctcattccttggatgctctaaatatcttaagctctagtatagcaaaaacatgagactttcaaagaaaattcaaggctttctctattagtctttgaatagtctgacaaatcccaattccatcaaagacatattgccaatacatcccaggtctttttatagaggaaatacttctattttgtatccatattaactcagactatctgttgacatacagagcacttcagtgataggtgctatataaatatttaaattaggatagctgattgctctgtaagttaggagtttgctaattctacattgtggttaatttctgattatgaaacattktttacatactgcttgggaacaacaaaagataagatattttaaaatgtgtgaaatgaagagtttttaaatcacatgggaaaatacttttgatgagtggaaagtgaaatcatgaaacacaattgaggataggccaaattcacagcagaaaggaaacttgtcaagatgttcattcttgtttatgtgggagaataatgggttatttttacgtacttttatatcttttttctgtattttgtaagttttcaaccctccacacgtattttacaatcagcaaaacaaagctttataaagaaatgtattcctttgacattgttcctttggatatgttcacagaatatttattagggccattgccttagtggtcgtttgggttggagacatggaaattgcacctccaggtgcttttaggaatggtaatgtgtgatattcagtactatataaaacacccttggaagtaaaatccttttgcattcctaatttttgtcccagatggctggacaggcttaaaatttcttataaaattggagatcctagtggtacatgatcctccaaggtagatccctgaaattttagatcggcctacagacaatttttgtaactttacctgaaggtagcgctttatgaaaatatatacatccaygtgtatgcacatatataccgaaacatgtttcagtttttaccaaggctttttggtgtctttttgttttagacgtggcaacaaaactctaccacgtcaactgatacattgagaagaacatgaaaacaaatgttgttctactaaggagagaaaattccttataaaacatgtaggaggagagtattgagactacctcactgattaccaggctaataaggttacaaataaagatcaggttcataatgatttttgtttaaagtaatgagcatgttttctaaaaatgagtaatttctatgttttgttgttttcgtgtatctgagttacatacactgtatataatattgattaacttcagtttcatttcccaggattttgttgagtattccctgcatttcctgcgtaagactaaggaactttatacatttccatttgttgttgcttgtttgaataaatgaatagagaaagaaaacaatgtgtacataatattttttaaaatggtgccacatctaggattattaaaatgctttttcatttgaagagctgtacaattttgcagaaataaatttgagaatattaaaacagtttctataactactgagaaaaatagagagtgtgctctcacttaaccaagaaaaaaatctttctagaagaaaatatgatagaatcagagaatgtaaacagaaaaatcacttttackcaatcattccacccagtttttacggttctgtcgaaggagagttagcagaatagtactagctgattatgcttgcgatggttaaggtgacagagactggtagccatttcctttctctctctctctttctgtgtgtgtgaggaggaaagggggcaatcagtactgaagttagcatttgggtagaatccagatctcagccttgcaggtcagagatgcaatttttccataaaactagaggttatccactgaggaggcacactaataatacaactatatctcatcaatcagaatgtcaggttattaatggacacaggaatttaactgtaaggaagatcagagtgccagtacttactagtcagtgcttcttgtttttagtgggaaagtcacctttagcatggttggctcctagactgtagctgaggatctctggcttgtgggaattctccttggaaaacttacactgtttgagttttttattctagaacgtttgaagagtgcccacaacatcccagaaaatgtggggattgctgggggaagattcagaaatgaaccatccttgcaccctccctgagtaaagatactacagtaacaaatgattatactgccaagggataaatactttgaaaaacagaaagtcatgagaactttgccctccagaaaggtcatagctaaatttaatgctcaaatactgtcaccctcttaacatggatttctggtaaagttctgtcttcctgtcttttctgacttttccttttgatttatgttttacattctcacgtgtttatgttagtagtaggctgactataatcaatttcagtacaatataaagaatgtatctaaaatagaaaaaaaaaacccagtgtattcgtaaaagaatatttctatatatttcccctatgggcataaggcccagaggatatgaggtagggaaggattaagatgtgttgaagagctggacatcaggtgtggagtgcatactgggttgtggaaaagacaggtggaaaagacatgtgaaaaagacacatagccctgcttttgtgmtgaggagtagaggtgggatgctgggaaattttaagaggtaagataagggggatgtggggccggtgtggagaggggagcaggatgaagacttgagtgttttaagattaggttgaggaatttgatattttatgtgtaccaaacattatattttttaaccaaagagtgatgtgaacagattaaacatrattattctagcagtggattaggtggggacccaaatggacacaaggaggcrtttaagagggtattgtgaaagtcctgggtagagacattgaagatttattaagatagtagtggtgggcaggaaaggtgatttaagaaaaaaaaaaaaaaaactgcagttgggaggattagcttgtgattgatagtggaaggtgttaacaaagggcatgaacgccacttaaaactgtgaacctgagaaactagaaagatagtggcgctggtcactgagaaaaaaagcatcagatcagtttttgtttattttagtttcggggtgaaggagggaagatgatgtgtttggtttggacatattcagtgtatgttacttttgcaacctcatgtgaccctgtctccttgaagctgctcaattttcttagttcacaaaaaaatattttaataccacaaccacgttagttcaccgtattttcctgattagtatgtacatgctttttagaactggagcttcttgtgcccagcctatcactacaaacacagaaatgttgtaggctttggacatttcaatttgtgcaaagactatcaccctatttaagattagatgttaagcacggtcctaaatcttacagggcagatgactttttactcttggtgctgaatcctaccgatgaaagatattactgagtcagtacagacttcagcttctgtgtaaccctctaacgatccccagggcaatatactgttgtaacctttgatcacacttaaaaagtacatgggcaaggttcttatccttgagcagatgagtgcttttcatatgactagttaaaaacttactttatcagtagagacaatctaggctgtcgagagaagttaaccttgtaaaattatcaggttgagttccactttgatgtttttcttgggttattctagatgcttactatagtttgtcttttgtacagttaatatatgtgtgtataaattaggctatattcaatgatgctagctagcatcatcgtgtgtgtgtatgtatacatatatataacatatatattctcatatatatatatatatatatayacacacacatacatgcattatacatatatatatatatacaattccggaccgttgactctggatcaagggtccggaagtgcaatccactgttgattctttgctcacatagttaagtttcccacattgtacaatcttcaatgctttcactactcttctagacttgtgtttatatatcatagtaaatttttggaggacttttttttttccgtttatgtatgtgttacttttcctgaaaaacatcagtgctkttgtatcacaggattggagggaaattaaaggtagagctcaatttatgaaatgcctaacaagtgatcattgttaagcttttgcctaatcactaccataatagggaactaagtccccttccatgccattttgttctycccttttcccctcctctctgtttagatatggtcttttgaaattgaggagtccagaatctggtacaacagatatggtatgactggaacaaagcgaagggtggctgtcacctcttttgtagaacaataatttgtgaaccttttttacaatatacacttgcctaagcatcaaccctcaacctacagagcatcaacgtgtgggtgagcaggaagggggacgtgtaattttgtcgtatgcctacttacgaaccactagtctagttaatgagacccttaacacatactaggactgcacttgcttttttttgtcagcataataatctatagatgtatattttgtttgtatcagctaaagctttgaagaccttcacatgagttaatactacactccattcatctgtcctgtgcctttggtactttagaccttctgtttttgtttggtcccaatgcaaataggaagataactaaggtttctgctttgttaaataacttctggtgatttatgtatagctagaacagtgaaaactgggaggcaaaaacactacataaatattaaaacaatttgacaaatttataactatcactgtaggtctaaaatgtgtaggtctaaaatgtacctggactagatgtggtaacacatgcctttagtccaagatactgaagtggctggggtgggaggattgtttgagcccagtagctcaagatcagcctgggcaacatagtgagatcctgtctcataaataaataaataaataaataaatacataaataaataaataaataaataaaatctagctggacattatggaaaacagtatggaggttcctcaaaaaactaaaaatagaactcccatgtgatccagcagtcctactgctgagtatgtactcaaaggaaatcagtatgctcccatgtttattgtagcactgttcacaatagctaagatacagaattaacttcagtgtctatcaacagatgaatagatgcagaacatgtggtatataaacacaatggaatactattcagccttaaaaagaatgtaatactgtcatttgcagcaacatggctagaactggaggtcattatgttagggaaaataaaccaggcacagacaagtacttcaagttctcacttatatgtgggagcctaaaaagtggatcttgtgtaggtagaaagtagaatggtgattgccagaggctgggaagggaagaggggaggaaggaatgaagacatttggttaatggatacaaacatacaattagatggaaggaatacattctagtatttgatagcacagcagagaaattatagttaacagtaatttattttatatttcaaaatagctagagtggaagaattgtaatgttcctttattagtctgttttcacgctgcctataaagacatacctgaaactgagcaatttacaaaagaaagaggtttaattggacttacagttccacatggctggggaagcctcacaatcatggcagaaggcaagggggaccaagtcacatcttacatagatggcggcaagcaaagacagagagccaagagaaaaagtttctccttataaaaccatcagatctcatgagacttattcactaccacaagaacagaatgggggaaactgctgccatcattcagttacctcccaccagttccctcccagaactatgggaattatgggaggtacaattcaagataagatttgggtggggacacagccaaactatatcagtctccaacacaaagaaagataaatgtttaaggtgatgtatcatccagttacctgatttgattattacacattgtatacatatatccaaacgttacatataccccaaactatgtacaactctgatgtatcaattaaaawgtaaagaaaaacaaaacagaaaaaaagctggaaaaggaaggcttgagatttgatgcactaaattctgtgtacttttggaaataatattaacataaggtggcaccgttaatggtgaaatgaacttttcatcctaggtgcaccctttgagatggcaggcacaatggctctttgtcttctacaagggtgattatcacatggtaggctttttcaaacactaacctgccttcgattctgatatgttctctctagggcacctcccaacctcctgaatcaatgctgtagtgagccacagttactgatgtgtgtgtcacatccatcaggtatgttgacgtgagagaaaaagtttacaaatcgcagctctataaacttgaacctagaagggcatgaacctaatttgtggaccacgcaagcatttactttcctgtacaaagttcctgtaaggagaaatttaaataaatatagtgtagaggaagggcctttccaggagtttctttaacatcagtgaaatattcttgcaagaggcaatatttgactcagtattttcattggtcatttagattttacttttgactttaattactggtattctagccttcaatggtwgactgtttcatgtttctccagaaagttaggtttcatttttattttctatagtttatgagtccatgcttgtaacttatagggaaatcataaaaacagaacagagtgtagttagaacactgaacttctaaaaggatatccctgccttagagatggtatataatactttttcatgagttgggayaaataagaaacctctttgtggcactttgggcaagaaaagaagttttgctgtagttaacattgtgatgaaatggactattaatctgaagagttgcacctggaattttttaactaatgtagttaacaattaatttgtataataaatagctatcagagaagcattataatgatatcagatgctacatattcttctcaaagtactaaattttacaattataatctccacagaagaaaatacgattttaaactgcaaataaaacatgcaagaacttgaatcttttattctgcttctacttgctgtgacttttcatgtttttaagtagggtattgcattgattgtcaactgggccaaattttgcccctgcctgaagatattatttagtttttaggacttgaagagtgctactggtttgacatctgctaggtaaagttcaggagtgttggtaaacatcctacagttcrgaggacaactccctataagaaagaattatctgactcaaaatgtcagtaatgctaaggttgagatatatcttagattattgtgcatttattttaatccatactccatatggaaagaaggatggaatcaatagaaattgaatttttcctaattatgaacatagtgatagcaggatctgttgatggagggattcaaatacagcgcagtgattaagatgctggatttgttatcagggttgagttctggtttccactctagccacttgttagccatgtggtcttggtaaaatgattagtctctctgagacagaatgtcatttataaaatgtggataataaattctaccttacaggtttgcttggatgaataaaattgcttgcagcctggaaagtattacatgttcaataaattgtagctactgttctatttagaatataaactgatattggtagcatagtatttatatggttatacagagagtgagatggtagaaatattaacagaaatgaatttcttgaatataaatatttctttacagtttaatgaagagctgtagtatttacacatagtattatatatgtatactatgtatacacatagtatatatatacatagtataatatgtatactatgtgtacacatagtataatatgtatactatgtgtacacatagtatatatatacatagtattatatatgtatactatgtatacacatagtatatatatagtattatatatgtatactatatatacacatagtattatatatgtatactacatataactagaatagaatcattatatatatatatatatctctagcaaagcacagtaacataggtatataactagaaaataatatttgacaatttggggagacctatagagatgcaaccttcaagacagtaaactaacgttaaaaatgccraattattaacagaggttatcaatgaggttcgttaaaaagaaaaaatattttcccttttaaaattttttattcttttattattttattttagsgacaggatattgctgtgtcactgtcactcaggctgaagtgcagtggcatgatcatagctcactgtaaccttgaacacttacgctcaagtgaccctctggccttggcatcccaaarcactgggattacaaacatgagccactgcacttggcctattcttccatattgtcatattgcttaattttgttttcaaaaaacatacattccttttgtaatttagaaaacaagtattataaatgaaaaaaaccctcatagctccccaatataaatggtgaaaaatataatcgttaaaacattcctcttctaatttataaggttacccytttttgctggtttatctctattagttggttttcctcttcagtcacctttctaaaagtggataagctgtaggacccattaacattttactggcatgataaagctggtcatgttgatgcctttatcgcctaagctggcatgtagtgctattgtgaagccagtacagtttcgtctgggtggtgagtagaggaaaagtgcagaagaatttagaacttgaatgtctaaagccagaactctatccttgaccaagtcttccctaataatttattaaaaacttcaatagaaatatagaaagcatattatttaaacttccagttgacaaaaactggaagacatacatactagcttagatgattgagtatcagtttcaaaatatgcatagagttgaataacgagtaaacattaaattttaaaaatatttaatttaaaaatatttaaaaggagaaaaggtaaatttctataaatttagatttaggaataattttataatttcatgatgagagaagctggaccattatctaatgcccgttacctaagggttagtttgccacagttcattgaactgtctcttagactagattttgaaagcaaacttttcagaatcctttgctatgtttgtagcattgtgaccagttctgcttgctgtattttaagaggagtattgatcactatgaagtggtcagaaagcctggaattagtcaaatccctgctctgccatgtattaactctgtggctttaggtaaattgtaatgcttaatctctcaaagcttaggttttcttatatagaaaattttttttaagctaccccagaaaaatgttttggggattgactgagattataaagatgctaataataataacttaataaaccttgtatgttgcttactctaagccaagctaaattctaaaaatgtatgtttgtaagtacatttaattctcattagtactctgaggttgatactgttgttctcattttacagctgaagacacaggcacagtgagcctgtctctatatatgtctctctatatgtctttatatatgtstctatatattctagtaaatcatagttaaaaatttttgtgcatatgagtgctagacatggtatcatgtgtttatatacctttgttaatttttgccagaagaaggaagttgggcttatctcaataaacgttttgagcccttttggtacctataaagatacatataaagaattatacttatggtatatctcaaaactgagtttgtttcctataacccatactaaaaacaatttatcaagttaatatagtaatatrttgtgtaagtatacatgtataatatagtaagatgtatatgataatatatgttcaagttaatatagcataattagcaaaatcataattgggttcaaataatattattgactgatactttaaaatatttcccaactattatgctgttccatttacttttaaaaaaaatagagatattcttttcaatttagagtgtaaaataattgcctcctccgtatatattttaaagatggcctataaactagattcattaattcaaaattactaaaataggcaactcagtaacaaagagaatcagctcattttcttagatgctaacaaaactaattatacaaattctgacaaagtggacattgcaaatgaatgaaaataaaaggattgttcacgatcttattgattaaataaggagaggctttgactgagtagatgatttattgaatacttaattgaacattaattgattatttaaatcattttaaagaatcagtagtattcatccctccatgagaatgacaggttttttttttttgttttttttttcgggagtactggcaatcaccatctgattcagtctaacgttttytggctggggcaggaactctgaactttatttccaaatgagtaataatgataaacaatcctagaggaaagtgggaaaatgcctgatggcttattggcgggaaaaagaagggtgtgtgagaggaggaattattcagttatcactggtctggagaagaaagagcatggcccatttgcaaaaatgattcttagttcacttttttttttttttttgcctttagtgatattatgggtaatagcgataaatttttattttctcaatttatatatatcagatttctcactctgtgtcatcaattaattcattcaaatccatttccaaaactttaatctcgttaaccttgccaatactgttttgaaaatctgtcttgagtttctgagttataaacagcctcatattttcataaatatgaaagaaagccatcaaaaaaactgcacttatttttttagccttggtttctctgtattctgtaaaatgatatagcctaataagagagctttactctagtggccttcattatagcccatgtgcaggatgattctgaaatatataaattaaatgaatggaaacagrcatgytgacaagtttgtttagcaccaacgattggatatgctattcttaaaccaaaacttttgtttactcattcattcctagaatttcagtattttaagaagtctcagtgctacaggatttcctgtatttttttaaaatgtggtaacatatacataaaatttaccatgttaaccatttttaaatatacagttcagtgacattaagtacatttacattgttgggcaactgaaaccacagtccacttccggaactttttcatcttcccaaactgatactctatgcacatttaaacaacaacttcccattccctcttcctcccagcccctggtaactaccattccactttctgtctccatgaatttaactattcttgatatcttatatgagtggattcatgatgtttgtccttttatgactggcttagtttacttggcataatgtcttcagagttcatccatgtygtagcacatgtcagaatttccttcctttttaaggctgaataatattccattatatacgtatgccatattttgtttatccatttattattgatggatacttgggttgctttcactttttgtttattgtacatatgttgctatgaatatgtgtgtatgaataggaagatttttatattgtttaaaagtggcaataatgtgaactttttgtataacatcaccaagttgacaaaggagctgcagcaaatgtgggtggttttactgcattttaaaaactagaacaccttcttaaactgatcctaatcaatcagctcctcatggaaagattagagcttacaggaagagaatgaaaggcatacatgaaacacatttagcacattaagacttaaattttcatttaaaactgaaattttattgcttggcttgtctttacatacaggattcagactattaaaaagctgatagaaaaagcttaaaatactattattttagtaatcctagagaagcaaagaagcctcttaacaaataacaaaaatgtgggcataaataacacatttatttcaagataacttaatgcttttttattaggctctttttggaactaatgaaactattatccaaggaggagataaattaaatttccacctacaagatcagtatagcaatattctgaattcaaaattctgttgttaaggatggtgtaaccatatatgacaagscttttacaaactcctttttgaacattgctttaagcaatcatttstgtatttgtattaattttcaatctaatcattccaaatgaggcaaagttttgtgtaccagtgattgaattagaagaaagaacaagttattttgtatagtctaaaagctttgtaagaatcctctgcttgcagtgtttgcacagttctccattagccctgtcgtgttttcttcttctttgagacatccattagtagatactttaacactaatccgttttctgtcccaaatacataggagtccaggagccagggatgcaggtgtcattttaccttctagtagtctatttttgtgttctggtgcatgtccgactgagctctatttttaaaagtacggagctgcttgctacctgaagccagagagatactgaagaatgaaagacctcgagagtcctgctgtctaaaggagtagcacagccagacactgatgagggtggaggtagtagctgagtcttttgttataaaagctcatgttgactcgttaacatkggttttttttttttttttttkttttttktttttttttttttttgagatggagtctcgatctgtcgcccaggctggagtgcagtggcgctatcacggctcactgcaagctccacctccctggttcacaccattctcctgcctcagcctcccaggtagctgggactacaggcgcccgccactgcgcccgtgaccgcacccggctaagtttttgtatttttagtggagacgaggtttcactgtgttagccaagatggtctcgatctcctgacctcgtgatccgcccgcctcggcctcccaaattgctgggattataggcgtgagccactgcgcccggtcaacattgttaatattttaatacacatttttgtttattttgtttgttcttttctctattgctaattttcgcccagtatgctaagcattttagagagatcatgaatcctcattttgcttccctttgtttgctcttttcccttttgctaattttctcctagtatgctaagcattttagagatatcacagattctcttaagattagaggtatgtattattatttatttttaaggcaaaagggattaagtaatttacccaaagtctcactgtttatcagatgcagaggctgggtttgggtccgggtctgtcttgtgctgatggcttcctgtttctgttacactagatggccaaaacatcactggaacttacaggatataactttcttcaaagtggtaatcattatacccagtccttctttccgttttctactctcactgtcctagtttatggccgtatcacttygtagttggatgggctgttgcagtaacttctcaactggtctccctaccctcatgccatctgaatattaatttattcattgaactaccacactacatcttcttgatgtacagctctaatcaggcagcagttttgttgaatgttaatatttaatcatgtaaatcctttgataaaaagtagtttgtagttgttttttgcctttcaaatgaaataaatacctccttgtttgggattcaggaccctctctaatctacccttcttaacattcagtcatttyaaactgctactgccttcatcacatcaattttctagtgactttgaagcgtgccttttctctctcaagacagagataggtagatctcttgaggtcctacttctgtctaccacattattgccctctgcccctaattctcatctctctatcctgatctccaaccagcttaggttgaaattttacccatcttctacctgcttcacgatgtgttttctgatcatccccgttggaagctctttctccttcctctgagtctccatagcgctgtatctattgctgtcttacggcacttacattctccgtcttggattgtgaatagttttataagtgagggtgagttccttgaggatgatcaatgtataattgagcccacctctcctgcgccccacattatttattgcagtgccatgtagatgcttaacaaatgtttttgaggcaatgagatatcatcataatttgaatgcaggtagtgcttggaaatttagataatatcttaagtatatgttatctcattaaatctgataacaatagtgtggaatttggtgattatccccagttgatgaatggtacttaggaattcacagacataggttcagtatgtatctgtggagmtttgtggatagttgtgctgctggggaagttgttaggtagaagtccaagttaaacagtagggagctaacaagacctcctgggaaattggatcctggatttcttttttttaattctttttttgagagagagtctcactctgctgtgcagtggcacgaccttggctcactgcagcctccgcctcccgggtcaagcaattctcctggctcagcctcccaagtaggtgggattacaggtgtgtgccaccacgccctgctaatttttgtatttttagtacagatgtggttttgctatgttggccagactggtctcgaactcctggcctcaggtgatccacctgccttggcctcccaaaatgctgagattatagttgtgagccaccacgcctggcctggatcctggatttctgaaccaaggttgtgatttggactcaccctcaggaaatcaaatataaaatcatttactaagtcccacaccatcagtttttcatcttacggtgggccctagatgttggaatttttgtttttaagtgtaacaactttgaaaaatattatattgaatgtatagaagacaactatgaatataaatttattggtattataaacactaaaaaattttgagcaaataatttacagacttctttttgtaaaatataaattcagtgttttctttatatctgcagtattgtgaaaaataaatttttttctaatgcctggctgaaaaataggtctgtatcctagttgtacaagaataacccttcagaggcacaggattatgttgctataatcctaagtgagctgtaagagttaaatgcattataatgggtctgcttgggtaccagtaaagattatatttaaaactcaaaataggaaacagaaaagtcttgtgtatgaatgagaaacatttgatgaaaggaagttacataagaatagagaaataatatataactcctactcattatgtaataatgtctcatttttctttctccttaaggaatgccatcacatgaatttttattgttgctgttacattggtaaccaaatttcattttcttactgtgtgggtgattttaattgaattttttcttgcttgctcaaggtctatctttatcaacttgaattattgcaaaatgcaacagttctataacatcttcagagacaattaaaatgtttggagatattttcctgatgctgaatggctcaacttttcatgctttatactagtatgtgtgcctctttaaatgttaattctctcccttacagttagctgtccggtgtggtgtggttagcaggtatctttgtttctgttttgaagaagaattgcgactttgcagggagagcacttaaccatgcttgtcaggttaatagtcttatttattcacagttgtagtcagtgggcactagatggaggcctgagggtgacagtatatttttcctgtgtaggacagctcttaggatttgtgagcaccattccatttaccatctagcagccttttctccattacaataaaatttacaattgtattatgaatgaagagcttgttggaattgcttcttaaagagaatgaagtcatttaacatcagaatgtgcaaaatgacaattccgtgatgaaaaaggagaatttagaagtatgacaacctacattttgtcttttttataaggcctccccaaaatttttatttcagggctatttcaaatctgagcttcaaataaaaacaaacaaaatgttaggactatcaattctaataaatttttatttaggtttttctggcacagttagaaatttagttatatataatacatatgtagatacatatatatatgtatcttgagagacgttagattagacatggtaggcactcaatttctgaaaattttcaaactctataatttagttactctttagatttctacttcaacttcctaatgaattattttctttcaaaggctcttcctggaatttttctgtttttggcaggtatgtttgcatatctcaagtgasacaatttggccaggtttctgaaaaagaatactttaaaagaaaaatgtaggttggctcttaagtgttttaatgttatttgagataaactaaaatagagcataatcatatggtatattaataggaatatgtgctgatttcttaagccccattcaaattttacgatagtttttgtttcttttaataaatttgtttggtttataactttatctcaggggggatatattattattttttcctcatttcttgagtgaaattttagcagaagtgacttaattataatcttggagatgcatgttgcttacaactaattgggtcctggacttaataaaatcacttatgtagaaagccatatactgtaggttaaaaaagaaaagggacaactttggtaattttcaagttaaaaatagaatataagtttcatgaggtcaggaaccacatctcttaattttttctttattctgagttcaacctaattattatatgcatgacagatactctttaaacttttttattgatttattggttacaaaataaatatattgaatggtactggcaattctagctttgtttcccacagatctggctttatctaagaatatttctctaatggaaatagcagttcctaaaagtttaattaactctttgacctcagaccaccttatttatatatgtctaaattatttcctttccaggcatgattcatattccttgagctattggccacgtgccagggaccattgccattccacacatgtgtaggttacagagttttttttttttttttttttttgagcaggaactagcatgtaaatcctttcttcaaaatatgtatttatctactggctgatacctgacaaaggagtgataatggttccctactgcttgccgactcaaggacagagttttctgctacctttatttcttcccccaaaatttattttgacagactgctttattgagagagagaatgaatataggatcagtgtttctgtacaaacatttgaatttggtgtgaaggagggataagcgtcagaggaaatggaaaaggggaaatagaaaagaggaagtatggtccatgctgcccaaaccgctgcttcttattaatccttctctgtcccctcagcagtttttctctatctttgctgtgtggattttgtccattctattatgggtgtctacctccagggataacccaggcctcttatggtttctttgtgcacacgctctccttactccagtcgctacctcctgttttctttgagcctgccagattccttcccaccttcatcctcttccagtccttgggatgacctaaattctcttctgtgcttactagaatcctgttcatctttcattccccatttccaggcccctctctttcacaaagctttctgaatctatacagcttcattctcattcacctgagctgctcacacctggcacctcacagtttagcatttccttactctgttgtgtggtcttcatttcctgacctcatcatagacatcccattgttttcttttttgtttggctttattgagatataattgaaaataaaatcgtatatattcacagaatacaatgtgatgatttgatatacatatacattgtgaaataatgaccacaatcaaactaacacatcgatcatagttacctgtgtgtggtggagttagggggtggtggcgaccatacttaaagtctgctctcttagcaaactttgagtaaatgatacagtatttttaactatattgtaaattagatccccagaacatgtgaacttactcatcttgtaactgaaagtttctacctttggaccaacatctccctattccctccaccttccagcgcttgacaatcaccattctaccctctgtttttatgagttcaactttcttagattccacatgtaagtgagatcatgtggtatggcttatttcacttagcatgatatcctacaggttcacccatgttgtgcaaatrgtaggattttctcctttttatggctgaatartatttcattgtgtatgcacacacatacatatacacacatcacatgttctttatccatttatatattgttgaacacttaggttgtttcaatgtcttggctttgtaaatagtgctgcaataaacatgggagggcagatatctctgtgacatgctgtttttatttcctttgcatgtatacccataaatgagattgctggatcttagggcagttctgtttttaagtttttgaggaatctcagtgttgtttttcgtaatcagtttactaaattacattcccactaacagcatgtaagggttcccgtttttccacacccttgccaacacttgttatctttttggtagtatccatcctaataggtgtgagggaatatctcattatgatttttatttgcattccccggatgattactgaagttgagcaccttttcatgtacttgttggccatttgtatgtcttctttaaaaatagttctttgcccattaaatcaagttacttattttttgctgttgtataagttcccgatatattttggatattaatctcttattgggtgtatgatgtgcagttattttctcctattctgtaggttgcattttcatttcattgatcacttcctttgttgtggagaagccttttagtttgatggagtcctactggtttacttttgcttttgttgcctatgctttcggtgtcatacccataaaatcattgccaatacgaacgtctttttctgtgttttattagaggagtcttatggcttcaggtcttacatttaagtctttagttcattttgagctaattttgtgtatggttaagataacagtcaatattatttttgtgtgtatggatatacagttttccaagcaccatttattaaagacatattctttccccattgtttattctgtgcccttgttaaggattaggtgaccgcatgtgcataggtttatttctgggctctctgttctgttctattggtctatgtgatagacatcctgtcttatgctgcttttctgccttattggaggcaaaagtcactggtatactatacagtttgggatcagcatagatgttgattacaggctctgtgatctagagaaagttacttagcatctctgtgccttttcwttctctatttaatrgggacaatatttcctatctccaaatgttattacttaatcttgagataatttgcttacagcatctgtcaaagtgccaaacatatagcaggtacacaatataattttgttttcctcataaatacatggttaggttcagcatggttattcatgaaaaacttyttttaaaaaattgarcaactgaataaattctaattgaatggctgaattatttgaaaggcaaaaaaggcaggcaataaagttagtctgaagtatcttcatgtaggtattcttggtgtagaagtgtagtaactctaaatctagcaaaacaagctttattyccatatactgtagctgattaccaagttcccagagggaggttggtggtgctttggggtccagtttattagattggattagatggggtagatgcaagaagatataccagcattcccaattccttccaatacaaagattttgtggcttattaaatttttaagtgattatggagtacttaattttagctttttataaacttataaatttttttaaaaactatttccagttggctttcatatgtttttcatagtatagatatagcatattacatatctatattgactacatgaagaaaagcaactagtgtgtaaaaattaatttttttgtttttgttgaatgtcattgtttcagacttctcttgtactgaagtgtagtaaaatgtattttctatttttatttatttatttattttgagactaaatgttgctctgtcccccaggctgtagtgcagtgacttgatcttggctcactgcaacctccgtctgcctcctgggttgaagcaattctgcctctgcatcctaagtagctgggactacaggtgcgcgccaccacgcccagctaatttttgtatttttagtagagatggggtttcaccttattggtcaggctggtctcgaactcctgaccttgtgatccacccgcttcagcccccgaaagtgttgggattacaggcgtgagccaccatgcctggccaatgtgttttctttcaaataaaactttattagaaaaatcatgtattataactaatattttagaaatctataagagtatggctgaagttaaaaatttaaacaagtgttattagtcttcctacataaaatattggtatggaatctgcataccttaaataaaagcttgtagttacaaaactttatattcttagtaatattgtatactctagtttaatttamatggctgtttggctctgttaatgatagaaaacccttcattattaaggacagcacttcacagaaaattgactgaagctaactttaacttgcagatggcgttcattaaagagtttcttttcataagggtcatttttcatttttatttcaaagattaaatggatttatacataattatttcaacatgacatctgttctcattttttcctttcagagctttcttcccaaatattccatgtttgtattttgtaaaccatacaaacaagttttaaaggaaaatatataatcctgagtgattacataatttattgccgttctctatcttatgcttttaattttatttaatgcatgtcttaagtttttcaacagacttttctaaatgccatgataatattaagctctktgacaacattaattatgtgtacatatattatttcgattgcacagtttttgagtgcaatgatggatccattgagaatgaggattctggaaagctctaaaagagtggcttgtgtatttttccttcttcctttttacccgctttcctctctccctccctttcttctggaaatgggaatttttttaatgaaatttcatgcaaattcaatgaatgaatggtaaaacaaatctgatccaaactattgacagaagtggaggcaggcacagaactccagcctcttcatcatctcctcrtttcctcctgaattccttttcatgtagtttcttggacagatgcatctggaatctgaaagtaatatttaatagagtattcacattcttaatagttgttatatttgtaagtcagcgacacaggttgaagccacaagcaatatttagtcttgaataggttttactttttaaaattctatttgagcttttttcttttttattaattgtggtcatttctacaactctttctagaaaactgtatttctcagatttgaatatatttgttattattagctctcttatttaaagatgaactaagtttcttaaggacaaaaaagaaaataatttttacctacaatttgatactatgtagagagaacattttctttcagaaatgatcaaaattgtgaaatctttgatagatggaagaaagtagttgtctttgcttgtaatgaatactttcaaaataaagtcgctgaataaaaatagtgatcttaygaaatattatagttggatatcatcagagaggtgatattataaatcttctaccccagatartgattttttaatagtctttctgttrcaaatgtttagtcactactgaaatacattatatgaaagagagctcaccacaaatcaaaccaatacaaaggagtattacaaggaaaaaggctttgaatccaagtgcacattggagcaagctgctattcttttacagattarctatttgttattgcgcattcagcaaattccttagcttttggtcttctgtctactaaaggaaaatttaaattccagctctgcaagtttgttgagtaataatataaatggattatctcatagacaaatgttttaaaataaaatattgctrtaggatacttgctatattgaaccaaaaactgccttgtaactttgactcctttgtcctagtgtttattttctatcctacatgtctgttaggattcccaagtcttgctgtccccaggctaaagctattcattgaattcaactgtccattgtctgacctcattttcatattccttaaacattgctcttccctgggatgcactagttaaatcttattgtggtattgggctrtccttttttgtagccatcctcagggaagccacacttgtttggcatgaccctgttgtcttggctgcactcaattgtacgtccccaagctgagcagtgagattctgattcaggcattcagtattgggaccaagggagagttaagttagtcttttccaacatgcaaaagctgtagggcttgaagcagagaaagtcaattcacagagaaaatgaaacataatttctgttctttctgctagtgtggggagaggaagagggatctcagttacttcaggactttcatgattcttactctacttcttcctgaagctacaccgtgatcctgccctttgttctagaaataaccacctccgtcagctacctagagttagtttctgatactgcagttactatttttcatcaaaagatgatgtttgttttgttgttgttgttgttttgggtgagaaccattaagatgtgtcctgtgatatcatttttacttgtcaattatgtctccataatttttaaaagaygctgttcattataagaccttcccaattcagaggtatcaaaatgtgaaaaaaatactttaatatagcaatctattttgaaaacatctctgttaaaatctagggctcagaattgaacatgaaaactggctcccctcttcccctgaaatggtggcactaaaataaaagccaacatatttcctgttctgtccacagagcccttatctcttgtctccagaaacctatgaaacatttccatttagatgtccccatcaaacgtatttcacaattcatgctcttctgccttgtcaggctggatctccttactttgttttcatagcagcaccatttaccccatcttctaaactagtgaccaaagagagtaatttgggatttttttcttctttcaaattttggcatttatttttaaattaatattttaaatcatggtataatacacataacaaagtttaccatcttggtcatttttaagtgcacattttaatggtaataagttaattcacattgttgtgcaaccatcatcaatatccatcttcagaactctttccattttacaaaactgaaacactgtacccactaagaaattactccccatttcttcctttaccaagcctctggtagccaccattccactttctgtccctawgaatttgactactttaggtaccttttagaagtaaaataggacagtatgtgtctttttttgtgactagcttattttacttggcataatgtattcaaggtttatgtgtattgtagcatgtgtcagagttttgacatttcttgtgttgacattattctgctacttactcttttttttttcctatctttatgctgtcgctgacaactagaaggcctaaggttttattactttgcacctgcgctactgaaataatgtcctaacaggtctctggagattccctccctgcttactgtcataatctgtaatgcrtgaatartctttathtacatggctttcttctgrttgttgacaataggactatcatgaatggacctccatgggtggttagtgcaatgtagaggtccgagataaccccattcttgctaaaaacattacacattttcatctaatgtccccgacgtagtctatcccttcaatgtaatttccgagacctttacaatataggtagaccctttaaaaaattaccgtgtgcttaaatttatattccaccattgttagccaaggrccttcatttcaattttatagtcatttaattttctcagtgtttatatctgtgtcttcttctttttgcctttaattcccctcagccaaaaatttcagcatacttatgatctatccaaatatgtgttctgtgtatagcttayctttttcattaaaacttcactattgtttcagccctgtatagttcacttagttacacgtgtaattttaaacactgttgttgactgtgttgtactggttagaagccayattaactagatttcagtttcttgaaaatttatacattagcaagcatagtgtaaatatgtattaagtgggcaataaatatttgytgtgttagtggcattttaatagtacatgatggaataaatgatagatgtgttgtaaaagcttttattgcatgattgccagtttctacctcattgttgtttctaaatctcccacttttaatttacctgaaagtgctttaatgtgtgaaaatatttaagaaattattagtgttccttttttctcctgagaatcacacggacaactttttttgatttaatctatattttgtctagcattatcccaacattagaagtagttaatgtatccataggcaattgttagatacatatgtaagaaagtgaaaaaccracagacagacaaaacccacctaagtcaataatattggcaataggatttagaatgctgttatggcacatgagatgctccacatcctacctacatggaatatggggtatgtgtaaagaatattgtttagccctattttttcgtttgtttcttttgaactactccgttttccttaactctccttatctttttctgaatgaccttaaactcaaggtagtcrttgagtgggagggatgatttttagccatctttttcctccaactcaggtagataggatttaccagcttggycttaatttcctcctttctgttaacattgaaaaccatcatactaactgtaaaaatcaaatactgtaataagagtgagggagtgcatgttttaaagtctgtmgctatattagctcataccacatatgtggcaagaagcagatactgtacaaatcagttcaataatgaggcattgaaacacaagttacatacygtgctaggaataaaatgataaacagagtaacactatyctgtccttttggatttttatagtttagtaggaatgtattaagtaatgacaagtacatgaatatgattaaagggatgtaaaatactgaatagcaaagggattttactttgtctatgggaccagtgaaaacctttgagaaagtgttctttaaacaaagacttgaaagttgagcaggaggtagccaggcataaaggaacccagagagttttccaagtggagttttccaaaaagcatgtgtgaagacttgcaagcttgtrcaacccaccattttttttgttgttgctgttctgttttgttttgctttaggattttagcagcctgaagccatggatctttgtttctgtctctagttttaagtggaaaagtgggctgaggaaggggcttcactggcccarcragaaacagaaatttggaacccatgactgtatttctcctgtggacaccccctgcctaggacaagagagagctgtgctgtagaatgctggggaaatggaaaggcagcattggtggaacagagagcatggagaaatcgtcagtgctgggaaattgtgggagctgagcaacaagtgtgagatgagacaggtgggggccaaatgatgcagggcctagctctacttgtcaaggattttgaaatgaaccttaaaggaagctatttaaaggcttagtcaagggcctattatggtgtgatttgtgttttaaagtagccattcacctgcattatggagaatgaaatgaaaggaagccaggagtaaatgtgggaaaaccagcagccaggacagtggaggagagcatctttgaccagtgtgatggtacgggagrgtgaaaatagatggactttagagacgtttagtaatagttttaaactcatgtgctgtaaattcgatttgattttaagaggtgacaggaaggcaggaggcaacaatagctttcaggtttataccttgagtagttctgtgaaaggtgatgatagataacagaatgtgattcctgagatgagaaaaactggccaaagaacagattctggagagacggcaaagaggaattctgtgatattatacattattgtatgttaatatatagtgtaatatttatgtatacgtatatttgattatatgcctataggatacygattttggaatcatccctccacaaatggccaataaggccacggaattagacaaaatatattgggagcttgtagaaaaagaagcactcttgagaatacaagtacttaacaagagagtagargtgaatttagggcagacaaccatagatttcaaatcatatagcaggaaaaagtcttgtacatcatccaatctgatataatcaaaatgaagatgaatgaaatgaaattctgtcagactgtataaatttctctaagtcaygcatagaaagtctcctaagtctaygtttcttgtgtaggttttgaaaaatacaattcagcttcctattgatattttgtctgaattgaattatatattgcgaaggtgtcaaaaatgttttcctatgtttaaatttaacaccctttggtggcagcaaattttcacatctctcttgagtattcaaatttgttaaaatatgaaacacagtgcttggccaaaaacagataatatttgctgaatgaatcaaacgggtttctgagayratcaatyctttaaagatagagactcagttatttgtctttttcttctgagcsaagtacaaatacttacataacaattatattgaattattgttatttttttcttgtagctattttttctcatggtgtaaactgagggcaataattggcatttttcagagcaaaagtttgatgtttaaaaatctaataaatataaaccactattagacctaaaagtatgtcaaacataatacaactctgattataaagtactcattacttttttgatcataaagattaaactttacaggattgctgataaacttaatagcacattttttttttgctttccaaaaaagcttttatttaaagactttcttttttaaccacagaatgtcaagatagttatgttctatttattgctgatttctccctttctatttttttcctttctttttgtatcatgcccatagcagctgtttccctaacccttaccccaacccacaggctttcccacgctccttttttggctctcatttggcatcgatcctgagtttgacagataaaacatgtgtctgaattgtagttacagccaaactacaatctatcagcttttccctcagggtaattatgcttattttaycccaaaacaaggtaattgttttgtgataaagtattcagttcactcggaataagccgttggcctccttttatctacttatttatttatttatttatttatttatattttttattttttttgagacggagtctcactcagcttcccagaccggagtgcagtggcatcgatttcagcttactgcaaccaccagctcactgcaaccaccgtctcctgggttcaagcgattctcccatctcagcctcccaagtagctgggcttataggcacccgccatcatgcccagctaatttttgtattttagtagagacggggtttcaccatgttgrccaggctggtcttgaactcctgacctcaggtgatctgcccgcctcggcctcccagagtgctaggattacaggcgtgagccaccatgcccggctggcctccttttatttaattcctcatccaatgataacatgctgacagatgactcaggttctttggagtcagtgtgaatgaagctcatgggatattagaattggagacagaaacagagaggcagtacaggcttcagtgttagacagaaatgggattcagtccaaacttggacacatactaggttgtgactctggatgtgatattcaatttctatgwgtttccatttcctcatgtgtaaaatgagataactacaagccttttgaaactttgatcctgaagaygtcgttttggtagatctaaaatgaatacatggtggatcccatcactgttttatttagaaatacaaaatcaargttattaattctaagatatgcatccatagctctgcagtatccaaagcacagcattaactttagttgcatgaaaatttcccaagttggtatatggatgtatatgaaattggagtggtcatggaaagcatatgtgactttaaaaaatgaaaattctcactcgaggttatcaacacccttggacttaaagatctgattgtgaattgtctaaattatgtgaaacagacaaactaccgttaggttgttttcctatgcggaatatttgacaactaaacttaaattcacaaatttaagacatgaatggatataacccacctttgtatgtgaatgcatgtgtgtgtatgtgtgtgtgtcactaaatggtcacaatttaaaacaagaccagaattaagcattcaaaaaacatttattaagcagccactatgtgccaggaatagtagaataaataaaatcttctaaagtttrcagttactttaaagtactccaaatttargcatacttcacacgtgctatataaaacataaaacaacttaattcttyattagtgtgtatttcagttgcatctttaggctttttctgaatgccttcattacttcttaaagccctcaagaaattatgaaaactcagaaggcaacctatctgatttcttaaatttaaatttcctggttaatttatttagattatttgmaaattcttctttgcccaggtacctcayacatacatggactatactacttggtcacttttaatttagaaggaacttcctttaggaacagatattttgtatagctgtaaattatttaaattcacatgaaatcactctttatattcaaagtacataaggtgagatgtagtttctttttcttataaatttatcctattaagggaataaattggctattttatttaaaacagaaatagaaattttatgaatgatggttgggaactttaaccaaaatgtacataatgtgcataaatgatgggaaactttgtttctgcaactagaattcatgctataatgtggacattgttagtctataagttaatacgtgtaatttaaccttatccctgtacttgatasatcattagttagcagagttatttatgtgacattatgtggcatgccttaatttttagaaccagtttactttttcaaaaaatacattgcagtacacaaaagtcctgtagaaaaaggtcattygaagtcttatattagaatgatataatttccttttttgttttactttgagttttaaaaattgatttatttggaaacagattagcaagtccccaattatatctttagatactggtatattaaagaatattttacaaaatcacagtatcaaccatagcctcgagaggtaaaacttatcctattyttaatttccagtggtagcactttrtaaataaaaattatggtgtatgtgccaaaagcctggacttttgtctggcaaaggttgtttaaaacttgaagagacatcaagaaatatgtgagttcatccacccagatctagccagaactgcttttgaatggttctgtggctcatttaggcaattaaagccttgtgattgccctattaaaagtctgaaagtatgcatataacccaccagtgttttacagaggaataataggtaagatttataaaacatctgaaatgaaaaaaatgtaggataataaaagcaggtatttgttgagtacttactgagtgttcgaggcagcgtacttagataatctctgagttttgttatacgtattaaatgagttaatataaagcacatatgtgcctggcacataaatgttatgtatttacagtaacaacaataacagttgtcattgatttaattatacattattatcctaaaaataacagaaaatcaatagatgggagagccgggattggaattscaggctgtctgtctctgaagtccattctccatatcactgagctattctagttttcctrggwagagaatctaggatggccaaaaaatgtccccagagcctccctgtaagctgtcctccacaacagacttctggaatagaaagaagttggcttatgacctcttgtcactgcctagtccttgggtgtgataaagttatttaaactgtttgaactcctccttctgtaagcaggggatatcagtaatatcaatcctaaatgtgtcgggaggattaaatgagataatgcatgcatattgctgctgaacacaaagtctgtcacataataggtactcaataaaggaaggctgtccttgttgctttgaggaatgcagatgactgattccattggttctgagtgctcagtttgtggcctgactgaattatgtgcaccagatytggtggtaggtttttgtgaattgacctcaccccggttgcatcttagcttttctccaccttttaggggatatactttcctcagccgtttcatttaaattgtatttaatgtggttatatttttaaaaggtggtttttaaaggctttcttttttaaccacagaatgtcaagatagttatgttctgtttattgccgatttctctctttctgtttttttcctttctttttgtatcatgcccgtggcaactgtttccctaacccttgattagcttactttctgaaataagagcgtaaaataataaaaataatggttactatattgtgttagttttcccacaacactttttttaatgcttttacattttacataannnnnnnnnnnnnnnnnnnntttttaatgcttttacattttacataactgggaatagtattatatattgattagtgttctatatttttaaattaacagtatgttataacccattttatacattaaaagtctgtagaaattacttctatgcttcttaatattccgtatatgactgtgtcatattttatgtaagtaattctctcttgttaggcttgttgattatctcctggttttgtcagtataaataatactgaagtgcatattttagtaaattcttggttgcacttctgattactgttttcagatatatgtctgtatatggggttatagattaaagaaactaagccctctatgctttaaaataatggttttcaacctcataattaaaattggatgaaatttcttttaaaaatcttagagcagtgatttttaaagtgccctgtgacatctcctttggggttgctattgagaggggagagttacacactgaaggtggcttttcttaaatgccgtttcttttttattttattttttttgcttataccaggtgaaacttattttcttttgaggcaagatcttgctctgtcattgagggtggagtgcagtggtacgatcatagctccctgcaggcttgaactcctaggttcaagtgattcacctgccttagcctccctagtagctgggactacaggtgtgcaccaccatgtcccactgtttttgttttttgtttttttcaattttcttttagagacagggtctctaaaagacgctgtgttttttagttccaaggatgcttttcaaaatatcgagtttcacaaaaaataaagtcaagatatgttgcttcatgtggctaatgtttttgttccattttataataaaatgtaaatattaaattctcatataactcattagagaaccacaaataaatgcatttacttaataaataatttattttaaattatatgacaaccctatgattaaatttaatattgtattttttttttttttttttgagacaaagtctcactctgtcacccaggctggagtgcagtggctgtgatctcggctcactgcaacatctgcctccgaggttcaagtgattcttctgcctcagcctcttgagtagctgggattacagatgtgtgccaccatgcctggctaattcttttatgtttagtagatatggggtttcaccatgttggccaggctagtctcgaactcctgacctcaagtgatccacccaccttggtgaggacacagagccaaaccgtatcgaatatcattaaaaagaaactgtggcatgggatagtttaggaattttttaaaaatcaggtgaagaatattttgttgacttgtcatcataatttttatttacaaagatatggaaaaatatttagatcttggtgcaagtatagaaagaacactattctacctatttccaaagggcttggttatcacatggagccagggcttcggagaagagaggatgtctgtattggagagagactatttggcagtattcttggcaacttggtagggactcgcagaaaactgcagtatgactcttacctataaatccgatctccacgctctaaactcagtcaagtctcgagctcatgattgcttacctccgagttttatgttatttttaacacaagaatggtctgagttcatgcggaggttgactgatgtagggtagaggctaccctggaataagctagcatccgagaggaatgaaactccattggtaatgacaagtagcaggactcttggccaagagttaagttggggcaggaagtttgaactgactgctgaattgggggacattcagggcaattgtacacgtattgcaagggacagggaggctccaggtgacagcttggttacatgattttttttcaagagcaatgtacaggaagcacaggccttactttttattgttgtatggagcagagtcccagaaggaccggctgtggagtgctgaataaaatccctgtgaatgcacaccgrgttctctgaaaatacaagcttctagtcatttctgggttaaggtgtagtccatttcgctttgctatcagattacacataagttattgagcaataaaaggaagaatgtcttgttctttattcatatgttctaaatctggtaggccatcgaactgtactttaataagaataggggaaggacaggtatacgagtgttggacttgttccatattgtcccatttggcagaacaggaccaaaaagtagtctttttctttttttctgatcattagaggtatttaagagcagaaacaaagtttggtggggataaaatagagaacactgaaatggtaaaaccacaataatattgacaaataggatagttatattagacaaaamcatgttccttgagtctggaaattgttagtgtcaagttacactatgtattaaggcaccgtaacatattgtggcactgacttttaggcacatatatttgtatatctttctaatttttttcaaaagtggatttttctgccatttatrtttgccatcgtataaataaaatttttatgttttgatgttcaacagccattttatactaataggagctctaactgtgacaatcaaataaattaatgtttttatacatgtctttatcggacttaaatctgtgttcacaccagataacaactcaagactgtgactatgctattggctatgaggagtgttgctttaattgcagcgaagttaatctgtagaatttaacaattatgttgccatctatcttaagggtttataactctggtatagaataagcaaatagcataaaacacttgtacctgtgtgtactcctcagagttttattggtaataaaaaaaaaaaaaaaaaccacccatgctcacttttgtgcttgggaacagaatctgtttctaacctttgctattaacaggaagtgggagaggtgaaatgagccctggttttgtggccgggccagagcactctgtgttcctgagagtggtattcaggtttcatgtctgtctagcttcttgctcctttgaatagctggcctttgaagtgctaaaaacatagattggtaatgagcaatgtaaagtaaagagtgggaaaatatttggaaaattcaagctctgagaatagcctgtctgggatgatttggctcaggctgtgttgtaactgtgtttttctttcccaggtaaattgtgaagttttatgaatataatagtataaatttcctctataagaataattgaaaaatctcaacttcacttgcgtttttggtagaacgattgctatatttagtttaaaattttagggcggcaggccgggcgcaatggctcacgcctgtaatcctagcactttgggaggccraggygggcggatcackaggtcaggagatcgagaccatcctggctaacatggtgaaactccatctctactaaaaatacaaaaaattagccgggcatggtggcgggcacctgtagtcccagctactcgggaggctgaggggagaatggcgtgaacycgggaagtggagcttgcagtgagccaagatcgcaccactgcactccagcctgggcaacagagcgagactctgtctcaaaaaaaaaaaaatttagggtggcactaactgtcgagtcttttaaaaagataatctatgccttgaagtgccatttttatttttgtaattacaaatgggtatcagaagaatggaatctaatatgaagttgaggtcatatattaaatctaacacctttgaataaaagtagaccttttgttccattgcatgttattattgaggggcccccattataatacaacagtggcctgttttagaaaatattctctatcagaaaaacaccataatttaaaaagacatatttccaccaaagtcacattctaaaatgtatacagaaggacatggaataaccgcatatagacttagtgtatcatgtccccattcttccaagaaaataggcaaattttgttaaacagccccaaaggtaaatatgaatatttttatatttttagaaaggtttgaattttaaaagacaatcttagttctagtatgtttatctcttgccttggaggcagttcttaaaactataaaacttgagttgtgactgtcagaatccaacacttatatgtttatttggaggacataattttaaaatactgacatctttatctaatttgttatattatgttacagtaatagtttaatattgtagtgcatgatattagacttgaaatgctagaaatcactggaatgtatagccaatgaagcctgggttgatttttgatatttttggattatatagtaccaaattataatcccatattctatattcagatctctgaaaaaagtggcctttcattgatcaaaatatatttatataaaacattttaatgaagaatacctatttataaaatatscagaggaaatatatgcagatgtaaaattgagcccaataaatccttgtgttttcataggtatgaaagttacaataaataatggcaattagatattgtgtgtgtcagaaaatcaatttttctcccaaatcaatccctctctttctttctgtttctgtatctctttcacagacacaatgtaaacacctatgcatatgtgctcatatctgttttagttgacttctttcttgagactttaaattctgaaatgttttacactgcatgtacagctaagattaaagtcttctttttaacagtacactttttataatgycttgaacttgtttctctgtggcagaggaaaacagcctcatgcayctggacaaacaaaggtgttccttcaaaaacagactttcagaatcattaattctggtttagaaataattatgaaggttaagtggactctcatgcgtaagattttagagctggtgagtggctaatctgtgctttacttccccttgttttcatccttcttataccaccggtattaccgtgcctcctcttaacagttttgttccctctgtagcaagtgagccagagacagtgcttcagcttcctatagcctcctggtggtatgcagggacagctggctgagatcatatgcacttctacccaaacatatcccaaggtaaggctacaggtagtaaagctgtgaccagaaggtagatttaaaaaaaaattatttaggtcctggaaatatagaaagagcagatagtgccctatagtaataaccaagtgagcaataactagggtgtgagtggagttattgtgtttagtctaagaatgaagaaatagcagtgttcggtgaagtggaatttggtgaggcatatacaaaccagaggtagaaagtagtggatttttgcagtttcatgcataaccgtaagtgcagtattaaaaaaatacatattgcgaaagtaaaacttttaaaggatacttctcagcttgaaattcttaatacattgtagcaatcatattagttcttgctgtaaaataaggtggctataaaataagttagtcaattttgagttgtgagttgaaaaggaaaaagtagtgattaatggagacatgagctaggaaaaagcatttggagagcggataatttacatcagtaggcctctcaacttttctttacctccccactgccctctttcaattacttcccttagatcacaagtttctgttttagtagaaaaatttttctatagatacaaatagatgtaagggagcataaatgaattcctgattactctgtaagctaagaatttaaacatatgttcaggattgtatttttataaaaatttttattgcaaattattaatatagattcacagatgaataaaaaatgatgtggtcctatttatgtaaagcaaaacaaatatttgataggtggtgtagaatgatgtttacacctgnnnnnnnnnnnnnnnnnnnnaaaaatatgcaagtttatatcactcacactgtggagaaaaccagtcagtaacaaactgttaagtcttaacagtgattataatattgaaaagaacaatatcaacagtagaacaaccatatcaagacagtggatcatgaagcaatgactataggattccctcctaaatttcgttcatygtaacacccacactgtgttctgtctctgtgcacagcacaacaaactcacttcaaagccaaatgaggacttggcatactcaggaaattctagtaatgagatgctcttagttttactgttacagtatgtagcacttcatcttaggcaaatatgacagtctgtggaatcctgtgtcattcatttgaaagaactgacaaaagaacatgtttttagatcaacttgcatttgcaggaacacacatgggttgccaaaaatatccatttagagtgtttaaaagaggcacacgcctggattggcctcggtgaccaataatgtctggtggtaatgcgtgttttttggagtagtctttaattactaaacaaggtggtgacatacataaagccagtgggttttttttccaccggmagatgggtgctaaagaaactgagcgattttatttttttcatcatataatatttctgatggtcttgcctccttcaagtctcaacatgtgtctctttaaagagaatatttcacctttcaaaatgaagtctcctaatgactcacttaaatgtttattgttttcttgccgtaaggaactttgtgacttgtaaatatgaatttatgtatgcatttttgtatgaataaatacatttataaaattgatatttaaaaagagctagcacttaagttaggccagacgtttttctaagcactttacagatgctaattttctaatcctttcaacagccctgaaaagtgactttcatatttaggattgaatataaactcattctaagattgtctataacctatttctgtgttgcttagcatagttctatttaasagaactaagacaaacatatagaaatatgatgatgacaatgatgatattatattactttcccaagtgtctggcactatgcgtatttcaccaagcatttgtagagaagcggcagaatatgatgattatgagcctcaattctggaatgagactaacctggttttaaatcctggctgtgcttcttacaggttgtgtgatttgtggtaagttacttaaattgtctgtgcttcagtttcttcatttgttaaatgtgtatgacacctatttcatagaattgttatacagattacgttaattactaaaaaattatttcgagctcttagaatagggactggcacatattcaatacaaaataagtaataaaatacagaggtatgtatttgaatattcaagacttcttggaaggaaaatacttaatgctgttgaggaaaattttaagcaattagaatggcaactagaagagattttgtaacaaactatagtggattatctcacatatttatccctcattcaggcaactacacatctgagttctctgcttgttactagagctcatggttgctggctccgaatgagaactgaatatgaaaattttcagtttgtgaaaaacatctggagcttttagttgactacaagcttaatatgagccaactgtatgttgcaactgcttaaaagagaaaaaaagaataaaaaaccctgaagaattccttaggcattataaatagaaataagagtgtccacatcatgggaagtaacatagttgacgtacttcacactggccgcatcacggctggaataccatgttccgtccaagacaccataattttaggaaagacttggacaaactggagtgccagaagtctggaaatatgagaaatggaggaagtgggactgtatagtgtagagaagactaataggaactaaaacacttgtctccaactatttatamggttgtcatttagaaaaatggacacgcttatatattgccctagaaaacaaagagtagaatcaatataatgaaagtaccatgtatatttttactcagtattaagggtgaaaactaatgggtaccagtgctgagtcttgcagcaatcatataagaattcctgtatatggccgaagcttacattcagttacattcactaaaataagatttttgcattcatatcctcattgggcttgggcagtaaaggaattaaatcccccaaaagttcattaaaattttagggctgttctatgattgcatggatggttaaaattagacctgatggcactattggttattctaagaaaggagctaaaagtctatataattggtttactttttattcagtctagttttkaaatcttaagaatggatcaaggaacattggatgaagaagggacacagggtaatgttattttcccaaatttcagaaattcttccaatttaggttcagcaggtaattaagaatgatttcatgcatgtcagcaaaaatagtttgatacaggactcattgaatattgtattgtgttgggaactgatcagagaaaaccatggtgtttgtccgtgaactctcgttgctttttatctaagaggggttgaaatgttgcgtgcttttgaattttatcatggacaatacttgagatttgtaccagtacactaagggttatttttaaggattgagtaaaatggaagtgtattaatgggaaatagaatagaagatagctatagtatgaccttggaaactgactttacgttttacaggcatgtttttctttccatatttcattcttgtatcttgaaataagctgtacttatggttaggtatatgctagatcttagaattcctttaaattcatcttgtcaaaatatcagccattctgtatgaatattaccaagtttaagacattggtttatgttcaatttcagcagtttgtataactgatttgaaaaagcaataaataggcttcawaattttatattttttataggaaacaggtaatttaatacatttaatacattaatacatttataatgtatgtattttttcatgaggtagactatgtaaaaagtaaagaagatgatctaaatccagaattaaaaggcacagtcacatttttttttcttttgcagcattggatagtatcagtttgttataatctagaatatataatatattctgtttttacatttcttaactaaatcctctttttaaaatataaataaatatctttaaaataatattttaggccgggcatggtggctcattcctgtaatcccagcactttgggaggctgagaygggcggatcacgaggtcaggaggtcaggagtaatcccacatcgttcaagtcagtaatgaatttatttgaatcaaaagtggatacatttaaggaattgtttctatacatccaattaggtaattctggttggctaaattgagagctggtcataatcccaaaagacacaattctgaatgtcataattctgaatgttaaaatcccagaagagtaaaatctctaaagtctaaaatccagaaaatcacaatccccaaaacatcaaaatcctgaaaatgtaattctgaaaaaaattaaaatattattattagtagtagtagtatttttgagacggagtctcgctctgtcgcccaggctggagtgcagaggtgcgatctccactcactgcaagctccacctcccgggttcaggctatcctcctgcctcagcctcccaagcagctgcgactacaggcgcccgccgccacgcccggctaattttttttgtatttttagtagagacggggtttcaccgtgtttgccaggatggtctcaatctcctgacctcgtgatccgcccgtctcagcctcccaaagtgctgggattacaggaatgagccaccatgcccggcctaaaatattattttaaagatatttatttatattttaaaaagaggatttagttaagaaatgtaaaaacagaatataggccactttacacaacaaaatatgcaataacaacatacatgcttttgcacatataaacactcaagtatgctaatgacagtcatactggtataatagttatgacaagatgaactgtccttataaagaagtaggtcaaaaaaggacaatgtataaatgcgtaccactatgattgatagttgtgtgcaacagctttctaactttggtcatctgaaataatataatgagcaacctaagtcttttgacaagatccatcaaaaactgtgataggttaccaacatatatgtagtcacccaaagagctgagatctcaagaaattttatatttcacaaatgcaaatgtacaaaagaacatctcttcatttactgagaaaatttcaatgtttttacatacgtacacaacacttaacacaaagtaaacatagttcacttctgtgaagtcgaatttgcaaaaaatgcataaaacagaactctcaaagtctctatacagtttatacctccagtaatggaaacgatgtgaagatgaaatacataacatagtgaattgctttacggggtttctaggtattcctcaatcctgtaaagttgacatctacaattaagcccatacgttctagtgataaatagaggtcagaaaaatagcatacgtgggtttggcttctgttttccttctttttttcttcagttattcttttgactgtgttttcttattattaacccttgcctcaaattgttccctgggagagtgctgcaggctacagccctttttcaaatggtgaaaaatttgagagaatagtggtatgaagaacattttgaatgcaaggctgtttagttgtgaatattgcattgatcacatctgtgtttctgaagctctgtgacttgctctcctaagcctagagcaatcttcactgaactaactctgtggggtaaagaaatggttctaagtaataataataggctcactttaacttagaaggtagatattgttgagtgactttagttagcatctgctgcattcaaaacatgctgggaggtgagggattatgaaagagaaagttgaaatacatagatttggacaatagaaaaagtatgtttaattttttctagttattgttgatgttttattttttaccttcatcatttcagtttcttattttgtttcagatacagaaacatcaaatccatgttccatacatcttagacactgatttttttttttatgtcattttgacatccctccagcacccaaatgccaacatctgctacattttgccacacggttgtaggcttgaactctgaaatgcccctaaatgtttttaaaatttctttgtgtatgttttcaaaataaccttcctttgagttctcagttttatgtgaactgtagttaaactcttttttttccatgacttgtagcatatggtatttaactgtttgcyagtatcgctttctgaaatgaacctatttgtacaaaggcattttaagagaacagtgcacttaatcagagaacctccttcaaggtgactctactgcttaaacatggtttaaaaaaattaaaatatttrtggctcagcattgttgtttcattgtctatcaaagttaataaaaataactggcctttgagaaagagtacacctttaaaatttttgaaggccaaatgatttttttttatttttcatccagaartatctatccctaaaggaagagaaactttcttcagaaaggtatttgttttaatcaaggaagtttctgctgagattaataacttggtatcatcccttagttcctgrtaaacatcataccttaaatgagtcttctgttttttaactagtttttcttttgtctaaaacaaaattgcctcttttgttttagagatgaattactcaatttttaattgttttgggggcagggtgcattattttcctattgaagaacaaaatgtaaaacactgccctgaaaggaatatttgcaaaaccatgaaagtgagcaaagttgagatgggctactctatagaaattttgcattttattctaaaatactgtattttgccatgatttgttccctggtgtgtatagaagcattggctgcagcctgaattcctgagcccttcagttctccacttttagtgtatataaacacaatttcactgagcttggaagaatcatgttgtagtgaaggtaatattattggcctctttcttttgttgctttgctgctttgtggagagggataagtttattgtaaaagcttctttaaatccatgttcttatacagggctatagatatcttacccgtcagttccaggcaagtcaccctttctgggctgcagttagccacaatagttaaatattctggttttttggaagatttttaaaaaatctctattctatccacctagttctgagagagtatttccctcagtttgtctcatttgtgggaagaaatattatctgcccgtctttattactaccccaatatcaagtttacatatttatgtgtttgccattctataattacgtctgaaacaggttgattatctattttcaaaataaaagatacagaatgaaatgaggctgtagggagaatgaatgaaccaaaaagaaaaaaaaggttttgcatattttaatttctgaaaagtttctccagtaggtttatcagatgatttttgttgttgttcttcacagaaatgttgttcggccatgtatgttcatgagggaaaaaagttctcatcctttgagagtatgaggattgtatacacgatgtatataatgttggagaaaaaggtttttattagtttcatgacattagtttccttagctgcctttctgagaatggtccttatgtttaagatgggggcatttaagttattgtcaggattaaattcaatcgaaagaattaagtgttaggaaactgtgccttgcctgtcaaatagtgactagtcaggaaaamacacacacacacacacacacacacacgcacacwcacgcacgcacaaatgcatgcacacattcctcactgctattttgacgtatatgtacctatagtatgtctaaatttttcatggtattagattatacttcaattatttgaaattaatttaaagaacagaaactaagaggaatcatagaatcaaagataactatgcgccttatctcaattgtgtataaaccttttgaaagaaaataggttcatttaatagtttaataacacattttgcagttgttgtaaggttcgtaagtttttgtttgctgagtattaaggcaaaatttttaaacaaatgaaattaagtggcctggtgacctggcttcaagtattaatctgtaagcacttttaaaatgcatgcttagcagcatggtttcttttttttacaaatcttttgcaaagagcagtgataatgtgccaatgacaatgaaatatttgaacaagaaaagttgtttttatttatrgagaaacaagtaaaggccctaaggtggttaaatgattgcttaaagtcacacagaagtggcatggctctgatttcccagtttaccagatacttagatactcttttcaatgatggaaaagcaaataataaataatttactttctagatattgttgaattcttactatgtttctgggcttctatgagatgctggaagatttcttaaaagtgaagagggtgaaatggggaggtgttagtcaaagggtatacagttttggttatgcaagatgagtaagttytaaagatctgtgtagtatattgcctacagttaacagtacatactctgttgtagacttaaaaagagggtagattttatgttgtgttcttatcacaaaaaaaggtgggaggaaayttctggaggtgatggataggtttatggcacagattgtggtgatggtttcacaagtatatatatgcttatctccaaactcatcaagttgtatatatttaatatgtgtagctttttgcatgtcgatcataccttaataaaataggtcaaaaaaagaggaagagcttcaattatttttctcttctttcctttttccataccttcataaaaattcagagtgcaaatttcttagtttatttcacctactttctgagcaatattttttaaaacctgtgttacatttcaaaagcaatattcaatttattatggcattgactagaataacttgttcttgaaacttaggtaaatggttatgaagtaatcaaaatgtatctttcagtatgctttttttttgtgctggagtagaaaacccaactaaaaatgatatacattttaataaccaaagtatattatctcacagatggaagtctrgaaggtcttaagggtgactccatcaaggagttctggctccattttcccaggaattctcttgattttgccctcctctaaatgaaacaatgtaattgaagcacttctgaacctcatattcaactataacaatgaatagatgaagagtgaggaagaattttcccagcagcctccaaaaatcctccttttattaacctgactaatctttttttgaactattcccttcgaagggcagtgggatcactgtataaccaaactttggtgggacacagcagacctgtgacactggctcacatgggagaggagtaaaacaccccaggaagggagaaagattatggacagctcaccctgccccttagaaaaactggagactatgtgttcctgaaatgaaacaagacaagtgttcattgcactctgagaatacattatgatgtagaaaaaaatttgagatctataggatatgaaagtggcacacaggcttggaaattacagcaattagtggtaatgtattatcttgggtactgcttggggtctctatatgtaagatgactttaaatatatgaaaattttgacaaacattgatactactctctcaaggaagctgtgtatttcccatttattttgtctgcaatctggtttttaataaattcaagactcaagttaacttttaataaatactgtacatattttactatcagaattttaagaacagcatacgttttttaaaaaaatacacaagatgtaattttagtaaggttaggaagagcatgtactgctggaagtatagttctgtaactacatagacaaaatatatgtcttctctgtcacaattttgccttcagattcattgtttgtagaatgtttcttaaggcttcacagatattgtaatttcttatagatggattgtggagagagatcatgtgtagatagaattcctacrtggtcccagtgttttaagtatagtagtcttctgccactctaatattgaataagaagtgctagtggaaaaattgggtgatcgattacttatttccactctgagatcaggtctcatttaccttgaatttgatttgttcttcctcagactcagtgtttctgatgcaggtggtgttaggctcccacattgttaaaataatgtgcaacattggtattcttttaaaataccattaacatgctttatctttgttcatttgtcaaatcaaggctttactattgaaggtgactttttttttttcctgcgtttcagctgagtttctcttacaatagtcttgactgctgcctgtttttgctcatgactactgattgcctgtaccctaaatcctctctggaccaggaagggaacatacatttgcaatgttggaaacttggagttcgttttcattgaaattctataggggctttgaatttgtgtggggtgttctgtgtatacaaagtatagaaaaaacctctattgctatctatcttcatttaaggggagagccagggaggctgtttagaattaaatgtttttagagagtgtttgctagcttttagtaactcctagacctggtaaggatcaggaccaggcaggtgtgaggactatacctgttaacaaaagcagccctgatccctgtgctgagagggagtatagtgtagtggcagggacggggaaagcagatacatataaaatcatatgacatgtaagaaggggaaactacatggtgctgagaagaaactatgtttatttcatgaaatgctgactgagctaagatctagggagaaatcagaaattaaattcccacaatatcatgaagaatagacttgaaaacagtatgagccttggctttcccttatttgagtcaatatgctgattgtatagagtgggatttattccattgggatcatattttttcagatactaaagagtaacttttagtttgggaagagcaaaatgtctccaattatcccaaggattaaaaactttaaagcaacttttcattcatattaatgtgaaaaagaatccacttagaaagaaatgagggttccacattgaaagacactttagcatttattacattgtgtattgttgaagtaagacttcaggtattcatttgattttaaaatatgtatggagcacctactacatagtaagcattttcctgagtgctggagcacagcagccaatgaagcagaaatgtcctggggggccttgaacttggaggtacttcccatttctcactctgtcatagggaatccccactgcattccttgttactgtagagtcaactgtgagattcttggtcgtggaacattttcattccattactaacatcarttatctctgactagcatttgtattcaggtcgattaaaaatatccctctgctgttgaatgaaatcttagaatcttaattcttctacgtcattcaatagaatttaggcttgtcttccagatttaaaaaaaaatcatctaaggtgcagtatgtactgaaatagtgaacctggaacaaccccatattccaytgatattctttttttttcctggttatacaactgctggaacaatagtgtaacaatgtcaaagaaaatttgtctgggaggtaggaagattggtgataggaaaagtactattattatggacaagctctagatttgggagtcataagatttgagtatggttcctggatctaattcctggtagtaaggaggccatgcrtaagtcgcttaccttgaccaatctattttctacttttctaaaatggtaattctatttgctctgcttaactcacagctcttgtaaggatcacatgagaaatgctcagttgtttttatactgtcatacaggcacaaagctaggggtgattaaattttagaccgcaagtgtggactaaccgttattagtacaatatagtgtcagagctgggcaaacaatttaaataagggaaactggactttgttctccccatcccacccctgcttttttgttttgttttgttttgttttttgtgtttcttgtgttgcattatacgggcaagattgagatttttggtgtgggaggggtttttctggtgtccctcaaattcaattacgtaggtaaaggtggaattgatccttgttactcaaagtaagacttgtcaacaaactcagcattacctgggagctgctagaaatgcagggtctcaggttccactccagatggctggatcaaaatctgcattttaacaaaatccccacgtttattgtatgcaaattttcctaaacagagaagttgacagatttctaaaactaccctgatcattccaaaagactctttaggaagttacrgcttcaatgacagcagctgcgagatgttttagcaccacctgggagaacgggggattgggtgggggagaggggctatactaaaaaacaaaacaaaacaaaaaaaactatgctgctttctgttcccaaggaaacattttaggggtgaaaggttcatattccattatcagtcccctgagcccaccagtgttcaaaaatgtttttttcccaagacttttatggcacttaagtcagactgctcctattggaataacagaccaaaaatgactgacagttatagtgtctgggattagggagaaaaatatttagtgagaggaactgggagtttatcaggagacatgaatgatttcatctccaggattctggttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttacatgtaattgcgaattagccctcacttccagtcatggcaaggtttaggattaaatgatattgaactagctttccccttagtaacattgcttttctttgcaggatgataaagctaatttttaatcatacctcctctacagttttaataattatgacttttcttctttttcctcttttctttttgcctcctgcctggagtcctgagtaaaatttaagattgtgtgtgtgtgtgtgtgtgcccttgacgctatctgattcctttgagtattgactacacatctggactgtgctactaaacaaagttgagagtgttggatgatgtgaaataaatcaactttgagactagagatgagtggatggctcatgacaaaaatttcaggctttatttttccaattttgctataaattagttaaaagtttgttatggccagcatttgggaacctgtgttgcatcagactcagccttcattcaattatttaacatatattgatcatatccctactatatgctattagtattatgggttaggccattcttgcatacctaaggttgtgtaaattataaagaaaagaggcatttacccatacctgaggctgggtaaattataaagaaaagaggcttaattggctcacggttctgcagactgggcaagcatggtgctggcctctgctcagcttctggggaggcctccaggagtttttactcatggcagaagggaagcaggagcaggtgtgtcacatggcgagaaagggagcaaagtgaacaccgggagggtgccacacactcgtaaacaaccagatttggggagaacaaacttactaatatgagaacagcaccaagccattcatgagaaacctgtcccccatgatctcatcacctctaatcaggcctacctccaacattggggatgacaattcaacrtgagatttagaggggtaagatatccaaactttatcaaggaccgtaatggaaatagacttgtactcatacagcttacattttatcctagtagacatgcctttgattgcatagcttgaaaggttgaaatgaactaaattgagggttgtttatattaaataaagctattttcccccaattttagctaaacctctttttatgtaaagaaaaaggattttttttttccagtaagatttaccagtcaaagcaggaaatcattttgttacaattgtcttacaaagcagccctgtgcaaggctgttgctaatgttaagacttttcttgggggtctccgatagctgattctctctcgagaagtcttcctattcttggatgtagagtgttgctaaaaagaattagttccattttctccagagtgctctaagttatagctatttatcttttaaggaagctcctaagtatccacaggtgttcagccccctaaaatttcaatttatcttcagcacagccagcttttcagtgtttactataaggctttaaccacatggtaattcctcccttaaagaagtctgctgtatataatgttaaggcagggttgtcagggctgttatgctgtgtcccaagccaaatacatttctcarcattccaaggttatgcgaatacacagaaataattattttcagatgttgacattgcacttagtgatttagtaatatgagaaaatatggttcaaaagttattcatctaaaaagcaatgcaaaatatagtagagacaaatatggtatgcattcaggcacatactgtgaagtagaaatgttggagtgatttagctttctgtcataacatctttatcacacaggatatggacttgctatgatgtgagttagcatgtttcctctgacacaactagagtccagagatgtgccttgcttctagtccaataatcactttcaatcactgagccagacccatgattcgtggattctcttgtcacttaagatgttgtctttttttttttttgagatggagtcttgctttgtctcccaggctgaagtgcagtggcatgatattggctcactgcaacctccacttcccaggttcaagcgattctcctgcctccacctcccaggttaaagcgattctcctgtctcagcctcctgagtagctgggactataggcacgtaccaccacgcctggctaattttttttgtgtttttagtgaagacggggtttcaccatgttggtcagggtggtctcaaactcctgatctcaggtgatctgcctgcctcaccctttcagagtgctgggattacaggtgtgagtcactgtgcctgaccaatatgttccattcttaagtcagttttgaatgttaaaaaatgaaatctttacagtttcaaaatataatttttctgtaatgatccagaaaataacaataggacttttaaaaagggcttttcttagctttgcaagaaaagagataagagcagaaaggttcactttttgaagagamcaagactcactcagttggaaagttactctaaatttactttttcctaacattgatttatgacattcagtatgaattttgtctgtttatatccacatatcatgtagtcaacatagaaaagggaaaaacctgaatgaagttttattatactcattgattctttatatgcatgaaaggggaaattatcattatttcttaatagtctttaaatttctacggtagcatttgaggaaaatgaaatgaactccatttgatatatgacctattgcacttaaaaatattcagatcactggttattgctgactgcttataaggcaaaatrttttgattttactgtattgttcatgctgcgagcaaaatgggtgtctgctaagtttttattttaaaatgcatatttctgtctttaccttgtagccttgcaatgcgtaattcaaaatgtttgcaaagtacaagtttattatattgtttgtctgcttcttattataactttaaaaagaaaatgggacaccctcctctcaccccaccctagagacagattttccatgacagaatagttttaaacatcaggatattgcataagtcagtctggaaaaaataggaacagacagctagcactatctagtagagctttgcttttgtgacaacattttttgattaaataactctacataaatgataatttccctacatagtttgataccaatatctaagttgatatcaactttcaaaatccataattgtttctgtgtacattctttctgattgtttttatttgggtactgtataaaaaatgatgagaatttaaaagtcattgtatgatataaatccaaagaaatctaattaagctctgagtctaatgagtgtgagagaaacctgttcaagggatgtttcaaagagttaacattgtggtggggtatgaaaaagtgatggtgtgtaggatattgccttgctccaggttttacaaggaatagttaggatttaatttttggcccccaaaagacttaaattttaacgtaattataaggaaaaagaaattggtggcatggctgtgtgatcctatgggttgcttgggactgagtatagtgaaaagtttgtgaagtagacgttaatattcaaagcccatttcagaaaagttgaaatcagagcagtaagcaaaattattctccaagtcccttttaattttatttgctcacttaagccaaaagaactgggataggctgtatctttttcacgttacaatgatcaaactacaggggccaagtgcaattctattcatatttcttttcaagggcaaatctatttctcaataagtcacatcacttacataacacttcttgagtacttgtttactacagcctggacaaagggtatcaaggaacagtaggtttacttggtggtggagtctgaggaaaaataaaactatttgttaacagccagttgtttacaaggatccttatctagtttgtgaaatctttatccctgtgggatgaagagtgtgatctaactcattgtggaagcttagctttcttccctttctgctcctggagctagaggttttccatcagagatggatatattcttttgggattccttatcaatatgccatgccattttagaatgacttcacctatctcacctttgattatttatgagtaaaaggagggagaaaactacccgttttgtgaaattgtttctgacacatgaataaaacattatgtatcatactaataaattataatgaaattgtatgccaggattggatctaattccttgaattattcaacagtgaagctcagtaagttcaaggcactaccacaaagtactgttgggagtataatggatacataagaagtaatactggttaaaggaaaatagaacataattgagaaaaataaattctgcaaatatataattaagtaccatgaagcaattagaaactgtgttatagtccagacttgaaagagattatttcctgaggcaaagggagcattcatggagtagagtagtcattgagtaggatccttcrtggagcagatagtcattgagtgggttctgaagggtgagtggaatttgaacagggagagacctgagaaagacgtagtcgaaggcaacatcattagtagcagaagagtgaaaaaaatatrgtattgaagaagaatagtgcaattatgtaatgggtcataaaatggattagattgacaagttaattctcactaagagccaggtactttgctaaaataagcattttacataaattatttagccctcacagtaaacctaagaagtagaaatgtatggataaagaatttaggacatgatacaactaatatgtggcagcagatgaacttgaaaccagggactggggtcttgaccactaatctctgttccctgatgttggtatttggtactacagggaaggatggatatttcattctgtaagctgtggtcactcacaggatgtttttgagcagagtgagcaatgtgttcctcccaattactctgtctcatctcacccatccctctcttcaaccctgcctttaaactacygagataaaccatttggaattacagatctgatcatatagtgcatgtgcttatgatcctccggggcccacagcatgcatttcttgtttcttcccatggtgtacaaggccttgccaatctctatagcttcatttgtaactactttcctttctctgaaatctccttgctgtattcttctgcttttccttaggttagtgcctcctcctggatgacccttttgcatttctggatccatctattctgctctgcttttctcatttcttgtgaaatattgaactgcttattaaccttcttcttcataaaaatttgaaaatctgtttccagatttgtagttctacaccaaaatggaattcagtcattgacactacctattccatattaaaatggcttttaaaattatgtaatgtattttttaccccaaatttccagtgtgcgacccatattcatgacctgttttgtctattagttaggataggctaagctatcttgcagtaacaacaaccacaaatattgtaatggcttacaacaaaaaagatttccctcatgtttgtgtagattgaagggaagactgcttatcatagttacctctgaaggaagctccacttgacatgttctttcacaatcacataggagagggagagcacatggtagtcacacgctggttctcagcacttctggctggtagtgatgcataccacttgttcatgcatttcactgacctcgcatggcctcaccaaatgtcaaggagacagggaagcaccatcctaccacgtggctgaaagtgggagacgcayggaaatacttagttcacaccactgcaatgggttaaagatctgaaattgtaagacaattcttttgaaatttatgttcactagtagtttgtaatagtgtcgagtcaaatgtagcagtttggaagtgaaaactaaaacaatcctaaagaggtgagattgtatcttttaaaatcattatctcagttgaaaactgaatattgaagcatatgcttaaacttaacacaataaatgtaagcatttcatggccatggcacaaaaatgtgttaaaactatatcgttcatccactgacagtgttgaagaacaaagcagtgtcacagaaaataggttgcattattcttagaaatatatcatgctttgagggatccttttttttaatggaggtcatgatcatctttcataaataatttatcagttaatggtagtgaacagagtttgaatgagtcaaaattctacaatgaaatgctcctgtataggtgtaagtatataaatgtatatataaatatacatatacaaatgtaaatatataaatgtatatatttaatgtgtatttgcccctagtttaatttgtcagcagtaactgctggtttttatttctttttgcaagaaattatatagaaattgatttgagggagatttaaaataaatgtttagtgagaggaaatcttactctgtcctatctatggatattgataaactgtaccactgtattcctaactcctaacttggatataggagcttgactatctgcatagatacgtaaggggatatggctgacaggaggaattacaaatgtacttatttaacaattaatgctgacataagctatttgggtaatacctcatttttttttagaatgaatgatgactgtcagtgtgactgaggatacagacatgaaattaggaaatcgaaaataaatatctgtttccttcaaaaaatttgactagtcatttttttgactagctttttaaaaattgcataagactaactcttttcgtttgctgtgtgtacattaaatatgtctgtataggtccctttgctttcttttgccccacagtaattatgttgaaaattataaacagaggcattagcataaattaaggattaagtatggaaatcataaaaaaccctacttccatgaaaatgaaatttctttttgaaaagagaaataggtattattctacttattttcgtttagcaaattttcttatggaacatcattactctgcctctcagaagatttgccaaagtgtttaaaactccctctgaatgtttgtacttcaataacctattgaaagcacaactgattttgtttgtgctaggtttatctccatttaaaggcagactccttcggtgagctcccctgtggcaatatgagagaaggaaaagaaggagggaggaccttgcaggactggtttatatagcaggaagttaagagacaagagagctctacaattattgagcacaggaaaattgatttcctattcatagtagtgtggcacatgtagaggagtctttaaagatgatacagcatgccattcctttcccctccgttgtgtaatcaaccagccaatatttatcaagtacctgttagtttcacttacagagtacctgtagctgagttttcttttcttttctgctttctttatccctgctctctagctcctgacctgtccatcacgaatatcagttttccatgtgccttagacctgtcttccatctaataagacttcacactgctcacttttcctttctgacactgaatacacataawcaacagagagcaatgtctsttaaacccataaacccattcaaaaaccaaaaccaaaccaaataaaatgaattggttgtattaatttgtatcatccatttacattttgagaagcatagtcaatcagataaacttactgttttaattctaaattcactgactttctgtcagtctctatgttccctrtatgtagcagctgggttaagaatataattgtcttgacaacaaattattgacatttacgagctcaaaagttacctcagaagcttttgaaatyaaagaaataaaagtgttaattctctctgatctgaacaagccaggactcagtgtcagccctttataggtcaggctgtggaaggaatgcataggatgaaataccastgcatgcctggtgcactaaaactaaatgggatttcagcagatgaagggaaagggtgaggaatcaagccttaaattgtctgcctcaggcatggtaagaagacttggacagtaatagaaacaggaagtgtttgctgtgaagcttgagtatattcaaagtaaatcagtttgtgttccattaaggaatcctggctctaggttggagcctacgcgggatcagtaaattttgcactaggaaatacctaatgtcaagccttagaaaacacctcatactgtggccagctgtcatcaaatccatcgccactgctagtaaaataactccaaagcaagtgaaactggcagtaattgcacaagtaaacgggttgcaaaagagcaaaatgggtacgtttcagaacatcatttctgttaggctccatgttatactgcttacagtagaaacaaatggaagtcgagaggtgaagcctggcattaagtttactagtgatccaggaataactgttagcagctgggcctgggtgctttttccctgctttgtcctggaaagatttcacatcttaagggaaatgaactacacaccttgagaaaatttttttttctatcatattgtataaatctgtgtaaatctcattttccccctttttggagttaagtagcataattaactgtaaggcttttccaaatactttcttaaccctgaaaaactttccctcgggacttacagtatagccaaatggatatcgattattgctaaatgtaaatacatatgcacatatgaggtgaagctgtattaaaatatgggtggcagtgtctttaactcagatttgggatgctttatacagtcatgggaaatatcaggggatcaacttgaaattctttaaaagttracaraattttggaacgatcaaggaacatgggaatatggcctcaccttttctttctcactgatgacataaatgccgccctcactgtgttgtttattgtttcttccagataatctttgcatactcagtacttggaatatagagccattgccctgtactcattttttccttcctggaggtataaatagactgatgacgccctatgctctctgcagtctgtgcatcattcataccgtacatctcctttctaggtcacaaagcttttaaaaaaaatcagcagtggtagcagcatgtgagaagatgagcatatgactgactccttcctttcacctcagagccgtgcctttgatagcatccagacagcagtgcatggaaacatgacatttgggtggttcaagaatatcagagggaaaaatagccattcttaccaaataacttaaaaatagcatagtctgagcatttttcccttcgccctttctcccccaacgtgcctgaaatgaagcccttcccatccaaagcaaaactaggaatttgtgttttgtgagaatttgaagagcctgcctctcttactacaactgctttcttccttccaaatgtataagcttaagtcgtgagaaaatgtcatctgtctcattctgcttccctctctagtaaaataaaaatggtcatgctttcagacggtcatgtattattgagtgcctactgagtgaggaaccatgtgttgagtgttttgagatggggtgagggaaaacnnnnnnnnnnnnnnnnnnnnnnnnnnnnnnnnnnnnnnnnnnnnnnnnnatggggtgagggaaaacattatttttctgctttcctcgagcttcattatgtgttatatttcatggtatctaagccaacagttggcgagaaggctgatccttagaggtaatctcacgttcaaggaaggtcgggaacaaggttggtgagtagtggggacagagttcttgttaccactggagtttgtgtcctggatgccaggtatacatcatcttattctcttcttgatttgtcagtactttttagggaccattagttctctgcctactatgtgccagactctaccctaagcatttagaattccagttaacaataggtaaatcttctattcatttaaaatttcattctaacagctagtaatgtatttggaggaataaatgccgtgaagaaaagcagaccgagtgttatctataggtagttatgggagatgtatgttatcttatattggttgatcagggagacacaaactgataaaggggcgattgcttatttctctgaaagaagcaaggaaatgagaaccacctggatggctgagggaactgcagtccaaggagaaaaaacagcaagcgtaaatctcacaggtgagggtgcatcagtggagcaagggcaagagtgttatgataagaggtcctgaaggcagcagtgagaaatgccctggaagcctgtgccagacatattgaggagtgtggattttattctgataaagacattgcagaggagtggcatcatttcacttgctcttcagaagagaaactggaacacagatgggcaaaggaggcagcatgagacaagcctctctcttgcaagccatccggatgagagataacagtggcttggaggtgacagtgaaggtggtaggaggatattcttaaagtagagccagttgaatttgctaattgtgatattgtaaaatatgtatttggtcttcatccctgttttctgtcatacagctcctaaaacccttgataagaatatcctttgtgtgctaataagacgactagtggctggaggcccctttgtracttctggatgggggctggtcaccagaatggtcaggggattgggactttcagccccatctctcaacctctgcagggctgaaggttgtgttgattactaatggccagtgatacagtcagtcatacctgtagaattgaagcctctatgtaaaacctaaaggacagggttcagaggacttytggatagctgaacatgtggaggttcctagaaggtggtacaaccaccyagggaggacatgggagctctgcaccccttctcctatacttcaccctatgcagctctccaactggctgttcattcatatgctttgtaatttttttataataaatgggtaaataaatatgaaatgtttctctgaattctgtgagctgctctagaaaattaatcaaacacaaagaggtgggttataggatctctgatttataactggttggtcgaaatacaggtcacaacctgggatttggaattggcatctgaagaggggggcagtcttgagggactgaggggygatgctatgtccaggtggatagtgttaggattgaattgaattagacgatgctcagctggtgtctgttgaagaatctkktgtcagaagtgttgagtgatgtgtgagagtaggagaaacaatggtttttcctacattctcttacactaatggatttgtattcggagagattggaaagatggatctgtcatttmctgagatgggaagtcacagcgaggagcccattaaccatatattaaaactccattagtaatattaagactgtccattctagaagaggtggtggstcacgcccgtaatcctagctagcactttgggaggccgaggcgggtggatcacctgaggtcaggatttcgagaccagcctggccaacttggtgaaaccccgtctctactaaaactaccaaaaattagccgggcgtagtgctgggcacctgtaattccagctactcaggaggctgagacaggagaatcgattgaacccgggaggcggcggttgctgtgagccgaggtcgcgtcaatgcacaacagcctgggcaacaagagcgaaactctgtctccagggggaaatattagtgaagaggacaatattgtaacctacaaaaattctgtggtaggtatgttacttttgttaacagacttttctgaataaagtactccaaagtaacttggagttaagacattttaatattatgccttggttttcaaaacatgaatggtttccttctcttttcatgaatttggatatgaatgcaggcacttacctacgtaatttctaatattgatgatactggtgtttcttaaattcactaaaaaattttatttgtaaagggtaacctgcgttacattatttaaagtttttattttaaggtttttttttttttttgagatggagtcttgctttattgccctggctggtgtcaaacttttgggttcaagcagtccccacgccctagcctcctgagtagttggaattaccacattacattttgaaagaagagagtttacaaatgtctgtttccatgcattttaaaagaggtcttgttacaaaagattcagttaatctctttaaatggaatttattttggtttcctacttcctccattaaagtacattaatccttcttaacatatgtatttatcacctgctggattgctaagtatgtaaaagctactttgtaaaagcaatgccgtagctaaaaaaatgtattgcatagcagccaatgtgatttagccatttcaacattgcattttattaacaggacactccagacctaaatggtgaaaagatttcccactcaaattgtcccctagcaagagaagattggaatatagaggaatctccttttctcctcgtgattctgccttttgatgaagtaataatctgtgttattccagttcttttaaatgttaattcattttaacagttgcttcagaaaataaaattttatgaggcaaaatacagcaaartatttcaacaccacatttttgtttttccaaccagagtttgtttcatttacagacattgtcatttattttttatttttattcattttttagaacatcttaaatttttaatcctttatttacaggttgcctagacgacttttgattaagaaaactgtagaaagttggtaactgccaaagtggtaggcggtggcacgtgtcagtttccacagagtccttccatgtggggtatctgaatgcactgcacggggtctctgctcacacttactggagccaattgtggcagattttagtctacaagtcgcttttccccctatttctctgtaaacttcagcattcttacagaaatatttacagtccttagagtattattcagctaggtcagcctgaagtggatgctcaggctgggggtcattcaccagtgctgtgagggactggattacttggtcagttttggttgctggcttccagttttcagcactaatttactggcagagagacctgccccttttagtggacatttgggtgacagatctttaagtgtgctcttcggtggtttgaatgggtgctctgctggaaagttgatttcgattctgaaggcccccttatatggagggttgtcaggaacaataagcccttgccaagtcaataaattagctccatctacctggaagttacggaagtttttcattccacaattgcatatttcttcaagctccttcatcagccttctgctggtgccgtcttggatttgatgctgctcctttcccagaatgcatcgcagcccaacattgccatttattatgctttattttgttgagcttgatgctttgcattagtttgtttacttattcaataattatatattgagtgcttactagagttgtctagtttctcaaaattgtgaggtttatgctaaacactggggacacagcagtgaatgagacctagtccctgtcatccaggggccaataggtcacagatgtgaattagccctttcccttgacttttgggattccaatttcaaagaggttgtaaaagagasagtgccatattcttgaaccttttagccaactaggtaaaaataaattttcacatatttctattgagcccactggacaccaatatactttaataattgtgtttaaaatagaaaactccttcarcttgaagctgtcttttatttgagaaaagtgaaaaagagattcgtgggatattataaaagatgaacaagatgcctaaaatggacaatgctcctttacatgttactttaacatttgagagaatgctatcaaaatgcagaactggctaaaagtgttagaaggagtagttcaagttgtcttcaaccaagagtcatctrgaatttggctgcaccctggtatatcaaatacgctgtatgggaatgtgcttatattttgatgagtaatgtgtttttataacaaatgaagatgcatgtcagaatgttgagctggtcaggtctcactagggatttgaagaatagcataacagcaagtgggcaccaaagaaaaattgagtttacttggatacacgagaactctgccttctgacttggtctgagaacttgttcaaggcaagaaacagtttctaacttcagctgaatcacagtgtgaaggtgaacaagtaaaaaagctcagttacctgcagaaagttgcttgcagtttcagttttacaaagctcactgtttaaatctagtagttaccttttaatcccttcagatatgtcagcaaaaattctagtatttggaaatatgccttgatcacttgcaaaaggctctggaagacagaagtcatagtaaagtgtcaggtattttaagaatctggttcaaacttccaaacaaagaatgtttcagacctcagtgtattaacagttttcctaactattcagttattcggtggtcttttattttttatttttatttttttcgaggtggagtcttgctctgtctaccaggctggagtgcagtgctgccatctcagctcactgcaacctccgcctcctgggtacaagcaattctcctgcctcagcctcccaagtagctgggattataggtgtgtgccaccacacccagctaatgtttgtatctttagtagagacagggttttgccatgttggccaggctggtctcaaactcctggcctcaagtgatccgcccaccttggccttccaggtctcaagtgatctgcccgcctcagcctcccaaannnnnnnnnnnnnnnnnnnnctgctgggattacaggcataagcaagtacacccagcctcattaccttatagtttttaatttttttgtgggagaaaggaccagtgacttttttgaatgtgagaagaatcccaaagcaaaaggtgatttatttcctttcctttaattctgccacaatacacggcaccccagcatctagaagaatcttctcatgtgtgagatgaatgtgtttgacttcttttggaaagagtcagattttatattcatttagaaatatctgtgcctataacgtggttgcagttgtacatggcacacagttgtttatttaactgtgtttcatcctttcatcttgtgtgggatgctcacacttaaccgcatttctcttcattgcawagtgtagccctgactcactggctcttcatctgatcagtctgccttgcttttgtatctgaacagtatctctcatcacctgaccaaaatgctctgctccgataggtctcagcttagatgttacttcttggaatgcttccctggacaatgctttccatattcacaaagggagtacttaatcccagtaaaatattagtgctcctgaattgtgtcattcctctgcatgcatcagactagttctcatcgtggttcatatagtctaacgcgtgcagatgcaagattagtctctgtcttgttcattgttcttcttagtgcctgatttagcacatgaaatatagcaatcatgcctaatgagtgtaagtgaaacaaaataattttttagaatttggaagtcatttgtcttaatgtgtatttttctcccttttctggtcatcagcattagaactgaagtcatcttcaatatctctctctctcatcccttcattaaatcattcaccaagttttgacagttttcctttgcaatgtgtctccaaatggtcatcctcttctcctttttcagattaggattcttgttttctttactcattggtaaaacaagtttgggaaatgctagttacgcagttaatggtgtagttaccgcaggacttgacaaaacctctaatgaaagaataaaacatttgctatatttgtttgatcagagaaacttttttccatctcaggggatcttatgtggttaatgatctgcaaaacccacctgggggaatgctggtagaattgtgcaacagtcaccctttcatcacgggctgtggatcatttgacttgaacttaatgatagacatcagctatagacagcaaacacatggaagggaagcatgccagccccctgacactgaatggcttctgaccctcgcactctttgggtggctcagaccatgttaccttgattaggtgaaggggccccaagtagggaattatgcaccttattcacctgctaaagacactgctaattcttcttgcagtacttcctcaatgctgtcttgataagatttaaagagttttttagcctctgcctttaggcaccttcagaaagaatgccatgtactcctatttaattcctgcctacaccactgttttgaatctgtaggtgcaagggatttaaaagccaaccacaatgaagttgagtttttgtttcccagatttgtgattgactggttttggatgacaaacttgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcccaccttggctactcaatacctgggattacaggcattgagccactgtgcctggcccaaacttgataatgtagaagtcatttgctgaggtaccagtatacaggtggcaaaaacaatggaaagagagaacgatgatttgtcaagagtatctaagaactaagtaaaatagaaagttcaattttcacttaaaggagccagagaggaaaagcctgtaaaatgttagatactttttgtcattgttttgaatataagtagggatcatgttcgggaaatcatgttgttgacacattgataatcccattagatttttccagttgctccgagtctcccttcctggctctgtttctcttacatctcagattcgatctatctgaaaattttattccacctgacttcaaaatagctagagtctcaccatttaactatctacacagttaccatcatctgttgccggaattatctgttgcctgcttccactcttgcctccttacagtttactcatcacgcagtggcagaactaatcctttgaaaggtgaatcagaccatgccatttctctgcaatcttgcaattgccccaactctcattcagaagaaaatttgacattcttcacccaggcaatagacatcagctatagacagcaaacacatggaagggaagctcagccgtcatctgtctctgtgatatctttgacctcgtgttgtaacactttccccatttactcactctagtcacatcagctcctggctcttgcttgaacccgttaagcatatatctttaccttggattttttgtgcttactgtttcctctgcctggaatgtacttttttccagtgtacacatagattattttttcacttccttgcctgtgctccagttttcctcatgaatacgcttaccctcaccactctrtctttacctaactgtatttttctgcagttaccagctgacgtgttattgtttgtattaccagctgacatgttattgtcttattggctgccttctttaactagaacgtaagctcagtaagaggagggctttgtttgttgtttgtttatttattaccttttaagttcaggggtacatgtgcaggtttgttatgtaagtaaactcaggtcatggaggtttgttgtacagattatttaggcactcaggtattgagcctggtacccattatttatttttcccgatcctctccttcctcccaccctccagcctccaatagaccctaatgtgtgtcattcccctctatgtgtccatgtgttctcatcatttagttcccactcataagtgagaacatgtggtatttgattttatgttcctgtgttagtttgctaaggataatggccagctccagccattttcttgcacaggacatgatctcattttttttatgactgcatagtattccatggtgtacatgtacctcattttctttatccagtctaccattgatgggcatttaggttgattccatgtctttgctattgtgaatagtgctgcaatgaccatacatgtgcatttgtctttatgacagaacagtttatgttcctttgggtatatacccagtaatgagatttctgggttgaatggtagttctgtttttagctctttgtggaattgccwcactgctttctacagtggctgaactcccaccaacagtgtataagcgtttctttttctccacagcctcaccagcatctgttactttttgactttttaataatggtcattctgattagtgtgagatggtatctcattgtggttttgatttgcatttctctaatgctcagtcatgttgagctttttttcatacgcttgtggccacgtgtacrtcttcttttgaaagtgtttgttcatgttctttgcccactttttaatggagttgtttgttcttttcttgtgagtttaggttccttacagatgctggatattagacctttgtcagatgcatagtttgcaaaaatgttctcccattctgtagattgtctgtttactctgttgataatttcttttgctgtgcagagctctttagtttaattagatttcattggctttatcttgctcattgctaaagaatagtgcttgtagcaggattctggcatgtagtaggcaggcaccagatgcttgccaaataaattaagatgaaagaatgtgagagcaagccctcttgtttgttatggaattcagtatttactaggaaagggtaggctgcctttcagtaaatccctgtcatgtctctatgtttattctaaaattggtaagctttctaaccataaacaaacagataaacatcatattaattgttcctctcctatttctctccttttcttttgtagcatgatgtttttgagtattcaaaaacattaaaaagattgggaaaggtctaagaggtggagagtagaataatccattcagataactcctcttgggtctacgtgaacagattttaggtactgttactgtgtgatggatctgaagctttcctgcatcaaagcgttcatccctggaacattcctatcaatgtaacatacttaatgataaattggcatttgaccacaatagatggtatttttccttaattaaagaaatacatgagaaaaaatgttaaatgttatgaaatgattaaaaatgaactgtccattttaatatttatatccaggacgtcgcgacaacctgtagcttccctcatgaagggatcatctctttcgcagcactccttcgatgagcaggagagtgtatattttagaacctttagagagaattggaagcatttactacgttttcctttaaataagtttgctgagtgacaggaacaagtcagatagcttaagtttgctaaaatacataagcaggtagaattttaaaatgctgaattttgtaatatgttccctgggggttagtttgcttgtgtaatatatcataccaccaaggagatactatacaacaaatctggggagaatttaataaaacaagtattagtgtttcacattcaaaccataaagttgacttcttaggaaattgtatgccccaaatattgatggaaacatgtatctctctgtattgcagcatgaaccaaaccctatgtaaactaaatcgatagctccaaagcaaaaccaacttataataacagaccagagttccagtaattaaaaacgtgacctactctgtacaatactctagctatattaatgtggtaataaagaattattaccaaaaattcgctggaaatgcaattatgtatatgtgtgtccatgggtagagttgccagacattgcatgggggtgcaactagtgatttggttatttcagttcttagaagtttaataatcctttatagctcccttttatctttacagaatagcacttgatgactggtaaaaagaattaacgctatgggcttgcccacaggaatcaagcaaagggcgtatgcttttggatgagtttgccagctggggaccatactgagaataacggttctctctcggactaagcattgagatgctttgtcaagtatccttagcttctgctttctcttcccttggttgagttataccaaagcctccttccgggaaatccctttagtccttttttatacagtcaaatcaaacacttctttatcagaagtgcatctatgtccaacaaaaaacaaaaaccacataaaaacctgacaattcacgtagcaagaaaatttcaagcaaaatctaagcaaggacattggcaaaggaattcctttctaatatgaaatacactacagaaaaagtattctatttcctaattctgagcagggaaatttttctatttattgttattattattattctattatatattattctattctaaattttctatttttttcatttagttttgctcttaatattaacattgctatactgagaccttaaatttatatgggtagcttagatttttctagggctcccaacagtattatacttgtagtatttcacttatggatgaaacaaggcgtatatgaaataaaatttatgcatatacatgcatgtaacacataaaaatatttgcatatatgcacaacttaattcctgtgttttatttttcgttgtacaaaatattttaactgtaattctatatacacacacattatacatataaattattatataatgttatcttagtgattgacccagaatagaatacagattttcttaagtttcaatgcaactagatagaaaaggatataatgtctgtattcaaagtaagggttaatctacttttggtaggttaaaagtagaacattttcttatctgagttattatatctgttaaaaaataacttgtaacataattaaatgtgtcatagttggtttattgcaatgctgtaaaaatttttttaaaaagaactgaactatgccctgattaaattaattaacgtgtcacatagattgccatttagaaaggttatttccctaaaattgctgcattttgagcctatcttytcagtaagttttcacaatgttatttatacagttagatattatgattacttttgtgattcgtttagatactaactttactaattgacagatatgatcatttaccttttttcttcaaaaatatttctagattttttcttcttcatttcagaaatttgaatcattttatatactagtgaattttcatcattttgtatatgttcatcttcacatagatgcatttattatttataaagcagttannnnnnnnnnnnnnnnnnnncagtgcttggtgcctttgtagctttgcctcaagattgttaatatgtttccctgaaagtcctactattgattgactcatatatgcctctgcagttcccatttctatctgatgtagtattgagtttgttgccactatttccttgttttttcaagaatagtccttttacttatcctcagttttatcgaggtatataaatattaagctttccaaaaaaaaaaaaccaattttgggttgatgttagacaaatctttttgtataggtttaagagtgtgctgggttacattttagaaatagcatctgatcagtagttctctcccaccttcttactaatgtgcccttagaaacacaggaaaagatgtatgcagaaaactgtggtgacattcaacctactgcctgcctgggaggagttttcactactataagcagaaaaaactggcaagaatgcctttcttgtctttctacctactgtcagacaagtagagcaaaagaaagccccccagagaaagcccctcagttttgctctacttgtctggtagataggaagacaagctgtccttcctgagagtcagaaacataagattcagaaacacagagctattccagtgaaaagcaaagacagacattaggatactgtccattttttgcatggatacagcctttgaggccatcggactgttgtctacactacattatatagtcattaacatggtgttcactgtggttcacagaatgattgaaaaatgcttatagttaaaccttaagaaggcacagaatttgaatttatacaaaaagaatatgtaagggtataaaaatatgtaaataaaagtgcctagatgcaagagtgatggaaataagtcaaatgttagcagtgctttcttatcagatggagaaattatggaygacttttccttcccagtttagtgtttctttgtacctctgaaaatttgtacaatgtacatctgttatttataattttgtacattgagtgtgtatcaagttactgtttaaacaaaaggaaagaatgggtagaaaatataagacatctatatttttataaatactttttaatatccataatttcatgtaaaattttcaactatcccggaggtagacttttattgatattttagagttatgactaggatagttgtgaaatctttccaactccaaaccccatggtcctcctactataccttgttacaaacagaaaatcatccttatggaaagccttaaaggcagaaaatatataaaataagtataagtatgttatgtgtataaagtaaaaattttaaagacatttttgaggttattagcataatttctatctttttaatttacatacaccttttaatgtgtttgttactagtgatatatgaagaaaaaataatgtataatttcaccatcaagagattgttttacattgtagagcatgttcttcatattttagtgtgtgtacattcatacatatacattcaaaggtttcatagcattaatctgaaatatatacttcaaaagttttcaatttagtaccattaatgatgggaagataatatacttttgagttataacggttttattgtgtatcagtagggcccgctcagaaaatcagaacctactctaatataagcagtaagatattgaatgaaaggaatcaattacagtgataacagaaggactggaggtacaaaagagagaaagggctgttatccaaatatcagaaggctattaccacccaaggctggaggccatgaaatagtgtttgatactgagttgcaggagaggctggtgcttctgctgcaatattaaaacagcattgtgccattgtggcatagcagtcttctaggagccaatactactaatatctgtgaaactctcaggctggataccatagtcacctacggtggctgtcagtagccccctgctgctgttacctcagcagaaaaaaatagcctatacttcttccaccttcaactctctaatcaatgcctcccactggcaggacctgacaagaagccagctggctaaggataaagaaaaatgtagtttagagtcttcctgcctyctgtgaatcagaaagatggggatggagttgatggccaataaagagtttgcacacatttgttcattaattcattttagtaattttcttctttcatactgcttgttttaataacctgcaagtaaataatccacaataatgtcaattcattggctgaaagcgtacaatgtaatttattaaaggcaaaatattgttaggaaatgaataattggagaaataggatggtatcaagaaagatatatgtgcttttctgaagcatctcatacatagtttataagaagaatgcaatatgaaaaattaaaatcagataaatctttaagcttttggaataatatgaaagttttatatggttatggcatggtagaattcacataactgattagttagaacaaagacaagactactttttcattatggaaagtaaacatagtagtcttctcaagattattagcaaattttccttaaaatgcttgcatctgaaaagatggcttcagcctgattattttaaagcctgtgtrgttcatcagtttaagtagggaagtggracttggcgatctcagaggagttctgtagcctccatgcccctgctccccccttttcatggctcactactgccattcacataagcaaacactagcttccctcagtcattcagatcatggatgaatgccattctgtgttagcttaaccaccatcattcttgataaaatataactttttacctgagtaatgcatacctagtataataggctacagtatttcttgaaatgtagagtccgtatcagtggtggtataaaagattgttttacatgcaaygagatatgctggtatataatattaagtgttttgctaaattrtttgcctttcatttctactctaatgttactgattaagataaggggagcagatctcaccttggagctaggatgctttcatgtccctccaaccctcactgattatctttgtaacagagagcaggcctcaggctaggagtgtttgtcagaaaaaaaaaaaaaaaaaaaagaggatcttgtgagaattgaaagagatagcattgtctttccttgactttagttttatggccactttgtacttatataaagtattactgagtttccatttaagtagtgacataaagttttaaaaaataaatccaattggaaasaaaattttatttatagaagactaagtgtacaatattatgggtggctggtccataacatggtagaatcaccaaggtaattgctacatgaataattgaaattttggaagcagtaatatatatagcacatttgcttctatctttttcttctttaattttacataaagatataaaacagaactataggcttatctagaaaaattagataaacataatcattcatctacttctttctctaggtaatgtatattaagctttgggcccaacccagtaactaaatgggatgatggtgatgacgattattattgattattgttttcttaaaagccrtgattcctattaaaatactcttgtagcaaattgtaatgaatttttcccagttggtttaccaagtgcgtaagaatcagatatcagtaaaaatgtcaaagtatacatttataatagcctatcttttccccagaatggcttattattatctctctgcagtgtatcagaatataaatagtattagaaggttttaaaaatatcaattagaatgggaatgaaaggaatactgaaggaaggaaaagagatgaagtgacgaagcacttcttttggccactttcctgctgcatgtctcactttgggtgctacttagawgtagatagagttggcaccaccaaacagggttattactaatcttggatctcacatataacttttaattttaggttgaaaatatgagaaaagtgttcttctcattgacaagtaattagccccagaatttccaaatcaattttgaatatcaggaagattaaaaattgaactactagaggccaggcrcggtggcttatgcctgtaatcccagcactttgggaggctaagatgggcagatcacttgaggtcaggagttcgagaccagcctggccaacatggcaaaactgtgcctctactaaaaatatgaaaatcagctgggcctggtggcttgcacctctagtcccagctactcagaaggctgaggcaggagaatcgcttgaacctgggaggcagagatttcagtgagctgagattgtgccactgaactccagcctggtcaacgagcaagacttcatctaaaacaacaacaacaaaaatcgaatttttttttggttgtttgtgaagattagggtcagtaatagaccccttttaataattgtatttttctcctcagagtggccgtatagataattctgatttgtttgctctattttaaattttagtttgattttttggattttaaaaaatgttattttcaatgtctgaagtttttttattcttcatttactctaaacatttacttcaagctttcatgcaatttggtattcatttgttaaaaacgtcttgtaaaatatcaacatactttaagaaagtaaaagctatactttttttttttatgagtcagcatctcactctgtcatctaggctggggtgcagtgcaggatcatggctcactgtagccttgaccttccaggctcaagggatcctcctacttcggcctcctgagtataccaccatgccaggctaatttttaatttttttgtagagatagggtctccctgtgttgcctaggctggtctcaaactcctggcctcaaacaatcctcttgtcttggcccccgcaaagtgctgggattacaggcatgaaccactgcacctggcaaatctatactcttgattatgcccatgataaattatctcagttataggacatcatctgtgtcaatctaaagagaggaataagaagagtagctattgccaccaatgagactttttgagaataaacatgaaaataacttacagatatttttaagttccaggtatcaaaattgttatagtatgaaaagcaatagagtagttgtcagaaaactttcaactcatcagtgacagagctggagataaatatgtgctgtctgtacatctccacttctttataaaatgaaaataattatcttttcctttgctacctcactgtgttttttgcaatattaagtatatagataagtaatttgtatgtatttttaaaactcaacataattatgttatacttgttatttattgctcaaatcttaatgctatatacctaatatctaagcatgttgtgatttattcctagatgaagaatcatctaagcctatggtaaatatatcaaaaggtattattttgcttatatcatagcaaacaatctctagagctacaaggatgtatagctgcaaatagaaaatatattttctgaaagattagtgaatctgctcttgttgttttcatatttctttcagtagtctctcaatatatttttaaatattacattttctacttacaaaagtagtatgtacctgctgaggaaaatgcagaaaaacattaagaaggggacaaaacatacttaatcccacttcccaggctggggaactgtttatattttggcatagttcctttgttttgtgtctgtgtgtttgtgtgtatatgtattgtatatgcgtgtgtaattcttgttttagacttttctattttacaaaacgaagaccatatggtataaagaatgtggacaccctttatagatggattttccacttaatttatttctttatctgaaaagcagaacctttaatattcattaccacttagtttaggttgttaatgataatgtttactaatgatactgttaggctcacagttcattttatgttgtaatcattattctgcacttgccactagatggctctgttctcagagtgactatttttccaaaagaaaaagtgccctgtatcattgaaatgatgggaaatgttattgcccttattaacattatatggaatgcacacaaatataattgcataataattcaacagagtatgcctgtgataatttaaatggtatttcaatagatccacaaatttaatatatccccttcaaaatgagggttatatttacttagaaagcaatatattcacttaacaaggttcactgtcacttagtaaatcaatattggaattattttttcagctctcgctttttatatcaataactttgatattgagtaagttgttttttcccattgcttggctaattkttatcataattatcttttctgtacttcagtatgatgactgtccttctgtaggcccaagaaatatactctatataagtaagattttcttctggatggctattacggtaagatgttttaccgtgagctgaatcatgattactctcaaagccaatctggtttcaggtgggtcctaagcccatgctaatttctatggccaggattgtacactatgcaaattttcattttccttgaagagtgagtgcaggactataaattgctgacgtgggattgaataaaatgagacacatggatacagacattagtttctcatgtgcaaagaagttgtggtctttgtttatacagggctttctagacatacccagctatttaccatccaatcatattttatagagagaaaaacagatattttaggataaacattctcaccacatgatgaactgataacatggcacactctatttatacccctagcaaatctcagtattatgaattaagaagcagttacatatgagaatatgaaattctaaaaatgaaattagaagtttagccgttgtgcataactcctgtgttttaaggttcatcataccccatttttattttcaatttttaaaaaatatttagttacatatagttcattaaattccaggtctaagttcatcaaatcttcctttctgaggataaaagtcgatgaagttggaggttgcttaacaatttcttctctttaatagcatgtcatagttttcatttttgcagaatatgtattccaagaatagagtagcccttatattggttcatattacgttgttggattacacacgctcattcacagctctgatggtaaaattttctaccaactccccaagctaagtacttacgtgtgttagaatgttaattctctaggtaatttttaaaaatttatttattttattttatttatttgtttatttttttgagacagtctcactctgtcacccaggctggagtgctgtggcacgatcttggctcactgcaacctttgcctgccaggttcaagcaattctcctgcctcagcctcccgagtagcgggactacaggtgcgcgccactgtgcctggctaatttcttgtgtgtttagtagagatggggtttcaccatgctggccaggctgatctggaactcctgaccccgtaatctgcccgcctcagcctcccaaagtactgggattacaggcaggagccaccgtgcccagccagtacttttattttaaaaatttaaaatggtagcatgtcctaaataaaataggaaatataaaagttgaaagtcctggagatggatgaaatagggaaagaaggtaggacaaacagttcctacttcttagaacttgagagactatatctaaaagaatattccagaacagggaagtgttataaataataccaacttgtgccaaaaaatattactcatcttagatctcccttttggggattttggatcaataagaaaccacgtttcaatggaagtggtgcagagcccgttgcctagtgtgaagagccaatgaactaagtcagcaggttaaaacctgaccccctggcccatttatttttctgtctttgcactcttgaaaagcatgttccctagagatctatccaaatagtcactggagtcctgaggccccaccctttgtccagtacactgaacygtgttatgcaacatggaaattgttcccattccaatgcctgacagccagactcttggaagacaagcaaagaaacaggatgcttctacggagcacaaacacttagcactgacagctacaatctgtgaatgaaactattttttatatgagcaaataattttttaaaaatccaaatattatgaagcatataaacaaaggttctaataattaagagttcttgctgaatgcaaagcaacaattctcctgtgtttcaaggaggagaggaagaagtgaatgagatacacagatgccattcagtagaccatctaacagggtgcgctgagttgtatttaagtgattataatgtgatataatgagtggtcatgagtaatacttcgaatgtgaatgctttttaaaattttcagtgtacttttaaagaaattatttaaaagttaaattatgactagtgtattatttttaagtgtctcatataaaaggcaattttgtctctgtgtgtttctggctctgtttttcagtagttgctgttctagagaaatctaatgtgaatataaaaatcacttaatctattaataagtatgactatataattgtggctttgtgtgtgatagacgaagtttgaattttaggataagtgttttcttttctttcttcttagccatcaccgcctgtcccagttactaaaggtacctctcttttcctctcatcaattttttgtttgaaagataaatgagatcttcagtgtgtgcttaagtcattttatagttatgagtgcaaaaaataaattgccatttgaactccagagttgaattcaaatttttcagaaataagcacatattttatttgttttttgagacttctttgtttttctcattgttgggtgggtagccttttttatatatgccttccaaagcttctttcctgattgttgaattacttatatgttagtttaataggtacattaattttttctatctaattgggagtgaaagaagactgctgttaaacatgagttcttagttattggttgttttcatcttttaaaattttctgatttgaggagaggcagatagacttggttaaaatgatggattataaatatgtgaaatgtctgaatgagatcctttaacaaagaaaataaaaggaatgatgatgcttttttttttttgtatatctaggaatctttatttctgaaatgatttatattaataaagatagtgtaggaatgactttctatattcctgcctagtattctttctgttaatttatactctagatgttgtcacaggaaatgacttataaaaatgtatttattatgcttgcttatataaaggaggatttttaaagtctttattttattcttgtatgtgatacactattaaaaacattgaaatatacatctgccgttatcttttactagattttgaacttcttccacattttaaagatatctactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaaaatacaaaaagtagctgggcatggtggcacgcgcctataatcccagctactcaggaggttgaggcagaagaatcacttgaacccgggaggcggaggttgcagtgagctgagattgggccactgcactccagcctggcgacagagcgagactccttctccaaaaaaaaaaaaaaaaaaaaaaaaaaaaaaaaaaagagttgcttaatggatgagaacgtttcttgaaacacttataaaattaatagcacattttctttttgtagccagctttgtgattttgtcccatatgtttaaacaaattaaatagcattgtttaggttttaaaatagcaacattgttctattaggattgattttgatacataaattcattatgacatttatttttccatttgcaattgatttctgagtcttccctttcataccctgagctgtctcagaatcatgctttctttctttttaataacattttgcatgttatacattttacatttgtatgtgttgcttcttatcattagtcttttgtcttaaaattagaatggccaatgattatggtctgtacttgcctgtgatcttgagcaagttatttaacctctctgaatctcattctgtaatctgtgaaattggcccaataatgagggatctataagactgattgtaaacattaaattaaatgataaggatacatgtctggcatggcattagaaatgtagtaaattcttgctaatcatggttatataaacatgccagagatgattcaaattacactgacagcaagggctgcctggtctttcaggttacactgtgcttccccttctatacacagcttccctgtagctcccctctatacgcagctccaagcatgccagacctaagataattatttcactgtggttattgtgacttttaacctaacttctgttgagagaaattaaaaacaagtccttaagaattgtttgttcactggatgttagtagtgggttggcaagcactgtaattgggttttgtaggacttctctacacaaagggtggaagagccactaagcatcctctcaaagtttcaaatatattttctggcaggagttattttgttaaataattctagaggagagtttactaagtagcttattttgcaaactgtgaggctgccactcagtcactaagtgtatcattaatgtggtctaattatctgagccctcacaattccacactgcactggaggagaagtccaaagccttgaagctcactgcctcttctctcatttcagaacccagtgatagtatgcttgagaattactaaacatcaggtataaggagtcagagatgctgaacagaaatcacatgattaccattattattttatatgatttttgcagattttgagacatatttgttcatatttaacccttaaatacctctgagccattctttaacacagaatgactgatatttttcaaattttcctagccaccgtaataatgaatacccttctagttacttgggtgaaacatccaagatccatttttgcctgccttctgaacttcattccttacttttattatgttgtaatatcctgccagtttcatgtctgtcaactcctccctatgctcgcagtcgtagtccatctagtcattctccactcagatggttgtcatggtcccaaagggtcttctctttctagcctcccactctctaatgagtctttgaaattgccttcagagttactttcctaaaatatgcacatctgcagtgtacttatttggcatagaaactggctactttgaatttaatacattaactcaaatcctatgttgtcgataataattatttaggacctgtttcagtttaaaaacaccggaatctcccttctaataaacatgggtgcctttatatgtttttaaaagacattgcatactgtctagagtaacataataaatttttaggtacaacatatatttttgatgacatttgaaaggaaatattatgtgggtggaatagggaaatagtaagttatctaggaaatgaaaacagtaaattatttaacacagcctaacagtgctataactgtaaataacactttagttctgaagttaaaggtcagtgttcagaatgaaggcagacaaaatagatattcccatggcagaactgttctttatggactttcaggaaactctaaatgacattctctgccaataatgactctgggaaattgcatctccttgttttctgaatttattaatacttctatctccaagtcttcctggaaatcatattttaatcttttttttttctgtttttttttcctatccctgccacatgtgttagcaaaactcggattgttttctcttacataacactaatcattcagtatcctccattattttagttgttagggtcatttttgtttttagtataccagaactttgtcttaagaaagaaataattgtgttgatggacttgatggcacaaaacaggagttttttaagtgggaatggaaaatagtttttattttgaatgttgttctgacttgaggtggaatactatattaagagggactctgaggctctgagttcagtgggaaagagggaagtgagaattcatcatgtctgagtgggacatctagttgtaaagggggttgtgtcccagggtttcaagtatgaacactgtaatgagaggtttgaacctagaaccacctgattacaaagcttacatcctttaatagctagtctggattacccctcataaaaatttgcaaatggtcaggaaagtgtgttataatttacaacacttttccacttgaagtattttagrcaggactagggaacaatgtaaggatgtaaaagtggaggtggtagagatggggtttatctcttttcttcttaaataataatcttggaattatgaatctgtatgcacgaatcttgaataagcatcaaaatctttctaaaactttcacagtgcaatgctgtgggttgcattgtgtccttttccccccaacccgaattgatatgttgaagttctaatcccttatgtgatggtatttggtgaaggggcctttggcaggcagttaggtgtagatgaggtcgagagagtgggccctcgtaatgggattagtgtgtttataagaagagacaccagagagcttgaactctctttccatgtcctcacatgtgaggacacagtaagaaggtgtctgtctgtaatccaaggagcaagccgtcattagacaccatccatgctgccacctagatcttggatttcaagtctccagaactgcgaaacaataaatttctgtgttttaagccacccagtctacaatattttgttattacagcttgagctgacatgcccattcccaggttttaccctggagattgattcaacagttctggagaccagcctagcatttgaactcttcagaatctccatacgattttgtaacgtactcttagggtagagcgcaaccaaatttttaatttgtctacaagtggttttcagccttttctgcacattaaaatctttggagcttttaactatgattgattgagaggccccatccgtgatcaattaaatccggggtaaggtcaggtactggtgttttttaaagagctccccaggtgagtctaacatgtagccaagcaaaaggaagaaccactggcctgaatttatcccttttcctctgttcttctgctccataaatcctagtttctagaaatacggagtccaatcatgctctctcttcccctctgggttccccttacatctcagagtgccattgctattattttctgaacagcaaatccatagtttcaaaaaccatcttttttctgttgcctcaagttttccagtactttaaatctcagaatgaggactgtaaaagtaagaaagtaaattgattttctaggatgtttggattctgggcaaattggtgttatttatttaaaactccacatttcaaagatgtaatgggttttagattttataccaaaacaatatttgatatatgatgcctttctaaaggttatctttctgatttttttcccaaaatatatttattgaatacttttttgtaatccctccyagctactgtgttggcactcaggatgtaaatgaaatggtaacatttagaatattttttaaccagcgtggcattgacgcgattggtcagaaagaacattgattgtaarccaccctatggtcatcctggtgcattttggctctgaatttaataccaaaagaggcagctacatccccaccctcttaaggcttatggttccttgtaaagtcttgtatttgaatgtatgttgacatgacctagatcatttttggatactaccctagagtatctgatacagtggatcagagttggggctcagtaatctgcattttcaacatgtttcctaggacactggataggaaaagacaaccaggaagggattactcagttgttccataaagcaattcccattgtcttcagtaaactctagccaactacttgcatattccttttatttctttcagggtgttttctgtggaaaatctctacggtctgatagttggcatcctggcagttaattttatggagagttagcttttgtacattcctacaacatcggctcctcctttccctcccactgcaaaccccagtcagtaggagattctagaaacttgaagagagataccactttgtttttcttcctaaaggtgcaactatttagttggatgtaaaatcctacactcttcagttgttaaatctgtctctgaatctagtcatccctcaggggttttattaatctaaatgaccamcattatcacagctgcaactcatcttaagaactatttctcagaaaaaaacagtaagtagctagtgactctgtacacagagaaaaaaataaagaacagtttaaatcatatcagggtttcttctgaaatttttttcagtgttggaatgtgtaacttttaatctcattttggggaattttaaaatttggtttggattaaagagcaaaatgttggaaaagtaaacagcttattatctaaaggcattaaatatctaaaggcattaaatgtctaaagatattaaagaatgcatactttcagattcacctttttaaatacattgaaatttttattcaccawcatggtaaatcttttaaatctgttygaattaacatattgtaaatgatactcaatatatacatattgtatgtgattttatatgcagtaagttataagacccatggctttttgaacaattgataatgaacatttaaaatggtaagatagatcttagaaatggtatctgatttcctcttacttctagtgagttgtgtcattgaatgttttagataaaatctttgaattatgaatattatgcacatgaaagagtatatataatattggtacagtttaaagaatagcaaacattggtgcatattagcctcaaatttaacactgaaagagacatgtatctccctaccctcttaaaacttacagtcccttgtcgagtcatatttgaatgtatgttgacaagacctacgtcattcttgaataccagccccagagaatctaattcagtagattagagttggagctcaggaatctgtattttcaacatgtttcctggtagactggattggaagagacaactaggaagggattactcggttgtcctataaagtaattcagtgtgtcttcaacaaacactagccaactcgatgcattttcccgttactgctttcagagtgttctactattcagcttaagaaataaaacattatcagtgactacagtttcctgagtgctctaccctgatcccatacttctctcttccttatacagttaacctgtagcatgagttttaagaaaatcattccatagcatggatctcttaaaaatagaattatatatatatatgtttatttttgtctatttttgaacgcgttagaatcatactgtgtttmttctttgactcatttttttcattcaggtttgtttttgagattcaaccgtgttgatatgtataattatagttcattcattttcccactatatattaatgcattatacgaaggtcctataacattgatccattctagtattgatgggtttttggattgttttcaatacttttttgaatattatcaacaatatgaataaaattatatgtggcttttagtgcacatgtacaagtatttctctaaggcatatacctgggagttaaattgttaggttaaatatggtatgtgcttgttcagctttcctaaatagaatcaaagtayactccaaagtgattgtagcaatatacactctccccggcagggtgggtgaattctagttgtcctatataccgacaaatatgatgggtgtaaaatgaaatttactgtggttttaatttttatgtctatgatgaataatgatgttgaagctctttttatatatttaggagtcattcttgaaatgcctttgtttttgttcactttattattgttggtttgtcttcgtattatttcataagattcctttacatattttcgatatgtgtcttttgtcgtctagatatattgtgagtgttttctcgtaggatttttctcaaattttcactctctttaaagtgatttttaggacaaaaattatctttcaattttaatgtatgtggattagttttctctggcatctataacaaattaccgcaaactcagtggcttaaaacaacacacatttattctctttcagttctggaaggtcataagcacgaagtcagtttcactgggccaagatcaaggtttcagcagaggcttgctttctcaggagactccaggggaaaattcttttcctttccttttccaccttctagagcttcattccttgcattccttggctcctggcctcttcctccatcttcaaaggcagcagtttagcatcttgtttccatcttcacattgcctcgactgctgctgtccttaaagtttcctctgcttctttcttctgtggacactggggattatatttaggctccattcagataatcgggggaatctccctatctcaaaatccttaatttagtctcatccgcaaattcccttttgccctataaaataactttgacaggttcagggattagaatgtggctatctttgggggccattattcatcctaacatagaagataaatttatctttttttttattttggtggagatggtagtgagacagtgctgtgactgttgaatcttcagaggccagattagcccaattttgtaagtagtctctttaggtcactgttgatcaaaaatgagtgaccaaatacttctgccacttaaagatgggggaatatttctttttccttaacatctatcacttataccaaatgtaggagaggaaaaaatgtgtgtgaktgtgtgtgtgtgtgtgtgtgtgtgtgtgtgtgtgtgtgtatgttccttcttttaaaattcctgagctcctctctttcctcccatgttaaaatcggtagcatgtccaagcctctgggcctactgccttcggttagctcacacttgctttttcatgtgaagtttgttctatggcataatcttagtaaagcgttttwaaaacaaaaagatacggaggctttttacaaccccttcgcctaattatatgattcattaaaagaatcttgggggtgggcatggtggtgactcatgcctgtcatcccagcactttgggaggacgaggccagcagatcacttgaggtcaggggtttgagaccagcctggccaacgtggtgaaaccccatctctaccaaaaaatacaaaaattagccagacatgttggcacatgcctgtggtccyagctactcgagaggctgaagtaggaggattgattgaacctcggaggcagaggttgcagtgagccgagatgatgccagtgcacttcagcctgggtgacacaccatacacacacacacacacatacacaatcttggtatgtaatgaacagagaaaatgctttcagttttgttttgtgcatctggaaagaaaatgggattcaaatgggctgaagaaacaggccgtacccctaagaaagaaagaaactgagaggcagatattcttggaacttttggtgcagaatgccagaagctagataagcaccccaagtagaaaccagaggaaagtgactgggggcgagaagccataagcacaagaattgtttaaatgcttcagtttgcattttagttcatgctacaagttatgtagttcatgctacaagtttatgcctggagcttaaaatcaggcatttttctctatctaaatttctttgctttaaccattgcattttaaataatttactctcctttcttttgagatataaaagaaagattttgttcttgcttttattcttattttgaggattgtggcaacatgtagaaaaacaggagtagagcattgctattattgacaaaatactaatgttacgaagttattgacctataatgtccttagactgggaaaaatcaatgccttggtaatatctatgccaagtggcaaaaaggagacatcagatatttatgttgttctacataatatttgattttatgatatttgagttttgcgggatatatttgatggatgttatgatcttaataagtagagattgtcaactcttctgtgaatggcatataaaaaatgataagagaatgtcaacggacatttaaagaaaccgaataactgagtaaaataagtaattcaatacttctgccttaaagatgggaacttaaaatttcatatagttagtgtgtcttgattattgcctattccatcttgtggcatcatacaccctgtaaatctacagcaggagaatacagttggcattggagaggaactggtttcatatgattatctaaattatccaagaagaatggactatgaatcccttgaacatatgcttgagtccacagggattcaaaccaacgcctggggtttagatggaaaggccttgcccaaagagcaaaaagatatgacaacaaaattataacccttggcaaattccatcaaattgatttgaatcygtgggctgaaaatgtcagtgcttattaaagtatacattgaaaattattaagaatatgattgctgaatgtcccatattcttttgtgtcattaacaataaagtggcagctgagcatttgtcttgtctaacaggattactgttggctatgaattaaaaaacagaacgtggaggaattgccttgttaactactaatactatttcgtggtttagtatagatgggttaatcctcattctatctacttttatatactcactgctaagccatattttgaggctgtttctctaacagatgcacagggagcactttcttattgctagagtacaaaaaaggaaagacatgtttgtgatgttttcaagaacttcagtgtccgttgcatatataaccttttgaaacaaagaaatcctatgcatttgactaagattgcctgtgaaatctggcgctgctaaaagaaaaatatgagataatattttaccataagtacttctttttcctattaaaaaatatcacagcaaaaacaaacactatgtgccagcaaatttatgcccctaattatcctgagaattatcatgcagtttgcaaggaagaagggrctctagctttccagttgctgatcggcaataatgaacccctgctctgttgttaaatactttttttttggtagagtcataaagaacagcacttctagcaaagatgcaaaatgttaaggccgtaagtcaaaggaataattcgatatctggcttgataaacggatttttaaaaataaccttgatttctgctaaaatcttttcccttgaacataaaagggagtgaaggatttgtatatttcaaggtaattaaaacattactgatttaaaggaatactatcatgtataagacgaagaaaactagaaagatttctttttctctgtcatccagtatgttagccttgagagtgagacccttaaagcagcaacagagtgagactttttgaaaacgccatagcaacctggcctcgtagcccatgcctttctttagaacaacaaagaatggtgcttgaaaagtcttctcatgattcttctgcttcaacagcttgcctttctccttgtcaccagagtaagccattccktccagatcgcatcttctgccagaagccacaagtttggcttcttgaaatctcagaagtactcattcctcaagtaattaattaaaacaaataaataaaatgtgtaaggctttaagcttctgcaggaggctcatattcttccaaaatagtctgtcaacaattacagtatttataataataattgtgagagaaggataattagctttaggaattcttcttcatctagatttttataaagtgttcttaggaatagggatggtttattcctattgacagcttgtcccatgtaggggagtcatgtttgaaggcaacataccagattggaaggagcaatgattcaaaacaggatactgaggaaataaacatactgatatagtatatagttgtaatagctgcagttgtaatcaggcatacataacctaggcagccatttacattttatacaccctcattagagcgagcttctggaaacacattagtcatattatataattaataagtactggatccagagccaataggctgagcaatacacacctgccttcagtgagcccctgatgacacttattctttttgtttttcttgtattttcagtacctacctagcacactgcttgacattcaataaagactcaataaatattggatgtattaaacaagattaaaaactgcctgtaaacgtaatggtgtaaatgtttactgtaaatgtaaacttttccaggaaataatgcttttcgtccacctgttttgaaatataattaaaatgacattttccttttcataatcaggacaagtgttaatattacaaaatccttattaagtcaggacaatgtcaatattttatgggctgtatttcaacattattaattctaatgtaaaatagtcactctttgactataaatctcaaatcatttccaggtcaaaattttggcacatttttttgcctagatttttggatagttgaaatgtctaccagccttctgaattttctcatgcatttttctcactgtcctgattaaagagcagaaaataattacactaattttaaaatatatactttgtgacatttttcaacatttattaaaacccacattttattatggccaggcttcttatctctacttttgcttagaaaaatgacagttagtttggaattcatttttgatttttcaggtagtgttgctgtatttctcaagaataatggttgagttatggtatcgaatacttctaaatattcatccttgttgaaaaggttttagtcattcccttaaaaggttaatagacattgaaaaacactgaataattcatttttatgtacataagctgtatcaaatgtagtgtagtctacaaggtaacatcagggctaaagtttcattccagtggggactgatggactgctctctttttgtgggtataacgtgattgtactagtaagcccaggggactttacaccactcctccttgatcagtcctgaagttcatgtattacctttttacctaaatttctttcagtgttttcttctctgctatcccttgagtatatctcttgagcttatcatgtgtcttggttgttgagggccagaactgaagaactgtccctatcccttcttgtgagttaaaagggaattaaggaaaaggaatctcactgcagaagaatgttttggttgttcatcctatatttaatcttgctcctttragtttatggtcaaacatgagcacatttataaaatgctttcctggggcagcgtggaagaaactgtgtttggaaagtgatattacactgaggacacttgggcaagaggcttctgcagcttcagtcgccattgctttgaagatcatcactcattgctcgaaatcttctatgaactcctgtaagttcagatgttaatagctgaacattgttcaacaaagtcttaaattgattttaaatggactggtatagcaaagcaattggaaggtatacaaaagagcaaaattgagaagctgggtgatctaagcctgaagtcctcaaatatttaaaagacttagtttgtcaagatttaaccatctttttctgrgttcttttcatcactgttgacaaaagcaagcactggagaaaaatttttcttttgcctatggggccagcagtgaagatgagctcatctgtccatcaagctcttgctgctgctacctggcctcatttaatagctgtgaggccaaatccttactgtctttgaagtcagaacatgcaaagtttgagtatttgatgtatctttgagatgtgtcagtggccaaccaatgagagggatttggcagttagtgtcaatgctacaaaagacagttaattgtacgaaaaccacaggataaaactccaagtcaaaacaatagaacatcatccaggttatatattttttagctatgtagcaggggccctctgcattcagggcttttaaacttatttccattaacatctttatcatttacatagtaaagctttcagaatataaaaattcttctgattatggacaagctactgtgtgtccaaagcattgtataatttaacatgatcaactactttttctaaaaatgttatttctcaaagaaataaaatatagcatttgcaaaacacacacacagaggatcttattattgaagaaatgcctaggttatttgcaagtctattaggaataattttccttaacttattgactgttttcatctcatggaaagaagtttccctcctgtctttgctttggattatgtaactttgatttttcttaaagtaatgatttgcctagaagtgaattcattcagcttaaaaaccatagtagggcagtgtgaaaggaaaatttatgaataactttttccactatcttttcacaaagataagttctagtgggagaagctctcaaagtaaccaaacaaaactagcattgacagtgaaggcagaacgccattcaggttctgaaatgaaaccataggagaaattgtcttcattgacttgaccttaacyaacttgctagmgttaaccagtgctctggagtctttctgttaaaaataccaactgatgtycatcaattgtggtggttacctggccagtttatgccacttttccttagtgttgtaattgcagaatttaattaaaaattatataaaccactgaaatataagccaaaaatawtgttgttgtttctatgaaaacttgattgaatgctttctttgaaagacttgatgaaggcaaagtagatacagcatatatgttaactgaggtgtagatgaaataattagggactgtgggtaaaactgtaatcaaataactgtgcagcattacagatgtttaaattacctttcttctaaaggtgacatgaaatagagagtaggagacctaaaccttgcaggattttagcccttcatagaaagattggtgaatgaatgtctgaataatgaatgtttcaagttgaaactgaatatttattatatgctcatttaattattaaacatgattatttgctttatgtggctctttcaactgtatttactgacgttgttgttgttgttgttattaactagtcctagtcatttggataagaagactcttgccctattagatcaatccctaatcataactggggtactataggacctactctttgttagctacatatagagtaacacaatgaaacagccagcaaaaataagtaaaggaagcattttaatatttatgtatttttaagaacattgacatgaatcccatttattgcttagagcatctcttcacaaatcccccaaactctacagattttcggcttcaacaatttattcagattctccacgtaagtgacttgggaaatagatttttttttttttttttttttttttttttgagnnnnnnnnnnnnnnnnnnnncgcctcccgtgttcacgccgctttcctgcctcagcctcccgagtagctgggactacaggcgcccgccaccacgcccagctaattttttgtattttttgtagagacgggatttcaccgtgttagccaggatggtctcgatctcctgacctcgtgatccacctgcctcggcctcccaaagtgctaggattacaggcgtgagccaccacgctcagcgagaaatagatatttttaacaaggtccccaagtaattttctctaacaagtacagaaagcacaagattatttctccctgttgttttgactcgtgtgattacataattgatcatttaactaagaaatgaaaagtattttagtgactaaaagtattcattgcacacatgtatttttttttctgtaaaaaaaaaaaacctgatgtagaagaatgtttctaagccatataggaacacaaatatttttgttccagaataacttaccagaaggccatggcatagagaaattccctcatttctataagtgtgcttttctcttgaatgagctttacttcagtgttttacttgggcacatgtagggaaagaaaaaaatcatgttcaagttgaggaataagaagagtttcagatgaagagaagcagattctggcacacaaagttgaacagtgcaaaacattgaagcccagctatacataatcaagctggctragctataatacacattaaaataaaagtttttttctcaatggacaaaattggaactaagtatgtctgactgttttagagataagcacttctcaacttctaacataaaaagagaagctggtgtttatgtgaaagaatctatgtaaaagccatatggaactgtctctaataaatatccatttaatcaaatgtcactatgtttttgaatgttttgtagtttgatgcagagaatgtacttttatttcttcagcagctgctctttttaaatggatgcagctgtactacagatttaatttgcaacaattgcttaatttttagttggttgcttctagtctttcaaaagcaatgtttcatgtttctgtggaaagatttttttcctagaaagtgcaaagtacgatatgacgtaggaattaggcaaataaaagtttctgcttgatttttttaaaacataaaagttgtatttcctctctttatagcactgcttttcctagacatccttttttcagacaacattactaaggagatttgatgcctacatatcagtcttcatctcaaaacttctaaaagaggccttacgcggtagctcactcctgtaatcycagcactttgggaggccgaggtgggcggatcgcgaggtcaggatatcgggaccatcctggccaaaatgttgaagccccgtctctactaaaaatacaaaaattagctgggcgtggtggtgggcgcctgtagttccagctaccggggaggctgagccaggagaattgtttgaaccccggaggcggaggttgcagtgagccgagatcgcaccactgcactccagcctgttgacatagcgacactccatctcaacaaaaacaaaaaacaaacaaacttctaaaagattgtaagctgtaacaaattctggcaartgacttgcaaatgagaagaaaaaaatcacgctcattcatgtaaaatggtatctgctttgagaataacccagtatcaagtatgtgttacttgaattagaactttgactttttaatatagagagatacttttatctttgacgtattttattaaaatgtaaagcacatgatgttcctttcctatttccttatattactctgtttttactgtaatgtttagaaatctactttctagtttaattgttatggagaaatcatcttcctgtatagattaaaattcaatcttttttgaactcaaagaaaaatttggaggsaaagataaatattaatgatggattatctaatatttgttccaatctcaacatgttttacttctcatagccttttatcttccagataaaattatgagcgcagatgtatagacatttaaaatgtgattttaaaaatgtataatgcttttaactttcctcatgtaagacttgtctatagggctctggatgtgtgagcaggctgcctggaacctcctagcctgctggttcctttactcctcccatatccaactgactcatagcttagtgaacagttttttgtttttgttttttctttaaattttgccttctttctggagtattttcaaaaatctccttgtgtatatattggaatatttttagctgttacctaagtacttaatttctttatatagtaggtcatgcagacagaattctgcaatacatacaaatttgtatctcccctcctcaaactagtccctctgagttaaacaaagtagttactataatttccttgggatttttatctcttaaaagtatgctatgcttagtggtatgtatataattcagtaatagtctgttttaatttttatataaggtttttctttaatattttaactgttgcttattaaataaaacccatttgtaataaaaacagagttaagtataatcagtgttcccccaaatcaacgtatctctcttgtacaatttctcatcatattgggtaagggaaaatgtgatttttggcgtatctgtgatttctgaaggaaaggggtttctctgtagaacacaatgtgcttattctttttcactttaacactggtatctattaatggctaatgagctccattaggtttaatcaacatttcagcaatttttgacttgaattttgtttaaactttctgctttgtcttttaccttttgttctttattaygttagctcatttaatttttatacgtaggataaaacatacactttgaaatggcctcagaatttgaaagtatggctgtaaagggtgaaatcactgatgttaagggaacataactaataatggtcattgacgtacggatgactagaaaggccagttgtaattcgtgtttaaaaaattactatatcatcttcaaagatttatttatttatttttgttccttttcttggtgtggtttgtgtgttgatgggtggtgaatttggaggaaagaaatgagtcttgagaaaataccttggtcattcattcttaatatgtttagagaatagcaaactttcagcatattttattgagatcaaaagtagcatgtgaaattagacaatgaaatgtcaatttttgtattagtttcctggggctgttgtcacaaagtaccaaaaactgtgctgcttaaacaataggaatgcattgtcccacagttctggaggctgcaagtcgaagatcaaggtgtcagcaagttggttctttctgagggctgcgagggaaaatctattctgtgcctctctcctagcttttggggactcaagcattccttggcttgtaatggcattcttcccatgcctctttttatatgtctgtctctgaatccaaatttcttttttataaagacacagacatattggattggaacctagcctaatgactccaacttgatcatcagcaatgaccctattttcaaataaggtcatgtttattcacactgaggattagaactgcaaatatgtttttttttaggggggacacaattcaacccataagaattctgaaactttgttttgtccttttttgattagtgttaatacattttcagagtactttatattctcagggcttagaataagacaaagtaagattattcattcgagtatactgggttatttagtaagaaaatggactgagatttcataatgaactctctgctgatattgacatgaaaactagcacattttaaggattcacctatctacatttacatgaaatcaatgttcttataaccttctgacatttacttacctttttgtatttacttatatacttaattttgcttttaagtattattactatctttaatgcatttgtgctcttttttaatatggcaggctatggagtacaaagatttgtgtttttctggattagcaaaaaataaaacaaaactgtaaatccaatcattcagatgagttctttggaacaactgaggagtctgtggcctgaccaacaagactaaggaccttacttcactactatttggatgccacggcttgaggttttgttaatattttagtgtttctcctaataaaatccaagggatagttgttcttttagagcacatttataaattcttattttagcctatcgctgatagacctttaaaaatatattgccttgacatttatattgatagagcatatattagtctgttttcacactgctataaagaactgcctgagactgggtaatttataaaggaaagagctgtaattggctcacagttctacatggctggggaggcctcgggaaacttacaatcatggtggaaggtgaaggggaagcaatgcaccttcttcgcaaggtggcaggaaggagaatgaacacaggaggaactgcctaacactttaaaaccatcagatctcttgagaactcactatcatgagaatagcatggggaagccatccccatgattcaattacatccacttggtgtctcccttgacacatcggaatcatggggattacaattcaagatgagattttgagtggggacacagccaaaccrtatcagagggatacattcattaagattaacaattcttacttcccagtgtatatgttcctcatgtttttaaaaaggaaaatatgatagatgtggtgatttagaaactggctgcttctatgtggttcacctaatccaagatttttgcttatttgtttgtttttttgagacagagtcttgctctgtcacctgtgctggagtgcagtggtgcaatctcaatccactgcaacccccgccttccaggttcaagcaattctcatgcstcagcctcccaggtagctgggattacaggcatgtgccaccacatctggctagtttttgtatttttagtagagatggggtttcaccctgttggccaggctggtctccagcttctggcctcaagtgacctgcctgccttggcctcccaaagtgttgggattacaggcatgagtcaccacgcttggcttaatcacagatattaaaatcacatgtttgtttgagagttagagatacrtgtagagactttcaaagcattacttgaatttttttcatagttttttaaaactttgtttctaattattgaaataatcaatgcttactgaacaaatyttaaaaaataaagagaagtatgtgaagagaagtacttaaaatccaagcataatataatattaaatttgactggcgtagtgtctatctgtgagtgtgtgttcacatgcctatgtgtagaactaaagaataatttaaataaattatgacttatacaaatrtgaatgaatgtatgcccaaaattccatttaactgattgattaatgagggaaccagtaagatgttacaactgattcaaatgagaagttaaagtatcacatacatttaaagtcagraaagaagtgctaaatgaatttacaaaaaggtgcataaggctggacacggtggctcatgcctgtaatcccagcaatttgggaggctgagataggcagatcacttgaggtcaagagtttgagaccagcctggtcaacatggtgaaaccctgtctctactaaaaaaaaaaaaaaaaaaaaaaaaaaattaattccagctacttgggaggctgaggtgggggaattgcttgaacccaggaggcagaagttgtagcgagccaagattgcgccactgcactccagccygggcaacagagagagactcaggcttaagaaaaaawaaaaaataaaataaaaaaagtggtcagtttctacaaggcaatattcaattgcattccaatggatacaacatccatttctatttttgttatttttctgttagtaaatgagattgctgtcagtttctattattttcagagttgtaaaatggctcaaagacaataaaagccagagaaatgcatgagctagtcagggaacctactaatttgtcatgttttttctttttgcccattttgaagtttttcacacagtttttaatacagctcatattgatatatattctcatcagttggaattatgtttttatgtttcttcacatagagcaaatataattaaaaataaaagcataatgcatattccttcctattgacattgatactatctatagcgttacccaggagcattatgaaatgcacaacacttaaaaccaaataaaacaaaaataccctttccttgagctctttactcttggggggcaagaggggcactatattatcctttttaccttcttcctcccagtcaacctctctctttttcacgtactctaccaacatccccacccaatctccccttatgcctccaaaattagtcctatcctgattgtggagtttggggttttctttgattcaatggatgataccagtcacaccatttgaaaaaagcatatgacagtgttgttcagtgttggtgaacaggaattcttgatatttatttttaaggattccawttaattgctaattacagatctttgttaaattaagccgaccttcactcacatttaaaaaatttaactttgttttggttttcatgagacaaatatctctctttaagtgaacaagcttttaaaagaattagcttcttcagtatggaaagcaagatgcaattcgcagctggtgcaatggcttacaccagtatgtaatcccagcactatgggaggccgagggggaagaatcccttgaacccaggagttcaagcccgggctgagtgacacagtgagacatctttacaacaacaacaacaaaaacaaaataacaataacaacaaataattacctcagcctctcgagtatactgtaggtacaaagccaccacgtgtacctgtagtcccagctactcgagaggctgaatagagggattgcttgagcctgggaggttgaggctgccgtgagctgtaattgcaccactatactgcagtctgggcaagagtgagtccctgtctccaaaaaaaaaaaaaaaagagaaaaagaagcagttcccctaatgattctggatcattatgccagaagtatccaggttcaaagcgatattttatattttagtaagtagttttcactaataattcttcagcaatcaacgaataattcttctggaatacatcaattgtttgagaatcataaaagagatttccaaataccgtactccaaaatcagtaacacactctgaatctgaattgggctatgtaaatgtcttcagtttacagttaagtatagatttttacttgcagttattttctcttagtcatttctttccttcattaaggacttcgtattttattttcatttgcgtgcatggacaagagaatggatgcattcattttgttgtttctagagatgaatacagaaaatgcctagtgaagactgagtctggctgtgatttacaaagttggagcgttatagccagtaagcctgtcaggcagcccctgacagcagaagcaagtcttgaggtgggcatgagaaatgacagccttctttatgccagagtcttattaccattttgatttaaaaaacattgttttgggtctcagtaaactattgtagccatgaaaatgagataaaataactatttggtttgtcctatgtatattctatatatgaaaggaagaaaaatcagtacatggctatcagtctctacagaggaggggaaataatttgtgcttagatatattaatgcctaactgatgttttatatatgtgatcataagatatgtcatttacttaaaatttatagttaatccccttttttgcctcacctacagacaaaatggctttattccagcaaaattaagtcagaaaataatgttcactgatttagatgttgatgacagatgggtcttaggtcaggataacagctatggctgggagacattgattgttaacatttatgccccaataatgaatgacctgaatttttcccacatgtttgctcaggaaacacagggctgtggaggtsttgacgtcatagaggcagaaggatttggggccagagtatattcactgctggcagtcattcattagtaaatccttggtaagagagttggatttgagtgacatctggaggctttctatacctagagatgggggagttctgggtttgtatttttttctggtaagctagattcatcttttaggaaataccatatatataattgatgggtttaacatttcacattgagaggaggtgaaagattgaaagaattgaagaagaaagattgagtttgtatgattttttcccctgaatgaatttggttaatttagtgttaggtgctaatataaaacattgcttgagccatgtagtgtcaggaaaacatatctgttattagttcttggttgccatttaaaaatggakattgaaatttcctttacctagcaggaaaattacaacagtgatccttgaatatttggaaaggacacatacattccaaagtgtctagtgatgaggcaaaattgttcatattgaattcctttttcttgctcaaggccatttctggaggaaacttgtaatattggagaagttacatgagcacattgtgtttgctgcatggaaaggagaatataaggcttctcagcacagtggctaagcagatcaagagttgaggttaggttagcaatcatgaggctgaggtgcaacttagactccagtcccctataaaatataccttatagagtttagagatttgatgcaattcaaagcaaatttactatrttgaacatcagcaatgtcccaaagaagaccataaaattctgtggtggttaaaatctgttgtttaaacattagaagtataatattaaacatttctttctgttggttctcgtcccattagaagagctagatcctaatagctctttggtaccttatcaaaacaggagaaacaataatttaatgatcctttaatccaggggtggtggctcatacctgtgatttcagttatttgggaggcccaggatcacttgaggccggggagtttgagaccagtctgggcaacatagtgagaccccgtctgtaccaaataaaaattagccagatatgacggtatgtgcctgtagtcctagctactcaggaggctgaggcaggaggattacttgagcccaggagtttgaggcccactgtaatctagcctgggaaacagagtgagcctgactcaaaaaaatcctttaatacttttctattcaagaatttttcttttcagtccaagaagatcaatatgttaccaacaaagcaatttcccatcaaaatggcatctttgccgattcagtgccacaaaaccaatacccaaaccgaaagtgaacatctagcagtgcaggctttattgatggcatgggattgagaagctcaagagagctgggaagtcacagaaacaggcatctctaatgaaagggttgggtattaaaaataaggggacgaacattcgtgttttcttctgggaacgggcagagaactcctcaaaaccagagtgctgccttccctcccccaccttttgtttcaatgggttgttgtcatggtgattgtaaactgtcatggtgctgtgaggtgtatcatttagcatgaaaattagattataaygaagttagagtttcttcagaggtcaagaaagctgccatcttggatcccgctagtcttggccagtttggtcactagggggacttttgacctcaggtgtcccatttttaaagataaacagagttaaggaaggatagaaattcacctatgtcatgtaggcatcatactgggtaacaaacctgcaacacattgtctagacctctgtgttagagaatgattattcatactttatggaaagaccttgtagttaagattgtcaagtaatatttaactacaaagtggattgtctgccttagctaggttactctaccggtataatcgaatctctttacagtagtagttagtagtagtaagtagtgtccaatgttactgcgtttttgtttgagaaataataaaattcaaatgttgtagaactataaaatatacagatttaaattccctgttgtaatcttacttcccagagaaaattcctgacgataatttagtacagagagtttttttttgaggcagagtctcgccgtgttgcccaggctggagtgtagtggtgcgatctcagctcactgcaacctccatctcccacgttgaagctattcttatgcctcagccttctgagtagctgggattacacgtgtgcatcaccacgtccagccaattcttgtgtttttagtagagatggggtttcaccacgttgtccaagctggtctcaaactccttacctcaagtgatcctcctcccacctcgccctcacaaagtgctgggattacaagtgtgagccactgcagcagtcctagtagtctttcaatactaaaatgacacatagaccagcatagtgggggaggcaggaagtattgcagggtgagtagaagcacagcacagcctctggagccacagtgtctgggttcgaatcctgtctgctattgtatgagtcacagtctgggcaggaaatagatgactcaggggtcattgaagactttgaggaagtacctagttatagaagtattaagaaaagcaacaaggaatgatgaggcaacctgggtgcccaaaaagtgaaagtggttatcactaggaccaaaggcacgaggagagggaggtgtaactgagacccagtgagagcagtrcctgtgggaaaggggctactgaacaggagctgtggctatgggtagagaaatgcagccactattggattacgctgctgcactgagcaggtgggggcagggcagcgaggggtgattataaatactcacctcaacctcctttcttttattccacactcactgatggttactgtcatgggctgaatcctaacaagatccatggactccagaatccaggtgttgtaatttgtaaaatcagcctctttagggcagaggaaaaggaaggagatgagtaagggtggggtggtggtggcgggaataaagacttacaagcaaaaagcaaaaacacttactagctgtgtttgctagcaaggcactgtgtttcctagtaactctgtgctttattttccttattgatttaaagaggagaataatagaaccaataatatagggttattatgagagttaaataagttaatatgtatgaaatgtgtaggtgagtaccacctgtatagaaattagtcagcaaatattgtcaatagtatcattaacactttatagattaattcatttatgaattatgaattaattttacatgcaccttttagctgtttctgatttttacttagcagtgtatcttgatcacctccttctctgtctgtatatgtacatatacatatatggacagtcagccctctgtatctgtgtgttctgcctttgtggattcaaccaattgtgaatagaaaatattagaaaaaataacagtacaacaataaaataatataaataaaaatagaacttacatagcatttacattatattatgtattttaagtaatccagagatgatttaaagcatatgaaaggatgtgtataggttatgtgcacatactatgctatttatctatgagggtcctagagcaaattcccctgagataccaagggttgactatatgtacatatacagacacacaaacacacacagatgtgcctcacttctctctctctccacacattcacactcacacccattcacaaactacttttcttttttttttgaggtggagttttgctcttgttgccaaggctgcagtacaatggcgcaacctaagctcaccgcagcctccgactcccaggttcaagcaattctactgcctcagcctaccaagtagctgggactacaggcatgcgccaccaagcccagctaattttgtatttttagtagagacagggtttctccatgttggtcaggctggtctcgaactcctgacctcaggtgatccgcctgcctcgacctcccaaagtgttgggattacaggcgtgagccagcacgcctggccgcaaactacttttcaatggcttcagagtattccaatgtatggatataccagaatacacttaaacctttctgtttacaaggggattcagactattttcagtattttaccattatgcacaatgctgtagtaacatttgaacttctaacctctaattttggattcaagtgaagcaagtgagttttgtgtattttgagtcatctagattaagttgtcttcaggccgctctctgatgagaaggaatgtaaatgagtgacattagtacaaatattcaagtggctgaagccttttatttttcttggtcctaacccaattcaattttatagagaaaaagtttatagagtttttacatgacctttaactttattgaagaagagcttttaaaatattttcttgataccaccatatgccctgcacttaggtttcatattgtttatgaaaatattgatagctgtgtaatcaaattcagggccaaatattttcagtgtttgattttattgtaatgtggtcagagaaacataattataggtgagtgacttgaaactcatgctgtgtgtaggtacatttcttaacagaataatgtatctcgtgagtgttatgtatgtgtgtctctgtgtgtgtttgtgtgtctctgtgttgtgtgtgtgtatagttttgtcctcaaacttatttctccttacatgataaattatgactttcctttcctatggaataaatgttaccagttcaagttgaccaagtgtgaaaacaagtgacatttatttcctgctttcctacttctgggcagaattggagtggaaagtaatacatgtcgttctgcactgaaatatttaggactattttgccctgtagtagacaatttaggcttaataaaaaggtttccatccagtgtttgctaaaggtaattgaagagaattggagaaaataatattttaaacaattccgcaaaaaaaaaaaaaatacataaatagaagccstatgttttgatggcattgatggcagtctgttctaaattcagtacaactgtgtttcatcagataagttacttagcacaaatgtgattcatgtaaagaaaccgattctgaatcattatttatttatttaaacatagtgtctgtctaaaatcattcaatttgagaattcttccatatggacagtggacaagagaatgttccatgaatttttatatactctcctttgccctaagtctgcctgtttgaaatgtgttcaatcaatgcctgcttggagttctgctatcctcttctttcctctcctgttttcttgaccattcttcttgtggtcaccaatacaagttctgttcatctagttgtctgggctctggcttgaacctttattgctggcacttagcataacagctaaatacttaaaatgctttcattrtaccagattttggatttctttaatttgtgaccacaagctcagtgttttgaaaggtagaatcatacaaagaaacaactataatctaattaacctaagataagtagttaatgttttatgtgtcttcatcattttatatattttacatagaacaatatacttaattttgaatattccttttaaacttgtctgtttcacaggcatttttttctgtattaagttttcaaaaacatttttaatggtcatgtgccaatttttttctatggctattacataacattctctcttgttagacatttttgttgttttcgacttttccctactrcaattaataatgacatgaaaagttttgtataaaacacttcaagttgcagaacatctctttacagaatattcctagaagtggaattattaggccaaatggtaggaatacttttaagctttctgtatatgttgccagattgctttttaagaaggttgtaccaatttacactcccactagcaatgtaggagagtgcctggtaactttttaattggatttctttgataagaaactaaatggacaacatttaactgttcatcaaaaagagagaggagtttgttgaatttctgttattgcactaaaggaattctacatgttaaaataaatcatttaatttttattctcattgtcatcagactataataatactgaatttgattcacatttccccctctttcgtactcttaatgtcagtacaaataagcaaaggttacagaatactgtgagaaatggtgagaaatgggagctgattctgtgctacttactcaagaaatcatgtgctgttctgtgcacactatctgtctcatcagtaaggaggaaagagatagatgagtgcctgataccaattaagtattccatatgtttgatgtgtggatgcataaatgaagtgatgaagtgataagctcaaaaacctgctattattgaaaggccagagccatcctttgccattgtggtataagtggacaagcccccttacacagatgaaaacatggttggctagttaccattatgctccttagaacttgttcaagaggacttcaggtcactgtagtagaaccacctccacaaacaaaccaacacaattctcagagatctgacgtgacagctctgattcctgatgttctcatggacctgggtactccacatcccaccccccaccgccaccccgcaacaccccgaattctctctctgctacctcatgggccaaattcttttgggatccatactaagaatttattttggctcttatcaatgagctgtccacgttccgttgttggaattcatccaaaattaagtgcctgacttcagggtttaagaagtatacttttttagattttgctttgctttgctatgttggatagaaaagatattggtactgaactttagcttctatctttcacgaatatgggctttgtgctcaaagagaaaagtcttcaaccatggctgcaggattttttaaaatataggacaaataaatatatactatatgaaagtgacagagaaagttgaacagattccagaagagtgtaatttatcttactaatgatgctcttagcagggagatgaactcaggaaacataagagaagttccatgaggacgccttgtacttgaattccacttgctgtagtatctcaaagtttcagcgttatcttgggtgtttatgttacgtgttgaagtgggcgcttattctataatggaagctatattattagatmcttcttctcaaaaagccagtcaaatcgctttaatgaaaactgtaagtagttgtgctctaaagaggatgcaattatttaggaaacattctcataagatttaaaccaaaagcaacttaatgtgattctgatacaactgattaagtactttatagttgtcaatcccagaaacataacttatctcaattgaaaaatgtatataacagatagtaatttttataatttattacaattgttatatgaagtcatatttaaattataataaattatatataaactgattatttgaaatgtaatgagttcttcataatctcttaactgaatggagggctgtattctaagagtctcctctattttaatgttaacaagataaagtcttgggcaggtgtttctgctataacgtgattttaaagtttttaaaaaacataggttctacaaattgtgccctaaaaaaaaaaacaggatcatgagaaaacataataattctaaccaaaataatagtggcattagaaagatatgttagtacaaataaataaataaataactgatatagtcaatataaacctaatcatagaaaaagaaaagatgaaggtggattattcaaaagagatggaaagaagagttcagagggtggcaaatgcaaaatgcatcaaaatcaggaaaacaaacattgggtatttccaattagagactcattgatcaaatagaacaaagaagaatactgtgcaggtaaggtttatggattactctatatattactctttgccctgttctgttcarttgtgttagtatactttatgttctgctgctgtgatgactttgtgattaaacattaaccagctctcagggagtggggaggaaatcatgtaagtcaatatatcttttgctatcccactgtttaccaattgcgtatgagctaattaactatgcagaaaygtgttatagcagaaaagatttagtagtgttatayggtaggctaaaaggagtactggttagaaaaattatcaaactatatcctatcatttttccatttatccatatcaagcattttccactataatctctgttatgtaaactggtaactatacctatgttgttaaaggaaaatttaccctaatgttaaataatataaaatcccaagtctcatagattggtgggcattgtggarcttgcagattaaaatataccgcccacccccccaactgaaggaaatgtaggaactctgtatagtcagccttctgtatccctggattctacatccatggattcaaccaacctcagatggaaaatatattcaagaaaaaaagtgagtgagtgtgtctgaactgaacatgtgcagactttaaatcattattccctagacagcagactataccaactatttacatagcatttacattgaattaggtattataagttatctagagatgatttaaagtgaacgggagaatgtgcataggttatatgcaaatactataccattttatatcagggacttgagcatccctggattttggtgtctacagggtcctggaaccaatctgccatggatatcaagagatgactgtattctgtaactcttttctgtatctcagattatttcaacataagtttttttaaaaaggcgtttacttcttcaagctttgtcttacaggtagaacctatctcttactggtagaacctataaaattgaacattttttcacagataaagagtataatgatggaaatgtttcttttcctgtttttctttttctctttccttgctttctttccttccttcttcctctgcccctctgcctcagtatggatgcaaaaaggaacagcagtaaaggcaagaatgtaaagtcattgatgcctcaaattgtcatgaaagagaaggaccaatgatcatctgtatgttatactttttggtagaaaattggcatatgcatgtgtttttgcacttttggggccatggaaagtaaggattaaaaaattatatcctgtggagtctgagatgggtcctgttgtgtgctctgacatcagcaaccctgtgaccttggacaatttacttagtctaacggttctacagtttcacatttatatggtagattkaagaccatactcctgtagaattgttgggaagattataagaggaaatacttgtaaaatgcttaacgttgtgcctaaggtgcaatagtgtctcattggctactgtggacttgtttgaaattattaatctttagtcatctttgtatatcatttccatggacccttacaaaatggttagagatatgcagtgaatagagagactttcataaggatgccgattacaatttgactgtggattgtgcccgaggttgttccttgtatctgttttagaatttataataacaaaaatgaaattaacaaattgatttttatgatataacatatatttaagggtcaactgttagtattcatataattagactaatgatgcaaaaacaaacattttaaacaaacctttcttattaaccttgttcaagttaataagatccagtaataatgtcatccaagtagtgtacattttttctttctctccaccccgattctgctacctttacatatattcaattttcttgttattttattgaagtacaatttgtatgcactaatgcacaagtcttaaatgtacggttcaattagtttggccaatgtatataacctgcatatattttctcagstcatattactagttcctttattataattaacagcatgcaacacattctgagtggtaacgaaggtcaaatgtatgtggggcattttagctgtacgcttgttaatcctcacaaccccacctgtttcctactattattctaattttactgataagagctgagtttaacaagattaaatgacttgctgagggcaccagcaaagcctaccttaaaacacaagcttgggcccttaaccagcatactacactgtatctccttcactgccgaagaagcaagagtctctgccacctgtctaggtttccagagtttctttttcactctgwtgaaattcacaaaaattctcttactcaaacttattagttattgtgtattatgagaatatttaaatcaaaattggatccaagtcaatgtatagggagacatttaagagttttcctgtaagtcaagggtgttcttgaaaagagaactcagataccgtattagatatgataaagtagaatacatcaagagcaaaatattctaattcgaatttagtgcattttatcttacttggaatattattgtctattatttttaactgatggcaatacattttgatgctcaaatagcattttgtgtacattgttaaaaagaaaaagatgattatctttatactctgaagagaatacttacctatattactgaaaaacagttcataaatctaaacttagttctctaatcattttttatttagacttcaaatattttcttccatgtgatatcctttaaaatgttttcttttctttcttcaggattttttttctatgtttgttatttgggtcattcttcagccaagttgctaagcagaaatctgtaaagtagtagtttaatcaaatatgttcctcaagttgttttaaaaatatgtatatttgtatcttgctgcaggacttctctaattttttaaaaaattgatcgatgtgtaagaggctttcattctttctttctttttttttttttttttgagacaaggtcttgctctgttgcccaggctggagtacagtggcgccatctcagctcactgcagcctcgacctcctgggttcaagcaatcctcctgactcagtccctgaagtagctggaactacaagtgtgcgctactatgcccagctaatttttgtatttttagtaaagatggggtgtcatcatgttgcccaggctggccctgaactcctgagctcaagcaatctgcccacctcggtctcccaaagtgctagaattataggcatgagccccggcagctggccaaggcttttattctttcmctgtagagaatttataagtattacagctaaacaagaaaataacgtactaatgtggattcatggttcaggcatacaagttttttctcttaatactaggttctctcaattctgtgaacaaggagttgtactacttttctctttgggcttatgaaacatctagaataattaaatcagaaaagggaaaatatttgttaagtcaaaggaagtattttcttcatctttgtaaacataagtctctacagcacygtaatccatataacctcagcgtcaagtcagattttttttattgcctgaaaactgctaagtgaacacattatatgtaaaattaaagtagtggaagtatacatgattgagcatttaaactggttatatgcaatattactactctaaatagaaataaaattattctgacaaccttgtttgtgccaagtttttggttatttaaaaggagtaaaactttctatttacttcaatagacgtgatgtgaaattattcgtagagcgaggtagttaaattttgtttgcttgtttgcttaccaaatcataccaraagagttactttttgttcatttaatgagtacttataaaaaatgaagctattttttagtgattgtaaatatttaagtgatcattccagactattttgcaaaattcaagttagtttgatgctgtagtaatacaatcaaaaaaggattctagattttgagaacaaagataatagaaatgattgcatcatgcttttgatgtatcaatttagcacattaagctgtcattattccagtcttatgctaaataacaccccacttcatgcagtgcatcctgatatgatattaaatatatacagactcattctgatttttataaactgtatttgttaagctttccaatttgtatgaatgaactttgaagcactggggaatacggataattgttcactaatttacaaatgatacttcacagagtaatattaatccaaaagataataatcacatatattttgtgaggctatagaggaggctaataccttagatgtattttgtatgaattactgtatcagttaggtacttcctattaaatcacgtgactgactccattcccagatggtagattttcagttttatagattagcaggtctaggaaagagtaaggttcagctgaatgctactgatcacttccaacttctttttattatctaaaatgtatcacttaaggtatgagtctcacaatcatacagaaaagtatatttagtcaaaaggatggctagtatggttagactttaaaggaaccattggaatgaatccccgctacctagaaaactcttctactaggatatatgcctatgacttaatctgtcatcttatttgctcataattcaaatgttccttgccagaaatacctttcctgaagtagttcccccaaaaaatgtttgtctgtagtctgtcttccttactagagtgtgatcaggtcagggactttccctacttggttcacctagagcaggtctagcaaatagaatgcatgtgtatttgtctatggaatacatgactgaaaaagtgagtgactatagaggtaaaaagaagttttaacatcatccaatctaacctttccagtttatatcaaggaaactaagactatgtataaaggaaactaatggttaactgaattcctcaattatttccatggattgaggaaataaataccagaatcacagttcagtgcttagggacacttcgggacattcactcctgccaatagaagatggttaagaagtggtgtttgggagctggacagacataactttggccagagtttgaatcctagctataccacttactagctatgtccctttgtgaaagatatttaatctttctaagtcattttcttcgactataaatggagatgatgcatatctcgttggattattgtgaagcctaaatgagatcatgtatcacagagcctggcacaaggaaaactgttatagctgtcattgtcattatcatcatgaccgtttagtccttatataaattatataggcatttaatccatgattttctatagtaccacggtagtattttttcccaaacttaatgtatttagaacttagttcaccacagatgatatatgaagtttatgaggttgatatgctagtttagaatactagataatactaatatgaaatttggtttctatactagtttataataccagttactattaaatactcatcaatctagtgtttctgatgcctggactttaacaggtattccatagaaagactacacttttatctgtaatagatttttgatataagaaggatgcaaattcagctacagaggttgaaactctgtggaaaaaaataattcaagataaaatgcttttttctcctcctcatcgatttttctatccacaatagaaaaattccatcagtcagaaaccattcaggagaagatatgggtaatgtcctagacatataaattatatagatgcatattgatcattccctattatatagagtgatctaatttgaatttctattttttgagactagagtcagacgtaataatattattttaaaaaagttgtccagatgcatgttattatgtcataactaccttatttcaatacatttctgtgtttgatagttttgcttattttaggttctaattttaaaatatacatcatttttcatattctttagaatttataaaccaccctagaatttataaaccacctttaatgtgtcatcattaaattgtagctttcaaatgtaacagaatctgtaatttactgttacaattagaagatatgaatcaattccttagcttaaaattttttgttgaaaaagaaaataccatgacaactgactgtcttcagaatcatctagggctgattgattcataatctaaatttagggattgttcatatcagaatctaaggaggacttcacrttgcattcattttgttaattcagcaaaagtagtactagttagatctgggaaagtggatgttaaactttatgaatgccagactggattatagttttctcatttgtacagttagcttaatgatttctaaaaccttttttcctttattttccttttccttctcctgttactctgttggtattctgcatgcagataaacatgtgtatctacatgtaacatgtacacagaagccaattcatatatgtgaaaaagctattcactcctgaccacagagagcatgtcttagttttctttaatcctgaatgctggagtctgatacattttagactttcagtgaatatttcttgaataaattttaaaatatctctacatctattaaagagaccatattcttctaagatgactgtattagttatctattgctgctattacaaattactgtaaactttaatggcattaaaaaccacaaatttattaattttataattctatataactatacagaactgtaggtcagaagtctgacatggaccatacggagctaaaatcaaggtgctggcaaggtctcattcctttctcaagtatctgagagggatctgtttccttgccttttccagcttctagaggctgcccaagttccttggcttgcgaccctctttctccagtttcaaagctggcaaaggtgagttgattccttctcacatcacatcactataatttctaccatcttcacgtctctcactattaactctggccctcctgcctcttcttataagtaccttgtgataacattgggcccacccagaaaatcaggatcatygctctaactcaacatccttaatcgcatctgcaaagtaacttttgccatgtacgataacttattcacaaattctagggtttagaacatggacatctttgggggctgtttttctgccaggcactctgagtgtatgccagtagctgaaagcaccagaggtcttttccttgtaattatacagggaagttgcttttttgcttagcaaatacaagtgcttaggccaaacctgtctgaggttttagctcaaagagaagtgctccattcttttaagtttagatttcattccaaatgtgtaaccagcaattactttctatagtcctatatttatggcctattacttgagatcctggtacagtaaattcataatgcattaggtcattagacaatgacagggttctgtgtggtacatggccaattttttggaacttgacctaggagtctccttttctcctactgttaactttgcaatctcttatgaatcattgtttttgtcactgtacctcatttgctcatctatagattgcaaatgatcactcaatctaattcaactgctagactagtaagatcacaatgaaaaatgttctataaagtgtagagctctctttccatatgtggtacatttttaggtcctctcaagggggctcttttgtactgaagtgttttatttactttaatgtaagcatgtgccatggtgaatctttgcacattactgaaaagaactcagtgtttaataaaatcatacctagcactgcctcaaatgttaagctttctggtaaattagacaaagcagatttatcatgccatttcttttttgaatggcagtgttagtccaagttcctgttgatggtctcackattctttccatagttctgttacataaatgtgaaactttaatacctaaataattctaaatatatttttaatgaggaagtcttcaggacagtggttttccaagttattttgtagcagaaggctttttgcaagaaaatatttttgtatatggcagcatggagctgccatatacaaaacaaatatatgtggagctactctggttgtataaggtgataaggcrccaagtccattggttagtgcccccaaaacacatattccagtgtctgctaacttcactggtttctagggaccatagtgggtttcagtggatagggctatttatttggaaaatatttaataagtattgaaatatgccaaataatatatattagggtcaaggagctatgggaactctaaaggaaggtgtgtgtgtgtgtgtgtgtgtgtatgtgtgtgtagcaggttaaacaaatgagttctccaaaaatttattttgtaaatgttaatgctaagtcagtgtttattctctgagctaacctcacctataaaactgtaacccatgtgaaaattaacacttcagattgtttccttggaagttatactatacatttaaaaaacaggtgttttatatgttgtttctataataatatgcactatacacacagtatttcattccagtataacagtctgtataattttgaaatttttttctgcatctgtcccccacaaacagagaatagaggctgtggtgttgggcatttaatgtatgaatgagtacatgaaacatttttattaatcatcttatgaaaggattattttgcaagaattttttgtcataacatgtagattagtttgtaataagaatcttataattgtattttttctcaaacttgatatattttgtagtcatttataattttatagacgaatttataatttggctcatacatatcttcagaaatgatatttgatacgttaacctggttaattgtctaagatgtgcatcttgtgtaactatgaatatacataaartggataagagaagtaacatgaaacttctaaggaaagtatttggtaagagagagaattctatttgtttttgaaaaattatggcatcaagttaattcattatttttatgtaatgttttagagaaattgatcacttaatgtttcatatatgtacaaaatttagctcacatttgtcatcaaaataaagtattttgtgagaaacaggtcatttttcaagaagactacttatttagtaaataaaaccataaaatattttaaagattttggttggaattttaaaagactgtgtatatttttattctttataaaaggttattaaatttagttttaaacttaattcacataaagggtatttattatgatccggggggtaattgtgcacagttccgcattcactttttggatttatttttttcccctcatcccagaagccagaatgtaagctacatttctgtttgtattggacctttgagagactatgctacatrgctaatggaaaaacctgcatacgagtccaagttctgcctcttctaaaattcattaccataaaggaagttggttagccacagggagtttcttaggctttctcagtttgatttcttagtccctagaaagttcaagtctgtaaaaactagaagtttttataaggaagttatgagaagtaaatgacarggtatttgaaagtacatgacattgtgtatggcatatgttaattgaccagtgaatgctttacatcccttgatctcttaactagaaattaagtggcagactgataactcctargttcatatcgacagcttcccctcttctgaattccacactcatatatccaattgcaataattggcttcttgacttaratacctaacagacgcctcatactccaaatgtgccaaatggaacttccaattattgcctccaaatctgctccatcctttctaacagctgatggcaactccaaccttccgcttactctgtcagaaatcctgaaggcatctctgactcccytttctctgttacacctcacatccaatctaccattagttcaacttgctaaataatccagaatctggtaacttctcaccatctctgctgctacaactctagccaggctggcatcatgcctagctctgattactacagaaacctcgtagctgttctctcggcttccacctctccttcctcactgtgtattcacaacataaattagcccgagtgatcctttcagaacctgagtcagttaatgtcactcctctgctcaaaaccctccaatggctcccgtgttagaccttacagttgcctacatggcctgtgcaattaggctcttttgtctttgtcattacctcatctctcattacctttctcctcacttactccaatgcagctatacttatccttaccattctttgtgtatgccaggcacattctcattgcactggctgttttctttgcctggaccactttgtccccagttatccccatagctcacttcctctctgcctgtgtcttcaagtttttgattaaatgcaacttctatgtacctgatccctcccgcaggactcccatttcaaatggaaaccccaccccccataataccagccctctttatgatactctaaagcactcatcttctaacacatgctaaaatttactcatatataatttttttcacttgaatttgagctctacaatgttacctggtttgttttttttttttagttttgtcctctgatatttcccaatcatctagaacagtgtctggtacataatagttgctcaatgaatatttgtggaatgatttgagtaaacagcaatttgatcagaaaaaaatgcattcttagagttctttcatttcaagcagtattgcttatttaaaaggaatccatttagacgtcataccctttaaagtcggcagtttgaaatttggcaaacaacttgaaagcagcctagatgaagcggttagaatatggtggtagctttgcaattgtactacctgggatcgattcctatttttgccacataaaaagctcattgtgatgatcaattttctgattctttttgtgagctcaaatacttgaaataattaaccaagtagttgataccaaaaaaaaaaaatctgggtttctgggtttttgattgttttcttcagtacttttttttttaagcattaaaaatccatacatatgattattagttttattcttggagatgccattcttacaggttaaggaattatatctttaaatgagcaaaatttcattataatttgttgatgcatgtatttttcgtatatagccagcatttttccctcaccaacatgtgtattctgttaccgtatctcaaactgcccttcttatgctggatttgtgacattgtgcgtcatcaagagctgttctcagaaacgcagattcaattacgtctaacaaacaggccaaatatctaatctgccaccattacagctatattaatctgcttctatccagtagggccttggcttggattacagtaggaaacaccacatctgtgtccacagctgctgccttttaaacaggacccatagcatgatattctggacaagggccttttaaggtgtctagttttaggtgttgggcaaagcctttcctttagtgttctgggcttctagagcaccacccatttttccccttacagaatgttcactttctgtcttctgggtacccctacattagtttctgttgccctaattaagacctcttttccagaagcaatctattatttttgtccagtgagatctatttaccctagaagtgtttgttcttataccttaatttttaaagtttttkttcagtaaaaaacagatatgaataagttggtaggaaaactattttaaaagggtatttttggccctataaaaatcccagcaggtatctctgcctacttttttgttttataatgtctagctctgaaattattgtagcctctgttttctgtttgttaccagatgatattttaatgttttccttccggatgttaaatgtcttttcttctctttagtgccacttagaaaacttggaaataaacaaaaaatgaagctcatatatttttttaccactgtctagaaaccattacwataatgctggtcttaattcatacttactagaattgggagatgtatttgacttactcataaatttgataggtggaaaaagtagcttatttattacgaagctgaaaatgtaatgttttttagccatttgtattttttctcatgaattgtcttctcatttacattttaaatattaatgatatttatatgataaaacatttcaaatgtgcttgacatacattaatatagttttcaaatggaaatttttaatcattttatggtagacattatttcatttaaaaaattctaaaatgggctttatttagatagcaacacattttatcagtattttcttctaaattttttcatttagckgatttttaacatagttctttaatacttttggaattcagttatacaaatggtagttgcatataataagcaaactgtgagtttttttctaaattgctatacaaatttgtcagccagtttaattgaataatgtatattcttttctgttggtatgtaatatattagatcaactaaaataatccactagaattagcaaactaggtagaaattgactatatttaattagagctagaagccagatagtacagtagagaaatggatggcagttcaaaattctggaatatgaagaaaaatagaaaaagagagaaatagcggaaagtagttttagagataaaaatctatatttgaaaaaagagagggacttgagtgtgtatgctgtggacaaattgagggctgagatggagaagttgaagacacaggatggattaggcaaaggattgatgaaactatatattggaaagggcaagaaaagggagtgtaactcccagatggatctgtcaacatggggtagagatgaatgctgtttccattgtagaaatagaagatacagagagttatggtgcaggtagatttgtaggtaggagggcctgaagttgaggaagattccataatatgtcctctgtttcttctataaattaagaagggaagcattctctgagagtgaagaggaaggaaggtcatacatgttatktatatgtcttctccttcattcatttgctcaaaaaaacacytattgaatgtttccatgtgccatgttctgtgttaagactagaagaagcaaccaaaaatgaagtgcacagtggagtctatcaaacaacttcagtcacgagtcagccaggcagccacatgatgaaaaggactctgtcacttctccactgcaacaactaagtcaccactgagtcaaaaataggatctgcttgactaggtgttgccagtttggggaaaacattttcagtttggttgatggcatcaaaatttaaaaaaaggcttcatgttgatacaagtgggtagatatgaaaccaggtgttaaaatatacacatatatttccttgctccgcatactgcagtgttcattgytacactccagcagcaaggatcatacccagcactgagatcgtgatttctaatacctttgcaaattgaaggaaccagagatctgtgaaaaagtggcttaatctagggctggttcaggaatatacgagaaaagcttggagtatcttttagtgcccataaattaggaagtgctcaaatacacacacacacacacacacacacacatacacacacacgatggtgatatgtcagttggacacaggagccaactgaaagagttcccaatggctaaacaacctaagaaacaaaatgaataatgtattagattataacccaaagtataaaataaatattcatgatcctgtactaatagaaatgattaaatagatgggctaaatagctgtctcttatgtaataaaattccaaatagcttatgtggatattgtcctccttaaggatgtatagtgtaactcgccattccttaagtgtgggctactcacagtggttccttccaaagagagacttgggcaaagtcttctcaggagagaaatgggcaaagagaaagagagactgcattggagaaaccttacagacactgcctcagccagatgatcaaggtgaccatcacaataagtggtgttgatagtatagacccataatatgatgtaattagaataccagtttgcctatgtggttgtctcctcaaaaatccataactccatcttatgaaaaaagttcagacaaacccatttgagggatattatagaatatacacgactagcattaaaaatgtaaaagtcatcaaaaacaaagtcagaaaaaattgtcagtcaggaggaacctgaggagacataaagacccaaatgtattataacatcctagataggaccctggaacaaataaaagacaatagataaaaactatatctgagtaaaatattggttgtgtgtaataatacgtcgctattggtccattagttataacaattgtactatgctaatataaaatgttaataacagaaaagtgaagggggctagtggagggggcacagtataagagactatgctatcttcaaaagtcttctgtaaaaagccatcctaaaataggaattttgtttaaaaaacaaaaaatccgctctgcaaattatacactctttaattattttgaagctgctcttataccaagagatgaagacaaatccaataagtactattttgatttgtcaaatgcccctttgtagaggccacggaagctgatggagtaatatctactgttgctttcatatctttcagcagaggaatcaggtaaaatagtcaacattttacaatgttattgcttggggtttaggaaatttcacctcccagaaaggttctatgtgcttatttttaattacacaatggaatatctggcagaacataagacattttaagctgtaagtagaatgattttccaggartttctgagcatcttagagcctacatttaccattatcagaggcacctgagtactgcttcgtaaattgcaacttcgttacgttagatagtgtcctatttccatgagagtgatgacagattcagaagtgccaggctccaaggaagttgttcactgggagaaaaagactcaatgtaaagcatattatttattattattgtggtaacacctatcattatataaatataaccattcaataatgccgtattattcataatagaagtcacmagattcttatccattcttcgtactctgggcttcctatgagtaaatgtattttgttctttttgcagaattaagtaaacagaattatttctgctttgccaaaggatgttgtcaaaggcctgctcctcttctgcctatatatttttcttttaacataatgtatgcccttgagcagtgattctcagtctttcgtgttttacattttgtcacatgctatactgaaaaatttgggtcccactgtcatagaatcaaaccatgtttatagtcattcgatgcatatatgtttttatatttctaatataaatttatacgattttagcagtaaactatgttaatacagtacgttagaaatatttgtgggtgttgagtaaaaccagagaaaataggggatttggtaaaatattgtctatttcataatatctgctgactgacattgcaacatctctaaagagaatttgtttttgaaaggcagaaaataaactatttcatgagtaatagcagcttagcattgtctaacagctacaaaatccatcaatgacatatactttctctggagaaaggtgttagcccttgggatggttgtaagacaggttttgtctcattttccttaatctacaaactgttggatgtagttttcccagttgtattaatttctcatggaatttgtggaaatatacactaaaattactttagcattttcaagattttcagatttttttatgaccttttcatcagtgtcctatgttaggagattgtgttgatatgttatattaaactgtaaggaccacacaagcagttttgacacatctgatagagattccactgaagttttactgagatgattgaaacaatttagacagatttcagtcaatttatcagtcagtaggactttaaatgatgccattaaatgagattaaaatatttctgaatttaatactgccaacttaaagtactgttaactttttttggcttgtttcaattggaagaaaaraagaggtagtgaatataacacacatctggaactaagaaaactaatttgtaagtcccacctcctccgctaaccatctgtagtctgttacacttgcagtggcttccaaccttggctgcacattaaaataacatgggaataggtaaaaatcccagtgcccaggtttcaccctaaaataattaaatccacatctctggggtgagacacaggcattttatttttgtttgaaattttcaaagaagatatcaaaatttgcaaggcataatcaaataaggcaattaacatactttagcctatacctmatattttgcttgtttttagtttcaaatcatcctaggatattattgattactcaactgattgacatggtttgggaaataaggtattttgaaaggaawaatgtcttctttttataaactgtacaggaaccttctattaaattctgtaaatgtcattgatctcaaatccatgcatcacatgtgtaaattatattatttgtgttgtgtttgaagtaaagcatgattgataacatttgatgtgaaaatatatgcaatggcagtaacgttatcatttctaaaagaacagaacccttgaagacaaagggtagaagtaatgtcagtcctgtttctacaatatttgagctatgtgaccttgagaaagtcatttaaactttctgattcttaattcccaggtctataattgttatactttagctttgcagttatagatttgttcagtgttaacatcacttgtatgaattataaacttattgttagttaaacatgctagaaaaagttgagagacagtgaagcataatagaaagcacatggtttttggaattgaatttggcttcccacattagttgtatcttactagctgtgtgactttggcatgtgacctaacccaagtttatgtaaaatggtttcaataacatgttcctgtcttagcccattttgtgctgctgtaacagaatacctgacactgggtaacttataaagaacagaaatttatttcaagaacagttctaaaagctagaaagttcaagattatgatatcagtatctgacaaggaccttcttgctgcatcatcacatggcagaagggcaaagaaagggcaagagggggccraactcatcctttcataatggtatcartcccagccatgagggtagagccctcagggcccgttcaactcttcaaattactacatcttaatactgttacaatggcatttaaatttcaacgtaagtttgaaggggacagatactcaaaccatagcactttattagaagttgttttaagaatttaatgagacaatatatgttaagggcctactgcctggcatatagtagatactgaagaaatggttgttgatagtgatgataatgtaatataccactaacatgttaaatgtgtttctgaatgcatgacctcagaatatatgtcaaatatatacactggttcctttttacaaaagcaagtgttaatgaatgagtgtaaaactccttagcttaaaaagtccactttacacatctataggtagtgatttgagaagttcctagaggacagttgatatggtgtgttagataaccacagattggaaatgctagccctctggacactcaaactttaactctggaaactgggttacactggaaagaatctacaataaactgaccttccackggacacgtggagtattctaactaatgcagaaatccgaagcagactagagtatccctgatctccttagtggtgtagaatctcacactgtattatwtatttatttatttatttatttatttatttatttatttatttattttgagacggagtctcgctctgtcgcccaggctggagtgcagtggcgggatctcggctcactgcaagctccgcctcccrggttcacgccattctcctgcctcagcctcccargtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctatttttttttttttcagaacatgttggcttagtattctctgggcaggaggccatgccaaggaaagtttttgacctttcaaaacctcccaaaggtaatgggagaagtgataattattacggaaatgtgaagacaagcatacttttttttcatagattcttactcagactcattcaaaaagggatggattttgagtattcattttggtgaagtctctgaccttattrgatagtgatacctccaggtcttgctttatgtggggtcaattactgagccgttgatgaatttcatttatttcttgtttaatagagtggcacttaaaataagtggacatgtaaaagaaaaatagatttgcttgatttgtatctttcaaaatggtagtgaaacaatcctgtaatttacacgaccagttctacttcacatatattttaaatgtactatgatcaacatagtcattacctggcatgtagaatacctatacatttacacatgtaaaaaatgaagcctcaatgtctttggtttgtgctggatcatttctttcagggtatggcattctcaagttattttctaatgaggtttctttaaatttttcaagttgctttcactgcgattaatttaatagtgaatatgtttataaaagtctgattctagagacaggctctgaaccattatgctatggcctctttgactacaaaaatcaaacgtttttattttctaatttgttaagttaaatatttttctatgtagtgaagcttaactaattagagagaccagcaggaattgtaatgtcaccaatgtaatttacattgagataagttttattcaaaagaatgagctaaaatattttattctgtgaggctaaaaactataactaggatgaggaactcttttctcccaatacaaattatagaatttcaaagcagraagagcatcttgttttacccctctttgtacagatgggaaaaagagccccaggagagcacaagatttgctcgtgtctcacaggcatttactgaatggcaaagttgccagtaaagccctgtagtttgactctgtcgacagcagaaatgtgttcttctatttcatactttccaatgcggttctagaaaatgataagtaattttgaaagttggtttatttctttcagagtagctagtgccattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacactttgaacaacggggagaaaagaggatactttccctctgagtatatttggattgcttggttataaaaatgttgtgtgattattgtaaactcttattcagaatgttttttctccgttgtataatgggcaccatgatgacataaataagcttctttataaaatttctgctgtgtttcctacagctccctcctatgacaaactgagtatttgtgatttarttctactggatgatttacttctactggatatccttaagattatatttatttacaaataagtaaaaatcactgaagtgggatccctgggtttgttgttataaaacttattaattatcttaaatatcaggttttcctctcttcaggctcagtcagtaggtcagggaaatgtcatgtggggccattttctcttatccctgccactttgacaatggttgtcaaattagaatgtgcacaccaatctctcgctaacttgacaaatgcacattcctaggtcccaaccttaggattatgacttaataagcctgggatcctgaatgtagcccacagaaatccacttagtaacacccgtttacaaagagactcctaatctgcgtggtccaaggcacattttgagaaacactgactgtgctatgttcttttctggagacagacagggactcatgtctccctccttggcaacagctattctttcatgggtaattcctatgtactatttgaatatcaaaatatttwtatctccctaagaatggggagacacaacgtatttgccccataagggtaaattgcaaacaaattgctccagtgcttcagaaaggactggttattcattcctgggactgctttataaagagagatcttctcaatattcaaatgtattacaggcatagaaaattttttgcatgaatatataaagactaagaatcagttctgttttttacagcctgagaggacatattttgaaagctttctaatccttgctatgacaatgactgaacttttagagggctcagagttagagcttcaaagatatttaataatggagaaaaaaaaaagattcatttgggagaagatctccaagtataaccaaatttatccctttacctgtggctaataaaataactgaattcaaaaagaaagcaaaagcaatatatattttgaatagaagactgctttttaaaattatgtaaactattctgtcattaaaaaaaagccttcctagtgttggattggagtatttccatatttggaaaccaagattaatagatgtttcagatccgaagtgtttgttcttccatctttttttcccccttttgcatgtaaaagagaatggtgaccaatttttttggtaaaagagttaataaatcacttaataatggatttaaatgaacagaggcataatcagatttttttaaaaaagacttttatttaattctccagacgcaacacttagatagaactttctgtactgatggatttttttatagctatgttgttgaatctggtagccacagtcacatgtggttattgcatccatgaagtgtaactagtgtaactgaggaattgaattttttaaaatttgatttcatttcatttaattgaaattgctacatgtggcagatagtcattgtattgatctgtgttgctaaagaagattgtgtaaaatggttttcataactttggggtagcagttggcatttttatgagactaggaagtatatgattatgtagtgttgtagtttatgtgactaaatgtggctccttatggaggagttctttaactttgccatacttataaagatagttattatttattctctctacttatattttgaaagtccctctcttaaagcaagtagatatcatggagtgagtctggaaactcctgttacagaacaccaggagtggccaaattatgactggtgccccctggagttgtgcacacagagtctgtggctacccctataagctgagtcacatctcaaggcaatgtcatattcacttttatgtctacaatgcttggtatggaattgattactgacaaatctttgttaagtaaggaatatatatctcaattttgatatccgcaataataaaggatagtgaataaaaaatattttactrtgtgctcatagaacacattgtatgaatttgccctttgatgtatatattcattaagttctacatttatgaagtacgctttgtggaaagtattaatttaagtatttaatacgaatataattcagacacagtatgtctactgctgattaatgaagaagggaatgtaaaaatatgtgctgcatcataaagtaactgcactaatgaacatatgtgcaagatgtagttcccaatagcaaaggaagagaaagggatttttgtttggttgattgattttctcagtcctgtggcagaacaaaaaaggcacatcagagaaggaaggctgccatcagggaaatgacttttgaggcgggttttggaagatgagctggagctagcagaggggtggtgaggaaagtaaggcctgtgctgctccaggtactttgctaagggacatcatctcacatcggttttctccatactcctccaacgtagatgtccttaatcctcatttcaatgatgatgcagctgattcggatttaaagaagtttgcctaaggtgacatcgytattcagtgagggtactaagctttgaacctaggtatgtttaacgctaaagcctgtgaattgcaccatagtcattggtatcagtaatgaaaaatccaacgtgtttggtgaaattcaagtagtgtagtatcgccaagcacatgatacaaagagaagcaactgaagtgctggaatggaggcatgtgataataaaaaaccatctatgccatgacaaatacactggacttttttctgtaagtaatgtggagccctgggtgggttagttttaggctggcaatgacatcatgattcctaaagaaattcaggagctaaaatcaacagcatatttagctaattatttgacttgaatttccattcaaattggctttattttttcctgaatacgcagttgcttagaagtggttgagttccatcctggtgcgtgctggctatcaaccaacataggagtaaaaattcaccatgagtagtcagccaaaagacacatgcagatgcttaggaaaataaattataaatatttcttatgtctgccagtagcaatgagaagattttgctatattgtgttttttgatagttggcttgttttactgtatgcttatgaaaacataaagtagcaggacaacagatcacattgccaaatgatttctaggatttggcccaaggtttgatgatccctctgccgcttcttggctttgtatgctcagaagcacccaccatcagctgtcagccctgtggcaaaaggaggaatggggtcagagtcaggcaaacagaagccagagccaagtgttgttctgagaaatactagcatctgtttagtgcagtgagttctctgctttgtacttggcaacccacttgggactcatgctgcaaagggggctgatgatttaaaactgagggaggagatccagaggggagaccttggctcatgaaacatcctcttcacctctgtgatgggccgttcttcatgtcctacagtttgaactaaagaatggcctcggcttctcctgtggatgtaaacatattttgttgcaagtgccattcgttttatttgttgtataccttttccttcaaatatattcctggctaaactcctggctgtctctcctggagtgtttttttttttttgtattcttggggttgtaagaatcaggttcatgtggaggtgtctagaaacaggctggctggacaggaaggaaataggtggatatagttttaaatttatacacatcttttggagccaggaacttctacacaatctagcttctatgagataaaatttgtggtacgaaagaggagtggtaacatgaataataagagattttttttaagtctagaaaaccttagatgttgggagtgtaatcaagcattttagccagtcattttgaaaggtaagtgagtttaaatgaattgaatactcagttgtgaattagtgatactgaacatgtacactgtcttatcagtgtgtttcatagtgattggtaatgcccagatttccaatttgatacacagtccattttaaaaagatatatgtgtgtattttatacgatgctttgtagttttgaagttttgagataaattatttagaatcaaatgctcatggaaatgtctgtaatattaaaataggtttatttcaagattattaattcatttgttcaacgagtgttattgagcgtctgttgtgccgaaccctcattaacctcaatagggaaggtactaggttcaagaggctgaagaagagaccccgagccaacaaaggagacatggagtttcattaggagcttacatacagtggagagagtcagtggcagtgggctggacaggagaaccaacttacctacagaaatgatccagtggtggcaggctgggcaggaaaaccgcaaccacttgcaaacagcatgcagtttatgtagcattttcacttaacactctctcctttatgacctccacctggcaaccctcattaaccccaaactcagggcctcattcctctgtatggcccatgttccatgggatgggatggggtttcagatgttcctcacagacaaagaacaaatcttcgggctgtccactagattccctagcttgggacacactttcaggtgtgtctactgtacagggtcattctaagggtttgcttaagtttaccctacagcatcattcacgtctgctctctcatgtgcttgcgatacagtgaccatcaacacaagggccctggtctccaggaacttacactctgtagagcagtgtttttcaaagtgtggttcccagatcattagtatcagtgtgctgggaattgctagaaatgcaaattctcaagtccccggcctagacctattgaatctgaaactctgagagtggggttcagcaatttgtcttttaacaggtgattgtgaaagtttgagaactactgcaaaagacagataaattaactgatgattattaagtatgccagaaaaggctgagttttacaaagaaaataaaacagggaaagaagatggacagtgtaaaagtgtgtagcttttggggtgttgtctttgtctttgagcacttgactgatgtgagaatatctgggaggaaagctttgtggttatctcggttagagattttagtgagttgaggcacggttgggaattgtgatgtctttagaagggctgaacctccagaatttgctgttgaataaattggaaatggtgatgtgagagggcagaatgatcctaaaggttgttgatggtacctactgatctctgatgttacctcatagtaagatgggaaaaaatgaaatggggtggggcagggaaaagcagactttgggggaagaataacacattttattttagaaaagttgtttcaaaagctcattagccatgtgtgaagctatatttgtgagtatgccattcatggggaaggttggcactgggaatattaactggggagtcatggtcatataaatggtattttaaaaaactagttagcctgagatcaccaagggaatgaatgcacatggaggaggtctaaataccaagtcctggggtatacctgggsggtggggtgggtggcattaggctaaagatagtgaaaattctaatgaatgataagtaatattttgctatgttgatcttgagattgatatgttgaaatggcagcatcctagaccaatcccaagtttaatgccttccttgaagttgccatgtttctgtttcggagtccttggtgccacaggtcccycttgactttcacaggccagggcttcttgccatacaggtaagtgttctcccttcccagcttatgggatccagactcatcagctgcccgctgtaggttgtccttaaaacttagagaatatgcagagagcatacacaattctgcttagaggaggagcactctccttttcctcttgtctcagttgtgatcttgtcttctttctctaatttccttttcctctattgaactttcaacaggcaaattctttggtctgcagagccaaaagaataattgtctttctttttaagttaatagtacttagatcattttgacagttgtcttatttattaccacttacacagaggcatttcttaatgttgaattcaaatgttgatttttagtgtcctagaccttgatattttctgatttgaataccctgagctgttgaccaaagcaacaatgaaatttataatttcttaacgggtgtgtgattcttgggatttctttcagaaaacaatacttccctgatgtaggaatgtatcacttaaagtaaaaaatgtttttaaaatttgaattatagaagagaataatcagtggatgattcacttcgtagaaaagttctttgctttaaaatgactcatcaagtgctattgggaacatttaaaatgttatttcaattgcacatactctttaggaagatacaagtttattrctttatatgtgtgtatcactgataaaaggtattttcatatatttaacaaaaatttaaagggaggaatggttaaatgactgtctaaggactcatacctctttagtgggcaaccaagtcttgaaccctagttaccagttgtcatgtttacttgtagaactaccatcacggccccaggggaacagcttaagaaagggataggaggaataaaatggaagcactctatagaataagtcttcatctgtactcctgatttaacaaattctgatattacccactgtgtttaggtttcagtgacaagttttcgtagcagttgcggctgcatttagctcttcacatcctcccaattctaaaactgcaaggtattgtaacgataatctgtcccatttcctcgtttttgaatgagaaaaccacagcctagagtagccattacttgccaaagctttttttcttagaagagaggggggatcttcagttatcttctagaatgtgacaaaattttgccaagatcatggtgcgtgctcactaaaagatgatgaagtttattgcctaaatctcaaattcagtcaagatgctacttaggccagcttttaaaatttgtataatagctagttttttatttaaatttttaaattgtgaaacagatcacaaattaaagagcacatataacatatatagtattacatatgcatatcatttaaaaatattttatatatagctatatatcttatgtatgttatttttactataagaataataataaaatataaaatgaacacacaggcatcaaccattgagtctaagaagtaaccattccacaatcttggaaagcccctgtgggtccctaatctgtctcaccccattccttgccctcagaggtaacctctgtgcactaccctcttgtggttagaagatggagctaggccgggctcggtggctcacgcctgtaatcccagcaytttgggagactgaggcgggtggatcacctgaggttggtagttcaagaccagcctgaccaacacggagaaaccccgtctctgctaaaaatacaaaaagccagacatggtggtgcatgcctgtaatctcagctacttgggaggctgaggcaggagaatcgcttgaacccaggaggcggaggttgtggtgagccgagatccaccattgcactccagcctgggcaacaagagtgaaactctgtctccaacaaaaaagaagatggagctacattactgctccggagccttgggcaagttattattctccctgtgcgtcagtttcctcatctgtataaaaggaatagyaatatatgtgttgtgaggactgaatgaggtcacccaggaagtgtgcttacaaaaatatgttgtgtagtcatcatcgtttactattcttgttactatcatcatgttcagttttacatttgaaggacttgtaatgttgccaacaagatggagtttgagggactaaaattgattttaagaataataatgttgttgttcctttttcaaatcttttaacatggaaacattctgatttgrttgggggggggrgcttttgacatcatctgtttcaccttatcactgtgtactttcaaaatatcttcaagatgctttcattgargcaacaagaaaattgttttgaacaaagaccctttagygtcagtcactatttcagaatataacaccagtcattgtttatatgatttactcttaataggattttgatattctgctgtgtaacgttgctgctgactgaatgtctttgaagacagtaaaatttgaccgactacaaaatattacttcatttttggggggtttagtctgtttggtaaggttactaaagagtacttctaaaagtatgagaggataaaggattgagatataagagaaaagttgacaaaatcagaaaactgtgcaatgaggtaatgagtaaccaaaacttgctatcttatcagtactgagaactgcagaaaaatttcttacttggagatttgtgcttttctttgagtattcataaataagagtgaaaaacaataatcacttttctcagtaaaagaaaacaaccttatacttgaggacttttgtttcaaagttggtaaggctttggatactaatataaaattcaccagtaaagtattttgaaactcttaatgccacctgtgcttctgaattcatatgaagattattgtttgagacctctgtggtgacatggacatcacacttgaggggtgagacatatcttcaccttctttacacactggctcatcttctatttagttgatactattgttcctcaataaaattatttttctctctattgatattattttcaagttgacttctagtcagcaactctgtaagtatctttttattggcttttagattctgtattttaaatgagccagcaatatttcaatttcattgagattgcattatatcattttgaaaacttatttgcctgtgattaaatttttgaacaatgtctgggatctaaaaactcacttgaaaatcattttttaaatcaaatttttttaaaaaagtgttacaattatagcaagtcatcatggaaaaataaagtaatatgggtatgtataatatgccttctaaacctctaagcatctggaagcagagatccatgttctgtgaatgacctactaatcttcttaatgagttcatagcaaggcatgtggtatttgcgatagaaaagactcagtaaaagctgtcttccattcagtttttgaaaagtgaatggatrccagtttatgttatttcctatagtgcctatcttaaactgatttttttttttttacttgctgaatctcatttcatgtcaatatgagttttgtattggtaatatagtgtttgtaattgatgatgtagccaactcctttattgaagtaaactgtgaagctaataaaacatcttcatgttttaaggccattaggagacatttttttctgtgtgtgtgtgtgtgtgtgtgtgtgtgtgtgtgtgtgtgtgtttgagaccaagtctcactcttgtcccccaggctggagtgcaatggcgcgatctcggctcactgcaacctccgcctcccaggttcaagcaattctccggcctcagcctcccgagtagctaggattacaggcgcctgctgccatgcccggctgatttttgtatttttagtaaagagggggtttcaccatgttggccaggctggtctccaactcctgagctcaggtgatctgcctgcctcggattacaggggtgagccactgtgcccggccgtgtttttttgttttgtttttgtttgtttgttttttaacataatgaatactacaacagaaacataattaaatagcttctaaacatttgagaagatgaatggatcactcgtttctaaatggatagccaggagagttagttaagtatttctgatcttatagtgaatgataatgtttgtacaacctaatagttgccccttttcctttctttttcttctctaatartaatagcaaaaacattgtttctggcattcagtgagtgccagataaatagaaaggctatgagcttgatgcacagtttcttttctttttcctgggtcctctctcctcccaacctacatttcttggcatctttccgctgtctgtttgttagagttctgactctgacgtcaaggactcacagtgagtgacccccgtggcaaacctgtaaaacattatacaacatgaataagaactttcttattagatctgcagctggctgagtacagacatatggcagcaaggatgttttggaagaaaggcattgcttgacaaagaacccagtctcttgaataaaggtttatactggcactctttgatgtttataatacccgatgccaggggcaaaacttttttccccccattatattgttattttactgtttaaaccccatcattttatatgttgcggtggctaaaatgtagaagcagacattttatgtgtgtctgtataactttaaaaggaaaaaaaaaaaaaagcaaaactcaaaaaactttctcaggctctgtctacccggctgtaagtgttcgattttctgaggctgagactcagattgaaagtgagggagtttgtaagaatgggcccagtccttttgagcaggttttaaaaggatgattaaagggtacataggctttgtaatgccctgacaactttaattgtttcttttggtggttgtcctttttatcgtgagtagttgttctcagttgctaaaaatttaggctgggaataatttccaacctaggaggttgtcacactgatttgcatttggtttgttatttcttagtcttttcaatgcagccctgctttcatcttactccctttctcaaaccccagctactgacattatgtacatggttgtgttttgtgatctgtgctagcacactggtgttgaataatatattgtgaaatattctgatggtgacaattcggtagttgccccaggaggaatgatgacactttgaatcagaggcacaaggacagagaagttcaacctagtggagagccaaggtaaatgaatgaaagcttctgcctccacaaggaatatctaagtccttttagcatggttctttgcaaccttgattatgtttataatgttcaaaatctttgatgaggccattgtcttcctagtacttactgcatctacaataatttagtcataagatattgataaataaggtatgcccattggacatgcctgatgggattttaattaacatctgcctttgacaactgaaacaactgaagggagggagaggtacatgacttttgcagagcacatattatgacagacgctaggggtataacatctagcaaataggtacttgatgacatttttatgaatactatgatttatcaaaataagtatatcctgagaagtatatatttatagatgaaacrgtatttacagagaatagactctagtttagagaaactgaagagcattagtaaaagtgttaataagaataatattttaagtactatgagggacttttttcctggtttttaggttttcatgttaaaaattcatgagcaggacagatatgtttgtcttgttgattttatctctataacgggaattcaaattttaaatatgttctagaatcatgaaagtcatggctagaaaggtcttggagattatctaattgaggagtcccaaatctctaaataaaatctaccagaagaatcataggtcaattactacatgtataattgttccaaataggtttttccagaaagtgcagaaggtagcacagtcctcaccaagttctttcattcagcaagtgctatcaataccacttaccaagcatatattttacttggagaaaatgaaaattgctccatccataattggttgagagcccctttaggtataataataatcttccctattatgtagttgagaaaactgagacccatatactaagagttgaattgtgttttccccaaaagatatgttgatatcctaagccctaacacctcagaatgttaccttatttggaaatagggtctttgcagaggtaaccaagttaaaatgaagtcattatggtgggtcctaattcaacatgactggtatcattataaaaaagagaaatttggacacagacacccctggagggcagatggccatctgaagacagagaattctaatgatgcatctacaagccaaggaaccccaagaattgccagcaaaccaaacagaagccagggagaggcaaggattcttctcttacagatgtgagagagcataggcctgttgacatctagatttcagacttccagcctctagaactgtgagataataaattactgttgttctaaaccactgaatttgtttacctagttatgacagctctagcaaactaatacatcatagatattagtagtcatggtctcctggagaagtaattagcaaggtagtcaagtctggaacccagtttaattcccaggttcagtgctcaatgcctgtctctagaaataaaactttttaatttcttttgctgtaaagataaatgcaccgtaattcacaaattgttatgaggactatttttctgttgtccatttttttggttatctttttactgacttatttcatttataacacaatcttgaagtctgataatttcaggtacagacttcatttattaaaataaaaactcaaacttgaggagacgaaagttattcgatcatttctttcacttcccacagttggttaatgaaatctggagaataatataattgttatatctttttctttgcttagcgtaaacactcaaactataagttatagctgataacactcaaattataacttataagctgtaccataattcatagtagtcaatgaattagtcagctaaacttgaacatattactacaacttatgggcatacccaactccagatagtagaaataagactcagagtatacatttcatgagataaatctaatgtgagtatccaataatagattcaaatatttttcaagaattgactatgagtctgtgaatatatattaatgactatacaatacttttttttttttttttaagagatggggtctcactgtgtaactcaggctggactctagctcctgagctcaaatgattttcccactcttagctcagccacactctgcgtagctggaactataggtgtatgccatcacgcctagcttaaaatatattttattaagaattggtgctatggaaaagtattgcttcaaccatttcccccttttcaagctaaaattaattagtaatttaaaaagagacatgaacatcaacaaattaaacaatggaacaaggatcattcaagtcctcctataggcctcttgatctgtacattaattggaataatggtctgttctttttgtagaaattaatcatgttcttaaacacctccatkcagtgtaagttctgactgtttaattaaaactttatagtaagctcaaactgggatcctgaaaatgaaaagatattttttgttatctggttcaggtttttgttaggatgagcactctcccttatgataatccagaggtctgctcctttgaaatgtcaccccaaagtaggttgcttgaagttcccagaggctaagagggttccccctatcaggacatagttatgacacctacacagctcccctcttagcttcatccctcttagaagagtttctatttatcttcatattctgagacgaaattgttccatttattctactaacctcagcaaaagctggttatgttaaaaacaaacaaaccaaaaaacctaactgcatctaggtaaacattttcccatatttgttcttgcaagatggctgataaggcattataagtggtgatccctttattccatcattacaggaaaaaataatgtttatttgatgtgaaggggaaaaattaaaattaaagataattctatacttcggatacttgaccatattaaatttacaaaatgtatagttgagttttaaaatcacaatataagtagatttcttctactcacaatcattatattagataagaaggtactcctcttgatctctcctttgctccatcataaaatccttactagatgggtaagacggtagttgtgataagacagtagtagcctatcctgtcttatacgtttctgtgaagcccagagaggtgacatgaatttctgaaggttgcagaactgagacttaaaacttagtgtgaaatttattctgttggaaaaaaaaattgcactgtaactatttctttgaactttgggaagtatatccttattagagaattacagtgtcaagacattgcgctattattaaacaaatgataccactattttgacaagagtggtactttccaaaatacctaagaagttaattgaagacttggaattatcagaggatttattttatgttgaaaattctgacttatttttaaattgtttattccatctcataaacttctatttgttatttaattttaggaactttgaaataaaagtttttttttttaatatatcttatgtcctgtgtgcaagtctaatggatagatctgtaccttgaagttccaacttctgccctcagagatgaaagtgacaaacagcaaaatatggagcagatacattgaaaactttaagaaacttaatttttatttagtttgtgcttatttactaatatgttctctgaatgcaaagtaagtatacatgtagagtcatctttatgaaaagctatataaagagctataaataaaagggatagataggtaagacaaaaaaaggcacactgacaaaatctgcggtaagaaatataatgagttagattctaggcatttgtcttatttaacatggagtaatttgtggatatatatatattgtgtgggtatttgaaatttatgtagttattttaaatcatgtaatttatttatgcaattattttatatttatgttaacttatttatgtaatgattttacatttattaagctgacgattatggtatatggaacttaaaggtataaatatacccatttatggtatatggaactgaaaggaataaatctatccatttaccaatcagtctgagagattctctggtttcttacaaatacagattggcaacaccgatgtggttaaacatgacaggcaaataactaccattcaatgtgaatattagcaatactgacaagagaaataacatttgggttgaatagatacatttatgtcaggtttttgtgtattagtttctctctctttttttttttttttttgagacggagtctcgctctgtcacccaggctggagtgcagtggcgcgatctcggctcactgcaagctccgcctcccgggttcacgccattctcctgcctcagcctcccgagagctgggactacaggcgcccgnnnnnnnnnnnnnnnnnnnnnnnnnnnnnnnnnnnnnnnnnnnnnnnnnnnnnnnnnnnnnnnnnnnnnnatattaagcgtcccatgctatattgagataactttcaaacataatacaattatggtagtaataataatttggaacttcaactatactacttgacattttagcatttatgtaattaattagttaactaacttgtaggtgccaggcacagctaggcctaccattaaggagtttgcatttttttcaagatagttatttatagtacagtatgaaaagtacacaaattttgagcagtattttccttttttcatggcttcccttattcaacttctttaagtaagtaaaattccacctcagaaatggttatccatgttccctatctcctccattcctattgtctctgccttgactcaagacctccttatctcttgcctggattatagaactgtgtcataacaggtctttctgcttggagttacccaccttcacttgaccacaatctgtgatacccagtttctttttctttttttttttttttgttttgagacgtggtctcgtcctgtcacccaggctggagtgcagtggcgccatttcggctcactgcaagctccgcctcccgggttcccgccattctcctgcctcagcctcccgagtagctgggagtacaggcgccaccaccacacccagctaatttttcgtatttttagtagagatggggtttcaccgtgttagccaggatggtctcgatctcctgacctcatgatccgccccgcccccctttggactcccaaagtgctgggattacargcatgagccaccgcgcccggcccccactttcttacactgtatctttctaaagaataagtctgaacaaagtagtgactattttaaaccaatagtatacatttactaaattcttagcctgcctttcaaaattacattcagatttttccaccattttctttttagtgcatcttaagtacaggtcatccgtgcgcccgtcttttttctgagcaaatcacctgtgtactttcacattcttagcatctgccaggggtgttccatatacctggcatgatcctccagcccccactacccgacctactttatttcttcctggtaaaaccctcttcaaccttcaagccacacgttatgcagcctttcctcgcactgagaaacagatactttaagggttatgatatttattatattgtaattatttacatgttttgtttccctctagagaatgagagttcctccaaggtggagactcattcagcttttcgtctctcttacataacctktgcctggcaggttgtaggtacccagtgattattgaattagttaatatacgcaatatggatttgcttgtcagagcatgagtatccatggctttctgaagtccttcaacctttgcttgtgctacttcctctattttggtcctcttcaataggcgaggtgattatgatctacctctaatgggtcacagtgaccccaaaggcaaagcaatatattgatctcccttaaaaggatgtatgccacgaaataagtgtttttatcttctcatccatattcacatttatactttaagtgcaatgtcctgagtgagacaaaccttcacactaatctgtgtaattaaaaatattgaaatctcattgcttggcaaccactctagacctttggacacattttctggcgctgttaagggggctcaggctgcaattgagatatagattacctatttaaaggaatcatatttttcccctttgaaatgtctgtcctttatctccttttgatggattttctaatttattaggctttgcttttttgggaagtaaattatacctgttgacacagttgcatcctcatgcaaaaacaaagatgatatcattaatattttatggcttaatcattaaatgtgaaagggtgaaatgcttgtattgcaattgaaatgaatcttgaattgaccaggtctttctctgtgggaataaaaagagaataggtatgaactttaataaaaaatggtgtttaactctacatttagcagaggtcttctaagtaattttgccatcagttttcttcccacaaattctcccattacataaataatctgctattatgttgatagactcatctttctgaaatatagacatgttcatataattcatagtttgaagtgtctgatgtctcctcttgcctttaaagaataccctgaactcttaaacttcacgtataaggttccatctgtcttgaccccaatctacctaggatttctcctcatccctggtaatctatacataccttaaaacccaactcaagcattacatgctttctttagctcagttttcactgatgccccagcctcttagggaagaattcattgtttccgtatttgtgaattatagcacctacccattcatatgtggaggaataaaatgtagagagtaagagttagtgtttcaaaggcagaccttctggctgtttgcattctgtctgtgggaccttcagaggattccacggagtaaaagcactctatgtgtcccagttctatcatttatgagagaggggaaataatactgctccagaaggttattttgaggatttttaaaataatgcatgaacagtacttagtacatgcctggtacacagtaaggactcaaccactaataaaaaaaatgttttgtgtgcttacattttgttttgatatgcttacatatttttcttccctattaaaatgagatggccagaattctgtcttcgttgtacaggcagcatccaacagctctcagcatataatattggatatgtgattattaatatatgtaaagggtaacatattggtcaaaacattaattatttggagaattattcgattaataaaatatgttttatacatattaatgctgaaatctctgctcaagtgttttaagaggggatttactcacagaaaataaaggaaaatgaaagctactaggtgaactatagtttaaaataacaaatccaaaaatgttagatattgcatctcttcagtggagtattatgcctggagccaattttgaaataaaaacaatgtaagtacttacaaaatctccatttggttcagactctgcaggtggaactaatgtaagtggaaagattcctaaataattccaaagtcactatgaataggaataatgatcatcatacatatacttatcacttctattagaaataagccatgcttatacatattgtttaatatagccaaaatatcttacacataaagaagttagttataattccctactctattcctcaatatttttaacagtgcttctcaaatttaaatagggatgacaagactgatgtttatcaggttttcctcaaggagatcctttactgtgaggtgtgtgtgtgtgtgtgcatagaggtattattgaaatatgattcacataccatgtgatttatccacttaaagtatacaattcattgttttttagtatattcacaaagttatggagctatcgccactaatccagaacattttcatcatgtcccctaaaacacctatgcctgttaacagccacttctcatttcacctacctctctactacttccaggcttaatcaatgactaatctattttctatctttatagatttgcctattccagacttttcttataaaagtaatcaaaatatttgcagtcttttgtaattaccatctttcacttakcataatgttttgaaggtttatccatggtgaagtatgtatcagtactacttcatttctttttgttgccaaataatattccattgtatggatataccatttttgtttatccattgattagttagtagacattttagttgtttttgctttttggctattatgaataatgctgctatgaacatttgtgttcaaatttttgtgtggatatttgttttcatttctctggaatatacatctagaagtgaaattgctggatcatatggtaaatccttgtttataagtttgagaaactgtcaaatggttttccaaagtgaatgcatcactttgcatttccactagcaaattataaaggtcctcatttctccacatcctcaacaacacttgttattttctatgtgtgtgttttaaaaatggtttttatagccatactgatgggtataagatggtatctcactgtggtcttgatttgcatgtccacagtagctaatgttgagcatcttctcatgtacttgatgaccatttgtatgtcttctttggagaaatgtctatttaatcctgtgcccatttttcagttagattattttcttttcattattgaagtttaagagttctgtatttcatatacaagctttctggtataagtctcatatcagatttatgatttgacaatattttctctcagtccttgtattgtcttttcactttcttaatgccattgttgtgtgtgcttatttttaaaacaaaatctgatgacagattattctaaaggctagattttaaggttgatatttgttttcatgatgcatctactattatttattttcgtattttctgaaattattagttttttaattacagctataacattttgaacaataaaattcttaattttagtgttttccaaaccgtgctctgtggtacacaagatgctccatgactaaggtagattgagagatgttgtttgctttatttcttactctgagcacacaatattaaaggccatatgatattctattttaaaaataacatgtctagcccagcatttccaaaagccgttttaatctttttccctgaaacagctattaaacccaagttctgtaatatatacttcagaaatattgttttaatctattctctgaactagttttacctggcttgtaggactatctgcctttgttcttaaaaaaaaaaaaaaaaacttgtgagagtctttttaaaattctatagtcagatctatgacaacaaaagagactgagacawccacaagttatttctaccatgtttgtttaactcaggagattgaatttgatgtgttatatacatggtatgaaccaaacgcataatagaaattgggtcttctctaccaatcagatagttagaaagatatgcttttacttcagagaaaattcaaagtcagctaaagtgtgtaggtctgtttcttttcaatttccagggccttttccattatgtatttgctgcctaccattattgctactattccatgaaaaatcgcactctgtgtgtgtgtgtttagatttgtatatgtctgctcaaatagagcttaatggtgacatttttatggcttcaggatgttggggtggagggaattatcttcccctcatggtcgctttgtgtcagatgatcattgcttcatctctagaatcctatattgcttctggacagggaaaataggaaggcagaaaggcaaaagagacaagctagctgagttttcccctttttaaagactttccttagaagcttcacacagtgacttctgcccgtatctcattaaccaggactgtgttccatgatctcctgatctgtaagggagttaaggttgggggaaatagtttcctagctggacccattgccatctctatgagaaccagggttctgtgaataaggaagaagaatacgacgtattataggatggacaactagcatttttgtcacacaaggcatgggatgacagaaaattctgagagtgaagagctaaaaattctttactacttgtgtattcaacagtagaattttaaaaatcaactccttattgtagcctaaaccacctgggttcaagcaatcctcctgcctcagcctcccaaatagctgggactataggtgtgtgtcatcaggcctggctaatttctaaaattttttgtagacgtgagatcccactacattgtccgggctggtcttgaactcctggactcaagcgatcctctggctttggcttcccaaaatgttgagattacaagtgtgaaccaccacacctagccttattttttttttttcctggacaacaccaatcagttattctttttaaaaagcatgtattgaatcccttaacacgtgccaattatattccacatagcaaataagatccataaggtttctgctatcctgaaacttactttctaaaatggaagatagacaaaagcaagtaccggttgagaatcccttatctaaaagggaccaaaactgtttggagtttggaatttttcagatgttcaaatatttgcatatacataatgaaatgtcttggggatgggacccacgtctaaaacacaaaatttatttatgttttatgtctaccttatacacatagcctaaaggtaattttatacattttttaaattttctttataaaacaaagtttgtgtacattgaaccatcagaaagccaagatgccactatcttagccacccatatgggcatcctgtggcaaaaaaagtttcagatcttggagcattttggatttttggactaaggatgctcgaactgtaatgaaataattacacaaggttatttcagattgcagtaaatgcaggaaacacacttggtcatatgctgaagagtgacaagagaagatgagggtaagactggccacttttgttcacttaataaaacccagcacctaataccatgcttggtgcaggataggtgctcagtaaacgtttgtgttggatgaatggatagatggatggatggatgatcagtcacagaaagtgtcctgaggaagtgttayttgaagtgacacccgaagaatgaaaatgagctgacaatgctaagaaaatgggaaaatgtattctaggcaagatgaacggcatccaaacctttaggttatatcagtgaaatcaaatttaattctaaaacaaatgagaagccattgaaaggtgttacattgattatctcatctgggcttcacaaaaattacgtgaagtaggtagtcttattatttccattttgcaaatgaggaaacttaacctagaaattataaaatatccagattcacagagctggtaagaatgaaattgggatttgattataagaaattcagctcgagtccacccttaaccactgtgcaatgttgtaaactataaaagtaaactgtaacaggactagattgtttaaacagcaagtaaaagcctgaaaagaagatatctgccaatttaatggattcaatttttaaccacattgtctattagtgactcttatgaattgaatacatagcacagtttctcagagcctccactgaccatctttctctttcaaagtaaaaattgtctttgtatattacattatggactggattattataaaagatctagtttctggttctaatgaacgctgaaatatggaattgctaaaaagtaaatttagttagaataacaatagcttgatagaggaaaatcattacaaactcaagcggagaattccagtttagctatgcccttgaagttgttattatactttgcatataatttattgattctgaaaagttggatttgccatcttctgagaatattatcttgggcatatggggcacaccctgcaaccagaaacagcacaggaatagtcattccttcatgacaacttctacgaaagtgtaaattgaggctaacaggraaatcaccctattactcctgtaaagtgacgatagctttcagttttcaaatgcgactttctgatcatgtttgaatgtgtttctgttcatgtttatggagaaatttaagaattagaattgtgattcttaattctaattcttaaatttctccacaagtaataggaaactaaagaatttttctgtggtaatttcattaggaaaactttggctaggacatggtgataatgtgcagatattttgtttgccatgtcacattcttccccttcttttctggaatgcaatcaatggtgaaacatgttttacggtaaaacatttaatactccaaattgtgaataaagcaaagagaatgtgtttaatrtattttttaaatcatatactttctttaagaccctctcactcctaacataagctagagttttccgtttcaatatataatcaaaaaaccaagtatcctattaagtgtatattrttgactcaaattgacaaggacattggtaaccttccttttttttttttttttttttttttttttttttgagacagggtctccctctgttatccaggctggagtgcagtagtgcaatcgtagctcactatagcctcgaactcctgggctcaagcaatcctcttgcctcagcatctagaatagctaggactaccaggtgcacaacaccacacctggctaatttttaaaatattttttgtagagactgaggtctcactatgttgcccaggattgtctcaaactgctggcctcctcaactgatcctctcacctcagtctctcaaagtgctgggattacaggcacaagccaccatacctacccctctatttatttagtttttgccttcaatcaaggatacagtacatcgcatttgcttgaaatagaaaaaaagaatgagcaagtctctcggttcttgtacttgtggtaggaatagagacagagaagtacctggttaattatttctgcacctgcaattctaacgacctcagttaactacagttttaggtcatactttactcttcctttttttctatttcttcctttttccttgccacatcatctattccactttattttcttttattcctaaatagaggtctgcataatatatcactaagaggaatacatttgcaataaaacttttttctgcaaaaaaagcattggttttattgtaaacaaacctctgaaattactttcaacatatcaaatgggtcatggacccgtgaagaattgagggggaaggtcaaatttaggggcagagatgtactgtaaacttagtcaaaagaatatcttcaagtcttataataaattactttcttcagcatttaagaacttgaacacaaaatgcacatgtcttgttaaaatctaattgaaagtggaactaaagtaatttttggcacaaatcggctttagaggacaaataagaaagccaagggtcgcgtaatggggctagtatatattgtagtccgtctatgcttttctcaacaacctcccaaagtctagctgattggggagtaagaaataagtagcagggaaaatgtttggaattttgtcttttgctgaaggtttcttggcacttatgaaaacttcattgaatgaaataagactttaaaaattttgtaaaagactttttggaaaaacgtaactttcacattaaaattatataaaaaccaattcagtatttttctcatttataagacttaaaaatgaattcaatgttttaagtcacaccaattactgagatatattttttaaaattacctatttatcaattttaaagaccatttctaaaaaaggagtttaagtagagaatattcctttgagttagatagtttttggtatacgtaacagcatacacacacacacacacatacacttttaattttcttggacttatatattttaggcccataaatgtaaaccatttggatatcaaagcaatgtttatgtttttcagcacgtaattttaatgctacagtctgagaaattgtatgttgtttaaatgcaatacatcacaatgtttgataaataaaaataaaaaccgttaaacctatccaaatgcaagaactcmtaaatattgttgagttaaagcttttgatgcagctgaggctatgtctggattttattattttccctaggatttccaattttttctaagaaaggagatcaattttatagattagtctcctgaagttgtgccagtgggttcgtctgagttttaataattttctgtagaaaatagccttgaatgtgtcttttcacggggcatggtatgaatgaaacctaaatatatagggaaacagagatattagcatgatccagtcataaaacaacaggtgaagagctagaaataataaatgaggcctttattttattttttatttcctactcatttactcaaattgacataaataatgcaagaggtagtttgacaaactgtacaatacagatttatagtcacattaattggtgcttaggggtttgggtttcacctgaagttaagttcatatagttaataaagtcataatgccttgtttaaatatttcatgagaaaattgcattttgttttgtctactcagaacctaaaatctgttttattgtggttattttataaatatttgcatggaatttttggagtaagtttatttggtttgtttgttttttttttaaacaggcctaactatcaattgcattggaaatttgattgtgtttccaactaacaaataataatacacctggaagtgcaagtcctttccatattgaacagactctctctagcttttccttagctgatcttttcaaacgtttgctatttgggcctctctggccccaaagagtagccttttgctactctttacgcttgaggaagattaagctatcccaggcctctcataaccaaggggatccattaatattaaaatttagatttttccactgttaatgcagaaaaccattgattcagtagacttcatggtcatgcacatgcgttacatgttactctgagtaatgctgcatgaagttttaattacagattgatcaaattctataaattgtgttttggcgtggccaaggaatgggtttttcctattctagtttaatagaaagtcataatatatatcatgtgaattttacgtttctcaatgaattagattgcaacaatgcctaagtttgattatatacttattaatagtgataacaattatagctcacatttagtaagtccttactatgtaccaggtatataaggctttttaaacctaatgattcatttaatgcttacaaaaccatacaaattggatgctattattagctaagtcatggagacatgaaactgaggcacaaagacattatataacttgtcaagatcaagtatctggtaagactgaatatcaagtcagaattgggatttgaaccagtctggactctagagctaacatgcataacatatagcctacactttttaattattcagaaggtacttcaagactcctgtggtgcctttgggttggcagtttcagtattttttatgcttacatagagcataagatatataaatataaaacattatatataatatatattcaaatatatattttatatgtgtatatatatttccctaataaatattgaaagaatgcacacatgaatgagtggatgggtgaatacagaaatgaaaaatttgtattgagatgtgctaatagagaatttggtataactaaacatctgatatataatttatattttgaggtaactctttagccaacattttaaartatgattaatttatagtacttacgaaggattttcagagacattacatttttctgttatttcactgttttaaacaagatggagattagagggtggaaaatggattctggagaaataaacccatcatattaactataaccatgagttccttgaagacaaatcaaatctgatgtcttttctttytccttatgaatatacttcagtacgaaggacctgatacttagtttggacccagtaattatttattgttgtaagtagcacagtaagaataaaaacgtttatgatttgcaaccagccaacctatattttaatccatatttaaccactggctgggttatgttacatttctcctctcttaactcatttccatatccataaaatatggagcatatgcctctatggtttcttggtgatgaaattatgtattaaaaattataaaactgtaaaaaatatatctcaaaatgtgtttgtgttccatggaaaactgtaaatctctcttgaaacaaaaaagtttctataatcacatacttctagaaatatttcatctgagttcctttaaaacttcctcaagctttaacatgctaacaggtactgggactatccaaggagggatgatattttgcagaatttcacaagcttattttactttattaccatttttcataaaatacctcacaggaaaacttaagcatgagactgatgtgattacattattattaatagtctccaaaattcaaattagcaatagaagttgtaaaaatttcaagtaatcaggataaaccagatgtattaaatgaaaataatggaagctttgtaagattagtggcagcatataggtttagaggaattattatcattgtgataacagggacagatacagaattatggaaacattctaaagcagtatataggaagatcattatcagaaatagatagagaaattgtagtagagaggctagaatttcaaactccagaatatctgaatttgcctctatctgaagccttctcattcccagtgcttatgaaatttacactggctgctatattgaaatgctaagaatcagaatcagggatttagtatcaatcaagtggatggaatttagctagttatcaccaactgtgaaaggaaaaatatccgttaaattcagtcacaatgctatatatcaggctctcagtgattttttaaaggagggtcaattttaagaattctaaggaatctctttgttcctgctaatttgtcygaaggtttacgaggaatacaggagaaagctaaattgtttggggaacagtaagagatttagattctgagaaagatcctggaggaaaagctggggccagtatgctgaaaaagacacagtcctcttgccctaccccaagagtaaagggcaagaggtagtggctgccaaaaaaaaaaaaaacaaaacaaaacaaaacaaaaaaacctgaaaaaacaaaaaagttttgtggagagatatcgaatggatatttatatggctttttgctgtattttgtataatgtaatgatgtcctcttgtctccccatgaaatcgtcagtgaaatcaacatcacttgctaatacattgtagagtgggattgatttgaggagcggggagatgtgatgaagtagctgtaatagaggtattgtgtttatgagactgtggctgctagtcacatctgttttacccacacgaggctgatgtggtcttctagtttgtaaattatgatatgcaggcggttcctgccagcagagatttaaaaaaaattatgcaggtgggtaagtctttttcagcaccacctgtattaggtctttctagatcccaaatcccagtattgacgactggagggctgataaacagtatatggcaaccccaggaattctgttagcttctttggcctaagccccggaccaaatgcagacttccactcttacttttctgaagagtgcaaggtaattttgacattcttactccgttaataagaagagacccaggaaaggaccaccaaaaaaaaaaaagaacaatttcccaaaatgactagacaggtgctgagactggcctaaactatcagagatcttcccaatccagagcactgacctctgctagagcctgcagtcaggggagacatacagttcaggctcatcttctcacatggaatgctgcagagagcaaatataggtagcatagaaattaaggaaaaagagtatgccaaggaargaatccaatcaaacatgcccaggttaaagaagtgcttttagtttcttatcaaatcaaaaaccgtgtgctcatcagagtaaatgtggttctaaaaggcaacccctgctctcatgcattttgtgactcttgaaaaacaaaacccatatgtaaagggacaataaaattgtactatttagtatgactaatataagggtgtctttgtggcatgtggtgcatattctataaattcttgttgtattgaatggaattaagtaagagtttggggacagaagaatccctggtgtattagtatttccctagataattttttcttgtaattttgaattaatgaagctaataattaacttgtagaccaattttatactaaaggaaaatagtaaataccaaatatatagctatgatcacaaagatccaatccctttttaaatttaacatagagatgctttgctgctcctaaggtaccattcctgctcccgcctcagagcctttacatcttctatttcctctgtctggcatgcatttcccccaggtttgtgtgtctggctctttatacaattatctgataaaatgtcacttttttcagaaaggactttttcgatctactgtacttatataaacttacctctgcttccagcccctaccatccattacccccacttgttctcccttcgtttattctattctaagcttctttatagctttatcatcacctggtatactatgtttctgtgtttrtcttcttccttcactaaaatataatagccaggaggcagagatacatcttgttttgttcaatggcatacagtttgtgcctagaacagtgctttgcacataatatgcatacaatacatatttacttaatgagtacatgatgaaatagaaagtggactgtgtggtaacctttacatccttatatgtatattagttttatatgtcttcagaaatatgttttagccatcttcagctgctgtaaaagaatagttttcttgagagtagtgcaaagataactgtggtgactattactttccatcgttatcctctttttttcatatctaaaacttctcacctctttaaggtacacacaaataataattttttatttcccatctagttacagtcctccttcagctttcatccctttagtaatagttgtggtgaattttttctcccgagaagcycctaaaaaggcgttcatttttacgtaaacaaacaacaggagaaaaacatataaacatgaaagcaaaatattttacctacagaaatatattttcagcaatctatttctcatgctattgttaaaaatatctctrcttggatagaacctttttgtttccatgctgacttcttctttgcttctcctgtgaactttttaaattctgtgtttggcagcagttttgttttccttggagctaagtactgtgtaacatactgttagctgaaggctgtgatgtagaaatttattattaaaaataaaagacggagagaagaatttattccataaggatcaaaatgacttagtgtcaaagcagttaggattttcaaaatgctttctataacagattgtgtttcttttcaaggaagtttactttgtttgccaggaataaatttaagggtcttcattgtgcctatcttggttaatgagaactgagaagagaagaaacattctcttttaaaaaaaattttttttagagaatttcttcatcagacggaragattttatttgccatttgcaggcataaccttggtgacctatatatccccagaccttctggtaagatgcttattaaaatgtcattacccagaggagtaatcataaactagccagagggtattttttatagatggtgagagacaaacattttttttctccctgaattaagtagttatgtactcttatcaactagaatatatttaaacttacttttatttatttttccagtctcaatctctccctctctgttttatgtttctagcaactttatgtaactaatcttaaaatcattagcattccttctccaaaaagagtatcatatcatcttaataaagtttctcttttcccagaattgcttaagtagcatgctgctattcatttctcttgaaaktttagtcaaaatgaattattttgcaaaaaggaaaattccacagtttctatttcttttcctcattgtctgtggcccattaacgtcttttatctgctactatgataatgtcaaatgattactttggtcatctgcaacttaacactaatcttatctgtttaattgaaaggatgttttgactttctctttgaaataatatcaacatcattttgcacttaattctgaaattcattgacctcaatgtgcaagctgtcttctttactatttattgtgaataaccatttttttttatttgttgtaatcacacatcargaaagggctagggagatgtctttgtgaaacatttatccctatggttctgtttaataggagtacttaccagtagctaaatgcctcattttattttaaataatctgtaatattaagtcagtttatcacactatgagtagttttttttaatggattctgacaatatgctgcttattgtagtctttcatcctttatctgagaacwatgtttttatgacagtaaaatattttttatacaaataggataaaaattcatatgctgtcatgcgctaatatgaagtttatccttacatctcccactctccaccccatgccccatctagtggccagaatgctgtaatcgtgggaaggaataaagctctgacactatgcagtccctacccccatcattgcctctttctttgcattaaaaaaaaaaaaaagaaaatacactgaaataataaatgctaaattttggctcagattattttaattagaaatggaagtttaatgataaacactttgtattcttcaaatccaaaaggagaaatatcctgtttacttcctttggtgctcttattgactgtagaacattacagtatctcatttgtcatatgcagagttcattctttttgaatatatttcacataggatgtagatttctgtaacattttttattactttgaaaaaagtagccatagtgtacattttaaaatactaccacattcttggtcagctcatacctttcaaatataatataaagatgatattaatatataaataagaatggaaaagaatttctttgccctgcatatttctcagtttgttatataatgctaggaaataactctctgatacataacacacttggcaaattttactgttttatgctttaaaagaaaaagtcaaatttagatagtgaattttttgaaatgcatcttacaagctctgatttgcaaattaccaaattgatcttatcttctggagtaaatgatgacccaaattagtctacattttgagtgtttttgttctttgactaaaatcgtcatcgttaagataattaatggcagaaggcagtgaattacatgctttcctcattttaattctggtcctacaaaaatgtttcctttttgacttactgtcatcatgaaatattctctcttaaatcaatatattgtggattataacttgtgtttgtaagatttatttacctcttttagttgtgataggagaatttaccaccttattttgatcctgttagtttaaactcattagcaaggaggataacagtgttaatagtcagcattttgtaaatcttccagaagattttgataaatcatttcactagaagcctattgctcaatttattgccactttaaagttgccaaaaataatgagctcatcttcctattttaatgtaaggtattgtcaatgtttgaaatgtgtcaagaattgtttttgatagttctagtgaacaactaatgtttctaaatcatactacttatttcattagttaattattgcttgtgaaccatattataatcatctttagtatcaataaatatttttgagatgatataatgccartaaatccataaattaaaaaattaaagcattaaagaaatayctactatgtaagcattcaattttatataatgattatctgggtcagtgtacccaaaattgtgtgctagccaaactacaattaaatcatcatgataattccaaggcttaaaacaattgactatgtctgttaaaaatgagtagcttaaaattcattaaattactttgttatgttttttacctattatactgtgaacatttcacatgttcttttttataaaggccttggaagccaaattttaattgctctatggtatcaytttgtataccgtaatctattgagtaatttcccttttgttggataaacaattagtagcacattatagttactggatttttagatcttagtttactggttcaaagggtatgaatttttaataatatatgtattatatatattttatatgtgtgtaaatatatatatacaatgtgtataaatatatatttgttatatagtagcaatatatatgcttagtttactccctgttttccaaatattcaacattattaatttgcaaatataataggcaatagtagtatcttgtcattgtttatattgaatttcttttacttccaataaagttaaatgtctttccatagatctatttattttgtaagttgttctcactcttccctcagttttttactagggttgggattctttcaaatttgtaagaacccttgatatcttgaagatattattctttacctaagtttactacagatattttaccaatgtgacatttgtgcaaatactctaaagttttatatagccagatcaatttgtcctcttttgtaataaaaaaaaaaagtctttaaaaaaagatttacggacaggattgacagattgatagctctttctcgattccgtgggtggtggtgcatggccgttcttagttggtggagcgatttgtctggttaattccgataacgaacgagactctggcatgctaactagttacgcgacccccgagcgggtctgcgcctgccacctgtgcgggggccggcaggaccccgacaagcagctcatgtgcgatgagtgcgacatggccttccacatctactgcctggacccgcccctcagcagtgttcccagcgaggacgagtggtactgccctgagtgccggaatgatgccagcgaggtggtactggcgggagagcggctgagagagagcaagaagaaggcgaagatggcctcggccacatcgtcctcacagcgggactgggacaagggcatggcctgtgtgggccgcaccaaggaatgtaccatcatcccgtccaaccactacggacccatcccggggatccccgtgggcaccatgtggcggttccgagtccaggtcagcgagtcgggtgtccatcggccccacgtggctggcatccatggccggagcaacgacggagcgtactccctagtcctggcggggggctacgaggatgacgtggaccatgggaattttttcacatacacgggtagtggtggtcgagagctttccggcaacaagaggaccgcggaacagtcttgtgatcagaaactcaccaayaccaacagggcgctggctctcaactgctttgctcccatcaatgaccaagaaggggccgaggccaaggactggcggtcggggaagccggtcagggtggtgcgcaatgtcaagggtggcaagaatagcaagtacgcccccgctgagggcaaccgctacgatggcatctacaaggttgtgaaatactggcccgagaaggggaagtccgggtttctcgtgtggcgctaccttctgcggagggacgatgatgagcccggcccttggacgaaggaggggaaggaccggatcaagaagctggggctgaccatgcagtatccagaaggctacctggaagccctggccaaccgagagcgagagaaggagaacagcaagagggaggaggaggagcagcaggaggggggcttcgcgtcccccaggacgggcaagggcaagtggaagcggaagtcggcaggaggtggcccgagcagggccgggtccccgcgccggacatccannnnnnnnnnnnnnnnnnnncgggtccccgcgccggacatccaagaaaaccaaggtggagccctacagtctcacggcccagcagagcagcctcatcagagaggacaagagcaacgccaagctgtggaatgaggtcctggcgtcactcaaggaccggccggcgagcggcagcccgttccagttgttcctgagtaaagtggaggagacgttccagtgtatctgctgtcasgagctggtgttccggcccatcacgaccgtgtgccagcacaacgtgtgcaaggactgcctggacagatcctttcgggcacaggtgttcagctgccctgcctgccgctacgacctgggccgcagctatgccatgcaggtgaaccagcctctgcagaccgtcctcaaccagctcttccccggctacggcaatggccggtgatctccaagcacttctcgacaggcgttttgctgaaaacgtgtcggagggctcgttcatcggcactgattttgttcttagtgggcttaacttaaacaggtagtgtttcctccgttccctaaaaaggtttgtcttcctttttttttttttatttttatttttcaaatctatacattttcaggaatttatgtattctggctaaaagttggacttctcagtattgtgtttagttctttgaaaacataaaagcctgcaatttctcgacaaaacaacacaagattttttaaagatggaatcagaaactacgtggtgtggaggctgttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcaagtgcctttgattcgttccttctttctaaagacgacagtctttgttgttagcactgaattattgaaaatgtcaaccagattctagaaactgcggtcatccagttcttcctgacaccggatgggtgcttgggaaccgtttgagccttatagatcatttacattcaatttttttaactcagcaagtgagaacttacaagagggttttttttttaatttttttttctcttaatgaacacattttctaaatgaatttttttgtagttactgtatatgtaccaagaaagatataacgttagggtttggttgtttttgtttttgtattttttttttgaaagggtttgttaatttttctaattttaccaaagtttgcagcctatacctcaataaaacagggatattttaaatcacatacctgcagacaaactggagcaatgttatttttaaagggttttttttcacctccttattcttagattattaatgtattagggaagaatgagacaattttgtgtaggctttttctaaagtccagtactttgtccagattttagattctcagaataaatgtttttcacagataaaaataaaaaaataaaaaaaaataaaaaaagatttagatttatttaattttttttttatttcccaagataggttgagtatttacctggattttattctattttatatttacagttttgtctttttaaaaatttgtcttttaaatctataattaatattaccatttattataaggttaggctttaattattttttaccctcaaaagtctatttttctttttctttcttttttttttctttttttgtgagacagggtgtcactctgtcattcaggctggagtgcagcagcgcgatctcagctcactgcaatcttggcctttcaggttcaagcgattctcctgcctcaacctcccaagtagctgggattataggcgtgccccaccacgcccacctaatttttgtatttttagtagagaaggggtttcaccatgttggccaggctggtcatgaactcctttttttcattagttgaataattcatcaaatacaaaatatttttgatgttttcttgcttatattttgttagcacacatacgtatatttattccaaattatttcattcatttgcatttttaatgctaaaccattatccccaaatttggttaagttttataatatatcttaataaccagaaaggtattttcatcacttgtaacattttctaatggattcctttcttttgagatggagtctcactttgtctcccaggctggagtgcagtggcgtgcgatcttgggtcactgcaacctctgcctcccaggttcaagcaattcccccgcctcaacctcccaagtagctggggctacaggtgcacactaccacgcctggctaatttttgtacttttagtagagacagggttgacccgtctggtctcgaactcctcaccacaggaaatccgcccgccttggcttccctaaatactaggattacaggcataagccactgcgccccggcctctaatggattcttttttattgtatatacttgaggtgtacaacataatattttgatgyatatttacaatgtaaagtaattactaaggtcaagtaaattaacatcgatcgtctctcatagttttaactttgtgtttggtgaaatcacckaaaatctaccctcttagcaaacttcagcacactgtataacatcatgaggtatagttctcatattctgcrttgtatcgctacacttattcatctgacataactgattatatatgtttatactctccaatgaaatttatattctttcaaaattaaaaatactgttagcttttgattgaaatctagttaaacctgaaatctagttaaatttgtttgagtagaattgagcactcaatagtttatagaattaagtcttctttaccagtagcactgtatgtcttcagtaaacttttaccattttctgtatatggttatcaaacatttcttgataatattcaaaggcatattatttttgttgctattgtgaacagttgtttgttgttaagtctacttaggagtcattgctgctatacagaaaagctaataacgtacataaattcatttatagtccatcttattggtgtgctagcttattagttgtaaatacttcttcagctggtactgatgactaataagattactgacagatgaatggagtttcatttctctgagtcaatatcttttatttccttaatattcttaatgttaaatgttattttcaataagtaaatattcttctttgtaagcaaggtagctcagggctattaccaccataggaataacgtgatgatattttataggttattattaaaaatctacgttttgtgactatgtgggcatatttcatattaaatatttaataattttactctttagaactctcaagatttttatagttttgaaggaggattaaaaattattgaactgatttggccttctggttcttatcatttgcggcagtagatttaactgcagtagtcatttacccagaatattttcttaaaaagctaaaggcttaataatatgcaaataaagctttacatggtttaacatctatctaggatgttcctgacagagctacacagtagcttcttttatcacacagtgatattaaaatactctcaaaatgattagaagttgaaatattagctatcaaaccaggagtttgctaytaatttaggtatgttaatttattcatgatagctatttaatatattactaataaagattggaacaacctgattattctttaaaataaagaagaaaaatgtttgtcaggtaaaataatcatttaacttattataattttcatctttccagctcatggggcattcagaatgggaccacaaacgagggccaagaggatcacaggtaagtttcttttccttttctttttcacgtttcgtttcgtaacactttcagccacgggttttctaaaactcaagagataataaaatgtagagcgaggaagaggcaaaataaccatgccatttgtttttatttaagttaactataattaaagtctggatttcaaatcccaaaggcagatgccaggatattccttctaagagctttctggtatcccagattggttgtgtttatatgaatatagattttatattcatcttgtctcggcagaatacattttgatcagcaacccactctctttattcatttcctttgacaatttttccgtgtattttcttttttcttcagcttcctgtttttggttaaatattttgaaatataatcagactaaactctgaactaattacaagattttgtctctaaattaactctcttcatctgagggaaacagaaagatgaaaggacctattatttttgaaaagaaacaaattctaagtctttctrtattaccagagtgttttcattgtcttgctttatgtcttaggcaaagagaaaagcttccatgacgcatttatgctttttaatgacctaattagacaatgtggatttgttttgctttcataattactttccctgatggaataaaggctgagctttacactgagaaaattatttctcctcctagagcactttgtgaagaaatgtaaaaataatttctctcatggcaggctatggttacctgactgtaaacatgcaaaataaaaattaagtgggtggaaatttttgcttctattgcacacattttgcatttgctactaaaaaatatataaattacaaagggcagttgaatgtgcaatactgtaaatgaaagttcattggaaagtgggggcttctcccaagtgtttacaaagctgatttgttcttgtgttgtcattaaacttgtgtgaataactctatttaattcyggtcactaggaaaacaaaaccaagtcaatcaattgttttagttcacattttaatgactgattttatttctgtccagtatcaatttgattagtaaataatgtaaaccaattaaattaggatcatctaaaagaatttatgccttactttatttccctcattcttatctccccttcattttctctgaaaactcttcctctgtacacatctataaaattttaaatcaaaatttgctgcaaggtcagtaatgaagggattaaattaacatagagtaaattcttcatgattcgaaaccagtaaaaatgtaaagataagtgcaaataagaaggtccatggtttctgatgattgccaccaaaacattttgatattcaaaacatgccaagcaagttgttgaggacatgtctcttcaaagcaagggtagtgttatatatagaaaattattgtttaagatatacatcatttactctctattttgcttactttggtataatttatcttcaggtttagattggtcactatgtcaatataaattgacaaaannnnnnnnnnnnnnnnnnnnaaaaaaaaaaaacctcacaattgtacagtatggtttttgttaactttcagtataaaaaggacaaaatttttaaaattccaaatattgcatatagctagaaaatgtgagaattccacatataaacaaaagctattttcataaataaaatttgattatatttgaaagcctgaggtggttctaaaaagcaaaagcattaaaatcggcttgcatgaattaccattatcaacatcaagtcttttttggatctcttaaccagcaaaatagctattctaaatatagtatacctttgtcccattttgattcctcaactcagatgaaaactgtcaaagtaaaaaacaaacacaacacaccaaaagataagaacaataagaaccatagcaaaaaacattaaaaagaaagagaatttccaaagaatttggaaatttcaggtagataaattaagtcttaagtaataacctcttatctgatttcaattccctgctgacgaaataataataataataataataataataacaataatgttttcatgttttggataattgatcccttcttttattgctattatctccttggtcaatatgtctaaagccttccagcttttcaaggggaacttcagacaagttgcacttgaacacagacctcttaatagtttactccaaagccttgctcaagtcccatcttagttaatttagaactggtttctaagcacttcctatgtttacagcactgtggtgggtctaactgaagacaactgaaaagacaagtatactgctttccaagagctcacaaattatggttggaaatacagcaatatttgtatatataattcacatataaggcaatctgatagacgcaacattacatacagtatgtggtgcatgatgacatatctgtgaatgacagtatatatgatggtggtcacataaaattataataccatgttttcagtatgccttttctatgtttagatacacaaataccatttgttacaattgcctacatttttcagtacagtgacatgctgcacagatttgtagcctagtaacaataggctacagcatatagcctaggtgtataataggctataccatctggtttgtgtaagtatactctatgatgttcccacaacaaaatccccatcattaagtgacatatatacaaagtgtaataagactatatatatatattgggaggccgaggcaggcagatcaccagaggtcaggagtttgagaccagcctgtccaacatggtgaaaccccgtctccactaaaaatacaaataatgataataataataataataatagtaataataataagccaggcatgatggtgggttctgtaatcccagatactcgggaggttgagacaggagaatctcttgaaccctggaggcggaggttgcagtgagccaagatcatgccactgcactccagcctgggcaacagaacgagaccccatatcaaaaaaaaaaagactgcatatatacaaagtgagataggatttaggtggaagagtatttcttactccctagtagactaggaaatacctctgagaagtgatgatgtctgaggtgtggctttaaggatgggtaagctttcgaaagtacagaggaaaaggtggatgaaaaagctttggtaaaagtctgaactgagaagagtgtgggacacctttgaatatatgtgaatttttttataacttctgtataaatgcttttggatggcaactcttacagcaattactgtgaagggataatctggagaatgctatactttattgactagataggcagaggaagttaagagggtcaagagtttgaaactgagtactctaagaattaggaccattaacacagaacagtttagatgaaagatgatgacttcagggttggcaatattaagtgacaagtgaaggtgacaattccaaaatgaagtttcaggcacatactcgaggcctgattagaacaaagggtgtcagtttgggaatgctaatcatacaggagataattgagctcctccagtagataggcttccagaaaaatattaaaagaaaaaacagaataaaagtctgatttttggaaaatatgctataaagactagaaacaagctgaggagggagttaatatgagtgtgcatgatcttactagagaccaggtggaggagaaatgattcagaaccaaaagtagttacaccaaggagaggaatgaaatcacagaccaaggttcaagaaaattaaaaatgtagcagatgtctttgggtttagtgattaggaggacattagtgaactttcaaaaaacagttttgagaaagaagtggtggaaagaagaatatagaagagaatagtgtaagataccagaagagtctcttggaagagctttgttttaaaagaaagttgggattgcagaaagaggtggcagcaagagtgatttatttatttacttacttatttgtttatttttaatgctaaggtgagatgtgtgtcttaattactggcagatgaaaagaattagtgtggaaaagaaaacactgaaaattctcaatagtgagctgattcaggaccgaggaaatggtgcggttcagggaagggaatgtgctttcttccagagtggtccttttggcacttctttatgtgttttcctcgccggaaacccacccccacccctaccccataccagccatttacactatatcagagaaactggccctgtttgcaaatgaaatactggataaatccaccaaaaagtacagatgggtaagctttgaaaagaaagtagaggccaggggcagtggctcacgcttgtaatcccggcactttgggaggccgaggcaggtggcacctgaggtcaggagtttgagaccagcctgaccaagatggtgaaaccccacttctactaaagatgcaaaaattagccaggagtgatggcatgtgactgtagtctcagctactcgcaagactgagacagaatagcttgagccccggaggcagaggctgcagtgagccaagattgcgccgctgcactccagcctgggagaaagagcgaggctctgctaaaaaaaaaagatatttctaatagaaagagagaaaagaaaaaataagaacagatattataacattaaaaggtattatgaaccgattgacttcagttttcttggtaggattgaggatataatagtgaaaaatcttgaatgctagaaaacatatggaataaatattgttttagatatctaaaaaagggaacttgcttgattcctgcccagtacaaagcagagagctgtgtcagatgtgagtgtgctagcctgcaagatgaattttaacatattttactttgattcgcaaaacatggatatatgtcaggtacttttttttagcctttgaggaatcagaaatagacaaaacgttggcatctagcagcatctaattttttttttaaagtcaaccttaattattgctaggatagagttaagcttcccctggcttctcccgggatacttaataaataagtgattttctcaaatttccctttgtatttcaaaattgtatcatatatgcattatcacagaatttaagatgcaccattcatatcaaatacttgtcctatagaaaaatacctatctctcttctagcaaattccaacccttaattgcatatgactttttagacgcagcaagaatgtcattcaagctgacttatattactttattctcagtaattctctttcataatttgtcagctcactcatagctttctggctgatttttcttctttctttttttaaaagtatataactctcaaatagtagatcacccaaatgtaggaaagatgctaaatgataaataaacttccagcagcatgcagaactcctttgtctggcagtgttcccagtaataccaaatgaagtcaggggatgaaattctcagaaggcaattacttgttgttttttcttcatttttattttttattcttgaaggaaaagttttccagtgggaagtaaagagaggcaacagaaaatatgctttttttttttttttttggagacggagtccggctccgtgcccaggctggcgtgcagtggtgcgatctcagctcaccgcaacctctgcctccctggttcagcgattctcctgcttcagcctcccaaggagctgggaccacaggtgtgcaccaccacgcccagctaatttttgtgtttttaatagagacagggtttcaccattttggccagcatgatttcgatctcctgacctcgtgatccgcctgcctcggcctcccaaagtactgggattacaggtgtgagccaccgtgcccagctgcttttttttttgttttttaaatgcttaaaaacagtaggaggacattccaaggggccaataatttacttatcacttagtggaggctccttgtggaaaagattagttcaatttgtgaatttgtaaacatcctaacattttaatattcttggaaccctcaggcctttatttaccaatagtgaaaaactagcaagtttttagttatttagtatattattggtatttgactaccagccagactgtattagctggacttaaaagtacttacaagaaacaaatttttgtgttgtccatctggttttcaaatgattgaagtctttctttagataataaaattctggtttgtatgattctaaataattcaagtattgtgtgtaaaatactggaagatagctgagtattccgatggaaaaaaagtgattaaatgcacactagactatcatcagtatgcttacaaatgacccatggcctattttggagcaggtctttagtggtttaacaagtcctggaggcaacaaattgtaaaaattctagactaaaagcaactacctagatcagtgagcctttatagcataatgttaagtctcaaggatgaattttgatgaggagtcattgtgctttacttttttgtctgtaatttcaagggaatggatctgattgtaatacctactgaagttgattaacctaatcatttgcctactaatggcctgatgcagtgacaggtcacttcttttctaggttaaatcatttgtttttgataagagaatgtggagagaaatttaaatgccttttcatatttatctggagtaatgccatatatatttattgaagttaattccttttaatacattttggaaagatgaccagccgtatttcccaggaatttgttccaagggattaatgtgagcagattgggagctcattattacgtctctcaaatgtccgacatgttaccagggaataatttatgccctagagctagctgccagtgctactttttctacaaacatagtgtctttcacttgcatttcttcctcctttttcatttttccatatatcaacctaacaactattaatattcgttcagaaatttttccaataattgtttaacttttggcaactctccaaagacagtttggttttggggtttttcgtttgcttgttgttttgagaaatttgtttaaattttgcttatactaacggggaccacacaaaatatatttgcctagggcctcacttagtgtagggatggctttgtcattgcatgtaatagtgacaggaagggacctaaatatcatatctatcttctccattaggtcttcctatagatatttaaaattttatcctttagtcagttctgcactattggacaattattttttactcttcccccactctttgaaattgcttttatttagttactgtttagtattatgtctttaatttgcattgacaaactgcaagacacagtttttagcaaatctatcatagtagggatattgctgacaatcatagtagggatattgctgacaatgtccacagcacacacagtgtcaagaggatggggagacatttctctctgtcctcagagaagggaaaacagtgtttctctttaacaactgaacccactagtatattagttctctagcatccctggtctctacctagtagaggccagaaacaacaccctcagtccccaaactgtgataagaaaaatgtctctagacattgtcaaatgttccctgggaatcaaatttgcttctagatgaaaaccactgaaattacagcataatctcattgataggtgtatggaagatagtaaataaatatttagtgattaatcttgacactttatgtaggaaaatgagaacatgtttcttcaagcatttatgctttcaggttttcaggtttcatctttaagtctatcgaatagaaattttaaagaacatattcatttcattgtgaagtagttttctcagagtggaattatgtccaagaaatctaatggctaggttaggggggaatgtactcttcccacacttacacatttaagtgattcgcaggaggaaagagagtttggctctgtcctcacagtagtttcatggaacttctgtttcagggaaactgatggatgaccttcagtaagtgactctttattacaggccctggtctcttaaaagaacattgatgaacaggaatcaaatccacagaaataaaagggaaaattgccactggcatttatgcttttattgttttccccatgtttatagattagtagacatgttgtttaatacttattgaatgaccctcttatgttggggcctgtggacatcatttccatgacatgggcactaccttgtgtgtgtttagccaaatcacaacctgtggtactttatttgaaacgaaacaaagcaatcaaataaacaaccactgataatagatgtttctctgcagggactgcagatagtttaagcaatagttaattttactaagtgtacaaaagcatattttgagagagaaataaaaacaaaartaatacctattactttaagccacagtttctgaccactgttgcagttgtgacttttcttatattctttcccccagatagcttatagtacacattaagaaaattaatgcaagtattttgcacgtacgttcttgtaaagcaaatatacacrttctgaaaaatttccagctctcaagttttgccttccacttgagagaataacaggagaaaaatatgctaacttgataacagttaattttatctttgaattgcaatatctgacaaagggaaataatttttatctcacgctgggtgattttataccatcagcagcattgagtaagatcttgttttttattaatcctgacaacataccctaaaagggaagttctgtgggtggatttttgatttttacttcacttatagataaaactgataaaaaaagattgtgccaaaaataatcagcttctcatagaagattaaaatctaagactaggatgtattaactagaacaaataatcagatatagaggtaggtaaaggtgatatagggtggaggaggttatatggagtagtaaggacagttaactggagagggtgaattgaggcaaagaaaacgggaaatgttgatcttttaagatgaatattaacatccattttcatatactaccaaaaaaacacaggatacaggcttttagtacattcttggtacaatttttttttatttggggaaattgaatgttttaatttcttattaacacatatccaggctatatgtataaatatgtgtttctaatagcattaacatcttatttatggtacaggaatttttctttacagccactctagggaacaaactaaaataytgtttaatagcattcctcacaagattttatattctcatcaaaggtgctgattttcttacaaagttttaccttgggagaacaaaggtggtttagcagttatgttgtcaacattaagtgattgtcccacgttatgtaaaattcagccatcatgtaaacatcagtaaacccaaagttaccagggctgacaactacaaagaaaaagcctggaataatattagcgatattaactaaaattatcttaaaagtcacaaaaatgaaacttcttgtcagatttgattttctagatcacagaactttgtttttgctttttggcggagtttttttttctccttttttggtggtgatgcattgtgtaataagcgattcttggaaaactcttaagtgttacaagttaaagcttattcttattggaaatctgcaggttatcaaacttgcatcaaaatagtttgctcgctgagttctgtggtgttgtgtttaaatacttctgggtgacaatttccacttggatctctacaactatttccattttagaattttgtaatcatattctttgttttcaaatcattttaaccctgaatttagagaaagttgtttacatagtatcagcgatacacacttaaaagggtatttttttttttaagtttaggaggaaaaacctctcagaaaattgtgggtgagacaaacagatggagtagaaatcacaaaaataaactacatcatgatcagtcaggaagatgtagcgcaaacagatataaaagctctagttctcaaaggactgggagcagaggagaggaaagaagttgtctatcaaagatgatgattggaaaatatagaaaagaccatctcatgaagcaaaaagaacatggccattgaagccatgttgaagttagaaacgtgcagtgaatkttttttttgtttgtttgttagtgggaatgaatgatgatttgggtgaccgacaggtcttaactccacttttaccactcattgtccctattcaggtgtacggtgacttagtgccataactttggtgacatttctcttctggtgcctcaaaaatatggtagtatatgcacaattattgcattttcaggcctttgcatgagtttttaaagagtactccaattaactataagtttaggaaatgtaatcctaggacaatttagttttctttttcgtggagaaatacagcatgacttcaaacaagttttgctaaatagtgaatttgcagcagccagttttgttttatagtgattatggcaaccttgtgtatagtgaatttttaattaatatttctaaaataaatgaaaacattataatttatgaacttacttaagagtttcatttattcaagtaagctttgctgaaccagtgtgtcttgaggaaatctgttaatccataataaaatatagcagcccttgaggaattagtgaaattatatctaaagcatgaataataaagccaagaagccttttgttttatttatgctattcccctgctttcaggcttttctgttttgaaagcgtacagctaagttgagattcccaacttttaatgtccatgataccttattgtaggacagcatattattactttgactgtaaactgaaattactggatgaggaataatttgtcatgttgtcattacttaaggagaagatagtatttaaatattgactttttcatacaggaacatgtgttctcattctctaggcatgtgactactcccccccacttcctcccttttttcttttctttttttctcttatcacatggaacttttgggctcaggagtgattctgtctcatgcagcttagggatctgaaatttacataaggactttaatagaagcttatgacacatgatatgaccaggcttttcactatgttttgccatttatttggcttaaaatcaatggaacaaactgaacttggcattactatttctgttcaaaaagaagaaaaatatataattttactgttttttatgttttggtcttggcactgtggcttttgtttatggaaaaagacaagagaggaaaaaagcattattttaacttcacatgataaataatcataccaaactgatatttccttaaaaagtatttgttcgtttttcttattacaatgagtattgctagtaattcagtgcaagtttgaaatgatatactggtaatatcttctttaaatagcattataggtttaagtacatcaccaacatcataactttatagagatattgcattagaattcatctagtttctgtacttattcatgaataagagatgcttatgtagatgttatttcttsttgacaaattctattagcataaaataaaagcattaatatttacttttaataaaagtcataacatttagcgttaagttcctttataagtaagtgctttatggacattattaactaatttaaaacatcaactatttttatctggagtgaatttctgccaatattaattaggaaaaatagggatataaataacgtctatggcttctaaatatttaaaagacattctatgttcgtcattttatgcactggtggttgtggaacttttaatcagtggatacagcattggaagtaatatttttgggaatgaacagtgttatacatattatatgcatagctagaagcataggagaggctgtcatttgttatactagatatcaaattgttgaacccgtctctcttttcatgtgacacaacatttcaaacatgcagcacagtatagtgaataatgtacaaaagctaggtagatttaatgaatattaaaattttctgtatttgatgcagtatttttgttgatagctatacgactgcttagaaataatctcattaaactttttcataatgtatacattattcccattaatagatatatacttcattaaatttattttactatgtttgaccttttgggaatttagagaatatggataaagaagtagtttagagagcatggaaaagaattagaggaaatggaaaggattaattttcaaagagacaagcaaaattggttgattttaatttttaaaggctgagtacattgataaatgtggatacaagtaataactrttttaataccacctggaaaaagctggcatatggccaccacattaataaatatgtgtgtataaatgggttattctaaatgaatgagtgttgtcataagcatgccttatattaaaaataaaatcattatctttatggagatataaaaaaagtaagatattttattaacattattcttttccaaatatgctaactttggtaaccacatttaaagtctttttgaaatcatgttttaaaaaatcatccctatgatggtcaccagattaacttcttaatatcagcttcatttagagaaactatgaaattggaaaactgatattatgtattgcttcactgtcttctacaaatactttctgtacattgtatataaatcatgtgcttaaaagataaagatgttctatatatttttattttaaaagtttatttatttatgagggaattagggttacaatagtatgtctctctcttctttcataaccttgtaaggagtgtcctgttcgcagcagaatagtttttgcagaacaaaatcacaggataagagaagaattgtaaaacccattaaggcattaccctatttaatatttttatcattaattaatatgcccctcataatgcacatttacattttgacatcaaaaagaagaatatgtagctaatgtatgaatgatagaatacagatttagaaagctttctcattaaccttcagttaaaatactaaactaagaagattcaagaggagaaaataaaattttgcacttaagtttttaataaaacttcagtgtgcaaagtacctgcgtatttgttcataagcaaatgaagaaacaaaaagtaagatttaagaatctggattgacgtcaagcccaatatcatatggcttttctaacagcaagtgccactttgggcttcactaacgtatttatggcatacagaacagaataattaattcartaaattctgcactggccagatgacctctgcagtgttgaattcagttctgagtacataatttcaagaaggatattgaaaagctgatgcactcacataaacaataaatatgtctagaaacagtgtcccagatgaagtggaagtttagcttatgaaagagaacttatgatgaaaagcaagagagggagaaaaattgtgctctcttaagttatcaacacggtggctcacgcctgtaatcccagtgctttgggaggccaggtgggtggatcacttgaggccagtgatttgagaccagcttggccaatatggtgaaatgccatctctactaaaaatacaaaaaattaactgaatgtgatggtgcatacctgtaatcccagctactcggaaggctgaggcaggagaatctcttgaacccaggaggtggaggttgcaatgaaccaagatcatgccactgcactccagcctgggcaacagaatgcgacgctgtctcaaaaaaaaaaaaaaaaaaaaaaaaaaaaaaaaaggtgtaaagggagtgaaatttttctctttgtcwttctgtaaggtgatatttggacaagtgaatagaacacagagcagtcagattttgcttaaatataaggaatacatttctagccattcaaattgatttaaaaataaaataaggcagtggttttcctaaatatgaaataggttaaatgattgtgcatagagaagtgtctgttagagtagatgagccaacttcgtaagcattcatttttttgtttctgagcagtcatgaacagaccaagatatgaaaatcttaatctcctaaattattgtgtgtctcagtgtacctcagagaagagtcctgtaactatgctcttcatttaatggaaatttccaaatctaggcaaaccatgagtcttaagctcagatctaggctgtcttctgtacagactagaattgtcagctccccttgaggagctgtttttaaagcagtcattcctatggactagcagtatccattcagtatcagctagtgaacttattagacgttctgatggacagtgttttagatgaaactagaaaagtcttccttttaagaagtttcccaggtgatgtgacaagtgttcatgttatgatagcatcagcttaaatgtgtcagtatggatgatgattggatttcggtacttaaagtaatctttgtattgcttctgcctaaaattctagagttagagctaaatttctttactacttcatgtttgttcatccatgaattgtgggagcttatattgtaaactgatctcagtcatatattcattagtatggatgaaagataatgagaataatgtttgatgaggaaatgagggaaaataaatgtgggtactgagtactgtgttgaaagacagggaaacagcattgaggattgatacaggtctctcttctcacagcctctggcaccacagcaataatattgtaaactctaaggagagccatttacattatagtgtacatgaatgmtgacccccctggagttgtgcagcgcacaacactcacaactgcatacatgatccttttaagccctttacatctacttctgtacttagaattacttccaaagcctaaacttgaatcctacattctgattaactctcaggaaaacaaaacaaggcctgtttttttctgactcctagcttttctaccagtatcttacctctctgtctaaagtagatcaaatatcctgtactctgggtgkcatcatgttatttcactcctctgggcctttacaagtacattgtttcaacttttaataaatcttaaatacaactgaaacattatttgagtcccagctctaagcactgttttcgtaacacattttacatccataatgcatttatcatagaacttagaacactatgcaaaatttcccactagactaaagcttctagtatccaagtastacttcatttgactctccaatagtgattgccacccataagttgttcaggaaatgttgaatcaatgaatgagagtggggcataaaatgggaaatttgagcacacagaactttcatttaacctacttcactatttgactatggtgtggccttgcttttaattggaggatagctggagttgcaatcagtattcatgaaarcatgtttttaaaaaaatgagaatcagtctaacagaatctgaactttaaagaacatctcattactgattatacatggtgacgatattttccaaatcgtggagcttctactgggaaaaggtatgaataacctttttgttctataatgattttcaacagaaattatattagagaaggacagttgaaagccttttaaaaataaattcataaagtaatccaaatcaagtttatgataaactggctcagtgtatttattaaatgtatttttagttaatttttaatgagttataaaaatatgacctgggaccaaaaaacttcccagtaaaagttctagaatgattttttaagatgttacaaaactatcttagaatgttaaacagaatattttattaacttagaactgttcactaaactcccaaatgaaaaccagatctttccatctcagtaaaatactaaagtatcatgaaactttataatccttatctagcaccaaatctacatttatctaaagattgacaatgtccatccttctgcattttttcctattttcctcgtggattagtagcatatttagaatttttgaggtttcatgctaaaatttatgaaggaaaatgaaatatataataccccgtcacagtagaagggaatactaaacatctgttcaaagaataactcgttgagcagacaagtcatttaaatataaaatatgcaaattatacaagtgattttagtgctttggacaagattattcactgccacggtccttccaattctgaagttcgtgcatgtattttatgttttacttagaataagttatttttgtaaatgtatgaaataccaaatcagaaatgccaatatataatatcttccccccatactgtactgattggtattcatcagtaactaccagtcaaatgactagtctacatttctaaacacactgaaatttccaaacttgggagttggttcatttgagagtgaagtgcttaactggtgatacttgtgtctttttaaaaactgactttgatggtaagtttttcgtattttataagtaatttttcattgcttcctgtaacaaaacataaaagatttaaaataaaatacttaaaatataccttgaattaattaaaggaaaaagaaagcaacattaattgaatatgtatttttgccatatattgtgctaagtacttttttcacagaatttattttaatctacaaaataatttctgagaatagataatttatttactcagttaaggttttggggcatctcctgtgtgtaggcacagtgctggtggtgaagcagttccatgggaaacaggacagatgaacttttggttctcatgaagctcgtattctagaattctagatattattattatacctttacctatgaagagacagacttgaatagttgttatgacttgctgaagtcactgagctagaaagaggtaagactgtgttcaaatgcaagactaagatgcaagactgttttcaaatgcaggacaaacgcaagaggtaagactgttctaatttgaaaaagccactttcgtctcttctgtgctatattcccttccccaacatatatttaagatgtgatttatcatgaagatatccaaacactttaccatataaggtcaaaattcagtttttttatactgatgctaattatgatcatttaaaataaattcatttttatttaattatttgctaaacctgaattttaattagaaacataatccctatattgtgatagagattataaattgagtctcagaaatttaaataactacaaggtcaatcttcgagtagtgggttttccaaacagtcttgtaaatgtgcaggaaaacaaaaacatttcagaattgcttttctgacaaaaagaaaaaatggagatttcagcccacggaaatatagccctgcattttctgcttctaagcctgccttatgtaaattagatttattatgtccagtacatgaagaaattccatgccaaacctatatagctctttaagctttctacttcaccacatttgcagcgggactgttaagtaagttagtttatttggagtagaaattacctctgaatatgaactttggaagacttctaaaagtgatataacctctcatttaaccagcacgaggtccatgggggtaaaattwactatacctggtcttcttaaagctgcacatctgtgaaagcaaaaggttataattaagtttttctggaatttcatgaaattacacattttaaagtatagtcctgcaggacttcacattaactgaaatcaaagacagcctggtacagtggtgaagagaatgatctttgaaataataaaaattccaagtccaccactgaatgtatacgtgaccttaatgagatatttaacctttggaagtaatgctttttcatctagaaagtgagtcagtatctactttgaaagtttgttctgtggatacaatacrttggaagacattaaattaaaaagtatgtggaataaacactcttatttagatgatagctttcatcattatcattatcatcaccatcaccatcaacatcatcatcttgctcccaccaccaccagctccacctgtatatcatgctatacaagtatgctcagcatgatgagcccaggccttcttttctctgatccttcagaaaatgacttacatgatgcccttggaccatagaggatcaacttacaaggtcacatttgtctcactgtccctaatatagcaatatgtagcatcttctaatctttttctcccacaaacggcaagatatctcaatatcatcctacagtaaagggagattatactgcctcataatctattctaccaaaatgattgttaggaggatcccaccattacacagattttttgttcatactttagagatggcatcgaaaccaagcccccaaatggaaatatcttccttccaagtttctataaatgccattggacatactatttattgagttaactttgactacatgagtaagacaaattatttgtcttaagttggaatgcctgtttttcaagtaatttatgaggaggaatataatattatccacaaagtattccttaggaattttcagtgggaatagtaattttgatgtcctgtatcttatttttatgaaagaaattaagacaaagttgttcttactaaaattggatttactttttaatcgacattcttattagttagcatcaaacaaaatgttacttaagtaaatttcagcttacctaatttatcttatttaactctttcattatggctaatatagtatttggaattaagctataaaattaattaagattaagctgtaagaaaaagttctgactaaaattaggagggaaaaataaagctctgattaaataaacaattacagaaaacyaaattttaactctaagataaatttgccttgcaacttggttttgatgtacaatttgtgtattagctgattaggtaacttcaaaagtcatcagctgtctactggttacaatacagggaacatttgggaatctaacctattaacacataatttaataggtaacacatattactctctaagattgtttgggatcatctacagactttcatccaagtgaaaaagagttctacttcattctgagttaggtcacaaggtcctgttaattttagctgtttataaattttcactgagaagctgttctttcatcctcctatttttttttaagctcaaagttcttgatttaatctgataaatgagctcaagttacagattctaatctgataatttttagtttcttatgcacctgattgaaataagggtcttttttaaaaaaatgtagcacaaaacccaatgcaaaacaactaagaaatttggtcaatatttgtatatgtacacaaagaacttacacctaaaacctattgctatatcttaatttgaactttttaaaaaattgattaatttttgtgggcgcatagtaagtgtatatgtttatagggtacatgaaatattttgatataggtatgcaattcgtaacaggcacattatggaaaatgaggtatccatcccctcaagcatttatcctttgagttaaaaataatccaattatactcttttagttatttttaaatgtagaattattaatttgcatttttattatactaatctataaaatgaatactattgagagaattgcttaaattttagcattaccagtctttaagttttctaaatatggttttggagtgaaatattatcttacctttccaaagcaaggaatttgcaaacaagattagtctcaagtattaattgaagtatgagtactatttcatatgttacaatttttatattatctattgaatgttagattggcaggaaatagcaaaattgactaaaatagagatgtgaacatcctgaaataaagacagtactatatacaactaattaaaaacagagggatgagtagtttggcagaagcattaagatatctggaaaatgaaataagaattgccttggtcttacatgatgtgaaaggactatatccactactagcaataaacagaaaagagaaactgactttcagcattaagcattcactggtggaaatgaagttagacagttttcattttaagtgtgctcaatttacggatattcacggaaatataatttgtcaagtagaacaatcttcttgtcagttacagaaaagatattgataatgagaatgttatttatcttcccttagccatgtgctattatgggctcagattggcttctcgttttttaaatggaatgtgtccagttgacagaatacaagattcagcaacctagagagtaacatggaattttacaaagaaataaaaggataagttggaaacatgaagttttttttttttaaactaaaccaggtgaggtcccccaaatacaatgaagagattgaggagttagcaccctccaatacatcacaggtgcagcaaatgcaataccactgtattagaagtactttagagggggaaaatattaaatcttcccatggtaacaagtagaaactggaataaagactactcagattatacatgaaccacccccacccccaaacaaggaattacagaagagttttctaattttaaagagctggctagagccaagttacatgaataggtgtgaaacagtggtgctttgggcacccagtgactaggtgagcatggccaagaacagcattctagagcacgcaatccatgtgggtcaagagtgttgaaatatgatgaaatggtgggttaggtaggaatcactgatacataccttgtttgccctgctaaggacctgggaattcacccagtagataataaagaacaatcaaaggattttaagtaaagaaggtttgctacatttaatgcccctctcctcacagtgttattgaactgtcaataatatsaacacacattaaactgaaccgcatattcagtttaatgtgtgtttttgtataatttgaacaaggctggaaaccaggagacctgaactcagattccagctggcttagccccaaatgagctgggtaatcttggaccagtcaaataatctctttatgttcattatgttgaactagtcaaataacatctttatgttccagttttgytaattttaaaaaagaatgaatctagcttggattacctctactatctcttcttcttttattttgtggttgtgttctgtggcacagaaatggaatttaacacatacaggaaatgtgcagtcattttatttaccaaacacgggacgggccaggggagaagcatttgttttcttgtataattaagagaaagctgttgaaaatataaagacaattgaagtagtagttttcaaaagatgggaaggaagtagaggtgtgaattcggaaacaagctagtaacaaacgtaggtttgaaaaatttaccagagtgggagaggggcagtcctgtgagaattccactcatttcgttacatgttccagggagaaactggataggttagggtcaatgaagtcggaagaaattcttaaagatcacttatgcattaggtttcactttgtctctaggagtttcacactattccaaaagagtacaaggcaggagttagtctaatatgctccccagagaaggcttcataaataagctatattctttatgatctttattttcaattcaaggaccgtgtcaggatagacaaggtggtactgcagtattaaacagaccccagttctcaaaacagggaggttgatttgttgctccatactttggctagggctctgttctgtatcgtcctcactctgagacagagatggtggggcagccaccgcctaagacattattaatcaccgtggcagaaggaaggagaattctattgggtatggctttggcagttaagtgtcacgttctggagtaatacaactaatacacacacacacacacacacacacacacatgtagtactcactaatgcgcaggtggaaaataggatcatcacaataagcactatcatttgaaagagaagaaaagaacccacacaccatcactaacctgaagcaattccaaaatcttactgggaggctatttgaaagtcccttatcctagggctagatacatttttaaattattattattagatctggttctgcttcctgggagaaagcctctgtctatcgttctctgatcccctggtcccactctccctggtctccctgatctgattatcttctatgatcacctataaagtgagcattggaaaggatgccgtcctgggggctttgcagtttcatttgatcacttcctatatgtaagtctttaggagtttaagagttgtgttaggtactgaatagtgttcttttcatagtataatactctcaaaaccatagctccttttaaaattaattcagtacagttttgtatgctaataactacaccatcagttttattttttttctcggatgtacttttaagatttgctgtatttctgtgtcctttaggtgttgtgcttctcactcccaatttaggtgatgataatttcagactgtcaggctttgttgggaaaccctagaagattttccatgagaaaagaatttttagtctcttttccttgagttattctatccaactgaaaagatatattgagtcctataaccttaatttgattttgctcttaaacactttaatccattcataggatttataacgggtgtggtgaccacatcttgattaaccsttactgaggctgagttgaaatatgcatttttagctcagtgcccttcccagttcttctsctatttaagaagggaaagcagttgccttttccgtgttcttggacctttctrttccctttttttttatccttgcaaacaaatctagtcttttctgagctcatttgtctcttataccttgtcaaatacagatcacagtaaccaataaatgatacttacatcctgttgtccattctctctggtagagctacaagtccattaggtccttcatctaccttcgaaatattgcagacagcagtgttaccatatgctccttctctgtgttccatagaccacctctttccagccactaatgccaggttcctcagcaccagctctcaggcccctcccctattgcctcatgtagttgggatacttcacagcaacagcccactctgggtaccagttctgaataactttctactctgcaatcagcagtatgtacaatgattcagagttgcgcattaggtaatgctttggtaaaaatcaaaggttcttaggctcaatcaaagggattgagaaaaatctmagagactgcagagaaaacaattgaagagccatgtattatagaaattggagtgggaatgarctctcacagaaagaaaagtaccaactgaaaggctggtcaagatttsattaattcacaaagaaaattacaaaaactttaggaaaaaaacctagtatttgggatgtacaaatgagaccatgcacgttagatcaaaatttggtaaatataaaaacaaacataaacataaactataatcaattaaaattgtatagttagcatcagagaagtatttctttaattaaattaaatccaccttgcccatgatagattaatcatgtaacaagccacctcttaggggattctgtgccagtttaaataatttcatgacttgggggtagagaattgtgaggagggaagaaagatttgctgggtaattcctgcagggttcaaaagacatggctccttacctcaaaacttacaacttgtattaaaaaataataaggcacacaaaaattaggaagacattttaatggtctactgttgactacagtagatggaagttgaagaggagaaaaatctgtatagactgaagccttcagggataatttcatataaactggtggctttaaaggataaataaaagttgtttggggtggaagagaagaaaaggctatttcaaaattcaaaagtcataaccacactggtaatattaaaaatattctcaggtccaaaagcatttagtcaaattaggactgtgatcatagcaatcaatgaactagtgtgcattttgacaagcaaaggctttctgattcttttctgtttctctttctattgatcatggggctaggaaaattgctacaaattatattttgctatttattttttgtgacatcaagagcaataatgtgtgytaagtcagaggaataaatgtacagcctagtattaaagtaatgctcctttaccccctctgcacactcgcatgttgctktcctaacaaacacgcaaatatgcaagcgtttcctagaagtgacagctaatggtataaattaacctcttgaatctggcattttcaaaactactgtagcacataaaagatagtggtgaaatatgaatagtaaatggaagaatgacatgtcctccgcctgctttcagaagcaaatagagggtttcactatcaagaaaattataggctctaggtttgtttaattactgagattttcaaacaacctttcttacaatgaactaatttgggtttgaggaaaaaaatagcagaagacagttctttctaaattttcttttaaaattatgaaaagcactcagaacattggacttaatcattaacagaataaaggcaaaccagaaatggtttatatagtttaatatgacgaatgcattaaattagaatagcgggtaaaaacttaatgccaaacagaaggcttattgccccaaattctcagactttcatgactttgtggcaaaataatagattttggttttggttttgttttgttttgctaaagggtcatcaagcagcacatgactaagtaatattgatacaggtagtggtatgagaaagttgtaaggaactaagacagagaacatgcttcacagcttagaaccaaatgtctactaccacctcaccatttactttttttctcatgttacaatttgttgtaaaccagttgaatacatccatagatgtattttcaacattatagacgttacgactttttctttgtttgaaattgagcatgtagtatgtacatgtacatagatttcttttcttttttttttttttttttgagacggagtctcgctctgtcgcccaggctggagtacagtggcacgatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatgrtctcgatctcctgacctcgtgatccgcccgcctcggcctcccaaagtggtacatagatttctaaatgtaaaatctatagagaaactgtggaacaccagaattataaaattgggcatagcttcattgactaccagtataatgaaaagaagctcctttcaaagatttaattctacgttctaaaatatgtattgtgttatttaggttgggatttttttttaattttccaaactcttagcaagtttttgttttctgattcagattcctctaaaaagaacttttaataaaaagacatttgtctccaaattaagaactaaggaaatatccttttgtggttaatcactttaaaaatgaatatgaaattattattatcgttattattgagactgggtctcactctgtcaccctggctagagtgcagtggcatgatcttggctcactgcaacctctgcctccagggttcaagtattctcccacctcagacccaagtagctgggaatacaggcatgcaccaccatgcctgactatgttttttgtatttttttgtagagatggagtttcaccatcttggtcaggctggcctcgaactcctgacctcaagtggcctgcccgcctcagccttccaagatgctgggaggatacaaaattattttgatggaaataacacatgctgcatgattaataattatattttaaaatattacagaatattgtaataaaattatagtgataaatatatatacgcttatatagtagataattaaatttagaatggtttgtcatcattgatccatgttgcaagctagactctgaaaccatatttattgcaactacagatattgatatttataggaatatgttttgagaccatagacttttttcatttttgtgtttggttttgtctatttgtaaatggaaacatttatttttaatgtgattcttgattgcactcaaaaacaagtgcactggtggagtcaatttatgatggagtatagaggtgaaagaataaagggaaatacatatagaaatagcattctcccacaatcttaatatgcagagggaaaaatagttaattttagaaataactgaaacttagctgttcttgaaaaactacccctcaaatgaactcttgaattccaaggaacaatttaaaaattacagactgattcccttatccttcactttttcccttcccccaattgtctgatgtctggctttctactcaaattctactcagttcagtcaagcccctgcccagaaacctggttagctggtttgttttccctcagaactcagattctgaaatactcccctctactttgyctcattcatagagtaagtttttgaatataaataaaaaactacacactgggtacagtatacactgctctggtgatgggtgcaccaaaatctaataaaaattcaattttattttaaaaactttattttttaaatcattttaaatctctcacaatgtctgtagtttcagtgaataaagagtttggaattaggaggtcatgaaatttaactatataatcttcccagtgatttctatactgacctcaagtagttgtttcatttgccctatcttaattcctactggtgatttcattaggaataagggttttgataagaatagckttaaactggatttcagtaatgagatggtactttgtagaagctaatggttaagagcacaacaggctgtagagttgcagactgcctgggatcacttactagatgggagaccttgggcaacttacttaaactctatgagctaatctgtaaaatacacataatattagtacctacttttctggatcataagaggactaatgaaataatctatataaagtgcatagactgggccctggtataagataaaccttcaacaaatattcatttttatttaatttactgttactaattggctttttttcattgatcaatgaaaattgttttaagtaactaatgtacctactttgatttttatagcctrgaaatagtaggaaaaaaatcacaagtgatgtgaaatatgtgttaattctattatagaacaggaaagctgttccatttctatgaaaactgggaagtacaaagagtttgactgatgagggcagaactaatgctgattggtgaaggtaggtcttggctcaggttcagagagagccatctaatgaccacaaccttcaagttctagacgcacctactgtgtgaaaggtgaattcctttttgctttyaataaaggagaatccagagaaagactggttgtgctcttgagcagggtgggacacctaggaagtgtctcttgtcaaagacataatccttgattttgcaggtccagaaattcattttgtgaggtaacctagaaaattaaagtctgaaatattagttcattagaaagttacaaatgagtgagatgaaactttgtcaactcaaaaatacataataggtttgtcagaaaattacagattgtgatcaatagcccagggcattccaacaagcagtacatgacacctctcagaatctcaaactgtgattcagagagatgtagaacattaaatgaatgttatgctgtataagtctcctacctccagaatgtttctatttataaagtttagtagcattttccccaaatatcagaacctcctttttaccaggacaggatttatacgcattgatttttccttgggggttggcaacctgtacttttaatttaatgcagaacgccagattcttgattaaaatattttattttaaaaaaattgactataagactgctgaataacttctattgtccctttattacattacaatccttaggaataactcagaagaatatggctatgaatttgagatgttttattttgacccaagctcagacttgttcttaggcaagataaggcctgttctgtaaaaagtatccatctcaagtgtgccgttaatattctgaatgtcttccttttctggcaattttcattttttttatgtccttgctttccttccccttaaagcaagctacctgttttccgggcagttttactctctgttctcttgattcctctgttattaaaagaaaaataagtttcacttaaaggtagttatgattaggcaaggcactcagaacatttttcacttctttgtttcactatagaaaatacgttagaactttttgctcattgataaaagcttaaaagtacaaatctactaatagtacctcaatcttgttctttctctagttgctaatttgacattttcctctgcctgattatgtyggaggatttctcattttctatccctaagccgtgcacagctcataaaaaacagtagttgccaagtgacaggtgtttttggaaaacttgcttagtttatamgttcagagaagacattgcctctaaatcagcagctactaatgaccttttgttccagggagttgttagagatccagatgaagtcctgtaattgaagcatagtttaggcttagcccagagttggtattttccaaatgtactttgttgagtttttgtctctgccctaagcatttattcttggaattttcaagattcacacagtttcaacaataggttattcattttcttgccttctcttcccattctcatgttctgctttaaccaaaacaacgtaagttattgaatatcatgtaatgctagagtgtcaacagacctgtgtttcattctgtcctcaccatttgccaactgagagacctttagtaagtaacaaaacttctgtgagtctgaatctccaaatgtaaatggtaataacagtctcacttatcaagcttttgttcattattaaataatttgtgaaaatgtctagcatgctactagacagatagtatatgttcaataaattctcattgttctccttcagccttaagttatcttttgagtgctttattttttatttttcactcttttgctttctttagtaatgatatttcagttttgactttggttcataccttttcctttctgtgtcttcactgtgcttgccttgccttttcttctttcctttcttccacagacatatactgaacactcaatactatgctagacactgcggatacaaaggtgaatgatactgtttgatggagttcacggttttatgggagcatggatatgcacaatcaaatgtagaatttaaaatgaggacaagtgtactgggcatttgcaaagcaaaacaggttagcaaaggcctcctggaggagggtaatagctggagtaaaccttcaagggtgggactaaaccagtgcacaagggggtgtgtcttctgtgtaaagggaacatgttccaaaagcaaaaaggcaagaaacaatctgttaagaagaaaccacaaagatttcctargaagagagaatggcatgagttgagatggaaatgattgggaaaggagagttaagtcatagagggtctgggtttagatatgacaccctcccctttaaagttagtctgagcaaactttcaaattatacagcactcttattatttcttctgacctccgccaaacctctcacgtgccctttactaccttagctatttctcctagtgggactgcgtcatattcctcatgtaagttggagtaggattaaaagtttattagataaaagggagctcttaaaaaagatttagtcttaaagtgacatagtcatatatgtactttaaaatcacttctctaacttataggatgaatgaattttcacgaaaaacttagattctgtatgaagatggctccgatctactaaaactttgtttaacttgaggaactcagagctatgtgaaatttgtgaggaattataattggaaaataatggttttaaaggttattgttaatattagaatgtttaactttttttaaacaaaaagtgaaaaagcaaaacttaggaaagacgaaggcttaggtctacagcaatgtaactaagcaattccaagattgcttagtacttactacttagcctaatctttaatttgatacataatattgtttctcaaaaatcttttgcactgatagtggactaagtagcaaggatcagtaatatatagaatctcattcagatatgtatttttttaccttcaggagtggtccacttggttggcttttaatgaggccattttactctttgctgttaatggtatttgctcatttgcaggaacaggctaggtattgtatttatcttttcccttataaagaaaaaagtgacagtaggcaataaataacttaaaattagtaggctctgctgggcgcagtggctcaaacctgtaatcccaacactttaggaggtcgaggtgggtggatcatgaggtcaggagttcgagaccagcctgactaacatggtgaaaccccatctttactaaaaatacaaaaattagccaggcgaggtggttgcgtgcctgtaatcccagctactcaggaggctgaggcagaagaatcgcttgaacgcgggaggcagaggttgcagtgagctgacatcacaccactgcactccagcctgggcgacagagcaagactccacctcaaaaattaaataataagtaaataaataaaattactaggctcttctataccatgtacaaatattgggatgaattttttttttaattaggacttctggaaaagatttgtgtttcatagtgtttcttctagaattttactatttctttgacagagagtacaaacattcagttgacctgtttgtcttttgttcagtaattcagaaaaatatattttttatggaacatatctaaagcaaaatagcttaataggtatatcatctgatttcaacttcggaaaatatataaatgtacatctaagcttctagtgaatggttgaaagaagtatatatggtgtgtaagttcttaagccratggattcagcctagagcagcagacctgttcccagcattttaacactaggtgtttatttacagtgatcaaagtgagaatgtgttacatcagaagttagattaatagttttctttaacacctctactttcacaataaatgtgctttaagtcctgacatacagatagaaaaaggctttaaagttgctttttaatgtgatgatctatacaacctctaactggaatttgaaagctggggccaaataccactgcagctcagatgctaaagctgtttcttaaaatgargcagataaaaaatagagaaaatcttttttaaaggctactttgctcctttccttctccataactaaatgttggagctttctgctggggaggggagagcaaaattggaggtggaagagaaccatgaagaaggcggtaggggcagttgtttttctgtgcctgctgacgtcaacgaaattgccagatggcatttgaatgctttgcaaaaagacaggagccttttattacagctgtcacatggggtttcattcatttgcattcccagaagtggtctaaagctttccctaatgtaggagtaatgagggctctgtaccttcagagacccagagggccttttgtaggatgttgttactttaagtggctctgataagggacacaggctcagagaatgccatgtttcactgtcagcttcagaggaccataaactactcagcttcaattaggactataatgtgatcattcaaaaaatattctctccagaaggacttttcatggatcgtgacagctgcggaaacacattcagggggacctgaagggtctagcatggcagtggtgggctacagaacaaaaatgcagattccgtgaattgaccccaagactgaaaaataaccagtgcacaacagacctgagcatactacaaacagctttgctcttaccattttgccccatgctgccttgtcagcccctsctcaatatgggggaaaagtggacctttccgataatctggggccctatatgtaggagaaaaagaagttgaagtgccaggagctgctctcagaagctgaccctggggacacattctcargccaggctggcctgtcctgtctatacctcaacccttcccactgccagaagttttcatgttttacttattttttgcctggaatttgtcaagcttttaattcatggggttatcctttttgtttgtttgtttgtttttgagacggggtctcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaatatttttgccatggttgctgtaaattatattgttcatggtaagtaaattgacatattaagggtgacctaagctatgttacccagcttgttttcttcctaaccttcatctgaaatcaatgacctgataactaacagaagtagaaggtttgctggcaataggtctgtgcattatgctgagataaaaagcagcaagtataccaagagctttggagtctggagaccagggagacttaaaaattagttcacatggccgggcgctgtggctcacacctgtaatcccagcattttgggaggccgaggcgggcagatcacgaggtcaggagatcgagaccatcctggctaacacggtgaaaccccatctccactaaaaacacaaaaaaattagccaggcatgctggcaggcacctgtggccccagctactcgggaggctgaggcaggagaacggcatgaacccaggaggtggagcttgcagtaagctgagatcgtgccactgcactccagcctgggcgacagagcaagactgcatcttaaaaaaaaaaaaaaaaaaaggaaaaaaaattagttcacattagttcatatgaaacattacctagtttcaatcttatgcctacactcacggtcataataggttacctacagtgcaacagatctagtgaaaaatcttatgccaccttgtgagttggcaacgtattacatggatgtgaaggccactggcttgagtgatggacaaacctagaatagttttccaagtgctctattacgcagcatataaaacaaaggtactcttactatcccgtgctccaaatgcataatgcataagctcagccatggaatattttccaaatgtaaatagtggaactgctgctgagtgtattcatttcattctgatttctctttctgattcggcttcagggtttggggagatttaggagatgatggtgaagattataaaatttcaagaagcaccttccaacttcctctgaccccttttcttctctcaactgcaggggaaaggggcacaatcagtatctcgtatgtatgagcaagttccagacctgagtgagaggtggcatgtggtcagtttcaaggaacgagagaccaacatccaagaatagtctggaggagaaaggacatatcaagaaacacaactcaagctgggtgtagtggctcacrcttctaatcgcagcactttgagaggctaagttgggaggatcacttgagcccaggagtttgagaccagcctaggcaatataaagagccctcatcttaaccagaagaaaggaaagaggaaaggaaaggagaggaaaaggaaaaggaaagaaagaaaacaatctaaatggtcagagtgatgggaattttaaaaggcagcaggcacacatttaaattatacattcccaccctagacagtacaaagatatgcagatagaatggaaattagaaatgaattcatgaataaatgtttcacctcgggtatacttgggcctaaatcccaagagcatgtaggttatggtgggtctgtgatgtgtgtttcatgtttctccaagaataaaccttaggaaagctgtaatgataatagcattgtcccactttgcacgtcctagctccctgtccacttcgaaagtgcagagcacttgtaccaggcataagtattgccattgttgatagtataatggttgttattatcatcactactctgatatgttaaggtttgcctgaatatgaattaaaacaatgtgtttctgaatgtaactgcaggtgatagtcctttctggcatattatgcctttccccctaaagtcctaaaacagtaaacctaggtctcttttgtgtctcagctacagaaaaataatgttttgttaattcatctcctttagccacaaaataagtttttgattgtacagtaatatactatatttcatatgttgggcagtgctacagttcaaggacagtatacagccaatgtacatacttaactctgttttgaatgacatgaaatgacaaagaagtgaataatcaattgtcaggctaccttagggtcaaactgtcatctgatctgactttaataatactatttttcaattagaagaaattagcataaaatattttaggacctagcatctcaatgctcatggcttgttccagaatacaattacattttacaagaaagtagccacgggagtggcttcatgataacacacagatacaaccttctaatgccgaaggcaaattgccaaaatatgtgcattgttagggatcagaggaagaaagaatgatacactgttctgttctctcattttgagccccgtaagtccagtctaggggctggtagagaggtgttattcttttttctcagactcaaaaactgtaagcctacccagagaattcaggtttcacagaacttaggcattttaacttatctcatgagaggctgattaataaaccagaatgtcagtgtactcatttttcttgagaactgtcatagccaaacagattgtaataatcgtggtggctgtccagtattttgttttcaaagtaagaaagtctacctgggcaaacacatcagtgaataagtaaatgtatttataatttggcaaacatttttatgcacttcattatgataagcactggtgatataataaagggttaagtaaaatacatggtctaactttaaagaaagatctgcaaacaaataattcaagggcaacgattaacatataattttcaatatggcacagatagcagtatgtcttccaagcagaaagacaataattcatagtcttaggtaggttacattactgaaagctgataaattgcatctgtttaaagatgttagtttggatttaaggggaattttttttaacccttcaaacctaaggaagaaagaatattgtgtcttaaaagcatatggaatgccagtgtactaattacagtggaaaggtcaaaaggttgtatttgttttgagggaacagagagattgactctagattttcagaattacctttctttaaaggtataaattgtcatcctgcagtaaataaaaggaattcgaacaccatatccaatcattatgtttttaaaaactataatatcaaacgactatgctagcaataagtcaaaatttgttcactctatttttttccttcagtgttctagtgttttccaatgatgtatgtgtgctgttattataacgaaagccactttctgtgaagtgtccacctatgcttgagtactaatcatagaaaggagctctgaaaataagcagygggcctgtagtcagggactgctgaaaatgagggagagcatcagggaaattagtgcactgtgcctcttctttcttcagtactcctttaygttcattgctcatggggatctgtgtttgcctgttaattgagtgtgtttattgcaggcagttgccttaagtgacatgatactcagtaggaggttgtgaggactagaaggaggtcttgtttgaatacaaggggtgggggagtcacacttttcagaccgattagaataatgagattctctaaacagttgagaaccatttgtaagaatagcacrttgtgttagaaggcaattagagctcattcttttaataattaggttttttgagttcttacagtatgctgagtactaagattataaaaatgaacaaaaattgttctcaaatgcataatctggcaaggaatttagtcataattagcaatacaacaatatcataatagatgttgaacaaagtactatggagacttcgaggctgaagygattaatttggtgtcagtttgagaatgaagctggaatgtttttatatattaaagttgaatcttgataatcaatactaaataaaagaaatgaagtggtaggcagaagtaacaccataaaccaaagcatagggttgtggcatcatatctgtaaagagaatccaggttagctggagggatgaggcattagtagagcacgtggagatgtaactggaaaagggcggcgggttaaaggttaaatgttaacacacttaaagacaaccaagaagttgaatgttgttccctaacttcgcggagccctgaagtggcagagcagcataataatatctctgcattgggaaaagccaagtttgtggcaggaagaaactagaagaaaaaaatattgtagccatcctcgtgtgatataatgagagatggattaaagcagggatgagaggctttttaaggaaaaaaaaaaaatgtcagtcttgcatgtaaatttccagatccactgaccaatttgatgttgaaggtaagaaagcaaagaataaatacaaataaaacctaagagtcaacgtgtccagttttggttagtgattttggttttagccaagtaggaaatacatgaggaaaagatttccaaagataaaatattttcttttggaaagttgagtgtgaaattgctttggaatatctgagtggagctgtccagaagctcgaaggagtggtcagtgttggaacaacagattagcgggtactgtattcattataacatagggtgagggctgggagggaagggcacagattaatgtggataaaaataataaaaaggaaagcagacagtgagtttgttctcaggctggaaaaaagctaggccagaagaagaggagatggctgtgcctgaggtgctaggcttcagtaatgtctggtggtgaagcaagaaaaagccaggaatgttgtcattagatattttgattaagatatttattaatattgatagagaattagtgagagcagaactctctttaagggctttcaaaatgttaatagattataattttttaaaaaatggttagctccttagagatggggtcaaagaccctaattttgttagtagaggaaatgctaacaatgtttttaagttgcgaggaaaaagcgaggaggaaaaagagaatgaataagaaatgcactaattaaaacaaatatgctgtctattagaaggatgaaattaaaagtacagtggtaggagactggtattaaccaaaagaaaaaatattatttgctcattgaaacaatagggaggaagtcaagaattaagaagtcctttctatatttagaaattcatatgaagccgaattaaagtcctcaataaagattggatagcttatttttgtatattttctgccaagaagaactggagaaaagagaattcatttaaactaattaggggctttttttttttttgctgagcctggtacctgagcaaaatgctgtggggttagaaaatgagtatgaaatgacgctcatctttaagaagcttacagaatccaaacatgtctgaagtgcctttctataagaatattaaatgagtagcattttgattattaatttgcctctaggattcagatatggatagtatgttgggggctcgcttgcagaaatgagtcacttggctaagagaactagctggtgctcatcactcagccctcagtaggttaccgtgtttggctgaacctaaggtaatcatatttttttattgccttatagcattctgaatataataagattataactaaaactgttctcctaaactgaagttattaacccagacttgtagatcgatacattataaaattttattattaccacctatttatctatacagttggtatattatatatatacagttggtaaaaaaaaattatgctgtattagaatattttcaactgtaaataaaagaaaactttacttcaactagttgtagcaataaagagatgttattatttctcatgaatagaaggccaaaggagggaagccttcaggattagtgcatttagtgaattcagcaatgttataacgcacctaggttttttattctctctactctgctactgtctatagtattggtctcatcctaatgccgattctacttgtgatccaaaaatggctgctggcagcaacaaactttcttctgaagaaaaaggatttccttttctagaagcatgaagctaagttcccctcatatctcattgactcacattgacttggcctacccattcttgatcaaatccctrgctttggagttgaaattatcatgattggcacagagagtcaatcatgatagccactgcatatgctttgaagacagtttagaattagacatttccaaatgtctttggacctatttgtcttaatatcagaatgttatcatagtccataggaaatttaatgaggctgtcaattggtccagcagccacaagacatgcttgatggatattcaagaagctcttataatcttttgagccagagtagaatgtagctgatgatagagataatatagcaagtttaaagtatttgtttgaagtattgaaactagtagggagacattttgaagctctttttagttagaccttattctgtcttaattatatattcttcagtttgccagcagggccagcacttgaaaggggccattgcatctgctctgtgtccatttttaagataaagctttgcttatttgtttttatggcatatttcaattaaagcattgccaccctactttagtccttatctccctattttaagatgaaatgaaattaaaattgactgaaatgatggttaaagacaaatttaatatcaatgtttttcctacatcctcctccttattttcagaaaaaaacatatttttaatcagtgcttgtattaatcttatgattataattttaaaagattatttttgaattcattttgtccttttttgcatagatctttgtcttaaagaacatgtgctgaatttctgtagaaattgactcttcatattccataaatctgttggtattaccatacaaacactctgtggaagcattgactgaactagcaattatgtctacaagaagaaaacaaatctatgacagaaatcctgagtgactcactattatgaccaaatgacttatttacttacttaatttcctcctttattcagcaacacattgttgctaaatgtggagtggggtatcattttgaaatacttcccatacaaaaccttgatgatcctgcctgacatctgcccrctaaatgtcttggtgagccaccatgtctgctgatcctaggataatcatattttttaattgtctcataacattctgaatataataagattacaactgaaaccagtttcttaaactgaagtgattaacccagacttgtagacagatacatcatacaattttatattcattaccacctaagaggaaaatgaagacggatgccttccttttagcaatagaagtctccacaagaatccacaagtttttccttccggggcaaaccatatgaacgatctggcttaagtatcagaaatagagagaataagtggcatttttcttgatggaaaaatattaatagtgggacctttcctaatacttagttctgggaagagtctaatttgacattttcaaagaagatgtgaaagaagggagtcaaccatgaaatcttggagtttactgatgatgttaacaagttccccttaataatctttatctacttaggctctcattaattggaggaagtgtttatttaaaaaaaataccgtatagcaaattggcaaggatattttcatatcattgaaggtaaatgactgtacataggaacggtacccagtatttagcattgtgaatagcgtagggcttcggatccagacyacctgggttggaatgtcatctctgcagcttaagatctttgtaaccttgggcaaattacataaccttttgtgtgcactgctttcaaatgttgaaagtcactccctttacaatgtcattgtttagatctcttgagttgcatcttagaaaatcaagaaattatattacaaactgtagtgtattacacctacctgccctatatgtaaaatgacttacagataagcttactccattctcaaaaaccagtaagcaagaaggaaccctcaggtattctgagagggaagggagtttcaagttcccaactcattgctgggtggatcagaagctagaaagccttgaagtccatgtttcaaagataagacttaggtgttggatctatgagacttataggggctcaagattttgagggaaatgctatattatagtgataagtatgtttgctatctgtctttcacccttctcacaattctcttttctggataataggcttttttgttggtttttttctttttttgatcctactttgaagagaggtatgaatgataatggtgactctgttcagagtgaccattttcaaagtttggaaaagaaccacatggacagattcaggtgttttaggatctgcactttgagaaacaactgttttcactttcaaccaacttctttcactcttcttataaccaggggtactggatacacccacagggttttctcctttatcctctaacccctttcagttccctgaatgccttccactagactgcaagctacctaaaggtagcagccctgattcattcatctctgtagccctaaggtgtagatagtaccaggtacccaatagatttcagttaatatttgtcaaatgaatgaagaagaaatggatattttttcagtacctctgtattccctttgtgacattattgaaatagggtaaatttgcagtggaaaacaaacaaacaaaattctatcatacttatgttttttttgtgctcataagcttcaaaatcacttctaacagtgtttctttagagaaaacacactctgttttccaaaaatatttttacaagtgttttgaagtttgatctatttttaagtttgaaaactttattattcgattgatggaatccttgattagttgtagcaaatgaaatttactgacttttatttctttttttaattattattattattattattattttgagatggagtcttgctctgtctcccaggctggagtgcaatggcgcgatctcagctcactgcaacctccgcctccttggtccaagcaattctcctgcctcagcctcctgagtagctgggattacaggctcccaccaccacgcccggctaattttttgtatttttagtagagatggggtttcaccatgtttgccaggctagttttgaacacctgacctcaagtaatctgcctggtctcccaaagtactgggattacaggcgtgagctaccacaccaggccctactgacttttaaaatacatttatgaggtgtttaatgttgtgttaaaaaattgggggctattgaaatcacccgccccctcaaatgtttacactgtggaaggcaatagagattrtcaaaggggaacattttcttagttggtcagacacaatatagattttattaactcacaagtgaattattcacaaattattttgtgaagcctggggtacttagagatttctgaaagaagaaattgaaagaatactgtagacagagtaaagaagactattataggaataaatctatttcatttcttatgtcgccatatctcacctatttccaagtgcaaatgattctccttaatgtaactttcactcttttcttcctgggacattcatgctgtgaatggccttgtttcccatgtttattgttgtggcagccttggtcaaatcagccttcttctatgccacaccttaatcttcctcaagcactgcatactgtttgattatatcattttccttgtcagccatctttcgtcattcagttaccaactgatagaattagaaatctttgtctttcattattgggcatctgaaatctagcctcatacttccctttcaaccttcatttctgctaataaaaagcagtaacttcccctgcctgagagtctagtctgctaatggacttctttacccattcatccttcttatgcagtccccacgtgctgccttcatgcttcttccagcttttctgctctgccccccacttactctctctagacctgttctttcacctcaccaggatctccagtccagttggccaatctttctttcctgtctgtcatacttctcctgttttctctttgttgccttttcaagtcaaattttatgctgagtaacactgggaagtactcaaccgggcctttgtattgcttgagaatctagccagctcttttttatccctctttcaaaacttttcattctcgtttgtacttctaacctcaacattgcccacatcacgttttcagcaagggactcagtgcccaattcacggtgtaattcacagtgtaaataaaagtcaacgtataaaaatttgtttaacttctcacctataaatctgtattcttctttcttactgttatcatggaaaaggtatctcccattgtgaaaggttactcctgtaccccttannnnnnnnnnnnnnnnnnnnattttacagccagttttcatgagacttgtctctatgatcttcatttttctatcttcctttcattgctcaatttattgcaatgtggcttgctacctcagtgtttcactgaaactgtagtctgtagagttgccagtgaccttccaaatactaaactcataaacatttttcaagatttactaatctctcaaacactgatccactgctgaccactccttgcttcttaacatttccttggtgccatggacactacactcccagttcttacttgtcccttcttatttccttttgtggatttcacttctgcctggcttttaaaagttgatattgattatggctctagcctcagtatactcctttctcttcacacactttcatggcaacatgctgttgaaatgaccatatatatgtcttcaatgcccaaatgtatatttccagttcagaagtctctcctaatatgccactggaatcatccaataaatacctcagtaccctcgtccaaactgattccttctcttttgattcctcattctatgaaagactcttagctacgtatcttcccaaaccttcatcctgaaagctagcctgactcctctctccacacatactgatgatgccagtattctacaggactttcttattgcccttactagttaatcaaagctcttgaatatggctcatattcctgccatgatctgtttcctcagacctctccagtgtcaacctttcaaactgaagcactgtgtacttcacctgagctttgtcttcaaaaggccattctttacctccaggcctgttaagatcttttccttttccagaaaacacaccctaatcctttgcttactcttttcatgtatgtacccaattgtggaaaaatttgtaggattgctttttgtgtcagtactattacttctccttggcattttcactrttttctggacagtgcttattccagaatcaggttgttaaataatagtttttaatcatgactccagtatttcagtgtaacaattctcagtatactttaagtgtgagattagaacatgcaattgtgctaggaggttgaatgttttaagatggcttccagaaaagcagtgatttgtttcaaagaactgtctcaaacactttaatttacttgtcttttaaggtacagaattggagagagggcatttacttatctttgaaggtttggagtatgttacttatgcagtcatcatttctcatattattgagtgcccacaaagtaccagataccacactgggggaatgaaacctagcattgcccttgtccttgcacaactttgagcctgaaggaggaagacagaccatcacatatagacataccaaaagctgaatcgagaattgtggcaggtgctattgcaacgaggatctatgtatatatgtaagatctggtcagagatgcaaggtttctcaaaaggtatagctccaaggctttttgtttgtttgtttgtttgtttgtttgtttgttttttggcttgctttcgtttctgctgttttcagagtatgaatggaatatcccaataggcattaacgtggaaatgtttgtatggtcctgaagcagtcagggaagatgtcctggattaagtgtagaagaggcaagtcagtagcctagataaacacccattgcatatggggcaggaaaaagtctagtgttgatatggataaaacaaatggcagtaaagttccacaaaacagtgtgttcaaaggcatttgatgttttgtgttaatattttaatcacagtagaaaattacatgtgggaaaatgttaatcaaattgtgcatgggaagaagtcacgtttctaatatgtcttataaaaattgagaaacgtaacaactaaaatgtttgcaacttagacaaatcattaattatgtaattgtaatttcactttaacaatgatcctgagggataagacacattttaaattttttatttctaccagtagacttatgtaagttattcttttttagcttttttttttgttttctgtgaaaaaaaactaaattctgcctgttaatgaggcagtagcacttgttttaaaagagatggtcagataattcttttaaaaggcagaatactgccatctgttgttcactgaagtttttagcctaagcaaacagaagccttaagttcaaatttaatagcaattcttgatatttaacagacaaagaccagcccacatttatcagctttctgagttcstacttatttcagagattcttagttattcctatcattttttaaaactctttctcatatcagagaagtgctcacatccagttaagttctctttgcttcctgtttcttccaacaacagaaataataatgttttttatttacaaagtaatttgtacttaaccaagccttcccacatttgtgtgagcagtcacatgagtagctcattgcctgaatttattatatctttgccagctacatcatcttttctaattaagagaaagagagaaaaccagcgtgcaacttaaagacagctaaggttatcttctgaaagatgcgggttcttactagagtaagtgatgaataagtatgttccatttcctaaataataaaacactattgtaaaattgttaactttgagttgttacgtgagttcgctagtgtctggaaagtagttagaaaatataaacaagacagaatttttcaccaatttttgacttgtttgctgatagcttgcagggacttgtataaggacagaggccatgtattccatctcatttggtgacttgcagtgctctttgaacatcaaaagagaaggatgttaagaattctggtaactaatgaagtttgttatgtttcacatctcacatggaacctgcccacagacatgttgggaagcagtttgatgaagggccctataggttttcctcctactgtacatayatattatcttaaggaaaaaatccaaatgtaaactcatattccctgccagaaaattaaaatacgcaaacatctgcttccttaggatggcctttagccaaggttcagcctacaatgagttactgcaaaattttcacatgatttcattttttaaaaatttcccaaccaacttcaagtctaaaattataaatgggtcctatgaaagtataaacacatatgcaattttgctgtctctgaggtcagaaccagtaatgcaccaaagatcattgtatcaaatccagctcatcttctaaattaatgtagtacattaaagaccaagataccatttcctagtatcacrgacagcctcccagagaaagagttggagggatggagtggcacgtagtgctacagagatgtaggaggagacagcttccaaaaactcatcacacatcttttcccagcattgaggaccaaagttggatgagaaaagccccagtgactatttcctttttatgtgtcatctcttacactgtttattcgtctcttatcccaactccctttccaccctaagaatattcctcccatgctgtgtttgcctcccagggtgcctcccaggatgactaaatagaaagaaaaaaatacttccaacaatggagctatgatgcctgcttttagaattcttttcacatcctgtgttataaatcattccaatgcaatcaaccatattaactgaaaccaggacttctgtacaatcactttttaagaacttaaaattaaaatcaggactattatgagtattttgcagtagggagtacaatatatctgactgcatttacctagagtaagaagtggaaataggtttttgtttttattgttttatttatttatttaatttatttatttattttggtagagaaatcatatctctgtgctatcttcatttataaargaactactggcccagttcatgtaggggacaaacacccacgtgcacaacatacatttctttgcacacacaatctttctcaacaacaatgtttcaccaacaataatgataatgttggtgatgtataatacttatcaaacatatattttggaccacgcactctcacaagtctttatgtttatgatctcatttaatcatcaattacactatacagtcgatattactattaatccctttttagagaggagacaagagctaaagaaataaaatgagccaggcatggtggctcacgcctgtaatcccagcactttgggaggctgaggcaggcggatcacaaagtcaggagttcgagaccagcctggccaacatggggaaaccctgtctctaccaaaaatacaaaaattagctgggcatggtggcgcatgcctggggtcctagctattcgggaggctgaggcaggagaattgcttgaaaccaggaggcggaggtggcagtgagctgagatcgtgccactgcactccagcctgggccatagagcgagactccatctcaagaaagaagaaaataaaaaaggaaaggagaggagagaagaggggaggggaggagaggggaggggaaagggaaaattaaatgaatttactttttaaataaaataaaaatcttagcagatctgaaatttgaacagaagcagtctaacttcggttcttgcctccttaaagaccccatgtattacctcatataataaatatttgatattgatgaatgaaaaaaactttctcttatatcccaacgttttaaaactctgctttccaacttcccacatacacaaccttacaaattatatatatgacaaaaatatgtttttctacctttttgcttcccaaatgctaattcataaaccaggcttagctttctagctcttgttccaggaatgttaatgaatagctttaacaccgcaattacattatgtctcattttaagggaaagaaaatattgagtttaaaatactatggagctctcttaacagacataattaggacaaatagctggtctgggaattttaaaaagtttttaaagtagagaatcataaaaatatgatataaattttctataattctagtaatatattttaacttaatacatagagtatgcaggtttttgcacatctttgatgaagagccaagaatgtttctctcaagtatgtgtccactgaagtgactggagtttcaggttgccgttcttacttacaccatacccatatttcctatttcattgtacatgcttgccagtttccgtttctttatagtggaaacaacttaggaacttggaagcattctgagttgaaaagcctttaggtgtgttgtgattttctttttgaatctttatagttgtatctcccctacttaaatcaagggaaatacattcttaggctctcacccttataaaatctatttatgaactctgtgtaaagctacctgacttcgttttcaagggaacaattccatttttctgcaggtgtcatttctttgtagatattttgttagtctatgtaatttacagtgacaaatataacaggcctaaagagatttgggaagaaaggaaactgacactaggcaaatgcgtaacttacctattgggagaagtatatggaaattccaccaaatagcctattccttgtgatctactcagtgtacactaggcaatttaccataagaaggaaacagcatcagtgactcaataacaatttataaggtagagcttgtgaaagattagcaattaatacaataaggacttttctaagtctacataataattttaaaatctttttttaaatgtaaaatgcttaaagatgccaagatgtaattttaaaayctttttcttttttcttatttgatgggggtgtgtatgtgtgtgtgtgtaaatgtagagaaatgaattacttgcccaattggaagggaccttcaaaagatcccgcccagttctctgatttcagaggaaaagagcctgattgctctgttggatacagtattgcctataaggaaacctgtaggtttggttttggaagtcatcataaaacttaagatatttttaagtggcctaatttgaagtatatagcatttctactaggttatctagataatttctcaattctaatgtttcagcatttgtaacctatcttcaagtttcatgtagacttacgaagagaggcttttggtgctgcttctaattcttttcctccagttagaataaattaatttccaaagcaagtgacacgccagaatgttcactgagtcagaagactggagaattattacattttctgcctgtcagcctatttaattaagttatcaatttaatctgtgatttaaaatatgtagaaagcagagtcataacttgactatattggtgctacctcaaagcaaatttatcaagaattggatgcattatcttcatctacaccccaggtgctagataatctccttaatcattttaaagaataaatttatgttgaccctaccatttctccagtctttttctgatttttcctttgggcacctttactttctttaaaaaaaatgatgtgtatctgcttttttttgtttgttttcatttactcttttcacataattatttcctaagcattcttagattttatcttttagaaattctccagttctcaatattttggcataaactcaaacacagcaccacagcaaataatctgatatgttacttaatgatacatgattttattttacattctgttcgtaacttggttacatagacttgttagaatttttcatagtttgcaacttacttagaaaattttagaaacttagatgccttttatagcacgcaaataccttttgacctccacacatattcgaagatttcccttttatcatatcagtactgcaatgtcaaagtttttgcccactagtaataaaaattaaaacaaattggccgggtgcggtggctcacgcttataatcccaggactttgggaggctcaggtgggcgggtcacctgaggttgggagtttgagaccagcctaaccaacatggagaaaccctgtctctactaaaaatacaaaattagttgggcatggtagcatatgcctgtaatcccagctacttgggaggctgagacaggagaatcacttgaacctgggaggtggaggttgcagtgagctgagatcacgccattgcactccagcctgggagacaagctccatctcaaaaaaaaaaaaaaaaaaattaaaacaaattttctgtaattgattgataggcacacgtctaaaagtatgtataatattgattatacttgttgtattttaaacttcttatctatagcatcagactttctgggcctttggtttatgatgagtgaaataacttagaaccactctagattgtaatataccaaggccattaacagttgtggtagtctaaagccaggattaggtaggacatcctggaaatgggaaagtagactggatgaagataaaagaggaaaaggaagttgtttaaaaactgagtactcagtcgggcgcggtggctaacacctttaatttcaacactttgggaggccaaggtgggaggattgcttgaacccaggagttcaagaccagcctgggcaaaatagcaaaaccccatctgtaccaaaaatacaaaaaaattaggcatggtggtgtgagtctctagtatcagctgctagggaggctgaggttggaggattacttgagcccaggaggctgaggttgcagtgagctgagatcgtgccagtgcacttcagcctgggtgacagagtgagactccgtctcaaaaaaaaaaaaaaagaaaaaagaaaaaaaaacacattgraaaatggtgaatttaccaaaagtatcagttatttttggcttgatatataaaaccgcactttcctccactgtttatcgtactgaaatgccacattttctatttaaaggtggcaatccaaatttggttgccatttaaatagtgtctagggaaatacacttgcattttctgaaatgttaaatataaatatttctattacaaggagagtctgtgaagtagaatgttttatattgcttggtaactttttttttttaaaggaaaagatttgtttgatcatctgcaccataagaagactcaactgcgattttgtgcttagtgtggctcgtactgcactgaaagatggtttcagattgttagttttaagacttttctttaaactggcttttatataaacttaacatttagtatttattatcactatctaagatttcaccagttaaataaaacatttctgagtaccattggtatacctcaatatttaattatattatttttttcaaagttaataggcatggaaaaaacttctgtgtgaatcacacaattttttctcactttgtacatgatttaaaaaacactaccaaaaaccaaaacccctctcccttaaaattccttaatagggacatcctagacatacccatcctttgtagcttacctgctatttattgaaacagcagccagtccatctttctgtttttcaccatttcatgtgtggttagccttggcaggtttgctgcaaacaaatctgattgttggttttaaattgcatgcctcattgaagcctttagttatttgagcaaaaaagtggtaataacttcttacgtgtgatgtgtctgttgactgtaacataattttattctagaatcatgaaaacaacaaagtgaggacctgacttaatgatactaaggatatttttttttccaatagtagaagtgttcacttcagtttcttagctaatttcaataaggataatttgtctctcggcttgaatgttgcttttgttttcacttaaagacctttgcttttgcaaaagctacagcataatagtagcatcaaaatacataatgtgcttattttctgaattcttatgtaactgtgacattgacttataaagatgagttttcagtttctattttaaaaagtactttttaaatgtttactattttttctatatatacaagaaatacatctattactttaaagaaaaaataaaatgtattataaaaagacacacaatttgataattataaaaaaacttgtcttcttcccaataatttatttaaaacttgtaattctcatgaacatgttctactttttcttcagatttgtagattttgtatactgagaacattttaagagaactttgtagttattactagagaataaacttaatttcattgtcaaaaacatttaaaattttgtcttgaaaacaaagtttgacttaaaatttcaaatttgtatggaaacagtccagttaattgttagtttattagaacaacatggctaaaaataaacattactatttcagaggatcacactggatgagattttcagaagcataatgattagagatgcactttaaaatacttatttctaaaagggaatgttagctaagtggcatttttacaaacattaaaaaattgaataatgatattatctctatttgcagatgacatgatctttatatgtagaaaaccacaacaattctacacgcacaaaaattgttagagctaacaaatgaattcagtaaagttacaggattgaaaatcaacagacaaaaatcaataacattttttatatacaaataagtccctagctgaaaaagaattaaaaaacactcccatttacaatagcataaaaaatacttagggataaatttaaccaaggaggtaaaagatttgtacatygaaaattataaaacactgatgaaaagaattgaacacagaaatatatagaaaaatattccattactcaatcagaagtattgttaaaatatttatactacccaaagaaatatagaaatttaatgcaataactatcaacatcgcaatggtgtcttcacagaaatagaaaaatgcaatcctaaaatttgtatgaaaccacaaaaaaccccaaatagccaaagcagtactgaggggaaaacggttgaaggcattacactttctgatttacaactatattacaaatctatagtaatcaaaatagcatgctactggcataacaacagaaacctacaccaatrgaacaggatagagagcccagaagtaaattcaagcatacatgttcaaataattttacacaagggtgctaggaggacacaggtggaaaggggagtctctttgataaaaggtgctgagaaagctggatttctacatgcaaaagaatgaaatcgtatgtttatcttataccacacacaaaaatcaactcaaaataggtaaagactgaaatgtaacacctgaaaccatgaaacttacttatagaagagaacatgggggaaagctctcggacattgaccttggcaatgaattcttggataacacaccaaaatctcaggccaaaagagaaaaaataagtaaatggggccacatcaaactaaatagcttctgcacaggaagggaaacaatcaacaaaatgaaaaggcaactgacagactgggaaaaaaatattggcaaagcatgtatctgataaggaattaatatccaaactttataaataactcttataacacaataggggaaaaataacctgattaaaaagtgggcaaaggacatgaacagacatttctccaaagaagacatgaaagtggccaacatatatgtatggaaaagtgtttaacatcactaagcatcaggaaatggaaattaaaaccactataagatatcacttcactcctgttaggatggctattattaaaaagacaagatataacaaatgttggcaagggtgtagagaaaagggaaccctagaacactgctgttagaaatgtagattggtacagccattatagaaaatagtataacggttcttaagaaaattgaaaatagaactatatgatccaaataagataaaatcaccacctcataaagatatctgcactctcatgttcattgcattattcacaatagccaagatatgtaaataccataagcatctgtccatgaatgaatggatgaagaaaacatggtatgtatatatgcacacacgtatatacatacaatggaatagcattcaccctttaaaaaggaaggagatcctgtcatttgccataacatagatggacctgaagaacattatgctgagtaaaataagccagacacagaaaaatattgcattatctcacttaagtgtagaatcttaatttttaaaaaaggtcgaatattcagagatagagaataaaacagtcgttaccctgggcagagtcaggggaagggtcaggaaatggggagatgtaggacaaaagatacaaagtagcagatatataggatgtataagtctagggtatctaatgtacatgaggattacagttaacgaaattgtattgtattacagatttttgttaaataaggagatttcagctgctcttgtcacaaaaatactatgcaagacgctagataatgttaayctgtctcactatagtaaccatttgactatctgtacatatacacataacatgttgtaagcctcaagtatacacaatrcaaattatttttaaaataagtaaataaaataaaattctacttttagctcagaaaaataaaattaaccctatagataacaaatatgacatatgcatgactatgtatcctaaaattattaatattacacttaaattttcatattggttcataagagatatttatgcctgtgatcagagaacatgggtactagtattaaattatgcattaagtaattacagatatatttaagcacataaaattaagattttctgtttttgtttttttgtttttcaccgtactggttcaacacttgagctatggaatgaagctatttttctttgcagcctgatatttccactttccacctgtctgattttggcaagttatttgtgtctaatgaaagtgaaagtaataatagtacttactaatactttgtagacttgtggttaatatatatcaactttaccattattattatagttattgtaattctagcagtaaaagacataacttttctgtatgataattttacagagtaatttattcattacttacaggtattgcaggactagatatctttatggatgttaggtgtcatgatatttttctaattacaagaataatatatattcactttttctataacatacttttccaacccactgaacaatattttctagacaataatttatgaatctacccacatcttttaaacaaggatagacaactttataatacagatataatgaaatttaaaaaaaaaaatttatctacttatatgtatctcggttgtcgttgccagaacactgctataccctttgtgttattgtttttatatgtttagatatttgtagaagtatttctttcgaccagatatgtatgttgttttgctggatcatagaatatatacatttaagctactaattgataggcttagcaaagtttcctgccaaacattttggattgtttttcctcactactcgtttacccaaaccattactaatgcttggtgttataaatcttttactgttttgccaattttgtaaatgaaagttgtttttattatgttgatttgcaatttaattatagtggacataagtggctttatatatatatatattggttatttacattttgtttgaattgtctattcacttcctttttcaattttgtcctttagtgattttttagaagctctctgtttggatatgttttatcttctctgtgtggcaaacattttctcacagaccatttcctcctttgcttatggtttattttcttatgtagaagtttttatcttcatttagtcagatacattaggaatatccttggcagtctatgaattcatattatttttaaaggttataatttcaagattataaaatagtccctcatattttcttttaatcgtacaactttatacttctgttttttctctctttggagtttatttacttacttatataagtaactatatataagtaatatagttacttatataagtaactatatataagtaatatataagtaactatatataagtaatatagttacttatataagtaactatatataagtaatatagttacttatataagtaactatatataagtaatatagttacttatataagtaactatatataagtaatatagttacttatataagtaactatgtataagtaatatagttactgatataagtaactatatataagtaatatagttacttatataagtaactatatataagtaatatagttacttatataagtaactatatataagtaatatagttacttatataagtaactatatataagtaatatagttacttatataagtaatatagttacttatataagtaatatagttacttatataagtaataaactatatgtaagtaatatagttacttatataagtaaatatatatggcctctgtgttttgtgctcttcgtttctgctgtgaggacagagtaatgactctgctctgataggcagtttggcagaatatgacagatgtgccacagaatcccagaactgaaatttctattccaaccaacaacaggaagagagacagattgtgaactagcacacaaatggagtttttttgtgtctatctcgaataacattcattgaataactaccattagcaaaaatattcattgaataaacaccaggttcaagtgtcacattaaaatattactaaaaataacattttatggtatattaatgttacttttggagtgaaattcctaaagaacatagatgtaaaatgttgagctcttcataaggagtgatatgaagtttttcttccccagatctctgaaactttttgccttttaaaaactagtgttcatctttttaatttcttcaaatatgcttgaccctccccaagttctagcattaaaaaatgggccacaaatgcaaaaaagggtggcagctagggcacattttagcagaatttgaaataggtggtgtgaattttactgtactgaaatcctaaagaatcagcccaattcatttcttagtgaaaaagtccaaattaatgctttgtgccttcagattcaggccttttcttgcctgatcttgtcttggtttgtgtctcagtcttcaggaaccagtattactgtggacatcgccgtcatgggcgaggcccacggcctcattaccgacctcctggcagacccttctcttccaccaaacgtgtgcacatccttgagagccgtgagcaacttgctcagcacacagctcaccttccaggccattcacaascccagagtgaatcccgtyacttcgctcagtgaaaactatacctgttctgactctgaagagagctctgaaaaagacaagcttgctattccaaaggtaggtagtaatgacataccccttaaagggttaaactattttttttaattstcttctaggtctccttcctgtcacctcaactccatctgcagattcatatcagtgactcaggcaaaatgtgttgatcgtggtgacagaagtaataaatatttaaacataaagacttctgtccttatacttgatagttttctatacatagaaaatttatctttttatgttacctcttttatttaatctttcatgttacttgcaaaacgttttctcttctatatgccaggcgcttttctaaggtgataaggatattgcaacaacaacaacaaaacaaagaaggcagaaatccttgctcctttctagtgcagattctgtttaaaattcattgactcctaaagctaaaggttctttactctttgattctcttgaatgatatacttcaaaataccctcctgactttccaatacacaatcagttttgaacccagaacagttttagtcaattatagattatttaaagtaaaatatatccttagtgatttctataaatatatattttatatgtaaaaggaagaaattacacaaacattctttttacatatatggcatgagttttatgaaagtaaattgtaggaggatcctcacccagtttagatctcaatattaattaaaaataagtcatattaaagacaaatcagtgtcagtggtctctggtatattcagcacagttatttatttagtaaacaatcagctatccctttgagctggtggtcagtcagtaacatctgtgcttctgctgttgtgagtctcttctctcaggaatgtgatcttcataactttgtcaataacatatttacatagtttccttccaatatgaaattccctgataaagatatacctaagtataatatgatagtaaggaaatggagagagagattaactggttccttcaggtctcaaattagacctgaggttagtgacagatttaaggcaagaaatctggtatttaagagtgtttgagttttctcttccaactgaattaccttctaagatgcacattcagatgtttaagagacactggaaactatttaatatcagagctattcttaaatcccaaggtgacatataattcacttctcaaaattttttaccttctttggaagagcagaatgtctttgtgaactatgcctatgtggttggtttattaggagtgattagccgcagataaaagtgggttgtggttctgtgtgttatgactgttgctgaagttataggaaaaagaccttcggtttaactttttcttttcttttttctttctctctttcttttttttttttttttttttttgagacggagtcttactctgttgctcaggctggagtgcagtggcgtgattttcgctcactgcatgttggccaggctggtctcaaactcctcgtgacctcaagtgatccacccgccttggcctcccaaagtgttggaattacaggcgtgagccactgcgcctggcccagtttaacttttaaggtcaagaaccactttagagtgttggtgctcatcctagtgatcccagactcttgtctcagtgcagatgatgctacatgtcctgtttaggatatggtgggagaagaaataagaaggggaacagcaggttggccagcagcgtctcctattaagaggagttgacactgatgacattacccatatctctgttgtctaagttacattaatcataagagaagtggtgcattttatgaaagacttgagctcctttcatttgtgaatgaagataataaagtcaataatacttgggggtatgactgtggtgcaaggtgatataaattaattcatgcccccaaacaagtgacttttgaggaagaacttctcataataactaatatgtgtgtataggtgtgtaaatcctgttgaataaatataactataaaattatcccagaggcaattgactctcactcctataatcacatatttgtataagcattgaaataaagaccctaaaaggttggttatgtatttatttatttatttattagacagacttctgctcttgtcacccaggctggagtgcagtggtgtgatctcagctcactgcaacctccgcctcccagtctcaagtgactctcctgcctcagcctcccgagcaactgagattacaggcacccaccaccacgcccagctaatttttgtatttttggtagacggggtttcaccatgttggccaggttggtctcaaactcctgacctcagatgatccacccgccttggcctcccaaagtgctggaattacaggcgtgagccactacgcctgactgcttatttttataatatgcattcattttggtcagagagtcttttattaaatttctgagcactcaaattttagataggtgatattaaaccaatgtaatttagtcaattcacttctaattaaaagcttgtttccttctattatattacataaaatttaagagatataaaatattctgggtaatgaagtcaagtctctttcctagcgcctgagaaggagtttgcctcctggcttgttgagacgagtttcttccacttggaccaccaccacctcggccacaggtctacccaccttggagcctgcaccagtacggagagaccgcagcaccagcatcaaactgcaggaagcaccttcatccaggtggcatacggctcctgctggtttaatgtctcttagagaagttacttgccaaaaatgagttataaattacaggagaaggaaggctaaccaattacatttggttggaggtcagctttgaagatggaaagggtacatggttcaaatgcagagcagtataggggttaacatcagataattaggcttaacatctgttgtgtggccttatatataagtggaaagagtgacttgatgtgatctctgccattgtgaccttagatgggaagggttaagcccaggataaaggtaggtaattttatctrcattgagattcataccgagacccttaaatcaaaagcatacaacttgacatttgcatttgatatgagatcccccagcccagtcattagcctcccacaagaccagctgtcttagcgttgtacaaaagacaaaagagcaaatcaaaagtagatcatcctaagaacacctagatatgttcaaacatttggtaatttaaacttttctgaggatattaattccaatttttgaaagcaacttaaaagccagaattatcaaaactaaagaaaaggttatattaacatctaaaaagaatcttgaagaaaatagctaaggaaagtgcatttagagggagatactgtgtccttttctatttagaataaaaatattatacttatcttactttattcaaattcrttaattgtgagaacatttaccgtatgatttcaggtttttgaaacacatgtataagttttatcaatgacctaatgaatgaaaaaatatccacatctatgtcgtattatatgacagcaatatcagaagtaattttctcctgatcgttagcctgggatataaataaaccaccatactgagactaatagaaatatttcagatgataagaatttaatgactgctgacctttcttttttgattaaaaatttttaattggtttcttccatattatttgtattctaagacatctatagaattggaaacaaactcaaatgtcattgtatattttatatgtcagtataatcccactccatcctattacctggacttttgtaaaacttgtaaatgagacaagaagagattatgtagtgtttcatgaaaatttcctgacggttgaaattaattagaagtcaatgatcaatatttttctctaaaaatattggtcattgacaattgctacagcagcaaatactgataaatgctaatagtattatagttaactattgcttaataaaatgaattatgttttcagcgtgtatcattagagtctgcccattttgccagtgcaacttgctaagtttcctgtcatagtataggtaatgcttcatgatttccttcccatagaatgactctatgaaaaatccactcatgccttctcaaatgccttttattctgttattctttgttacttgtagtcaaatcctatctcccctgcttttctcttctcttagtcaattaaatgaacttgagggtttaaattgaaatgatgacaaggaaggaagttccaaggacttttaagaacttaacgcccaaggatcttgtcattcttctttgtaaaatggatcatccaaatatttacaatagaaataaggaaaatacttacaatagamataaggaatagcatacaattccattcattctcattctctcattcctgaaaatactcgtagatgtcttgtctggacattcattttcctcactgcctaatatactatctcataatctcactgtcctatgaaaagtactgatgtaaaaatctgaaagcaatataattccttcatcattgtgaagaaaggaaattcattctgaatagaatttgatccctttaagggaaaactatttataagtaagtggcagtagtaccaccactaaatacagctagttttggcttgattataaatcacagtcaaaaccttcttttgagttttagccctgaaattgcttcccttttagcccttttatttatttattcctttccatatcttttcatttattgggtttgctttgaggaaggactacattgatcaaaagaaataagaatgagaaataataaaaattagaaacacaacttaactcatattcctttatatatacagctggataatttacccctgggtaattttaaatacagtctggtagaaagcacactggactgagaatctgaagggtcttggccctaccaaccactcagaaatgaaatgtactgtgttcttagaggcaagtcattagcctgccagaatctctgtacccaattacaaggagtcattaggaaaaaggggaactatgacataattggaggggtaaattagatggaagaatacaagtaggtgcttaaaaaataggctttagagaaataggaaaagctgaaataaatcagaccctaaatgattccaagttgaccttggaattgacccctgcctgtgtattcaggcaaaaagaaggcagtaaacttggcaaaagagactgttacctgatcagactttaaggacttagaatggagtcattacggggataataagagcataagaccacctttgggaagaagattgagatcttccatcacaggcacatagataattttcctctgctgtgccagcatgagaaaaccgtgtaaagcctttcctaagctgttctgctttacagaatccaaattatttcatattcatgaaatttaaacaggaatcaggaaataaaggacagcgatgaaaagctgaaaactgtgagggtctcacacagcaatatatgaaagcacctgtgaactataatgcatttatwtataatacattgatttattgtattaatagtaaaatacaattatttagtgtattaagaatgtgatatgactaggatgttatttatcttgagttcattaaatctgcatttattaaagatactctagtgtattttgcaaacttgaaaatgaacacattttaaatgtttttatttgaaaaaaatagtaaattgttgagatagccttcataatatatctttctgatatattaaaacattcagttactgtaaggcattgtctttaaaaaggctacttagaaaagtaaaagtaataacctattcactgtattatgtaatgagaactgcaaacatttgggccacatatacattacataatatttcttcacagtaatcagttagtcaatccagnnnnnnnnnnnnnnnnnnnnnnnnnnnnnnnnnnnnnnnnnggaccagcatcacgagaaaatagtcagtgttgttatctgtttcagatccaaagtttctttcagctcattatttcctaaatgccaagaacttgtgaaatacctaggatgtgctttctgaggaagatgtcaaagaaatatttttatgccttacttaattgcattttataattgctgaaggtcataccacatttcaaatgtcctcatatatggaaaactgctattagaagtaaggagaaaagatgaagttttaaaatacctgggtcagtagttgaagaaaaatctctctgaaatggaaaaaaaaaattgagataacaagtgtcagagtgtcaaattgacctcaacacaaattacacatcttacccattgccgaatttactagtaattaatggatacagacaatagtaagacccatgcttagcattctttcctttgagaggtctattagtacaattttctgaaagtccctttattccacattagcacatgttctggtttggatttagcatgcagtgttctaagcaatgcatgcataatattacttgcacagagggaaccattttagctctggaacctctccaaattatatcgtattaattataagcttatatggcaatctccatgcatccatgagcccataattctatcaattttaggtttatttacaataggctacccagacagaccaagcacatcctgcttacattgccaatctaagattggcaaaagatcaaattgtcaaatcatatttacgtaaattatagattgtacccagtaccaaatttactagtgcttgaaaggacacaggtgttagcaaaacacagaccaagcacttttcccttggagcagtccaagattgtcaacacaactttcgaaattcccttctctcccacattaggatggagtctatttcagattcaacatgtrtaagttttaagcaacacatgcagagaaattttgtcttggaatacctccaaaatttatatcacaatcattgcatgacttacataacattctctagttcagtcttccatgaatctattaattccacatttatttgcaataagcaacctaggcagaccaagtacatcttggtaaaagcatttgctagaggaagattctccattgcctttctcctagttcctatcatcagtgtgtttagcatcagctccattgttggcatgtccctttttacaaattcccttgtaaaaaggtaatttgactagatcatttccgtcacaaggaaataatgcaaaaaaacacaccattatttatgaatgatttcatggtcattcaatttttgaatacagatccaccaaaaataatagagtactgaagtaaacattatgacacttacagcttatgtaaattcacccgcatcttaaccagttaatctgtaagcctcttttagaaaatctgtgaggaacgtaattttagagtacagtgagaaggtgtttaatttttattaattggataataagaaagttatctttcctctttgttaacccagtatgcttgatgagtaactgctatatccctgcaacagagattgtttttacataatctgtttcatcatttggaagtacagtggttctgtcactgaacctgaaccaatactcagattggcaaatctattagagaaatgatggttgggttctggcaagactggcccaataactgatgaataatttgtttaattttcttttaattctgtctttctggtgcttttagtcctgattcttggaataatccagtgatgatgaccctcaccaaaagcagatcctttacttcatcctatgctatttctgcagctaaccatgtaaaggctaaaaagcaaagtcgaccaggtaagtaacttaactggagaagggttcatactgtgagtgtggagttctagagtaaaccagaccttaagcgttgaaatattctgagggtgccctatattcagatatgtttggtttgtctgttctaataaccaattagttattttttagaagtctcaataaccaattagttatttaaatttctaccttatgtgatgatacagattccttcaaagttgttgtatcagatttcctatcttgaactaattagatgcataggaaatcacttttaccatcaaggatcatctgtggtagcatcatctcataatagaaattccaattttttagtgtctgttaaaattatttttcaggagtatgatatatatgaattcaagaaagtgttttatttactacacatgagctatgataaggaatttagatatcaaaattaagaataataaagctttaaatgggaacatgaaatgatatcrgggaagactacctcatttgttcagggtccttgctcacccaaaactgtaaaaggagtttttgtcagattcygtctctgaattgcctttcccctagaagcccaaytaagaacctgggagatttcctctgacctttcctttttggaatctaacttcatggtttcacttctcagtattacagaaaatatcaatgagattttcagtaacttcctgcttagtttcttaatcttctgcctttagcagtttaagagttcatcaaatggttaaaaggaaaactgcccacttcccactgagatatgaaacattcaagttcwggcttccatggcaaccccaaactccaatttttatgtcaccagcctcatgacattgctagaagctctgctggcttgcctcccaaatagctgcacccctctgtctggatccttcacttcttactccatgccaatagtcagtaaatcatgctatgaaggsaagaacaatttgcaggattttggctcacctttctgaggttctcttctttatgggaacctagtccctcagaattgtgtgctttgcctcgatagcttttttgtaccattttattggaattacatcagtaaaatagaccattaaggtaatctacttttccaacaactaatctggtcctctctgctctttagaaatgttcattaaattttgtcacttagaagtcattattgacctgctaataaaattgagctttcatcagggccaggcaatgtaggctaatgtaggcaaatacttaaattgagatattcctgaaggcaaatacggatttgctcagtaataaggagaatcatctgggaccccagcaaggtagagaaactgcatttgagaattccacattaaacccaagactcttaaaggggtgctaaagtgrttttaggtatgtaggaccccttggctccctacaaaaatatatatggatacttttggaagggaagcatcaccagttaagggccatgagattttatcagatcagattcaaacatggagcttacaaccaggatcactaattgcacaaagaaacaccatgagtttgagttaacagaaacaaaaatayaactttctagatctgtaaaagggttaaaatatttaaaytaaaatttaatttaaaaatttacatatttaaggaaaaataatagcaatgagaaaagacataactgcagagcagctaaatgtaacttttggaaatgtagtcaaggaaatattaaatagcatagtagactactgaagaaagaattattaaactgggtagagaaagatcggaagaaattatccagaaagcaacacagatgaagaattgggaagtataatagattttaggagatatagaaaaatgagtctaatgtacatgatatatgtaatcatagttttagtagcagatagaagacaaaaatacttaggtgaagcctagtaaatggaaagaaactcacacgtagatacaaaatagtgaaactacacaacaccaaagatatacacaaacaaaaatcctaaggtctaccagagaaaagacaaatttccttttcagaaaaggcagtcaggctgagagcagagttgtcagaaatactggcagtcagaacacagcagaatattttcttcaaatttctgaaacaatatggtaacctaaaattttgtgcctggcagatgcatcttacaagaataggagtgaactaaagacaatttgaaagaagtcaaaactttaccacccgccaaatctttactaaaggaatttatgatggatatattctagaaagaatatatgatggatatattctagaaagaatatatgatggatatattctagaaagaatatatgatggatgtattctagaaagaatttatgatggatgtattctagaaagaatttatgatggatgtattctagaaagaatttatgatggatgtattctagaaagaagaagaagaagagaaagtttgagatctaatgaaaatgttaaacaaatctgaaaaccatgggtcaatccaaacaaacattaaattcataaataatagtatttccagatttgtgaatagtttttataagattttttaaggacagaactaaaatttcagacagtaataatacgtaattcaagagatgaaatataaatttaagtgttctaaatccatgtgtagctcaaaaagggggttcagatgaggaaactgagggaaaagaaggttaagtaatttgctttctctgggtcatgcaattaatcctgaatactttcttttgtcctaatgacttcatactagaaaaaaatgaggatgacaaattgtcataatttaaaactaggatattttgggttctgtccttgggtgggtacaagataatggaagggtttggttttctcttcctgtttcttcggttaagtaataacataaaaaatattgaataaccaacatgataagatcaagaagctgaaaattatggttagggcagaccctggaaatatcagatcaagtgatggaacagcctcatattcctgtgtcctgatccccagtttgtatgactkcactctagaagaaagagcaaaggagcaaaatgtaaaagggaaggaatgtccacataagataccacatgggcaggtggtaggaatgagagccacaggcatagcaagagcccccttccattcttgccatcaagtgcataaggcatttctatcatgatcattttggagyggattttgcattgtggcatctttagacagctgtcacagcacagctaaaagtttataaaataacctatatcccaggcatgctgaatccaactaattaaattcctaaagttcagccaaaagagacaaacacatctatcaagaatcagagagcctaaagagattacaaccctccctaatcagatgggcccttctgctttaaaatccttgcttccctgtttgggttgatggagctaagtggttgtgacwtgtttgatgcagttgactgtgatgcatcctggttttccataaactccatggaaagaagctgggaagagccccctcgtggcaaagagtgtaagcaaatggaatcaaatgaaatgtgaagagagtctgaggaaacatgtagcagcaataggcaatgaggcggagrgaaagcgagtatgaagtaagaagaggcatacagaaagataaataccctgtttccagagagggctaatgaaatctgttctttgcgcaaatcaagtaaacagygtgtcctctagttcagtcaatcaatgttaattttaaatagctgaaacacaaattattatgcagttactaatataaaataaatgaacgaaatcacataggactcctttaataaaagcttaaaagcaggagattcaaatataatttgtattttcaattttgctcttctagtatgagtcactgacattgtggagctaccatgatattattctgctttaaaaattccttgaatttatcgttactgtatttgcagtagtcctttcccggattcttgtaagtttggctgccgactgcagtgataagagatatctctacacctataatctagactctgtttttcctatacaaaatttgaaaatatagagaactttaatcatggtattgtgattmttyttctttggcattctctttagatgcaatttctgctttggaaaaaatattcgggctatccattttcacctgggcatggaaaaaaagagatgtctttatcagacaagctggttccttttttgttccattaaaattaaactgagagagttttatagcacaaaacagatggattcacttaaataattcccctgtagtattgtttattttctctctttgattgcccaaaattccttgtgtcttgacacacattttctcatgctctcaggaacaaggaattaaaggccgaattactcaaaggagttggcattttagactttatttttaaaattatatttttaattttttgtttttaaatgttttgattttaagtatttcacattaggacagtttgaatcattcaaaaatttatatttcatgagctatgtcttcttcctggaatctgctaaaattactcaaatatgaagtgaagataaacattaatatacttgagagaatgcatgtttatcggaatctcttcactcatgggtgagtgtgtaaatgtgtgagtgtgcgatgtaaaattagatgagattttcaaaggttttaacggtcatccctctaactttagacatgattacattgaaagcattttagaaaattttaaaaacttccaaaggttattcatccctattccttagactgtcctctttctgtatctgaaataatttatttatagtttatcctttctataaagaaaatttggttattatctgcatttatctccctatctttttgaagaccgatacggtcttcaaaatatgcatgcacatcctaattctttctgtttttaaactttaagtaaactaagataatgcacactaggaaaaatagtagtttggctttggaaaaaaaaaaaagagaacttatacttttataactttagcttctcacctgcagaatagaaatatccatgcttctcatgattgttgccaagagttacactttttttatatttatttatttatgtattttttgtgagatggattcttgctctgtcgcccaggctggggtgcagcagtggtgggatctcagctcactgcaacctctgcctcctgggttcaagcaattctcctgcctcagcctcctgagtagtgggattgcaggcatgcaccaccacatcaggctaatttttgtatttttagtagagatggggtttcaccatgttggccaggctggtctcgaactcctgacctcaagtgatctgccctcctcggcctcccaaagtgctaggattacaggcatgagccaccgcgcctagccgagttatgcttttaaaagtgttcaaaatatgtagacaaacactatagaagcagagcttctctcttacaggtttattttaaatttcatcccaggcagtaaatttgatgtcttaaaatctgcttgtttgtttaaatttagttaatccgtgagttccaagaactctaatggttgtgtgaattttaaaatgtgtgtttgagagtgaattgcatgtatctgaagcaatcagctggcagctactaaaacttagcaatgaaaaaatcactcttctcataaattgccttcagaaaaaacagggtgtcaagacagaaatggacaatgttctcatgggctttgaactattgttctgttaaaaaaaaaaaaaaaaaaaactgtgtagaaaactgtcccaaaactcacagtttactatgagaacagctaaggaattgcctaacacagtgtctatcaggaatctctttttcttatgacacagcaattacttttaattgctgtttttgcaattacttttcattgcaaaaaccacaattacttttgcaccaacctaataaaactttgccctggccctacccaaccctatccagacttgcccagcaacctctctgaccacgttccctgcccctctttttgctttttgctaagctgccagccactgacctcctgactgctcctctgacatcccccaggtatgtccctctttcctgaacatgctttccccagctacttctctaaatgtcttctgtatttcatgaggcctctattcaaattttacccacccccaccctttcccagccagagaggccttctcagtccatcttatctaaagagcatttctgttcttccctgccttctactctgtgcattgttttcttcctattacttgaatttaagttaattttcttttttattgactttagtttttagtttctgtctcccctaaaaaagtgggagctccrttagagcagggtttttattttataacctactccatccgtggagcaagactcacaataactacttgttggatgaagaaatcattgagatactcagtacagatacctcggtaaactttctaccacatcatactaggattcagctccttaacggctacagtgcctttctaagattatctggagtccctgtctaaatccaaaaagtggtcaaaactagaccaaccctttttaacctttacatcagagcacccatatatgtgtaatagtatttgtgaatatcgtagcattagagaaatgggaagggatttcaagtttgaaaactagacttcctttattttataaaattataataagaaaaactaattatgagctattagagataatattaaaaattgagttttttctagagtttccaaataaaatatttccttttttaaaaatattttcaaccattaaataattcacagcaaacttataacccacttgctgtgcagaatcatacattgactgggaaattctgagttaaaacctttgtgaacttaattttttgttttgtttttggctcaggatactatgtaatgtgaaggtttgtcgttatctttggaaaaataaatgagtctttttaatagacgtagaaaccgaaataaaaaccatcaggcatgacgtaaggagcaatgcaaacgctgcctaatacgccatgggttttacttcccccttggatagtctctgatagaggtactggtttataagctgcattttactaagagtagctgggtttactctatattctcccatgtactagtactgtgaccttgggagggttttttaacctctctgggtctaagtggtttcgtttgcttagtataaaggctgggagggggttgagctgctgattaggaactaacaatagatatgttgagaaagaactagaaggggttgctgctcttcacactgaagcaaggggagagtgagatttctcatctttaacaacaacaacgacaaaaagaaataacagcgccaacaagaaattraaaagaaaattacacacgaacacacaaaatcgttcaacaaacttaatattcttttcagtggaccagaaaacctttggtatgacaactcaaacttttgaggaagctggatcctggaagcaaactttgctgtaagccagctgccagctaaccacacacataatttgatgatgtgaaggtggatggctgtaaatgttcctaagtggtgagaaatagacaacgacttttaataatttcatttcatttgccctacattacattgttcagccataaaatcatgaaaaccagtaagcaggttgttaggcagaagttatttctctccttttttccattttaactgcaggctgccttctctgtgtttgggagagagtaacttcaaaagacatcgtcctggtcttccaacagccacgttttgaaatmtaagccagtatcctgtaaaattcttacaatctagagtaaatacagacagtttggcccaaatacccatacttgaaatggaaactttaggtctattgtttgctctgaaatggattatattacattttaaaatgttttcttcaaaaattattttgatcaaagcactctttcacaccgaaaggtcttatttcactgaaactgcgaatggttaagaaggttaatttcctctcagtaatgcatcttctgtatttacatattttaagcatctgatgcctgctgaactctgcccccagatactggttaacgtttaaaacaatagcagatcctgttcctgctaaaaccttcacaacctaagagaaagtaaacacatgagaaaattttaactattatttccatgtcagaatgacaagaagaaacaaaaatgggaggagaaaataatatccttctgtcctgaagttactccacgacaccagggctttggctgtatgtgccaacattgccactattttttttatgatgattcattcctcccatttaatgctgtggagacaccccaaccacactggcttcagatgttggtatgtggaggaggccagcccggtgacctgagcaggcacgtggttgttactgagtttgtaagagtccaggtgaagttcaacagttgcaattttgcattttaaagacatttgtttagttacttaactctcattctttctcaggtgccctcgctaaaatttcacctctttcatcgccctgctcctcacckctccaagggactcctgccagcagcctggtcagcaaaatttctgcagtgcagtttccagaatctgctgacacaactgccaaacaaagcctaggttctcacagggccttaacttacactcagagtgccccagacctatcccctcaaatcctgactccacctgttatatgtagcaggtaaggattttttatgaactgaagtttaataataaaamygatgatagttttcccctagaaatacctaccaccagcccacgcagcttggggtaggtttgccaaagtattagacaaccaagtataggataatgtgatttgtgttgaataggctacaataaaaacttatgttttagtagttttctattaatgaagtttagaatccatgcagttcatacagccaatctttagagaggatacaaaactgttagctgtatatgttgcctgtttgctgatggggaatatagaaaatatataactaaaaaatgatatcaagtattctgttgtaattcttcattttgttggaatgtttgtacttgttctccagggaatgggttacattgatattaggcatatttaattgtcagtttgcatttcccatttttgcaattttaaaatgtgwgaataatacattgcacaggatggctggactcaaatagttctctgaatgaaatttaagcaattgtatgtgctattctatcatgttgaaacaaaattacaaagtgttatctatcacagagkttaagaaaaaaatggcctagcatggctggagtaattattttgccaatgttgtcacgaagaaataattatctcttcttactggttaatgtatttttattgttcttcagtaacagcttgaataatttatcttaaagcattatgrtattttttaagtagaaaaacagttgagtgtttttaactatgagagtaccttgaataaaacagtatttcatttctgaggttgatgaggataactatttgaataaatgagtaacttgttggttttctagtatcaaatattacctcatagactcagattttttcattgtattcagctttaagaaatagcaacttatattaagcctcataattttcattttcatattttttactcataagttctgtaaattaaatgaatgttatttataatttttatttttacctcctttatctttaccggcatttttacatgagaaattattttcattcgtttgcccagagccaaagttattctactatgcaaaagttattctgctgccctctatgagttttttaataaaataatttctgcaggatattaatctcatctcttttccacaaaagagcaagttctgtagtaaaatattcagaagatatatcatacatccctgttagaaattcacaacacacatggctttattaaaacctctgagaagctctgttaaaagaatccctctttatttatttttgttgtttcatttagtgttttctgaatttattcgaccacagaaccaatttctttgggttaacacccaagaattgcccatggatcgaatgtttggcagaacacaattaagaagcattgttttattgtatgcaccctgagccaagatgaagcccagtggagtaatcttcatcaaggacatctgggttcagcatttttagggagagtctcccactgtgggttccggacttttgggaaataagtcccctaaagaaaggagagagatgttcagaaaagctctaccactcacgcagcttttttcatcatagtgtattttttttttttttttttttgtattcttagcaggaagaatgtaatgggatttgtataaaaggtttcagagaaaaacaagaggatttcactgtctacttgttcagtaatgtttataaatccagtagtgtgtgttttatttgtttgggctttataaatctgtaattcaaaccaggttttattattgccttaaaggcagccacccatgtaggcacagagagctccagaaacacacaactaattgttgtggtttcccctgctgaacttgaagagtttggcgttgaatcccagtctcttggctgctgtaatgtctatgcaacaagctatttttctggcatgagagctggcatatttgaagtactaatttaaatggtccttttaggtattattttgcaatgaaaaagtttaaggctaataaactcgacttctcctgagcttcgtctgagaatgtaagcctaccaattgcatctcctttcttttccctttttgtcctatcattttctttttattctctaacccaaactgacagatttaataattagaaatattttacaggtaacgtttttctatttacactcaagggttgaaaagtaaarttacttagtatgcagatacggtctacctacctcttctcttagtgcacacacgagcacaattcaggaaaaaaaatgatgagttatttaagatattaaacaataagctatcactacttttttcattttagagtgggtagtctgtggttaaataacaaacaaaaaaatcccctgagaccctttgtaatatcagtcagaaggaaagaacccagcagcaaatgcagaatcaaaatctaatcatgaagtttctaaacaagacagaagagggaagagccagtttatggcctgtgccaggccatttgtggggttactgtttaatatttaaaacagtcaaacttcattcctccaacaccctctgttagagggcattgctcacctctcttacctttgtttttcttggtggtttacggtacttctagggcctgtttctctcaaccagcatcctatgtagtcagtcatcaaaatgcacccctcttttgttcatttccttagggccttaacaagtaactgatcgatctgaaaaaaagaagtcaatttttattttttagcaaaacataaaattcatatactatcattctatttcaacctatgctgtcttaaagttctgtttagacataaaaatatcataacccaattaaataaaataaatctaataatgaggcttttttttttttttttgagatggagtcttgctctgttacccaggctggagtgcagtggtgcaatctccactcactgcagcctccatctcccaggttcaagcgattctcctgcctcagcctccccaagtagctggtattacaggcatccaccaccctgcctggcaatttttgtatttttagtagagatgggatttcaccatgttggccaggctggtcttgaactcctgacctgaggtggtccacctgccttggcctcgcaaagtgctgggattacaggcgtgagcccataatgagcttttaagcagcctggcccataatgaggcttttaagcagacagaaaggtatttattggggaagataacttttgtctaaatataggtcaacacctgcaaaatggctactataagtaggtagcagcctataccagtattctctaaataatctaacaaaattttaccatcactttcacctcaaatatgatctagataaaggaggaggagaatgagagtcaaatgaactttctaatcctttgtattgattactctctcacaaaaaagaaagtagtacactgcatatcagcatttatgtatcaaacaaaatgcatattttcacaaaacaaataagcagaaggtagaaatatttgactattgttgtttatcttaatgtatacatagatggtatgtgcctatgactttttgaaaagaggaggctacacctatagctcttccaatattttttagctgtggcagaccatattcccaagggaatcctgctgatgagcccctggagagaagtggggtagccactcggacaccaagtagaacaggtaattcattgttttggattctgttgcccaaaatggaaattgccttatttttgttttcctgatcaaaacagtgayctacatttctgatattttgkggggcgctgggagayggggtctcatgatgttggycaggtcggtctcaaactcctggcctcaagtgatcctccygcctcagcctcttgaagtactaggattacaggcatgagccactgtgcccagcctgattttttaaattatagatttaaaaggacaagggagaaaattaaaatcatctgtactcctactctctagagttaatcattggtaaagtttgggtgcaaagctttccaaaattttttaatacatttatacatgtgtatatttttaaaacacaagaggccattttatataatatatagaactatatagaaatattattttatcttgctacttctgacattggaagtactttaagtggttcccaaaacatagcaaatactcaataaacttccttcagkcaccttagtcagctatgagaaatgtcacagttgctcagagaggatagacttcagactctgggtgtttactgattggtcttttagttagcacagtttactgctgactgaaatggcgacagtgaagaaggacagatgaggaaggaagccacaggattccaagaaataggattggatacataggattgcccatgctcccaagcatatgccatcactctgtgctacacagagaactttattcctgggtgtgtcaactcagtttctcccacctcacgtgcccgttctagagtgttttagtcactcagtggtttaatgtatagggagagaaatagagaaaaaagaaacataaagctgtaggatttgttaaaggtatgaactgttgatctaaaaaatattattgaggggttattgaatgtcatgcggattacagattataatttccatctgttttactttgttaagagatgtgtgatgttctccaccctatgatcctatgttcttggagtgctcaggaaagcagtatttccctaaacactatatttaccatatgcatcttagcaaaatttgcttaaatgagcccyctttccccattgtagatcttgtaataagttgttctcttttaattgtagatgacactgctcaagttacctctgattatgaaaccaataacaacagtgacagcagtgacattgtacagaatgaagatgaaacagagtgcctgagagagcctctgaggaaagcatcggcttgcagcacctatgctcctgagaccatgatgtttctggtagtcccatatcacttaactcactcatttacttgagagatgagcttctgttacagatattggctcagaaatgaatctttgaggccaggcaaggtggctcacacctgtaatcccaacattttgggaggacgaagcgggcagatcacgaggtcaggagttcgagaccagcctgaccaatatggtgaaacccctatctgtaataaaaatacaaaaaaattacccaggcatagccaggtgcagtggctcacgcctgtaatcccagcactttgggaggccaaggcgggagtatcacgaggtcagcaatgagttcaagaccagcctgaccaacatggtgaaaccccgtctctactaaaaataccaaaattaccaaaattagccgggcgtggtggcacgcacctgtattcccagctacgcaggaggctgaggcagtagaatcgcttgaacccaggaggtggagtttgcagtgagccaagatcgtgccattgcactccagcctgcgcaatagagggagactctgtctcaaaaaaaaaaaaaaaaagaaattacccaggcatggtggcaggtgcctgtaatcccagctacctgggaggctgagggaggagaatcacttgaacccaggaggcggaggttgcagtgagctgagatcatgccactgcacaccagcctgggcaacagagtgccactctatctcaaaaaaaaaaaaaaaaaaagaaattaatctctgaaacatgagatttacagatgtatttcatccggattaaacatgtattacagcccttcccatacatatcaatatattttttctctttccaagcattattggtctcttaatggttctattatctggtgattagaagcataagtatttatagttatacaataattgcagatatttattaacccaatcaaaaagtaaatataggaaaatgtattatttcattccttaaaacaatattttataaagaaagaaaagaaagatgaaggaagggagggaagaagatattcattgtcttagggcatctgctggttttctctagtatctccttgacttagaacatgaaccaatatttrtttttcttgtcatattktcaggcatatattggcactagccacctattaaaatattctttaatgattacttactttgtgtatttaaaaagatccatttaaggaggatggaagcatatatttgagtcagcttcattttggggaggtggcaagtggtagaaaactgttgactctcaagtgatcatcaatggctgctattatcatttttcttttactgtatttactgtttgtatttctaagtcagagagatcgtcaggtaaaataatgtatatgtttccctatcctcattctctttcttcttttttggcaaatgtactcttaagaacatcctcgtttgggaccaattataaaaaacctttacttttacgtagtacatgtttctcaagaaacagtaggtcacatgaaataaattaaaatccctaaaaaatatggcaattgttattctataggattaatgtccattttaaagcattaatataaacttrattaataatagtaggaatgatcaggtcctactactcatggatttcttttgagagcttaatttaaggagggaaccctyatctcagaaaaatttacatgactatgtagagatataaatttacatgtaatttcagaatattctgaagtctttaaaactttatttaagaaccttgcagtagtcccaaagtagttatactaacttatagaagaaacatccgtgtttttgctggagtgtatatggaccagtgataggcaagcacctaatagtgcaaaatttatatctgaaatggcatttgttcctttccttcttactttggcgtcaatgtctcgttcatgttgacttttttaagcaaagatcacttattcaccttggagttttaagtcatttatttccgatagccacagttgttattgaatttagcaaagcacaaattgccctgtagaaaaactgcatgctgtttaagtattttaatgttaaacattacaggacaaaccaattcttgctcccgaacctcttgtcatggataacctggactcaattatggagcagctaaatacttggaattttccaatttttgatttagtggaaaatataggaagaaaatgtggccgtattcttagtcaggtaagaaatgcattcattcacactaattkaaatataggaaaaacagttcctttgttgcttaaagctctgtaaattcttgacacttgtggataggtgttatgtggagaaaggaagttttagaacacaacattctgtagattccttgctgtgtgttaacaaaagaaactggaacttcaagtgagtcgartgtcatattctacaattaaaatatgatatatttttaaagacaaagtaggtggggatagagatatatagacaagggacaaacgatctagaattcatagaattaagcaaaagaaaatctgacacaagcctctaaaagaagaaaactgcctatttagagatactaatttattgtctgtaattatttttgatgactttttaaaaacttttgaatattacagagcttaggccttatcaaagataatacattgtgccaaaatgtgtttcctcctagtgttatgaaaaacacatcacatagagttatagaataatactgttgctgcataaccagcctttgagtattgttttctttaggctagactactctcaaggcttttcacataaataattacttgttttgctgaagaagaaagaaaacatgtagaaattaagaatttgaaaatgtttgttttaaaccataaaacaaaatgatggatttgctgtactatggaatagctatcgaaatacacacccttaattaaataaagaggatggtgygataatatgtatcagcttatcttcacatgttttaggtgtattcttataaatttgaataagtatcacagcagagatagtaaagaccatcaaacttgtgaatataagacttaggtaagaattcaagacccaacccagatctactggggccactaacacttctctgcaaaacaatagaagagaaatcactgaaatgctgatttctatgcagtgcatcagagatgagctttctttggaccactcaacacatgtctcaatgtggaacttcgtttggggtgagaatcctaatctgtgaagattgaagggaaaagatagcaggcctttcttctagtgtttgattctacaagcacatatggctgtctagtctaggggtacactaacattattgatggaatataagacacaaaattcttacaaagtctgtaaaatattcaattattgcctctgctagactctattctgtccatcaccatgttgaggaatataatggcagcccttgcactttgctaggagttgagagtcctgttcctcttcccttcctttcttcttggtgctaagcaatgtctcttacactagctgatcttcaggacagatttaagggtagctgttcagtccaattcaccttagcctcatactttagggatccccctgggagattgtgtattttctttctgaaacccatggaaaactgcaactttgagggagtgatctttcctgcaaataagcctgtaacggtgccacaggatgtggcaatgagtcaggaagcattttctctcttgwttttatttttttgctagggagtgtgttccctggtatagagagacacatctcatctcattttatatttgatgtatatctcacagactctcgaaaacttaatcttcatagtaactttagtgcaggttttttttttaaatatgtatyttatagaagaagaaactaaggcttaaaagaggctatgctactcttctaaagtcatatagtaaatattcaacccaggattccaaagcagatttatccatatcagaagcctagggcttttacattcattcaattgcttctcatatcttcataaaacaccttgacttattatgtcttcaagttctccaaatgaggattcatacctagtagaaaagtggttatgatagcagtcagttttacagcacaaatgacagcatacagaatttcattacaggtaccaaccactcccttgaagttctgtgagctgggaatgggagaaaacaatttgaccaaaattgctacaaaatattttctaagagtcatggataccagtagacaataaaaagattaaggataattaacaattagatccatgcaaaattcaataatgtatcttttgttccaatcatgttccaaaaacagagtaatatattgatatatgatccttattagtcactgtttatgttcctaatttcccagacattaaactttgaacaaatgtagtttcatatgacttgctaagtagaactttttgggatttttccttttatttgagtttataagaacaaaaatcatgarattttcattatggaaaatatgtatatatttttgccatagtgagactttaggacagctgaaatgaattaatgtgaacattccaataaatcaccttttggctgagactaaatggaaaaagtctcatttcaaaagatttttaaggagacatgtgcaatggaaataagttctcagtttcaatatacagcctgccttttgatgactatcattttaaccaacttaaaaggacacccttcagattttgaaaaggcatttaatgttttccgttaccgatatttacctagtttcaccactgttctctttatgtctgacatacacatagggatgtttcataagkctttgtcttcttttacaggtatcttacagactttttgaagacatgggcctctttgaagcttttaaaattccaattagggaatttatgaattattttcatgctttggagattggatatagggatattccttgtaagtatatgtgatttgtgaaataatacttttaaaatatgtcgaatttgctgtgggtaaatgggatagtgaatcattagcaggtagcacagaattacacatggtagacgctcaatatggagacatcatatggtgattaggaaatatcgcctgtgtgttagaatcctggcccctttacttttcagctgtgtgagaccctagggtttacttaagctctacatgcctcatttcttagttcataaaatgagaattatagtacctgattcatatgattgttaggatcaaataagattataattttaaagaggttattttagtgcctagcacacagtaagtctgacataagtccactttaatatggctattttttggaaataaataaatactaaatttattgcccatttaataacccatcccttttattgggtaaattcaacttttgttgtggcatctgaagagttaagtcactatatatgttttctccacgtaagataaagttggctggcgtttagagggacaggaggatgatggtctgatgaataaaatagaaaagacatatggaagtggttatggaaaaatgataagaaacacttaaaaaatcaggtaaatggaaagacccaaggaaaacacacaatcaagtattcaagctttgagtcttgtgggaataagtttcccatttataacaacaagaaatcggaacacagaggagatgttaaattttcattatgtagcatttcaggaatcatcgattataacacataagtaaaatggtcctatagtgctacgaaatatatggtttgggagacagtgtctataggtcgaaacagggaaattgtggagatgttcaaaaatcatgtaacacatgaaggaaataaatatatagaaagaaaaataatcaaacataatatattgatcggaacatgtcttggaaatatgttatttaaatcatattttagcttttaagcttttaaaagttttaaaagcttttatatttgcttatgcacctcagacttcagagtcccataactttttcktaattgtaaagagctgaaattacattaaaaaataattaatactaataaaacacaagtatttccaggaaggggtatcacatcaacttagggatttattatgagcatatttattgttttcaaaatcccatccacctgctacattggaatgaatatacacagctgttagtgtrtcatagaaaaagagaatgaaaaactgaatctacaagtgagattttctgaagaatrtgggaccaaaatacagacagagtaaggcagttggagtacgkgaaagaggagctcaacagtaccagggcccctgggaacatctggctgacaaatccatggaagttggaagagaaacatgaaaaaaggggtagttggaaaggatctcaagataagccttgctttcttaatacagttttcccagggcccaccctggttggatgccagtgattgacctaagtgttcacgatttctcgaaggtcaaggagttatataaataaacttttatagaaaggaagacactaaaaacactaaggaacagctaatcactagactgaatttccaaattcatgttatattttcaaatgtattttaatgatgtaattagccatagcaaagttccactgagttcaaattgatactaaactccayagacataactaccaactttttcacaggtggtatatcattaaatcatagttgaaagatggcaaatgtttaagtacaaaaataagttttcagattctaagatttattattcacttttatattttcttattacatttttatatgttacaagtaatagatattttttacccctgaaatagtgggttctttattccaggtgaaaagaacttgttgtaataaacctgcttgttctattagaagtcccagatagtctccataaagggaatttatttacatcttctcataggaaagctctagcttcatttgtgatcacttttatctaataatatttcatatgtgctgagattgtaaattaatatgaatatttattaaaatcttcacttatcattagttataatcagcacatacaaaaatttgctgtatacctacttgttttaatatttattttggactatatttctaatggtcctatctaaataaatccttagttgaaaagaagcataagaggaaccaaagttaaaatggggttggtttaactttaatatgataatgtgtgcaaatattagaaactaaatttcttattatagttctaagtgtacctttaacggttttcaagaaaagagggtaagtaggaaakcttttaaatttgtaattagaatccttacaaaaattgaagaatctagatttaaacagagaattaaagtaatttcatggtagtagcaatagaaagacaagaaatatggtcaactcaataatataaatgtgataaaaatgtatttgttcaatcaaacttaggataaattaatgtatggtgaatacccaattgcataaggagataaataatgtttggtgtcattcatagtccctttcagttgggcattttacttaataaaaaatccattcatattcattcatcgatccagttatttttgaaggtagtttttattttcaaagagtttcctctctaaagcatattctccctaacacctctcattctgatttaagtttgagaagtggggagaatgcctcagaagtacctgtgatcatgtagctatttcatggcagcaatgagaatagtcctgctcaacctatatttagttcagttcaattcagctgtacatgatgtgcccactgattttaaagctagatattgaagtgacatggtacatgctagaggggcagaactaccagagtattaactatattccaaaagaaaaaaaaatatttaaagtgttacctctattctttattacttctkcttaccctatggtgcataggagcatagacaaaattttaaatacaaaatatataaatttggatcttaaaatctgtgaatttacatacaactccaaccctccataccagctcacttcaactctgtgcttgagggaaaaggagaaagttgagaaaacaagtgtatcaagacggaagagggagatgggcggactctgggaaagaggtagggtgtaccatgtgctagtgtatgcatgtgcgtctatatgttattaaagagggcgagggggttgccacatgagtgaaggtgtcatcgagaaggctaggggtttgtccaaaatgcagagatgaaggaagaagtatgatgagaataaggataaaataaggatagctctgatagcatttcttatccttctcagttgcctaccctggccagaagaagaagaggaatctttgagcatttttatgtattacatagaaacctgtcagtaacttacattgaccttgctagcttctttcctgggtgtctttgctcctgggttgggttaccagagaattaatgacaagaacaatggagatgccagcacttggcataatactgagtacatgctaagtgaatatttgattaataaacatgtcactgactgctaacaggacagatggttttctattcttcaatctaagtgattgatgacagtattattctcctacacatacacacatataactagatgtatatgtttagataagcagctggatttggttagtgatttttttttatttagtacttttaaacctgtactcgaaagcaaaaggaacatgtttaaatatacatactgtctttacctagtttttaaatcaagattgtaccagcctcataaaatgagtttggcagcttttcttcttgtattttcggcactagattatttacttaggattaattgcttgttgaaagtttgttttttgtttttttgtttttttaaaataaaacattacctataaagttttctgggcctgggccttggggtgggggacagggtggattagagctcaaaaggattagagctcaaaagctgcaagttcacctggaatagatgttatcaattccttaccccaaacaggctctgccaacactgtgatactgccccccatccacctccgtactgctatgctcatgcacaggtttctctgacttgcaacaataatagtaactactggcatatagtaatcttcccagcttgcaacaggagaagataatttaagaagctggcttccaacatatctcccaaaagtggaaccctactcccagactgccattttcctaccataacaggtcattactatcttctaccgatggaggcagaagatattttattttattcttacaaatccagcattgattctgggagaaagctggtgatctatactagttctgtcttgttctacagcagcaatttattttacatgaataatgtttacacaaattacaaattcaccgtgtatctggccctttaaaatatatttcctaatgtaattgtcacaattgtaccatgaatttggcaatattattcccgtatttttaagataaataagactttttactctgtcttatttttaagataaggaagtggattttaaggaactcacccaagttagcatggataatattatagcagaggtaaaagcacacctgtcccaaatccagaaaattctagtatgatcaatttcataaatagcccaagtacagacataaaatatgatcgtaattctcttgcctgtgaattatttgtaaatgtaatgggctcatatcactggagatgggctatactcagggatatagatgtcaatcttaataaaattgctctttcaagtaccatataatattattactcatatttacgattgacacaggtatacaagttttgctattttctcctcaggaggctaggatttgagcctcctcctcctcctccttcccctcctcctcctcctcctccccctcctccccctcttccccctcttcctcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgccagaaatttaacacctacccaggtgctacaattgccacattgaccataggtttcctctttcttctctgactagggaataggtgtttctctcatattctcattgtcattcttgttctctcctgtttctctcttctccttattttaagtattatgaagaaatgtaatctcttatactagagaaggaaacagtatcatggttggttagcagaaatacaatatataaagtataggtatttacaatatgtaaatacaatagaataaagcatactaatcagtgaagtattatgaggggtctgataaacaaaaaacttggaagaattgcacagaaaaggaaggtgagccaagagcacactgggcacgtggttatggtttgaaagaagttgaactgcacatgtggagtatgacccccttcccttgatgatggcattatgaccagatggcattatctggttaatggcatcatcaaccagatgatggcattatctggttttcctgtaggttttaactcttctaaatggcttagcttcctacattattatacaagaggcttttctttttctttttaagtatttcttagaactatattctgaaattagaatttctagatcagagaatataattgattgtggctttgaattttgcttgtggatgaaatctacatataaaagatatgttattgcagtgctttaagattgatacagaaaaatggtattatgttctattcccagattatttttgagtaccatctatcagagatgaaatattatgtctcatctagttgaagtatgtcatagctattacatttattctcattctctgcatagttttatgcaggagcatgaaaataagtaccagagtaaacattacacttttttcacacagtatgtttcctatatacatagtttgtagtcgactgttgacacagatttttccacttcagatacctgcatgcataataaatgttacaagtaaggtttttttcttgttacgatggatgttatggagttatggaagagtaatcaaataatatttgtcctagaaagtttggccaactttcatggaaatagtaaaatgttaggactaaactgtttgtccagtagatggcactcttagttcttggaccccaaagttcataaactgatgactgttcctgttcactggttacagatcataacagaatccatgccactgatgttttacatgctgtttggtatcttactacacagcctattccaggcctctcaactgtgattaatgatcatggttcaaccagtgattcaggtatgtacgaagtgaatctgcactgccttatgaaagatgggaacaagggtgtttttgtttttgttttttttcaaaaagaaagaagtcaagacaaataatgtcagtacttttttaaaaasttctttgactctcattttctcttctcagattctgacagtggatttacacatggacatatgggatatgtattctcaaaaacgtataatgtgacagatgataaatacggatgtctgtctgggaatatccctgccttggagttgatggcgctgtatgtggctgcagccatgcacgattatgatcatccaggaaggactaatgctttcctggttgcaactagtgctcctcaggtaaatctttagattttggttaggagaactaatttaaagatttctcaagaaagtgaagttcagtgtgatttataacaggcaccaagttaatataagccaaactatacatagtcttacgttgaaattctcagagaccgtgctaattctgaaaagaagccatggattcttccaagattctaatagcaggtatacaactttattatccatgggaatcatttctcagttttcttcttaggaagaaaacctacttgaattcatgttaatggacctctttaacaaacaaaaggcaacctatacaaaagcccctttctgaaaagattagagaaccaagcatttcttggacttttaagaatgtaaggtttctttgtatataaataccattcctttgaaatatattcaatataacaattatgattcttatgacattatctataggttggtaggattttaatatcaatttatttcattggaggattttttatttttttgcctaaacatagattccaaaaacagtgaataaatttaaagttcatcttggtgtatagttctaagtaaaaaattcatcactaagtatgtagacatacccatttatacaatcaaatttagcccctcatttatttaattagctgaacccaagttgctaaacattctgagatcctctgttcttctacaagatctagaggccaatttcattcaatattgacttttctgttttcttctttgcctcttctatcccattgctgttcatttccacagctcatcttataggctattctatagtttttcttgaatctatatacaataaaaattatctgataattttttcttgactatctaccttctttccacttgtctttcatacaccagaattattttttctaaatataggcaaaaatccactggccaggataatttaccattcagattattttacacgtctacatttttatatacctctatgttaatattctgtgcttagtgttttctttttgtcctatgtctttttatttctccataggctatacttgcacactagtgttcaggcattttgtaggcagcttcccttttaaaaaaaaatctctaataaannnnnnnnnnnnnnnnnnnnaattctctaataaaacttctctctgcattattagagaatttcagacaagtaaatgtcattttatgtctccgaatactagataaaaggtgatatttcctgtggagtggagtgagaatgttttaagtcatggacattttgggtattccattcatctttaatagctgtatgtgtttaagaggagataatgcttatgccagayagagaaagtaacctagttacctcttgaggtattgtggcattggtataattatatattatatttatatttacatatatatgtaaatataatttttttcttttttctttctccctcctcttttctatttgtatataatttttatgtttaaattcctgtaccctacaaagaaatctaaagaaaaaatcttttaaaaaatatctattaagataggcgagtgccccctcaaaagagtttggactaagttttcaaggaaaggaatttatcttacaaaaaggggaaatttaaccaagaaaaataatagagtcattgtacagtaataagtgattcttaataagcaggagttacgtgattacatttctttgttgtatgaataaaaagcaatttcaaaagcattgcatattctcatgatttttgtgattattttcttaaaaagttgaactcttaactgtcttatttgcctaggcggtgctatataacgatcgttcagttttggagaatcatcacgcagctgctgcatggaatcttttcatgtcccggccagagtataacttcttaattaaccttgaccatgtggaatttaagcatttccgtttccttgtcattgaagcaattttggccactgacctgaagaaacactttgacttcgtagccaaatttaatggcaaggtaaatagagctgtacccagttttcttttttttttcttttttttttttttttttgagacagagtcttgctctgtcgcccagactggagtgcagtggcacgatcttggctcactgcagcctctgcctcctgggttcaagtgattctcctgcctcaacgtcccgagtagctgggattacaggctcatgccaccacgcctgcctaatttttgtattttgtttttttagtagagatggggtttcaccatgttggccaggctgctctcaaactcctgacctcatgatccacccgcctcggcctcccaaagtgctgggattacaggtgtgaggcaccrtgcccggctgcatcagtcttcattttatagacacattgaaagatatcatggaagcaaactgttgaacaaaacatgttactatgaactcccatatttcaaatgtgaaaatggaatacaataaaatgtttaaccagaagcagacatataggtattgatctgaatctagatgcccaagaagctgagatgctgtctctatagattctactctgtgctacagaggaataacacattctgtcattgtggtttttgtttgatttaatttgttttcatctctayggtatatttgtataaattatctggcagcagtacagatcaaaaacttgaagcagaattttatacctcaaaagtaaatgcccaaatattaagttatgacaattttttatgaactgtaactatattattttaatagtaattgataataaggccaagcacaatggctcacgcctataatctcaacactttgggaggccgaggtgggtggatcacttgaggccaggagttcgagaccagtctggctaatatggcgaaacaccatccctactaaaaatacaaaaattggccaggtgtggtggcgcacccctgtagtcctacctacttgcgggggctgaggcaggaagattgcttgaacccaggaggtggaggttgcactgagccaagactggaccatgacactccagcctgagagagagggcaagactctgtctcaaaaaaagaaaagagaagtaattgattatatatgccaatttaaaaaagcatttgttgctaattcaataattaatgatttttaaaattttcatttttgtaggtacatggtaggtatatatatttatgggttacattaataaattcatataatgtataataatcacaacagagtaaatggggtatctgtcacctcaaacatttatccattgtgttacaaacaatccagttatactcttttagttattttaaaatgtataattcaattatttttgacacactcaccctgtcacccattattataattttatccataattcgtttactttttttgtgaactatttttaccattaatttacacagccaataacatttttaagtagctagaggttcccaattatttgrtattatgatccctatataatatgaagacaataaatgttctattgtttttctcttctcttcaacttttgtttttatcaaagcaaaacatatattaactttatctctcaaataggtaaatgatgatgttggaatagattggaccaatgaaaatgatcgtctactggtttgtcaaatgtgtataaagttggctgatatcaatggtccagctaaatgtaaagaactccatcttcagtggacagatggtattgtcaatgaattttatgaacaggtaactgaccactgyttaatacagcttaatctgtacttacaggttgctcatgaattgctcaaagcttctaacagctatgaaagtatgatcactctattttatattcatacttttgtcagaaaatgcactggtcaattttgatcaggagacaaaaagtgacgtataaaaattggactaaaatataatcatagaactctatgataaaagttatttgcaagcatttggggggaagaagatattgagatagtggaagtcagatgttaggaagatccttgaaatactgtttttttatagatttatttattatcatagaaggtagtttaaatgtatatggagtagcttgtatgtatatggtagtttaaatgtatatgcatatcacattaatttcacttactttcctwaaaaatttatttattatcatagaaggtagtttaaatgtacatggaatagtttatatgtatatgtatatggtagttcgaatgtatctgtatattagattaacttcacttttgtaaaaaaattaataagagcattatgtgaaaaagctaaamagaaatagacatttcatttgacatgataactaagagttaacagactactcagaaagctaccacaattacataagcygggggtgatcctcctgacattaccctacacccatcagaatgcacttgaaccttcctgtttggcactgtgaaccactcttaaaaagaatgtggaggtgaaggagcatgcataaaggacaggaataagtgacagaaaagcatgtggaaaaaaatgaaggtatttactcttggggaaatataactgtcttcagatatttaaaagagtgacatactaatttagaaatcggttaatcaacattgctgtggagattaaagaagataaattatataacatacttagcacaggatctgattcataaaaaaagttagatccctctctactgccctaaaaaaggtatgaatataccagtctatagaagttattgggaggtagtgttcaggtcaatgtcagaaagaaatttatattgctaaaggtatccaaaaaataggctgagacaccatattaatggtaataaattgactgtcattggacatgtttaaacaagagattagaatgaaattttatggttactataggtaggattcatatatagaatgaaagatttgttttttttattttattatactttaagttttagggtacatgtgcacaacgtgcaggtttgttacatatatatacatgtgccctgttggtgtgctgcgcccattaactcatcatttagnnnnnnnnnnnnnnnnnnnnnnnnnnnnnnnnnnnnnnnnnnnnnnnnnnnnnnnnnnnnnnntgtgtgatgttccccttcctctgtccatgtgttctcattgttcagttcccacctatgagtgagaacatgcggtgtttggttttttgtccttgcgatagtttgctgagaatgatggtttccagtttcatccatgtccctacaaaggacatgaactcatccttttttatggctgcatagtattccatggtgtatatgtgccacattttcttaatccagtctatcattsttggacatttgggttggttccaagtctttgctattgtgaatagtgcctcaataaacatacrtgtgcatgtgtctttatagcagcatgatttgtagtcctttgggtatatacccagtaatgggatggctgggtcaaatggtatttctagttctagatccctgaggaatagccacactgacttccacagttgttgaactagtttacagtcccaccaacagtgtaaaagtgttcctatttctccacatcctctccagcacctgttgtttcctgactttttaatgatygccattctaactggtgtgagatggtatctcgttgtggttttgatttgcatttcactgatggccagtgatgatgagcattttttcatgtgtcttttggctgcataaatgtcttcttttgagaagtgtctgttcatatccttcacccactttttgatggggttgtttgtttttttcttgtaaatttgtttgagttcattgtagattctggatattagccctttgtcagatgagtaggttgcaaaaattttctcctaaaaccataaaaaccctagaagaaaacctaggcaataccattcaggacataggcatgggcaaggacttcatgtctaaaacaccaaaagcaatggcaacaaaaaccaaaattgacaaatggggatctcatcaaactaaagagcttctgcacagcaaaagaaactaccatcagagtgaacaggcaaccyacagaatgggagaaagttttgtgtttttaaaacatcatgaaatcatgtattgcctttcctaagaatgggattaattcataaatctcgaaatatggaaatgcagaaaaatgtaaattaaagggaaaattcatgtataataataccacttcttaggcataattgttgctgatattttgggatatttcctttattaattttgctagataactgctggttaaaaatctcccttttttcctcagaaacatttgaagcacttcaaaataaaacatttgtacagtaatattattaaacatatagataaataagaatatcagaaaccacacaatcacaggagatatattaaaattcaaacaaaatctgggataaggtaaccccttgaattgagcaataaattctttaaagctttctggaagccaaagcaaaaaaaggaaaataggctacatttatatatttttaaaaaaattgttctcactattgcatttttttttttgagatggagtctcactctgtcaccctggaatgcagtggcacgatctcagctcaccgcaacctccgcctcctgggttcaagtgattctcctgcctcagcctcccaagtagctgggattacaggcacctgccactacacccagctaattttttgtatttttaatagagacggagtttcaccatgttggccaggctggtctcgatttgcccactttggcatcccaaagtgctgggattacaggcrtgagccaccacgcccagcctcaccattgcattttcgtgcatttatattctcatataaaagacactgacttgtgtgattaaaatatcatctacttatacattagaatttagactttctgtatttctccttgataaaaagcaaaaacctcaagttcagaaaagtactaattagcaacagtgtttctataggaaccttagcacttgaggtaggatcctttagctgtcaagtaaagaagtttgtgcattaatgcctggggttttacatatttacaaatttcagatgccaggtgaatgttgacttcacttgtattttatttctagggtgatgaagaggccagccttggattacccataagccccttcatggatcgttctgctcctcagctggccaaccttcaggaatccttcatctctcacattgtggggcctctgtgcaactcctatgattcagcaggactaatgcctggaaaatgggtggaagacagcgatgagtcaggagatactgatgacccagaagaagaggaggaagaagcaccagcaccaaatgaagaggaaacctgtgaaaataatgaatctccaagtaagttctaaaacctagttctaatgtgttttccctgggattgctttcttactttagatgaattttatgcttcttatgaaatacacaatacttcaagtctaaacatcatttgcggagtttgactacggatagctcccttccccaatatcataataatagaaatcccagactatggaatctataataataacacatatgatacaaagatatcttctccgtcatgaagtcatgaagttagaaaaaaataataataaggagttgaagcctattcttcagggtatctggttttttgtttgttttttgttttttgttttttgaggcagagtcttgctctgtcacccaggctggagtgcagtggcacgatctcggctcactgcaagctccgcctcccaggttcatgccattctcctgcctcagcctcctgagtagctgggactacaggtgcgcaacactacacccggctttttttttttttttttttttttttgtattttgagtagagatcgggtttcaccatgttagccaggatggtctcgatctcctgaccttgtgatctgcctgcctcgacctcccaaagtgctgggattacaggcgtgagccaccgcgcccagctgcttcaggttatgttagcgatttaaaagtgaaagaatttcagttaccataaagaccagtcataggtttttattggcttggttaggggaactccatgtgaatagataggaggtagtattcatttgttcattcaacagacatttattgagcatctgctctgtgccaggtatccttccaggtactagagatagagttgtggggaaaaaaagacaaaaaataaaataaaatccttgcccttatagaagtacattctagtgggatcagtagacaataagcaaaacaagtgagtatatctatagtatgttaaatacagtattatttactgtagtgataaatgctgagaaatatgagagtaaaaataaaaggagggagatatgaaatattatagagataggttaaaattttaggtaagatatccagggataggaaagatgtaaagcagggaaagatttgtaaaaagaaaaagaaaagacctgcaagaagcaagggagtgctccctggggctgtatgtggaaagaggattccaaagagaggagaaagcaacctgtgcaaaggtccggggatgtacattgggtggggtgttcagggagcagcaggagaactgggatagctggagcagcaagacagaggcagccgggaacgaactgtccaagggagagaatacagtcatgggttcttagttgctgtttctggttgggccagtaaagccccttcctcatcccactgttctgcttatcactagagacagaaactaaaaaccatggtttcaggtgctaaaagcctaaaacaaaacaaaacagaagaacagcaacaacaaataagtcagcctggacaagcttggaaggtgggactctgtaggtcacggtaagtgttgtggcttttactctgagtaagatgggaaatcgtcagtggttttgaacggaagagttagtagactcaacttacattttaactggactgcttcagctgctctattgagaatatgcttggggttgagaagggagcaaggatagacatagggcggtcagttaggagaccattgaaattatccaagtgagagatgcctgtgactttgaaccagggcagtagcaacagtgacagtgacaacctatcacatgtgataattggctggagtgcatcatgtggccaatctaacctatttagcttaattgactatgaaatcatttttatttatgcctctaaagctactctcctatttatcctgtcatgaaacaaatagtgactaatagcataattagtaaaaatccatgacccttgcaatgatattgcacaaatactgctcctaagaacatagtatgtgatttctgtctacctttacagataaagtacaatcttaatatcctcaaggttcttaccaaaaatacaaccagtgaaagacattctgatcatttcgtgcctatttttatcacagtcaggataatgcacaacttggttcattccaaccatcttgtaaggagattaaccttctactgatccattttgctctcatataagcaccttgttgtaggcacacataagcaaacataaagaagtccttatcaattatgaacttatgaagtaaaattttgcaaattgagttttagatcagatctggcctgttaattactttttgtagaatgggggaaaattaaagttgtttttcttcaatatgctactgtcaaagtaattatatttcatttatctgatgcaaataaaaagacttccattagaaaatttgtactaatcttgagattcagagctagaagccaagacttggaattcatgggttattcattcatttttttcacttaataaacatgtattagttttctctttttgtttgttttcatttcaaagagccaggtagtttgctgtcttactaagaataagacagtttttccactgaatgaaggtattgtcagcttagcctctggaaaagctttgttcccaggggccctgacttactgctctttgaactcaaacacatggaaaatacagacgcacagatccaggcattgggaattgaaggacccaggccaggagacttaacaggctcaacttgtcaacctagcctttagcagcaaatgctacaaccacatattccatttctttctgttctgtagggttgggttgtcataccttccmgtttttatcaagttcactaaagcaggaatgagagactttttgggttctgtttgctcatgccttccaaaagttaactgaccacattatattacaatttaaaaatatcccatccacaatgatttgatactgtagctttggaaatattatctttaaagtatttctttacaaccaagaaaatgataaatatggagcaacattagtatttaccaaatattggccacatagagtaacagaattttagaaatgaagggggaatcaatgcttatcagttagctgcctcactttacatatattaaactaaggctcagaaatttaaatgacattgcaaggttgtagaaccagaaagggaacctaggtctcttaatttttaacttcaatgcttttggctctyagtaatgttaatatcagaattcatactggctaaaatggttaccttgactttgcctaatacttaggtttcagaaaaaaataaatatgcacagataacktctgtagtttgtaaaacttggagatgtcccaggaaacagaataaaatgtttcaatatggtatcctaggaaaagaaggtttttatcccaccttataattaaatctgaaagattcctacagtgaactaagaggttyctaatgaagtactaagctgcatttagaattggagcaatgaaaggctctttgttctcctttcaaaaggttccagtacagaacaatttggctcccaatacaggcatgttttagaccacctgcaggctctaatctacgcaaatttatttggtacaaactttcttctacgtcaccttcttattcagtataattccagagaggtttattgctaacatttaacagtattaataagagaacagttgctctcatggggactgccctggaaggaaaaaagaggaaaattgagcttttgttagcttcttccctatgaatgcactgccatcaatgtgtataactttaagatgaaataatcaccttaaactgaagagtgtttgctacaactgtgattcaaacctgtccttcagacaggggtcctctgtaactctcttgattcaaaggattagcttaaaaagtatattaacatttaaacatttctcaacagaatttgatttataacaaaaacgaagtagaaatagacaagtagagatagaagagtaatttttaatttgctttaaaaaatctgatgtattaatgtattttattgactttcatagaaagaattcaaatttakttaaatttcaattgtatctactgcccttgttaggaggctttcaaatggaagaattgatataaggggtcttggcctgtgccccatacacttttgcctatgtcccagttcttcaaactttgcttggaatactgctagctccttttcacccagtgttatttaattctcattacttacatccagcccaggtaccaggtcctttaaaaaaaaaattctacctaattttccacagtttgtgtcatttgtgttgccatggtttgatgtatcaaagagaaattgcaccagacatttgttaaaaatggcaacgaaggcgttattcaagactactgtaataggggagacagattgaactctgttgaagcaaaaggtgggagaattgttcaatgctgctgtgagctagtgaaaaagtgctggaggatgttatgtgagcattggttagtatgattaagccacctgttaattggtacttactaaagttaggctcctacctcccaacagagactaggagataggcctgcctgctggcctacctttcttctttccttccatccttccttccttcatttaaatcttttttaaattttaaaatttaaattttattttgtaagactgcaaagctaattagaggctgggagaagatttatctatattccagaggggcagagaaagaatttgctattacaggttttctaaagtaaatgttctaacaagagggaggtcaggggcctatagtctagaagtctaaaatagtgtcaaactgagagaaatggcaagcccatcttggtcacaagaatatgtctgtcataaaacatagcacatgtatttcagtttttgtcttcttggcactctctcttacagagagactgtaaactcctttaaggcaagatctgagcttaattgatctgtgtttccaaagtatcctggaaagtatttgccagttagtttgagtccatctcatgaagaaattatgaatatcataatttttttttccttttgactctgcctgtgttcatttccctcagcactcattcaatttaataattgtcattctgtgtctrtatggttcaaaattaattcaagataatttaatgtcctttttattcactrtgttttaaaaattaattttattctgtacagtacaagaaatttctgcagtatatcaaaataaaactgttaaaagaatgactagcccttccacaaagatgttggcagatgacctccaagtttctttgtcacccccatagaaattggctttttttctttcattattgtgctattattaagacttttcttttttttcttgctcccagagtaagtcatatctacttcattaaatagacccaaatatcccttttgatcttcctgctaacttgtactgttttttttaattgtttatttacttttgtagagacagcagtctcactttatttatttctgtagaaacaggacctcactatgtttcccaggctggtttggaacccctgacgtcaagtgatcctcttgcttcagcctcccaagtagctaagattacaggcagcatgagccaccatagccagcatgaactattaactctttaatgcagtctcaattagatcagcatctcctgtagaccactttttcgtattagttttatttttaccacttatcaatacttcatcatttacctggaaatgtggaacaaaaactagagagaaaattattcatttagtaaacttttactgaatgctttagtaaagtctaggtcttcacagatattacatatacacaaaagtaaagagaaaagtccatataccaggtgatatggtttggctgtgttcccacccaaccctcatcttgaattgtagttcccataatccccatgtgtygtgggagggacctggtgggaggtaatcgaatcataaggggagttacccccatgctactgttctcatgacagtgagtgacttgtcacaagatttgctggttttataagaggcttttccccctttccttggcacttctctctttgtatgaccatgtgaagaaggatgtttgcttccccttccaccatgattataatttcctgaggcctccatagccctgtcagtcaattaaatctcttttctttgtaaattactcagtcttgggagttctttatagcagtgtgaaaatggactaatacagtaagttggtaccagaagtggggtgctgatataaagatacccaaaawtgtggaagcaactttggaacacagtaacaggcagagattggaacagtttggagggctcagaagaagacaggaaaatgacagaaagtttggaacttcctggagattggagggtcatatggtttggctgtgtctccacccaaatctaatcttaaattcccatgtgttgtggagggacccggtgggagataattgtatcatcrtggcaagtcttttctatgctgttctcgtgatagtgaataagtctcacaagatctaatggttttaaaaagaggagttcctttgcacaagttctctttttggctgctgccatccatgtaagatgtgagttgcttctccttgccttcctgtatgattgtgaggcttcctgagcaacatggaactgtgagtgagtgctcaattaaacctcyttcctttgtaaattgcccagtctcaggtatgtctttgtcagctgcatggaaatggacgaatacagtaaattggtmctggtagagttgggtgctgctgaaaagacaaccaagaatgtggaaacgactttggaactgggtaacaggaagaggttggaacagtttggagggctcagaagaaaaaagaaaatgtgagaaagttagtttggaattttctagagacttgttgaatggctttgacaaaaaatgctgatagtgatatgaacaatgaagtccaggctgaggtggtctcagatggagatgaggaacttgtcgagaactggagcaaatgtgactcttgttctgttttagcaaagagactggcagcattatccccctgccctagagatttgtggaactttgaacttcagagagatgatttacggtatctggtgggagaaatttctaagcagcaaagcattcaaaggcaacttgggtgctcttaaaggcattccattttataagggaagcagaacataaaaattcagaaaatttgcagtctggcaatgcaatagaaaagaaaatcccattttgtgaggataaatccaagcgagctgcagaaatttgcataagtaatgaggagccaactgttaatccccaagacaatggggaaaatgtctccagtatatgtcagaggtcttcatggcagcccctcccatcacaggcctaggggcctaggaggaaaaagtggtttaatgggctggrttcagggtccctgagcagtgtgcagcctagggacttggttccctgcatcccaaccactccagttgtcactgaaagaggccaaggtacagcttgggctgttgcttgagagggtggacgcctcaagccttggcaccttccatgtggtgttgagcctgtgagtaaacagaagtaaagaactgaggtttgggaacctctgcctatatttcagagggtgtacggaaatgcttggatgatcaggcagaagtttgctgcaggggtggggcagtcatgcagaacctctgctagggcagtgtggaagggaaatgtagggtcagagctaccacacagagttactactggggcagtgcctaatggaactgtgagaagagagccactgtcctccagaccccagaatggtagatccaccaacagctggcaccrtgtgcctggaaaagccacagacactcaatgccagcccatgaaagcatccatgagggaggctgtaccctgtaaagccacaggggcagagctgcccaacactataggatgcccctctttgccttccaccatgcttgtcaggtctctccagccatgtgaaactgtaagtccaataaacttctttcttttgtaaattgcccggtcttgggtatgtctttatcagtagcatgaaaacggactaatatggaggactcagaagacaggaaaatataggaaagtttggaacttctagagacttgttgaatggcactgaccaaaatgctgatagtgatatggacaataaactccaggctgaggtggtctcagatraagatgaggaacttgttgagaactggagtaaaagtcactcttgttttgcttaccctgcagagccacaggggcaaagctgcccaagaacacctcctgcatcattttgacctggatgtgagacatggagtcaaaggagatcagttttgaactttaaggtttaatgactgccctattgaattttagacttgcatggggcctgtagcgcctttgtttcagcaaggaaactggtggcattttgcyctagccmtagagatctgtgaaactttgaacttgagggagatgatttagggtatctggccgaagaaatctctaagcagcaaagcactcaagaggtgactttggtgctattaaaatctctcagttttatgtattcagaaagacatggtttggaattggaacttatctttaagagggaagctgagcataaaaattcagaaaatttgcaacctgaggatgtgatagaaaagaaaaacccattttttgaggagaaactcaagtgggctgcagaaaatttgcataagtaacaaggagccaaatgttaatcaccaagacaatggagaaaatgtctccagggcatgtcagagaccttagtggcagtccctcctatcatagacccagakgcctaggcagaaaaaacgatttcacaggccaggccccagwccctctgctgtgtgcagcctagggacttggtgccgtgagtcccagctgtttcagccatggcagaaaggggccaatgtacagctcaggttgtggcttcagagggtgcaagcccgaagccttggcaacttccatatcatgttaggtctgtggtgtgcagaagacagaaattgaggtctgggaacctccacctagattaaagaggatgtatggcaatgcctggatgtcctggcagaagtttgctacaggggtggagccctcatggagaacctctgctagggcagtatggaagggaaatgtggggttggcgccaccacacagagttcctactggtgcactgcacagtggagctgtaagaagagggccattgtcctccagaccccggaatggtagatccaccaacagcttgcactgtrcacctggaaaagccacaggcagtcaatgccagcctgtgaaagcagctggaggggaggtgctgtaccctgcaaagccacaggggcaaagctgcccaaggctgtgggagcacacctcttgcatcattttgacctggatatgagacatggagtcaaaggagatcattttttaactttaaggtataacaactgcccttttgaattttagacttgcatgggacgtgtagcccctttgttttggcagatttctcccatttggaatgattgtatttacccagtgcctgtaccatcattgtatctgggaagtaactaacttgcttttgattttgcaggtttataggcagaaaggacttgccttgtctcagatgagaccttggacttggacttttgggttaatgctggaatgagttaagacattgggggacttttggaaaggcaagattgtgttttgaaatgtgaggatattagttttgggagaggtgaggggcagaataatatgatttggctatgtcaccacccaaatctcatcttgaattgtagtttacataatctccatgtgttgcgggagggacccagtgggaggtaattgaatcatgggggtggttattgtcatgctgctgttcttgttataatgagttcttatgagatctaatggttttgtaagggacttttccccctttgcttggcacttctstcttcctgccaccatgtgaattaaggacatgtttgcttccccttccaccatgattatgtttcctgaggcctccccagccctgtggaactgtgagtcaattaaacctctttcctttataaattacccagtcttgagcagttttttatagcagcatgagaatggactaatacaccagggaaattcacaatctaatgggaggatcttagctgaacttctgaactcttggctcaagtctaaaatcgtcacttagatgagggtactgagagttaaatgatattctggttgcttggaaaagaacagacctctcttctaagctgtctaccagctgcctactttacctctctactcagaggtcttccagacacttcatgttcagaatacctctattcattttctgctgatatggttttgctgtgtccccacccaaatctcattttgaattgtagctccaataaytctcatgtgttgtggaaaggacccaatgggagacacttgaatcatgagggcagtttcccccatattgttctcctggtactgaataagtcatggatctgatgattttataaggggtttcctcttttgcttgactctctcattctctttttgcctgacaccatgtaagacatgccttttgccttctgccatgtttgtgagacctccccagccatgtggaactcttgagtccattaaacctcttttttctttgtaaattatccagtctcaggtatgtctttatcagcagtgtgaaattgactaacacaccctcaaatatactcctcatccaaccttccctttctcagtacatcttaccaacatactcaactgctcaggccagaaaacagggttgtctctgattcctccctcttaattccctacctctaatcagttgccaagtcctgttgattctcccatacaaatatatctcatatttattgacttttcttcattttcattacccctgtcctaatccagtcaccacctccatacaatattgtaccaactgggccatctccctccctttctgctgactttcaaagactccataagactcagtataaatgtacctgcttgttcactattttcctactagagtaaaagcctgctgctggcaagcatcatatttatcttgtctgtcagagggtcactagaactgaggacaacattttggtacatatcgggtgattcataaatagataaggaatttagaaacctcaatagtgaatgctgacattaaatagtcttctttgaaatatatttttttctgtttaaattgggtttattatttttcctcaattaaaggatgtaattctgtgaaaatttttcttaatatttgcatgttgaaaactttgaatcatttggtcaaagaaaatgtaatgtatttcttttttaaatgcatacgtgctgatgtataagatctgtacaggtttgtccaaggctccctcacagaccctatagtctagaagagaaactatttggaatatatgaaaataagatttgagtttattttttttaagtagggtactcatttattcagattaatagacagaagcaaataattttccaaagtagatgtaaaaaatgtacattcctataagcaatatattagttctaattgttaaattcttcgtctacacttgattttttatagtcattttcattttagctattccaagtaggcatagagtgctcttatgttatagttttcatttgcatttccctgtcttatgtaatatgcaactttttgtatttttaatcaatatatatttgtacatatttatgtggggcacatgatattttgctacattcatcaaatgtgtaatgattaaatcaggatatttagartatctgtcacctcgagtatttgtcatttctttttttttttttttttttttgagaccgagtctcagtctgtcacccagtctggagggcagtggcacattctcagctcactgcaagctcactccgtctcctgggttgaagtgattctcctgcctcagccccccaagtagctaggacaggcatatgccaccatgcccggctaatttttgtatttttagtagagatggggtttcaccatgttggccaggctggtcttaaactcctgacctcaagtggtccatccgcctcrgcctcccaaagtgctgggattacaggcatgagccactgcacccggccatatttatcatttctatgtgttgggaagtcccctcttcccactattttaaagtatgcaatacattatttttaacaataatcaccttactctgctatcgaagaacttatttattctaactagtatgtttgtgctcattaatcaatatctcttcattcctcctaacccccaaccatacacccttctcagcttctgatgtctgtcattctaccctcacttccatgagatcaacttttctagctcccacataagagtgagagcatgagatatttgtctttatttgctagacttatttcatttaacataatgatctccagttccattaatgatgctgcaaatgtcataattttattctttttatgtctgaatattattccattgtgtatgtataccacattttctttatccattcatcagttgatggacacttaggttgattccatatctttgctattgtgaagactgctgcaataaatatgggggtgcaattatctttttaatatactaatttcttttcctttgataartacccagtagtgggattgctagatcatatggtagttctcttttgagattttgagaaatctgcatactgttttccatagtggctataccaacttatatacctacaaacagtgttatgagttcccttttctccacatccttgccagcatctgttgtttttctgtttttagtaatagccattctaactggggtaagatgatatctcattgtggctttgatttgcatattcctggtgattagtgatattgagcattttttcatatacctgttggccatttgtatgttttcttttcagaaatgtctattcatgtccttgcccactttttaatagaatttttttgtttttgttttttaactgttgcttgattttcttgtatattctggatattagttccttgttgtatgaacaatttgcatatattttcttccattctatagattttctcttcactatgttgattcatttgctatacagaaggttttcgtttttagtttagtcccatttgtctgtatttgtttttgttgcctgggtttttgaggtcttaatcataataatctttgcttaggtcaatgtcctatagaacttcccttatgttgtcttctaacagttttatagtttttggtcttacttaagtctttaatctatcttgagttgatttttgtatatagtgagaaatggagtctagtttcattcttctgcatgtgaatatccaattttcccagcaccacttattaaaaaagatgtcctttcttcaatatatgttcttggcacctttgtcataaatcagttggctataaatacatgcatttatttctggagtctatgttttattggtctatatgtccatttatatactaacaccatgctgttttgtttactatacccttgaagcatattttgaagtcaggtagtgtggtgcctccatctttgttcttttcgttcaggattgctttggctactcaagctcttttttggttccatagagattttggaattgtttttcctgtttttctgaataatgtattggtattttaaaaataaagattgcgggggaggagccaagatggccgaayaggaacagctccggtctacagctcccagcrtggtggatgcagaagatggtgatttctgcatttccatctgaggtaccgggttcatctctctagggagtgcgagacagtgggcgcaggtcagtgggtgcgcgcaccgtgcgcgagccaaagcagggcgaggcattgcctcacttgggaaacgcaaggggtcaggkagttccctttcccagtcaaagaaaggggtgacagatggcacctggaaaatcaggtcactcccacctgaatactgcgcttttccgacgggcttaaaaaacggcgcaccatgagattatatcccgcacctggcttggagggtcctacgcccacagagtctcgctgattgctagcacagcagtctgagatcaaactgcaaggcggcagtgaggctgggggaggggcgcccgccattgcccaggcttgattaggtaaacaaagcagccaggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcatgcagctggagatctgagaacaggcagactgcctcctcaagtgggtccctgacccctgacccctgagcagcctaactgggaggcaccccccagtagaggaacactgacacctcacatggcagggtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcrccaatcctcctccaaaggaacgcagttcctcaccagcaacggaacaaagctagatggagaatgactttgacgagctgagagaagaaggcttcagacgatcaaattactccgagctacgggaggacattcaaaccaaaggcaaagaagttgaaaactttgaaaaaaatttagamgaatgtataactagaataaccaatacagagaagtgcttaaaggagctgatggagctgaaaaccaaggctcgagaactacgtgaagaatgcagaagcctcaggagccgatgtgatcaactggaagaaacggtatcagcgatggaagatgaaatgaatgaaatgaagcgagaagggaagtgtagagaaaaaagaataaaaagaaacgagcaaagcctccaagaaatatgggactatgtgaaaagaccaaatctacgtctgattggtgtacctgaaagtgatggggagaatggaaccaagttggaaaacatgctgcaggatattatccaggagaacttccccaatctagcaaggcaggccaacgttcagattcaggaaatacagagaacaccacaaagatactcctcaagaagagcaactccaagacacataattgtcagattcaccaaagttgaaatgaaggaaaaaatgttaagggcagccagagagaaaggtcgggttaccctcaaagggaagcccatcagactaacagcagatctctcggcagaaaccctacaagccagaagagagtgggggccaatattcaacattcttaaagaaaagaatttccaacccagaatttcatatccagccaaactaagcttcataagcgaaggagaaataaaatactttacagacaagcaaatgctgagagattttgtcaccaccaggcctgccctaaaagagctcctgaaggaagcactaaacrtggaaaggaacaaccagtaccagctgctgcaaaatcatgccaagatgtaaagaccatcgagactaggaagaaactacataaactaacgagcaaaataaccagctaacatcataatgacaggatcaaattcacacataacaatattaactttaaatgtaaatggactaaatgctccaattaaaagacacagactggcaaattggataaagagtcaagaccaatcagtgtgctgtattmaggaaacccatctcacgtgcagacacacataggctcaaaataaaaggatggaggmagatctaccaagcaaatggaaaacaaaaaaaggcagggattgcaatcctagtctctgataaaacagactttaaaccaacaaagatcaaaagagacaaagaaggccattacataatggtaaagggatcaattcaacaagaagagctaactatcctaaatatatatgcacccaataaaggagcaccaagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaatagaatatacatttttttcagcaccacaccacacctattccaaaattgaccacataattggaagtaaagctctcctcagcaaatgtaaaaggacagaaattataacaaactatctctcagaccacagtgcaatccagctagaactcaggattaagaatctcactcaaaactgctcaactgcatggaaactgaacaacctgctcctgaatgactactgggtacataacgaaatgaaggcagaaataaagatgttctttgaaaccaaggagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaagatcagagcagaactgaaggaaatagagacacaaaaaacccttcaaaaaattaatgaatccaggagctggttttttgaaaggatcaacaaaattgatagaccactagcaagactaataaagaaaaaaagagagaagaatcaaatagacgcaataaaaaatgataaaggggatatcaccaccgatcccacagaaatacgaactaccatcagagaatactacaaacacctctacgcaaataaactagaaaatctagaagaaatggataaattcctcgacacatacactctcccaagactaaaccaggaagaagttgaatctctgaatagaccaataacaggatctgaaattgtggcaataatcaatagtttaccaacaaaaaagagtccaggaccagatggattcacagctgaattctaccagaggtacaaggaggaactggtaccattccttctgaaactattccaatcaatagaaaaagagggaatcctccctaactcattttatgaggctagcatcatcctgataccgaagccaggcagagacacaacaaaaaaagataattttagaccaatatccttgatgaacattgatgcaaaaatcctcaataaaatactggcaaactgaatccagcagcacatcaaaaagcttatccacaatgatcaagtgggcttcatccctgggatgcaaggctggttcaatatacgcaaatcaataaatgtaatccagcatataaacagagccaaagacaaaaaccaaatgattatctcaatagatgcagaaaaagcctttgacaaaattcaacaacccttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccaaggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaacagacaaatagagagccaaatcatgagtgaactcccattcacaattgcttcaaagagaataaaatacctaggaatccaacttacaagggatgtgaargacctcttcaaggagaactacaaaccactgctcaaggaaataaaagaggataaaaacaaatggaagaacattccatgctcatgggtaggaagaatcaatatcgtgaaaatggccatactgcccmaggtaatttacagattcaatgccatccccatcaagctascaatgcctttcttcacagaattggaaaaaactactttaaagttcatatggaaccaaaaaagagcccgcatcgccaagtcaatcctaagccaaaagaacaaaggctggaggcatcacactacctgacttcaaactatactacaaggctagagtaaccaaaacagcatggtactggtaccaaaacagagatatacaagaatggaacagaacagagccctcagaaataacgctgcatatctacaactatctgatctttgacaaacctgagaaaaacaagcaatggggaaaggattccctatttaataaatggtgctgggaaaactggctagccatatgtagaaagctgaaactggawcccttccttacaccttatacaaaaatcaattcaagatggattaaagacttaaacrttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcatacaaatttacaagaaaaaaacaaacaaccccatcaaaaagtgggcraaggacatgaacagacacttttcaaaagaagacatttatgcagccaaaaaacacatgaaaaaatgctcatcatcactggccatcagagaaatgcaaatcaaaaccacaatgagacaccatctcacaccatttagaatggcaatcattaaaaagtcaggaaaccacaggtactggaaaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaacatcattctcagtaaactattgcaagaacaaaaaaccaaagaccgcatattctcactcataggtgggaattgaacaatgagaacacatggacacaggaaggggaatatcacactggggactgttgtggggtggggggaggggggagggatagcattgggagatatacctaatgctagatgacgagttagtgggtgcagtgcaccagcatggcacatgtatacatatgtaactaacctgcacaatgtgcacatgtaccctaaaacttaaagtataataaaaataaaaataaaaaaaataaaaataaaaataaagattgcactgaatccatacattgcttgggtagaatggtcattttaacaatattaatacttcagatccatgatcatgggatgtctttgcattcrtgtgtgttgtcttcaacgtgtttcatcagatttttgtagttttccatgtagaggtctttatccatcttggttaaatttatttctaattttttatagctattgtaaaagggattgccttcttaatttctttgtcagctagttcatcattggtatatagaaatactactgatttttttgtatattgatttttgtatcctgcaactttactcaatttatttatcagatctaagagttttttgatggagtctatgtttttctagatataggattatgtcatctacaaagagggacaatttgacttcctcttttccagtttggatgcctgattgttctgagtaggacttctagtacaattttgaatagcagcagtgatagtgagcaccttgtccttttctagttcttagaggaaaggctttcaactttccacattcaatatgatattagctgtggttttattatgtgtggtgtttattatgttgaggcatgttccttcctagtatttttagtttttatyatgaagtgatgttgaattttatcaaatgctttttctgcatatattgagaggatagatgcaaaaaagcatttttatgcgaagtcacccagtactgaactttttattgttgggagtctttattgctgatttaatctgattacttattattggtctrtttaggttttctatttcttcctgattcaatcttggtatatgtgtccaggaatttatccatttcatctaggttttctagtttgctaatacatacttgttcaaaatagtctctgatacttttgtatttctgtgctatcagttataatgtctcctttttcatttctgattttatttttggaggtcttctcatttttctyggttagtctagctagtggcttattcattttgtttatcttttcaaaaaaccaacttttgtttccttgacacattgtactttttaaatttttattttatttagttctcttatctttattatttcttttattctactactttgtggcctagttagttattgcttctcaagttccttgaggtgcattattaggttgcttatttgaaacatttttagttttttgttgttgatatttattgtgttaaacttccttttgactactactttgtgttgtttccattttcatttgtttcaagaaatttattgatttattccttaattatctctttgacccaaaggtcattcagagacwttttttttaattttcatgtatttatacagtttccaaagtttcttttgttattgatttctagttttattcattgtggtctgagaagaaacttgatataatttagatttttaaaaaatgttttgagacttattttgtatcctagcatctggtctatcctggagaatagttccatgtgctgacaatgagtactctgcagctgttcaacaaaatgttctgtaaatatctgtgaagtccattggyctaaaatgcagtttaaatccaacgtttatttattaattttctgtctagatgagctgtctggttctgagagtgggatgttgaattcctcaactatttttgtgttgaagtgtctctctccctttagatctattaatrtttgctttgcatatatctgggtgtgatactgcttctcagccttttggctaagatcaggtttagtatctggttgctctggtattggtgcatatatgtttagaactattctatcctcttactgaattgatctcgttgtcattatataatgactgtgtcttctttttactgttttgacttaatttctgtttcatctaatataagtatagctactcttgcttttttgcttttgtttgcatgaagtatatttttctgtctttcacttctagtctatatctgtcttttctatcttttacttctagtctgtatctgtgtacaggtgagatgagcttcttagcacataattaagtcatgttctttaatcaattcacccattctatgtcttgtgaatggaaatcttagtctgtttacacccaaggtgattatcgatatctgagtcttcattcctgtcattttgttaattgatttataattgttatgtatatcttttgttcctttctctctctctctctctgtcttattgtttatcattgcagttgggtggttttctgtagtgctaacatttgattcctttcatttccttatttgtgtttgctctaccagtgggttttatactttcaagtgttttcataatgatagatatcatccttttgctttcacatgtcagcctccctgaggtatttcttgtagtgctggtctagtggtgatgaattctctgagctttgcttctgtgagaaaagactttatttttccttcatttataaaggacaacttggctgggtatatggttttttctttcagtgacttgaatatattatcccattatctcctggactgaatgatttctgctgagaaatctgttagtctgattggagtttccttataagttactagatactttycttttgctgtttttagaactctctatgtctttgacttttttttttttttttttgagatggagtctcgctctgtcccccatgctggagtgcagtggcgtgatctcagctcactgcaagctccgcctcctgggttcacaccattctcctgcctcagcctcccgagtagctgggactacaggcacrcgccaccatgcctggctaattttttgtatttttagtagagatggagtttcaccgtgttaggcaggattgtctcgatctcctgacctcgtgatctgcctgtcttggcctccgaaagtgctgggattacaggcgtgagccaccgcacccagccatctttgacttttgaaagtttggctacaatgcaccayggggaggaccttgaattttatttgtgtgagtttctctgagcttcctgcatctagatgtctaaatctctttttgttagacttgggaagttttcacctataattttgtwaaacaggttttctgtcccttttattttcttttcaccttctgggacactgaaaattcaaatatgtcatgcaagctttgttcattattattattttttatgtttttagtgttcatctgactgggttatgtcaaaagacctgtcttcaaattctgattctttcttcaacttgatatagtctattgttaaaacttttgaatgtattttgtatttctttcaatgaattcttcattccagagtttgtctttggttctttgtttttatacctgtctctttagtaaatttctcattcatattatgaattgtttttctgagttgtagtctatctcactgagataggctttaatattgttattttgaattatctgggatttcaaaaaattcttattcattggaatctgttgctggaggattattttgttcatttggaggtgtcatattttcttgctttttcacatctcttgtgtctttgcagtggtatctgtgtatctggtgtagcagttgcttgttctaatttttttttcttttctttttatttgagacagagtctcgctctgtcacccaggctggagtgcagtggcaccatcttggcttactgcaacctccgcctcccgggttcaagcaattctcctgcctcagccttccaagtagctgggattacaggtgcccgccaccatgcctggctaattttttgtatttttagtagagacggggttttaccatgttagccaggatggtctcaatctccagacctcgtgatctgcctgtctcagccttccaaagtgctgagattacagccgatttattaaattatcttttgtcagggaaactttttcttgaaggtgtatctatgctgccagttgggtaaagttccttggcttttgattttgggtgcaggcagtagcatagtctctatgatttatttgactgtaaacagtatcagtagtatctatgattccttcagtggcttagagtgtggttattagtggaagcctgttgtaaaattttgctggggacagggatgtgatgtgaatcagtctttagaccccagtggtggcagcagtgggccacatgtgcctctcctaagctgctcaggacttggtggatatgtgggtcctggtgtgagctccctctctgaagcaatgccatcacatgatttccaggcagctctctgtatcagtttcagagaccacatgggttgacagacttccccaaggctaggactgcaggagtacatggtgggaatgtggatggctggattcattcacttaatctttcctcatattttagggagcctctctaggctcatagatgatgctagctgagcaggctgccttacttctctcttcttccttaccttaggcatttcctgtaatttctctgttgaattcaaaattatattttagatgataagtctgattacctactcactccattggttcttctctgtggagcaggcaagtaccagatgcctctagcctaccgtcttgaagacaccctccaagacaagtttcttaaaggaggtatgctaaggtagaaccttttttttgttagaagttataaaattccaatggaatgagtatatacaaaaagagaacattattggttcatgtaaacatgatgttggctattatcagtgcttacttgttcctgcgtttgtctctgcctcacctgcctaacagcttgttctttcagccttgctttcttcatgaagctggaactgtagccagctctaagttcacttcatgccagatgcataagcaaaggagaaaggatctccaattacacctcgcaaaccgacattcattctgtgcaaatgagaaatatctcaggggaggactcaggcccgacttgggccacacacacacccattggccagtcactgtgaaacaattttgtagacyggttgtgagggcagaagtagaatttaacaaccttttctggaaccacataattgaaggaagggggaaaagttccccctaaatgattttggacgcacagttaccagaagaagagataaagataaggagaagaaaaaggaaaaaataaaaacagaaacagtatatactctaggaggtacatatggagtatcatgggaatttagaagaaagagattatttcttagaagaattcagtgaaatctgatggagtctttaaaaaatgaaggaatatatactctcaagtggttgcaaagaacatttcaggatagacaataccagcttgaaaatatgagttcagtgtagatgttttaaaaataagaaaagcagagtagttaagtgtagttaactacactttgaaattaatttttagtttattttatttttttgagatggaatctcgctctgttgcccaggctggagtgcagtggctctatctcagctcactgcaagctccgcctcctgggttcacaccattctcctgcctcaacctcctgagtagctgggactactggcgcctgccaccacgcctggttaattttttgtatttttagtagagacagggtttcaccgtgttagccaggatggtctcaatctcctgagctcgtgattcgcccgccttggcctcccaaagtgctgggattcacagacgtgagccactgcacccagcctgaaattaattttttagtccacatgaagcagatgaggaacatcaaaaccatctttaaatatatcagtcttgtagatgtttgtgaattaaattgattgacagagacagactaacaagaagttatttcagtgatctatgtggaaagtcttgagagcctgaatgtaatgagaataataccaagatataagcagaatcttgcactgaacattgccaaatattaaatactgtccctagttatttgtcagtgatattttaatgattattgccatcttcctcttttttccccattctccaaaactgcattattataatatacagtattataatatatatattatatatataataatatatatataatataatataatataataaggttatggattaactcctcttaattatctgaaaagagataacgttcatgtgctcagcacacaactaagtagtctgatttggtgttttttattttatttattttagaaaagaagactttcaaaaggagaaaaatctactgccaaataactcagcacctcttacagaaccacaagatgtggaagaaagtcattgaagaggagcaacggttggcaggcatagaaaatcaatccctggaccagacccctcagtcgcactcttcagaacagatccaggctatcaaggaagaagaagaagagaaagggaaaccaagaggcgaggagataccaacccaaaagccagaccagtgacaatggatagaatgggctgtgtttccaaacagattgacttgtcaaagactctcttcaagccagcayaacatttagacacaacactgtagaaatttgagatgggcaaatggctattgcattttgggattcttcgcattttgtgtgtatatttttacagtgaggtacattgttaaaaactttttgctcaaagaagctttcacattgcaacaccagcttctaaggattttttaaggagggaatatatatgtgtgtgtgtatataagctcccacatagatacatgtaaaacatattcacacccatgcacgcacacacatacacactgaaggccacgattgctggctccacaatttagtaacatttatattaagatatatatatagtggtcactgtgatataataaatcataaaggaaaccaaatcacaaaggagatggtgtggcttagcaaggaaacagtgcaggaaatgtaggttaccaactaagcagcttttgctcttagtactgagggatgaaagttccagagcattatttgaattctgatacatcctgccaacactgtgtgtgtgtgtgtgtgtgtgtgtgtgtgtgtgtgtgtgtgtgaaagagagacagaagggaatggtttgagaggktgcttgtgtgcatgtgtgtgcatatgtaaagagatttttgtggtttaagtaactcagaatagctgtagcaaatgactgaatacatgtgaacaaacagaaggaagttcactctggagtgtctttgggaggcagccattccaaatgccctcctccatttagcttcaataaagggccttttgctgrtggagggcactcaagggctgggtgagagggccacgtgtttggtattacattactgctatgcaccacttgaaggagctctatcaccagcctcaaacccgaaagactgaggcattttccagtctacttgcctaatgaatgtatargaactstctatgagtatggatgtcactcaactaagatcaaatcaccatttaaggggatggcattctttatacctaaacayctaagagctgaagtcaggtcttttaatcaggttagaattctaaatgrtgccagagaaggcttgggaaattgtacttcagcgtgatagcctgtgtcttcttaatttgctgcaaaatatgtggtagagaaagaaaaggaaacagaaaaatcactctgggttatatagcaagagatgaaggagaatatttcaacacagggtttttgtgttgacataggaaaagcctgattcttggcaactgttgtagtttgtctttcaggggtgaaggtcccactgacaacccctgttgtggtgttccacacgctgtttgttggggtagcttccatcggcagtctggcccattgtcagtcatgcttcttctggccggggagattatagagagattgtttgaagatysggttattattgaaagtctttttttttgtttgttttgttttggtttgtttgtttatctacacttgtttatgctgtgagccaaacctctatttaaaaagttgatactcactttcaatattttatttcatattattatatatgtcatgatagttatcttgatgtaaatatgaagatttttttgtttctgtagatagtaaactctttttttaaaaaaggaaaagggaaacatttttataaagttatattttaatcaccatttttatacattgtagttctctccaagcccagtaagagaatgatgattcatttgcatggaggtcgatggacaaccaatcatctaccttttctaatttaaatgataatctgatatagttttattgccagttaaatgaggatgctgcaaagcatgttttttcactagtaacttttgctaactgaatgaattctgggtccatatctcccagatgaaaaactgttaaccaataccatattttatagttggtgtccatttctttccaacactgtttgttatgattcttccttsagtacttatatacagacctgctcattatctaaacaatcttaccttctaagtaaaccttgattgtgatttccagtttttattttctctgacgtagtagaaaggaatgtttacattaaaaatacttttgtttctcataaatggatattgtactcccccctttcaaagcattattttacaataattcatggcattttaaaaaataaggcaaagataatacgacaaaaaatatacatggtttcaaggcaaattctccaataagttggaaaatgtaaaaaggatcaagtggatgcagcctctacctaaataattaaaatatatttcagtatatttctgaattaacaccaggtcttcattatttagaacttactaaattgttttcattttcttagttttacctgtgtatctccatgtttgcaaaaattactataagtcaaattttgccagtgaatttaactatttttctttccttgcaattaaggggaaaaaagcatttatcttatcttctcataccccttgcatctaagtacttagcaaagtcaatattttcccattttccaaatgcgtccatctctaacataaatattaattgaacatagagctatgtttggagtgagtggactggcaggacagttggaagtccatcacagtctattgacagtttcatcaaagctgtatagtccaactagtggggcagcttggctactatggtggaagtctcagcaaactgcctggttttgtttgtttgttttgttttaaggtacaggaaataagaggaataatagtggccaaagcaattagaacatcttcattccagaactgtgttcagcaatccaggcagattgatacatttttctttaaaaataaattgctattacagctagacgtcaattgggataaataaagggatgaagatccactaagtttgtgactttcatacacacccagtacatctcaaaggatgctaagggacattttctgccagtagagttctccccctttttggtgacagcaatattattatgttcacatctaactccagagcttacttcctgtggtgccaatgtatttgttgcaatttactacatttttatatgagcctatttataggtgccattaaactcaggtctttcaaatgaaagagtttctagcccacttagggaaaaagataattgtttagaaaaccataaaatcaatggtaggaaaagttggaactggttacctggatgccatggttctctgttaaataaagtaagagaccaggtgtattctgagtgtcatcagtgttattttcagcatgctaataaatgtctttccggttatatatctatctaaattaacctttaaaatattggtttccttgataaaagcaccacttttgcttttgttagctgtaatattttttgtcatttagataagacctggtttggctctcaataaaagatgaagacagtagctctgtacagggatatatctatattagtcttcatctgatgaatgaagaaattttctcatattatgttcaagaaagtatttacttcctaaaaatagaattcccgattctgtctattttggttgaataccagaacaaatctttccgttgcaatcccagtaaaacgaaagaaaaggaatatcttacagactgttcatattagatgtatgtagactgttaatttgcaatttccccatatttcctgcctatcttacccagataactttctttgaaggtaaaagctgtgcaaaaggcatgagactcaggcctactctttgtttaaatgatggaaaaatataaattattttctaagtaataaaagtataaaaattatcattataaataaagtctaaagtttgaaattattaatttataaaagtgaactaattgtgtgattatcaaatcctgattaatgagaagtgaataatctaaaaatcatttatattctactgtgggaggtattcttggtgcttccatgtcagtatcgggctctccattgtcctcatcatttatagtacttctaaaataataatggaaacctcaataagggtcttgtcctcttctgtcatcctaaccctgattctagtttaatgcctttcctgacttatatgccatttgtaaataaacttcctttcaaactgttagaacgctccaataaaacaaagttctatgaactttcatagtctagaaaaaccaacaagatcccccttatttagagattattagctaatgtgtgaaagaaatatcaatagaagttcaaatgctaatagctcaattccagataattgaaagctaaaatatctatgtactttgaagccaaactgagtttatttcattgatcgaacaagcagcaacacattttatgaccattgtcctaggtcgtttgtgtctttatgaatttgctgatattgtcagtccattttttaaatcttcaacaaaattcaattttaagattaagaaatcagcaattttaggtaaagaatattccaagattaaattgttctttttaagaaatatatcagttttaggtcctatgttcacacatcaatttgttcatctggaagatattcaaattcttattgggaatgaattacactacaaacaatgagttgagctaaaaactatacataacttaaattgagatttgcatacgtatttgtgtgtttcacaccaaagacccatgctcagagaatggtaacatattttccagtctatgttatgcaccatggatgttaggcaatgtgtgctattgccaacacatggtatttgttgaaatacatgttgctttgaccttacctaatggtgcttttacctaacttgaagtgctttttgtgttcccaccagcaaatcattctaacagcaggctaacaatggtgaagtaaaatgaacatttttgggccgggcgcagtggctcacgcctgtaatcccagcactttgggaggccaaggctggtggatcacctgaggtcgggagttcgacaccagcctgaccaacacggagaaaccccgtctttactaaaaatacaaaatgattcaggtgtggtggcgcatgtctgtaatcccagctacccaggaggctgaggcagaatcgcttgaacctgggaggcagaggttatggtgagctgagattgcaccattgcactccagcctgggcaacaggagttaaattttgcctcaaaaaaaaaaaaaaaaaaaaaaagaacattttttggcaaaatatgaagacacgaaactgaagataaaggcttcatttccatagtggaaatcagtgtttacctgctgattcaaaaatactgacctagtatcagtgtaggtaagaccataaaatacagtgtatagaattatatataaatggaaaacaaaattagcttttgacatatgtttaagtctctaaaaggaatccacattttctttccagatacagctagtttttctccacatgtttttaaggttgatttccttgacacacattggtatccttgggtttctgcttccttgaaaagttgtggagcacagaagaaaagccttctctttacagataaaaaatgttgaacatgttcatgttctgacaatgaagcaatgatttcctcattgctttgcattaagaagtggttctttagttatgcaaataattcaataaccaaaaatgcttcaaagagtaataataaatcaccataggtaagtattctcaagaatgtttaaatttggtttattttcttgaagcaaagttatttaattttttaatttttaacttaaaatgaaacccacaaaatgacattcygtggtactgagtattttcacataatcagaactgtaaactactgattattttcatatactcagaggctgaatattttgatataataagaactagtatcatataacagaaaactagaaagaaggtttaattctttttctaatattctacaagcctcatggggaaaatgttttatgaaggattcaaatacattagataaaaattagtgtcaataatttaactttgtacaaattatagtctgagatcttctgagttttcctaagacaaaggagtgtattatccagcaatttattgttttgtgttgttataaaataaatgttctattaatgtatattttattttactaagttctaacacaaaaggccaaatacttatctttcctactaagaaaaattaaaccttactaatcttgactttcacagatgaaacactgaccagtcaataaacaacagccactgcattaatctgcccagcatgatcagatagtaggttagaatttgaaattcattaataaaaaattaataacaaaactttgtaagccttaatggtttaatatttccgtgtcattgaaagttcctatttcaaattaaacaaactacagcaggatatttttcctttcctgtttcaaaacaaaaaccagatgaagaaaaaacaaagacaaactcataggaggaaagcatggcttctcttcaattatacttctcttactcaatattagtaaccaaaaaataagcagaaattctcctctgccataattaaaagaaagaatggccttcgacttaagttctagttcctcaagcctgctttccttgtaaagtccatggtactaagaagcaaaaaatgcagagctgtggattgggagtgaacactacataaaatttgcagggtatcccaggacacccctcagtctttaatacaaaccaatttagttactctggagtgaaatgacttgtggatacactgttcaaccatgacttcctttatgacaaggagcacttatacatgtttccaaatgtgaattagcccttgaattagtttgaaaactgctacttgaataacttttgaagagaaagattttctttccggtaattttactccctaaaaaaggcaaaatactcagatgttcaatgtgaaattacaaatagttgtttgaagtatatatacttcaataaatagttctttgtgtatataaagtgttggttcatagcagtttccttgtcccttttctttttaaaattcccaactgattatgggtcaaaaactccatcttatatcagcgatgatttcattttaactatttataaggataatttagtattatagtattgctaactttaataattctaccatatctatatattacctgttagtgaggttttaatggctttacttaatacatatttgttcatcagcttaaaaaatcactaaattttttatactctgtaaaatatttgcatgggaattttagcttattatgtttgcttaactggtgtttttttcacttatgactgtcagtttatgtcttaatgtattctcacagaagaatgcataccatttttgttccaacaagaacaatctgttagttgataagcactggtaataaatatcactgaacccacccaccccctgatatttcttcctcaagttttctatcatgcaaatcacaaaatgaaaattggtgcttttacaaatatttgaaagctctcaatgcaaaataataaaaatgagattctccctggctttctataatatattaggatatgtgactgaaggaaatttaatctgaatttagagtgttttaggttttggttggtttgaataatttgatttgcattttggtattaaaatgtgctctgatttctgcgggcatttgttctgaccagtcattacctcttcccaacagaaaaaaaaaaaaaaaaaaaaaaactggcattggcaagttttaattaatatggcccaaaaatttgaccttgaaggatatttgtaaaccagagagtatttaattaactaaatttactgtttctgaaaagcaatattttcaaataactgccaaccaaagtgacactatagggatgtcatttgtacatgacaatttttaacaatgtaattcttaccactctcgacagacctgaatatgtttactaataactttgccaaatttttcaacttctagaaaaacaagagtgagtcttttgaacttcatcattttgcaattgaaataaatcttgtcctttcacctatatcttccatttaatatatgtagcaatacttagtatcatcccatcacaagtattgttaggcgacttagtggcggagaaatgtttgtaaaaagtagaatctgtacagaaaaaaaactagatcaattgtatttatttttattattttttagcttagatactatgttga

SEQ ID NO: 12324 - DNA, 68445 bp, Homo sapiens
  misc_feature (1)...(68445): n = A,T,C or G, or insertion/deletion polymorphism (see Tables 1-2)
caattccccattcttgcttttggtgcttgaatatgtactttttttttcttttaattatcagctgggcatggtggctcatgcctgtaatcccagcactttgggaagccaaggctggtagatcactttgaggccaggagttcgagaccagcctggccaacatggtgaaaccccatctctacaaaaaataaaaatattagccaggcatggtggtacacacctgtattctcagctactcgagaggctgaggcagagaattgcttgaacccaggaggcagaggttgcggtaagccaagatcacaccactgcattccagcctgggtgacagagcaagaactggtctcaaaaaaaaaatttttttttaatttaaaaaattatttagcacttatcttgctttgcacatctaatatttcaaagaggaggaatttaataagcgtttaatcaagcttgacctggaaatcctggtctctgagccttccatccctgtcacccagtctctagcctctctttggagcccccattctcctccctgaatcccatctcccttaccaggttgtcatcctctttctgaaccccatttcctgctactcaaccttctgtccctcctactcacgtcatctccctccctgagccctcattcaagtttctcccaccaggcgagcatggaagttcttttccactgcacactcagcaactcagaaaagtccttccttttcatttttcagccaactctattgtcccagtggttctcaccgagaacatggagttaaccagcaggaccacagcactgttgccttctgcatggtcttccagaggtagaggttagaggaaggatcttacaggaagaatcctgaaggcagaggaggagccctgcaagaagggagggctttgaccttcatttccacgcccctttctccctctgtgtctcctctgtgtgggccccctccagccctgaggatcaatgggggttcactttcactgagctcagcaacactgctccctccccacttcctgtggctctgagctgactggcctgcttggtctaggctgggggctggtcagtgccacacccagatctggggaaaagaaattccttggccggcgaggtggctcacgcctgtaatcccagcactttgggaggccaagacgggcggatcaggaggtcaggagatcgagaccatcctggctaacacggtgaaaccccgtctctactaaaaatacaaaaaaattagccaggcatggtggcgggcgcctgtagtgccagctacttgggaggctgaggcaagagaatggtgtgaacccgggaggcagagcttgcagtgagccgagattgcgccactgcactccagactgggcaacagagcgagactccatctcaaaaaaaaaaaaaaaagaaaagaaaaagaaattccttgggcccctccagcacctctcgtctggtgggtggcctaagtctcttgtcctttctgggctgcacagggaaaaggaagaaggccttatctttctctcatgcttcctcctgctctcagtagaggtgggttcccaaaggtcaataatgtgatgccatcaccccctgagcactctccactccaatcccctcctaggaaggcttcctagattgagaagaactgctaggaccagggaattcccagagcatctccctgctccacctgaaacatgtacctgaagagcagtcagacgaatgggtcacgtgcgtacagccccctgcatggtctctaactttttcatgcattattgcattcagtgctgatagccagggaaagtggggaagaggtggagtgacttgcccaaggtccccaagtattccacaggtggagctaggactggaagcccagccatgacttgtagtttagggctctttctgcccctggcactgccagcctctctggatgctggtgcctcccacttcacccatcctgggttctctcctagggagccacagcctctgcagcatgcccagcctcagggcctggccaggctccctgtttcttatcaggccaaattggaccctccatcctggcattcaagtcctcctgcgtgcccctggctaagcttgctcttccgaatgctctgtaacattcttcccacaccagtacacacacacacacacacacacacacacacacacacacacacattaaagcagcacctgagtgaattaaaagccatacaaggcaagtctcttcactgagcctcagtcttcttgagtgtaacatgggaccgtgaacagtattaccgcacaaggttgtggggatgctgaaatagacaatgcaggtaaaacatcctgcataaggcttaggattgactgcaggcctcattaatggtagctgcaggcattattggttgtacttctctgcgtctctcccagtcctccccactcctgtccccaagaaagctccctctgccattgcctgtggagacttctccctcctctgagctctagcaacccttggagctgtaagaaagcccagggtcaggtggctagcaggcagagagattttaggaggcaagtgagtggaacccagacctcctcgcctcgattcaactagcgcacttctgctccaaagctttgtacacattggggtgctaccttacaattctgtctgtaaaaaggattccattgctgataaagtctaaaaatcactgacttaaaccaccccacctctcactccaggaaaggaacctgagcccttgattgacctggggtcacagtgggaatcactgacaggcttgagcctagcctgagagaccatagtcctagccacttcctgccctccatcctttcagacctggaagtttgatcccttggcacgagtaagttctagagaacaaggattggccgtgtatggttatcctcagctcccagcacccagtgcccagccggcaggtgccagtcagtggaaagcacaggtcacagttctgggggtcaccaataggctgtgtagacttaggtgagtccctgtgcctctcagagcctcagctgtctcaagcaagctgctgctctctggcccaaaagggactgggcctggcacacagatggcactcagcaaatggaagcactcgccctcccacccttcctctcartcaatacttgctccattgatggctgatggggacagtgatgaattacagaagatcttggagccctgcccacttcttgcacagatggggaaacaagtccagggtggggaagagacttgcccaggtgggagtgagtcttagtgaatgcgtctcctcagtggggcagggaagctttcgcagtgttaccagggtggagacagggcytgggggtggaaaggaaactgctgagggtggggtcaggggaacaggtgggagagggaaggaggagggtagggaaccacggtgtccagtcccctccagcagaggggccaattgagggagcctgagacagctgtttgctcagaaaagtgtcttagtcactaaaggttgtggtggggaaagtccgtcctcccagtcatgtcctgggaatccggatggcgcaggaaggccacccggtgaccctaagagtggccacctgtcctctctgaactggactttctcttctggcccttccactcttccatgtgtacacatatgccaagtaaatttgctgtggcctcctggaaccatctcccccatccctctcaccccttaggaagagttctgtgtccctccattacccatacgcccgcaggagaaacaggcttctatgccctatgaaagtccttcctgagatctaacttccatccctctagctgcaaccacagtctctttcctctttctgctgcctttgagcaggtaatctggagctggagttgggaatgatgagacactccctgcagtgagggctcctcacaaggtggggaagggacctttgtagtcccccagctgggaagagagccatgggatccagaggtgatgctgagcttgaagattagatttcccagaacagacccagtttcagatattctgggtgttaagggcaacctgaattcaaattccatttctgctacagaacaagagcctcaaaaagaccccctagaaacacccccagggcgcttgcaactgctttcctgtgcacctttcatgtcctagaccttagtcccatttcccaggatctatgattgagaagaaccagccaggcagttccacagagggaggacagtgctgcatattttgggggtgccatcttcagctcatagagagaagatgggttaactcagcccaggcaccacatccctagtggggccttggggtccagaaactgtccccagcttccagtagaggatccgggcataacctgccctggggcacccggctctggccctgggcacacctggaccaggagcagcagaagagattcaggtcagaccccagagggcacccccagctaggcagaggggaaaggatcactatggggtaggggtgtgggccggttgccaagcccagtttagggaccccacagatccctgcagcccacggccctgcctccctccctccctcactggcgctcagcagatcaatgctgcctttgctgacagctgagaatcgagctcgccttcccgccccttcccccgcccctcccgctcggcttcgtccctcgagatcctcccggaggaaccgggaagagtttgctgcggaaggctcaccctggggcagggcctgcggagggagcggctggtgtggccgcagctttccgtggaggaagagggaaagaggatcgggaaacccaagttaccaaccctgtgcagggcccaggagggctaaaggagagggactgccccctatagccagagagatggaggtcggggactaagaaaaactttccagctggagagggaatgccctgggacaaagtatccccttttctggctgggattctgtgggccttgggtagggggtgtgtgtcccctctaaggctggcttagagctcatctcccaacactccatctgcccaaacccagttccctgacctgggagtggggcaggggagcaggcccctccatcggggaggatcctcttctgggcagggtggctcttcccccatcacgatgaagggaagctcagaggtggcagttggtgggagaaagacacacccaggcccactgtgttccacacaccctgatgctgcctagcagcccgtgggctccaggcctttcaggtaagagcaggacaaccgccgctgcccacccagccacacacagcactgggcacactttaagcacccgcaccaggcacacagtgctcgaccccarcggacacacctcatccccttcggactccacctccactttcgcagccacccacacccgacccataactcacacctcactgactccatccccgcacctggtagacccacagccacccaccctgcacacacaagtagacgccgttccaccggtctacacctaaactccacgggacactgcgtcccttcccctgccgcccgcggccacaactccacattccactttccacaagcacacacgaggcgtcccaccccgggctggccttcggggccacactgccccacgcagckgtggacaccacttgcacgcgtccggcttcccggccccgcgcgctgcccccgccacgcggttcggcccaggcaccaactcggccgcccgtgcgccctgccccgccgcctgctccgcgcgttccctccctccgcctcgcctcgcttgctcgctcgctccctcccgatttgggaaggcggccgcggggcgggcgggggaggggcggggcgggggagkgtgacatgtgagcggcgcgcgccggtggcaggtggaaaggcgagcggcatggagcgcgtaataagagagttggagtcggaaagagcagccccagtcgccggggaagcgggaggtcagtgcgggctccggcggcccccaggctccgagcgcccgcccgcggccccggcccggcccctagcccccgccgcccgcgcccgccccgggtcgcccctctggccccgggtccgagccatgcgtctctgagcgccccgagcgcgcccccgccccggaccgtgcccgggccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccttccgcgtttccccgcgcaagcctggcctcccggggcacggccgccccgccctggctccgccttctacccccctgcctcagggccgaccctcatctctctccccccaggcctaagcccggtttctgatcccctcgctgagcccgaccctaagccctgatctcccaggcctgacccctgcttgacctcgcttctgacctccccgcaccgcaactgcttatttccatcctgaccgccaatctctgctcctctgtcccaggtactcccgaccgccagctgcctcccccaagtccgcttggcgaagtctggggcccctggagtgggcgcccttttcctcttccccacccctgcctccctgtgtcccagacacaaagaggaacccttggctcccacacgcttctgtcacctgctccccagctctgagctatgaagggctcccctcaggggtgctcctctccagggcggccctcattcctacccctgcccagctgactgtgggtgtgtgggggtccctgtgggccccctgggccctgacactcgcatatgctgtgtccsacttgatctgtgtcttcgctcagtcttcccctccaccctcaacttcccagtggcaacggcggccgccctgcctgccctgccctaccctgccggcttggcccagctcgcctgccttgttggctggcagcaccaggcctggctctaggcaccaggggaaaaagaaagaggagaggggtaggtttggaaacactgacgctgctggggccccctcctccctctcaccaggctcctacaactttcaaaaacactgacccctcttgggtgtgaagagtgaattttggcagctcagagctcagtcttggggtacggcctggcccagccaggaacatgagaggccccgcagatatcagttgaagggctgggcctgacgctgggacgctcagaggtgcccagagagagacctctggtccctggaaaatgtgtggctattaatccctttttgctgccaccagagagggccctttggcgctggggtctcctgggtggcccacctgcctgcccacctgactgtctagcagccctcctgctggcctggctgtccctctgccagcctgagtttccacctgtgtgcgagttggccagtctgctcacccttccacctaactgtccgcagtccttctgcttgcctgtttccatccatctgtggcctgtgcagttatccgggtgcctgtctgtgcatctgcctatccacctgtccacctgactgtccactcttcctctacctgtcttttccacctgtctctgggtctgtccttcggcctgtttctcgggtgcttgctggcctgcctctgccccatctgaactgggcccacataatttcagaggtgaaggggagaaagatgcggcacagggaggggcagggggggaagacagcagggctctctcggccattaagtgcgttgggggtggcaaccttgactctgtgcagagacctcagctgggctaggctggggcagagagttgaaattgctcaggacatgaggtcaagcttcggttcagggtcaacggtttgtagtagcccagtccttagtgtccattgggaggcctaggatgaatatttgtggctataaagaggcccgttggagtgaggaaggcccagggctggtggagttgggggtgaggggatggggactacttcttaggagtggctacagagcagcctccttgagtgcctaaggagggtgagacaccccccagagaacaactgtgccctccgtgggctcctcttgggaagggacttttccaaggcatggcagggcctggggaagccaatagggctctgaggtggggtccttacccccccaggcttggccttacagcccccacaagggtcagtggaggtgaaggacctgcctcctgtcccctggccagctgctgttggtgcctcctttgaaaggaccgccccttcctctccaggagctaatccactggcacctttgccccacatcctgccctttcctgatgccaggaaatgccctcgccagggccgtgcttgtcctgaccacttgtccccgggagcccagggccagggcatgtcttgggaactctgggggargaagtatggtgtgaaagtgtcctggtgtttaaggatctcagggaattggtcacccatcttagaggtcaaaggggacagaggtgtcaggaaccccacctcttatgtgctctgtgacgttgggttgattgctgggcctctctgagctttaggtctgtaggttgtcaaagcgggtagaaaccccaaccttgcggcctctctcttggatgaggtaatagagtgggaaagagcttggtaagctccaggggcctgtctgagcttgaaagacggttgttattattggggctggaggagggggcccacacagaaggtctctcctgtttgtgaggagctccagatgtggggtttctcagtcacactgcagggtcttgccaggaagtacttcctgctgttggactcctagccagaccattacactttgggtcaaatcctttctcctcttcccaatctgcctcagtggcagcccaagtgaggggagtccagggagtactgttagctaggacccccttcccagagacgcaggctgtggcaggaggggccccagcagaagagcctgcaagagaagggctctgggcsgggcgcagtggctctcacctgtaatcccagcactgtgagaggctgaggtgggaggatcgcttgagcctaggcaacatggtgagacccctgactctacaaaatttaaaaattagccgggcatggtggtgcacacctgtagacacaattacttgggaggctgaggtgggaggatcacttgaacccaggaattctaggctattgtgaactgtgattgcaccactgcattccagcctgagtgacaggatgagaccctatcaattaaaaaagagagagaaagagaagggctcaggaaggagggagctggggtgagaggagcgcattcgccctagggtatgcctccctcccatctgccagcccgtcccctctgagccccacacagaacctgcatctttctggctccaaraggtgggagattgcctagagtacaagcccagatttggcctgtcctgcggcagctgcaagctctgggaagagaggactgctgactcctgtcttctcctgttgggatccagaatgaggggccactgagcccctctccaagctttccctctctctgtrgaccctcagtctgatcaccaagctgcatccccctcctatgccccagtccctgatttaagccctgaagccttcacaggccctgctctctgaattttaagaaataccacctcgtggcccatcctgctcgctgagcccttatggggaatgctcgctgtccccttgctgccccctctcaaaggccactccagcttcccttgaagtcagagtgctggagggggctgagcaagaccctatctcccttcatcctccccagccactatgagccgcaggcctgccgctcccagcccccagggcccagcagactttctctatgtgaaggtttgcggctctgtaaacatcctccctcagccttgtccgtggggtcagaagctgtgggaatggggaggggaggaggtggcagcagcttctggggcccgcagactcctaacccccgagcccccgacctcccaccccggccatctgagaaagaacatcgcctgggttggaaatcatcccagcaaagtgtcctcagaaccctcaggcatccccgctaggtcagtcggtcctcacattttgacagccccattttacttgtaagaaaactgaggctctggagaccaaagtcacctgggaaatgagtagcagatacagcggactctgtgcagagacctcagctgggctaggccagggcagagagttgaaattgctcctgcytccttgtccaggactgttcgctccgttcctagtggccaccgggcttggctcttggagtctgaaatgaaatctctggttgtgtgtgcagcaccaactatgcacagggcaccctgctgagctctctctaaaccggtctcattgtgtccttctgcagccttgtgaggtgggcactgttmtcctcctcatttgacagatggggaaactgggactcagcagaggccacccagttaatgtggaagagcctcagcccggagcgggggctgactgggagctgttgcgctcagcaccacagcctcagctagcagcaccccaagtccaggctcctcaagaacagcactcctgtgtcatctgtccgtccatcccagcaccccgcacacagtcagcagggggtgggcagtgatggcattttgtggaattgagtggaaactgccagcctcacccagtgcagccacgttttagttgtagaccacgtcactgctgcgtacctgtctgaatgtctcacacatgcactcactgcaacatcgacacacatgcacaaacacacacacagcatccatccaacaaaaagagttctagtttacagctgcccctaccttttccctgacttcacagacactcaccatggacacacacccgggcccgtggctccagcccagacccctaggacagaacaaagcttgctcctgtccttgagtttttggccttcacctatacacaactgcagggctgcccttgcgggtctgtgtgtatttgtgtagccaccttggagggcagcctcagaactgtggaggagcggggtggctggcctcgtagaacttcgctggcgtttgctcctcctggggggtcctcgggggtcctttgatctgaccttggggtatactgctgggtacaccaagacacagaaaggggcagctactcatccaaggtcacacctagtgagttagtggagaactgtgccaggaacccaagcrttttgtcycccagatcaggactttagataacaattttcctaacctagccaacaggggagatggatgctctaagaactttgcccttgtgattgggaaagtctttgagtgtgacccamatttttcgtgctgctgtttttcagccctagtccttttgcttggtctttgtaaggagctggggagaccatcctgttcttatactgccttcctcctcctccttgcactccccttcacgctcctttgcctccttcttctgaagttctttggtgtcactggagccggttcgatctctcactgacggcccaccccaccccaactccatagtacgttcattcttccattgaagacgcgctgctagatgtctaacttcaatccctattgctgccgaagcccttatccttgggatatttaagccaggagtgtttcaagaggtggttattattcttgggctgatggcagcactttgagtggatgattaatttcaggctctctgagccagtcaaaggagctggaactgcctgggagcagggaaaaaggaaggccgaggccctgcccacaaaggaggctgcccagggaacttccccagactccctcctacctccctagcaccaatgtgggtctttggggaaggtccgatcttcttgtgggctatggagccccccagcagggaattctgcatgtttgccctgggggaagctcctagtgtgggagttgagaggttgaggatgggggaatagcagggacttttcgtttctccagaagctgtcctgcggggagtgaagagcacgggctctgaggctgacagatctgcgttccttcctggttctagccttagcagtcgtgtgtccttgggcaagttacttaacctctctgggcttcagttttctcatctgaaaaatgggagtaatcataatacctgcctctaagattgtcaggactggatgagataaggcaccgaacactgctgggcactgttagccatgatcatcgttactgttattattatgctgttatcactgtcctcattcttctcctccggggagaggtgtggtaggtgtgctgggctcagcaaggtgagtgtgtctgagtctgctctggagagaataggagctatgtctgcctgtgtcctggggcgagtggttctccatgggagctgaggctgtgtcttttcagcctcctgtgggccctgcccatgagagtgtctgacttacattctctcgtgtaacgctcacagccatcttatcaggtgggtgctgtcttcttcatgtcacagttgagcaaagtgaggctgggtgaggggatgtcacccagctcatgaatggagcccagcctggctacctagcatgctcactgatttgtttcttccttcatctggcaaacagttacagagcatcagctccataccaggaccagggagccagagagagctagaccatgcctgtaccctgcctggcagagtgggggattgggggtcactgtgaggaggtcgcagagtctgccgggaccactggcctcagctgcttcttctcccagggagaggtttggagagaggtctggtctgtgtgtagctgtgagtgtgtctgtgagttatggggaggacggtgtatgccagagggccactgtgcggccgagtttgggcctcatggtccaaccctggcagctggcctggcccccgagagataaaagtagagccatggtgcccagagagacagccagggactcctgggagaggagggcactcccccactctctcctgagcaaatgatcatggagaatgagggcagggaatcccaagggagatttagagatctcagtccccatgcttactgggaaggtgtccacccccactccaccccagttcctgagcctcggtatcttcttctgtaaaatgggcctaacaggaaagtggacctctcagggctgcctggcacacagtcgtggtgggcaaatgagagagactgctgtctcaggaccttgaaatgcatagggtaccaggtagggagctctcttccagcatcttctctgggggcccctcaggtgacagggtgccacttcacagggcactcagggggctgcctgcccccagtggaggctctgaggggctggagaaagggtgctgagccgacctcagtggctacacagagcccccaggacttcaggttccctgggcaaccctgtccctggggcaggagctgcgtgccctggggatgaggcacaggaggggcagccccaggcagcagactaattgggctgggaatccgtgggcagcgcctgaggaagggaggcaacaggagctcagcgattccctccctcctcaccccacggagatttgggggacagtggatagagcagggtctctagcctaaaggatggagggaaaatcttgaggcacattctcctgagactccttggacacccaggccgggaaggtgggactggaggaaagctcactggaaataaatggagcatggttcccatcaaagcagaggagatggaggtcagacagcaggaaggactgcccaagaaccaggaggtgaatgagattttctgggatattgtttcaaaaacttggagccccctgtctagccgggctggacaacatttactcgaattgtccctatcaagcaaggaatggctccctactcccacagagcgaaagatggaggggagatgcctgttccctttgagcccaactttggcggggtgtgggtcgggggtggggtagggatcagatcgggtacccactggcttttgggcagtggtgggagggtcacaggctgctcctccttctctgccacttctctctgggagcctcgggcctgtccaggttgctgtctttgggtttattttttgctgggcttggctgtcccctgggaggggagggggcagggagagaaaggaaaagcaggaacagctttgtcagcacaatctcaggcgccttcgctactgcccgtcttggcccagctgccaccctctactggagggaccagcccctgggcacagtggggattcagaccctatggaacttcctcgcttasaggcaggaccagcaggaagggactaggcctttctacccccatcctctctccatatatccctgctatacagaacctcaggtctcagcgctggagcagatccacgggcttcatttcacaggtggggaaactgaggctagaagggacctgatggctcaagggcacagcccacacgggggccttttccaccttccctccttatggagtaacatgggagaaatgctgcctccctgctgcccgttccctgggtgaactcattcactcatctcattttccagcctctggggattggtggcagtctggtgggagagacgggggacggggaaaggacagtgtgacccatggcccagcagaggaagggaggtacaacctggggatgcacagaggctaggtgggggtatcaatccctcccctatatgctttttatcctaaaaaaatacattcgccctattttacagacagggggattaaggtgtaaagaagttaatgacttgcccaaagtcaacatagctgacaggtggtagaggcaggatttgaacctagcatgtgcatctctgggagccatgcatttggccactccaccatgctgcctccccaaggggcccctgtgggcccttctttcttttcttttctttctttcttttttttttttttttttttgaagcagggcctcactctgtcacccacgctggagtgcatgatcactatgatcactgcagactcaacctcctgggctcaagtgatccttccacctcaccctcctaaggagctgggactacaggcgcacaccaagacacccagctagtttttaaatttttctgtggagacagggtcttgctatgttgtccaggctgatctccaactcctggctccagcgatcctcccacggtggcctcgggagccaccatggctgcctgctgggcccttccttcttgaatgcaacccccctggctttcctcaaacctgcctctgtggcttttctctcttggttctatcagcaagcagctctgcctcctctttctgccccttgaatgttggggctttgtctcaagtcctcttcacagtacatagtttcagggggtggtctcatgcactcctacgacatcaggggtcacccctatgatgacagcctccgctctgcagtttcatccctgcgcttcctgcctgctgacacctctcctcctcattccctgggcatctcaaactcagcatctccctccaaacctgccctccttcctcaatccatgtgacagtgactccccgatccccagtgcccaagtcagaaatgccctccacacaagcatcctttgctctcacctaagaaatgacttacagtgtcccaaagcattgcgctgtttagtgcttctgtgcttttccttctgcctgcaactccctcccctcttctgcccactgcatcatctagctaactcctattcatccttcaactcccagtttgagcaccacctcttcttggaagcactccctatccccattacccccaggctcaactgagggcccttcagtgcccccagagttctgttcacccagccctgtgcgttttttgcttttctgcatgggactatgagaactgggtgtgtgggggttgaacacaattcttggcacatggtcagcaatgagtgaatgtttgatgaaggtggcattggggccaagtagtaaggatgagaagggttttgccaactagagagaagtggagaaaagacccctcagccctctgtgtggagcactgagctgtgggtgttcatgatttttatcccgagtgagctccaggtgaagggaacagcagagcaaaggccttgagatgggacttccttcccctcactcctttgccccaagacctgcagagcacagggccttgattgacaggctgtggaggtgggccttaccctgtgggcagtggggagccatacacggtgacaggccagggtggggacactggatgggaaccagggtttgactctttctgagtgagtgctgtgcagacgtgaggtcatctattttttccagtacccgctaggtagcaggcactattattgttcccattttgcagacaagaaactggggctcaaagaagagaaacaccacatactaagttacacagcttgtctgtggtygagtcaagactcaaacccatgtcggcatcagggccaagcccgagctctaaatggttctcagcctcgccagctgacccaaggcagtttccagtggcctaaggcaaaactgaggagaataaggacggggtggcgactctttcataaagctaaatttattccacttaaaggactgtcttttagtatgagatgatgtcctttcttttatgaaatgatgggctgggaaaaaaatgtccttgcttggcaaaataaaaagttgacaaccttatgcagtccccaaagtgtttttggaaattttaccggtggtgcgtgaaatccctgagtctgggcgccatcccggctcctccccactgagctgtggagccagaagagggaggggtctggtagggacagagggatcaggggacagaggagcctcaggtcccgcactttgcagtgaggaccaacccaaggctctttcctaagattgggttgggcgggtgggggggtggggggcagatcagccagaatcaagggctcacccctcagttaaaggagcactggaccgggaggcagcaggcttgggctcagctcctgcctctgcttcctggaggctgtgtgatgccaggcaggtgacccaacctctctgaggcaccagcttccttatacatagaatgacaattgccatctgtccctgctcacctcacggggctgcttcctatagcaagtgcttggtaaactgcaaagtgctgtgaagaacaggggggttgtggtggttttacctttttttttttttttttttccttttgagacagagtcttactctttcacccaggctggaaggcagtggtgtgatcatggttcactgcagccttgaactcctgggctcaagcgatcctcctgcctcagcctttcatgtagctgagacygcaggtgcacgtcacggcgctaggctaatttttaaattttttgtagagaggggatcttgttatgttgcccaggctggtttcgaattcctgtgctcaagcaattttcccaccctggcctcccaaagtgctgagattacggacatgagccactgcacccagccctggttttactgttcttatcttgccatcagaggatcccacttctctagggtcctgggcccctcatctcactttcacttttcacttgcactgctttgagccctgaggaagagacatatgggggagcggggcaggtggaatgacacaggccctgtaaaagcagggtggccacactagcaattcctgtcctcaggctcccctggaggacagctcagagatgcccaggctggagacctggggaactctaggaaaagaatgcacgaagctggagccaggctagagttctaagcacagactttgtcactgagtaataagattcatagtctaatctctaccaggtattgtgctaaatatttttcacactgcttcatttaatccttccaagagccctatgaggtaggtcctatcattatccccattggatggaagatgacactgaagcttaaaggtgaaacactgcccttgtcacacagccaggaastggtgaatgcccaagaggacgggagttttctgggctcagctcagacaactgagtgcctggagaggccgagtgtgcaacgattctgtgacatgagagggtgggaacggtttgcaggactgtggtggggggccgagggggtaatcagtgcacatcaggggcaccgggttggggtcrgaaggcaagagacacgatcctgctggctagcttctagcagtcacctccctctctgagtctcagcctccctctctgctctggctctcaataataacaaagataatactagcaggaccttactgagtgcttaccgtggaccagatgctgctctgagagcttgccacgccttctatcactttttcctctcaatgacactatgaggtaggtactgttattatgcctacttttcagatgaggaagttgaggcacaaagaggttacgtgacttgcctgggtacatgtagcagggccaggattctaaccacaagagtctagctctataggctgtgatcttacccacctaactcacccggactatgtctgcctgcttctaatggggggtgatatkaggagaagttgagccttaaagttcaaggtcctgggccgggcgctgtggctcacgcctgtaatcccagcactttgggaggcagaggcaggcagaccacctgaggtcaggagttcgagactagcctggccaacatggtgaaaccccgtctctactgaaaatacaaaaaattatctgggtgtgatggtgcgcacctatagtcccagctacttgggaggttgaggcatcagaatcgcttaaacccgggaggtagaggttgcagtgagccgagatcgtgccactgcactccagcctggatgacagagtgagactccatcaaataaataaataaataaataaataaataaataaataaatacagttcaaggtcctgctcccaccccgattctaccctggggactcattccttccctctctcgccctttcatttgagaaaccttcacttctaaatgaagttcagctgcttatgccagtctccccgggccaggccctgtgccagactctggggacagagcaatgaatcagaccttcctctgctccctgggggagatgggctgggaagctggcagttaccaggcagggtgataagtgccactgtccaggcagcacggagtccagtgggagcccagcacagagggccaagccctgccccaatctgggcatggctgggaaggcttcccagaggaagaggcttaagttgagactgaaagatgagtagaagtaggagttagctaggtgaaaaggagcaaggaacagtgtttcaggcagagagaatagcacaggcagagacccagaagtgaggctgaacagggcatttgcaaagaacagcaagaagtcagaagagcgggatcctagaggaggcaagaggtatctggagaagaggctgggatgcaacagggccaggctcggcagtgaggacaccgggctggggagctgcagcttcctgagagggtgatgggaaggaagtgatgtcaggagtaacatggcagattcgtgttttagaaactcctttctgggactggcgaggaggatgctggaggggtaaggactctggcaaggagccctggggatgctaccaacttgtccccctttttcctttaccttccccccagggtccagcctcctgagtgcctcctccagagctattgaccaaccctgctcagggcctggctcaacctgacccggagccctaggactttgcctatagggaaagttcagctgcttatgcaaactctggcttggggggagatgtgtgtggttgagctgggagctggtggtgtgtgggggtggccttggaagcagagagggtgggtgcaggcgccgaggctgtctggaaagggagtctggggatataagcttggggtccatgggggtccctagaatagtggccttataatggctccaagagggtacactgggatttggcccagataatggagggacaccctggcgaaggggcagagtcctggcagttcagccagccccagctctgtctttttcttgaagctcaacagagtatggaaatcattggtctcacccagccccctcattcttctgagggggaaacaggctcagaacagggcagggactaaactcaggtcagcagtagagcccagaccagaacccaggctcagtccaagcatcttagttgtctccaatgatgataaataacagtraaaacctttctgcagagcttcccaggggctggcctgggcttaggcaccctctggatggtcttgggcagaygtttttcacatctcgagccttagctcgaggtccaaaatactacctgtactgggaaggaggtcctctctcccactgacagtccacaaagccgttttaggcatgctggacccattgtgggctttacttattgtttgttcaatgaatcccactgaattcatgtaacaaccctggaggaagatrctattatgctattttgtgctgaggctcagaaaggagaagtgacttgcccaaggtcattcagctgagaagttgctgacttagggctggactccaggggtccagatgcctgtctaggatccctgatggacacagccccatttttgagcctgcgctctcagcgaaaatcagttggtgtctcaacgagacccatcgtcagctgggcagggtgtgtgtatatatgtggaagctgggctgggctgctggctggaactcaagccacaccaacccctgtgcccctgtgtttggacctggctgcagctgctgcccgtgggggaaggggaccttgccacttgccctcctgcatcaagggttttttctccttggcctggctgcctgggcaaaggagctggctgtggcatgaccatgtgggcacctgccagcccctcccttgttggggtctgktcatctaatgcccttcacatgacaggcatggggtgggccctggctggggagagggatttgcactctcctaatccaagggctgcagccctccctctgtcttggccagggccgtgggagaggtttgtccttgccccatgcccagcagccccagctcagatccctggcatacacccagttcctctgcttggggccttcccctgtcctgcttctgctccccaccctcctactctgtgagcagaatcaggagctagggggcaatgctggggcattcaggactgatggaggtgcagtgctacatagcatgtgggactgaaggatgggggcgatgtcagggaggtttagggcacatgttggggcaaagttgagggaagatgattggggtgcagagcaggagtgtttggggctcatcctgggccaccccttcctggaaaaatttggctacaagtcagggaggcaaatgtgtgggccatgccccycccctcgctaggcagtaaacactgccgtcgcctgggagacaagaaaacatcttggtccccccacggttgtttataccaggactccctctccttctctggcctggtctggcctctccactcctgagctgggctacctgagtygagggtccagcccccggtcatggcaggaggccctggcagcacgcccactggcccccaccagggactgagcactcaccacctcctggtggcctgtcccattggaggccctaggtcttattgatcagaaacgtgctcccaagccttggcctccacgagggaggcctgggactgtgccctggatttgctccaacccactgcctgaatgcagtcactggcctcccggtaacctcagcttcccatgttcagtagcaggcaggatctagattagagcttttcaaactgtttcaagtcatagatctggttctttgaatgacacctgatacagaagcacaatatataaaacagatcaaagtagggctactctgggtggagtcaygggttggggcccagaattctacccactctatgccagcctatatggccctggcatatcaacccagagcctgtacatggtcctccttgctctagaacacattccaggtaaccctggaattccctggccaaatacttatgcctacttccagggtctgcacaggcccttctcccaggggctgtcagagcagccctaggctcaaggacggctgtttgtagtgggtatagcaaaagcccggaagagcaggctgaggcacccccaggagtgtacccaaggcccctcccagggagggatgggcccagtgtgggaagagaatctgaggatcggagggtagcaaggggctggctgtcccttccctgctggattccagcatgggattccaaggcatccaagaactaaaattcaaacctggtcttctaggtcattatgaaggtatatgtgtcaggaaggatagagcaaattttatttaaaagtttgttaacctgattgaaacttttaaatatttagacttatggtatgtgggtctccatttatactctctccccagtcctgccagagttaggggtgagcttgcatcaatcctccttccacccacccacctacctctgcagcaaccccaagacagccttacccagaactctcaggcttcacaggacagtgtggaagtcccactcgctgaaactcaaggccctggtgactgcatctttctgttcactccccagatactgtctgagcatcagctggggccagcctgggggttgtggaggagccagactggccttgccctagagggatggatctcagtgaggagtaagcgggtaggaacactctccctcttgtagaatagtgtgagaaggggtgcctgagggggcccacaggggccctggaatcctaacsaggggctaaagaagctcctctattcaaagccgatcatggatggatgaggtggaagagagacagcccaagaaggggagacagtacaaaagccaccaaggtggaaatgtacagggagtggagaagtcgagtgtcgctggtgcttaggatgtgtgtacagcctcaaacgctggtctaaggagcttgggttttctattttaacagtaagaagctgttgtaggattgtaaatggggtaggggctgaggaagaggcattcagactgcaaggtaagtggactggaggtggggatagggggctggaattgtggtggtcagtgagaggctggctggggggaaggggaatgggggtgagtcctgggctgaccaggaatgggacttgaggggctaggaagaaagaggggatcttaactctgctttctgggaccacatctcctatctcctcctcctttgttctgtctcagtttttgtcttcttctcctgctattccactgccctaggtctccaggctggggagaggggcactcaccctaaaccccctctccaaagcaggccacttcacacaagtggccaggcaagaggccgcagttgtataagaggcttttctcagctggctggactactcattcgttcatttattcattcattcactcaacatttattgagaacctacaatgcaccaggccctgcactaggttttggagagaaagtaggaacaagatcaagtacctgcattcatggagyttacattgaggggggcgggagaaccaggaactgtatctatccccggtgtctaccatctggcacctgtgcctgggctggatgcctgggaacagggactcttcccattacctactcatttgttccagctgccctgtgtcagcactcacctctctggacaatgacagaggagaaggggtcccatgcccaggatgccagccccagggagcacctgtctctgtaagaacagcctggccctcggggccaggacctgggctcaggcctagttcttcctactcactcctgactttgagccctttgcaaggacccgactttgatttctttatctgtcaggtgggatttggggaggtcctgaggaggcgaggggaccagaatactggacctcagctccagtattctcccttggtgggcaactcctttggctatgatgggagggggaagggggcttgggactcaatattatcatcattacccatacaagatagtaatagttgctacctattgtgtaatttattccgcactatctgtatggtcggtgtgtcttctctccccattttccggatgaggaaactgagtctccgtaaggtgaaatgacttacttgaggtcacacgtgaaactacctactccaagagccctttaggatggtgctgtgaggtggaagggcgaggccgaggcggcggtggcgtcgcgtcccccctctccgcccctggcctcggggacgcggcggcaccttcacactttccgcttggcccgctgctcgcctttcaggccgccgcgttttcaattgttaatttggaaacggaaaaagtagccggccgggcgggggaggccgcggggaggtaaycggagccgcagcaccgccccggcccctcccgctctcggggcctggcattggcaaagccccgcccctcccagggacgcaagagccccgcccaccattccccgcccccggcatgccccgcccatttccgtaagccccgccctcgccgaggcgggctgggggcacctgggagtgccgagcagtggcgcccctgctgaggagaaggagcccgggcgggggaagggggccgagggctgtgctgggggaggagtcccccaggagccctccccgcaggaacccgtacctctcccgagaagtcgcgcagggtgtctgcttcccttgtccctacgtgaacccaagcctttctgcaacccctctgtaggttcacccaggggagacccctgcctccagactgccggaccagggatcattggtcccattagaaagacgaagaaactgagtcctgagagggacagttaacttgctaaaggtcacacagccaaggcagagcagagctgaattcaagcccattcttttgactgagatacatttagggactgtctgcctcatttagaagaggagggggcatcaggaccagagatacaatttgtccccttccccctatctccagcacggtttctgtggttagtaagttactggaagttctgcttatcattattcaattatgggagggttttggaggtagaaggaggtccctctaaactttccatgtaaatgaaatgtaaaagaccctcttctggggactcccagaacacagaagtccctgaggactggcagcttcaggagccgtccacggccttgcttcccattagggaagctggaattgccagtcccagatggatcagcaaaaaatagggccctcagagactcccacccaatcccttcctcccactgaggaataagctgagactcagacacagtttcccaagtcttcagctgactggtggcggagtcaggagacagaacccaccgacccagctttctagctgtgtccacgcccttctgcttctccctctgctgccccccaatcctgacacctctctcacagccaccactcaggatcctgcctccatcagctgggcctgcaggctgggcagcctttctctttacaggcggaggaaactaagaagagtatctgcagrtgtcctcccagcttccagttaaagaccctcccaaccacccttccaccttagctgtgggtcaggcccagagaagctgcgctcctggcctcgagtcacacagcaagccttttccagcttgcaaagcccactggattcagtctggctggtcctggatttggggttcccactgggagcatggctctcagggcagctgtaaccagatgccccaggtgtggcctgtgagtttgcatgctgctttgcttattagtaacaaaggcattgaaacccctcttcctcattgtgtccccaaaccacccactgggtggggtcctcaatggctgagtctacagaactcctgggctgggctcagtcttggcacctgagctccccagggaactctgccctccacggtgctcctcttcgaccctgtcagctcttggtgctctctctgccctggaagtactgagaacccagtggcaaggactaactctttcccttgtcttggactcttccctccctctccctcccccaatatagtgcacaggttctgctgactcagaggacagaaggctcctttgaggttaccctgacccctgccaggttcaagtagctgggaaactgggcaatgcttgaacccactgccacaaagtcacatgcagcaggaagggcaggggcaggtcccatcttggccccaggatgagggaatttttgaggtgggagtgagaggcaggtgcctgagtccttctacagacagaggagaaatccaaagaacattgcattaggaatcaggaaatctgggtgccaggcccaactctgtctctgatctactgtatgatcacaggtaagccaggcccctctctgggactcagtttccccatctataaatgagaaggttggttaatctctaagggacctttcagtgcccagatatagccagtatctggtcatatcttgccacttccgcttcccctcatacaagtcaccatcatcagctggtagtggctcatgcctgtaagcccagcactttgggagatggaggcaggagaattgtttgagcccaggagttcgagacgagcccgggcaacatggggagaccctgtctctacaaaaaataaatataaattagtcgggcatggtggcacccacctgtggccccagctactcagggggctgaggctggcggattgtttgagcccaggaggttgaggctgcagtgagccgtgattgcaccactgcactccagcctgggtaacagagtgagaccctgtctcaaaaaaaaaaaaaaaaaaaaagtcacacagggtgaagtggcatgtgcctgtagtctcagctactcaggcagctgaggtgggaggatcatttgagcccaggagttctgggctgtggtgagctattccaatcaggtgtccacactaagtttggcataaatatggtgacctcctgggaacagaggaccatcaagttgcctagggaggggtgaactggcccaggtcagaaacggagcaggtcaaaactcccgtgttgaccagtagtgggatcacacctgtgaatagccactacaatccagcctgggcaacataacaagaccccatctcttaaaaataaaaataaacaaaacaaacaaacaaacaaaaagtcactggcatctcttgccaggattatactttccaactcacaatggggcaaacgtcattgctccctcctcccctctcccccaccatagtccgttcactcagcagcctgtgtgatctttttaaacataaggaagattgagctactccctgctcaaactccccatctcactcagagtaaaagccaagatccttaccatagccagtagatggtccgctttccacctcccctgcctctctgccctcaccccccaccactctccccttgctcattccactctgggatcactcctttcctggtagttctggaacacagaaggcacccttctggctcagatgtgttggatttgtttttccctctggaggtgggatgggggttaagggagcatgaggtgggggctcygacctaagcctgccagtctgagctcatgctcagacacagcatgagtaaaggtggggaggggaaaagagcgcgtttgccattgtcagggacagagctatgataatgcagtgccaagtgtcaggttgggtaccggctagtgaagagcaagttggcctggtgggtggggctttccttgcaatcatgctaaggggtttgggcctgggcccacaactcagtggatttcacactttttaaaaaaacagcaaagctttttgttcacatgaaatttttttttttttttaagatggagtcttgctctgtcgcccaggctggagtgcagtggcgcaatctcggctcactgcaggctccgcctcctgggttcacgccattcttctgcctcagcctctggagtagctgggactacaggcgcccaccaccacgcctggctaagtttttgtatttttagtagagatggggtttcaccgtgttagccaggatggtctcgatctcctgacctcgtgatccgcctgcctcagcctcccaaagtgctgggattacaggcgtgagccaccgcgcccggcctcacatgaaatttttacgccaaagccagcatgtaaaactgagccacccgaatctgcacggagctgctcagtggaaccgagggaaggtttccactagccatcttgcttgagtttctcaaatcctggctgcctaaattccaccccatgtttccccttyctttcaatggcatcctgcttgggagggcccacacctccctgtttgagaagtcagctctgtctggccagtcccaacagatggatgcccctgtgtcctctttgttccactctggctcttgtcaacacattgctcagcccactgacctggtgcaacaggtaggcaggctggcacggcagaaggaagcagacagaacaagtcggaaggtttggggctggtgcaggtgggagaggaggaagctattcctcatcaaacaccttgtctagaagacactgcctttcatrtcccgtgggwcagaaaccattcaagctggctcaataaaaactggcttctgtactattacatttgggataaagaaaaagaaaaattggcttctggaggtagaggacagatatggtaaggaaagagaattctttagaggcttcaaggcagaaagcacattttggattcatgggatagagagcagggggatgaggttccagcgtagtgcagtctcatggcccatctctctgcacctctgccaactttcctctgtggttcttagttccattcctgcgaaagacaatcygattggctcagcccaacctatgggtgggcccttcttgggtcagtctccagctctccatgaatctgtggcggccaggagagtgctgtggagccaaccgcagggctgtcatgtgtcgctctgcagtctgggcgccacaaaggggccggctgagagggctgaggggtgctggaatccagcctatgcccaggggtggggcagcccaggggaagggatgcctgtgctaatgggtccgtctagaggggtcaagtttttataacttgtcaggctaacgggaatgctttttttctaagccatcctccaagagggggcatttttttcatagtttgttctatgtgctggcggctgctgtccctccagggacagcctcagggaaactcagctgagggccaactctctcctttctaccccactgctggagagtcacaaggcggaagggactttggccattactgagtagtgctccacctacatgttgcagacagggaaactgaggctccatcagggccccattgcaatttctaagccccagcgcaagcctctggcccagagaagcagcagcggcagtggcggcggccctggtgtggggccctgggtcacgtgctcttgctccctttgccatatttagaatcgctggatcaggggaaacttctcctcccagcccctgaggattcttggaaagagcctcgctctgaggcctggcttactgcccctccccttattcccctgcaggagaaagtaagtgcctgctctctctagaagagtctgggggcctccaggctgccccccttgtcaggaagtgcctgtcaagtctagctgaagtcccttcttcggtatcagctccggtttggggtttaaggagcccctttcttccagaaggtgatggtggccatagcttctgccctctagggaccttggctgaatggaggacagactggcctcagggtcctccagctgaggggagacagagccctgcctttgggccctggtctagggggcaaggaaagagtcacgcgctccccaggccagatgcacaaatcacttgagcttgggggttggagaccagcctgggaaaatagcaagaccttgtctctactaaaaatcaaaaaaaattagccaggtgtggtggtcccggctactcaggaggctgaggcaggcagatttcttgagccttggagagtgatgctgcagtgagctatgattgcaccactgcattccaacacaggcaacagagcaagaccctgtctcaaaagaaaagaaatcagggaaactgctggtggctgggcagtccccagacactggcagggctcagtctgggagggacgctggaaagacgagggaaggaaggaggctctggaggaaggagggggcaaggcctggatctgtatttaccttggccttggtggatacttgggggtggggagcggtcctcttctcacacaggctgcttcctactggataatcaagccttaaaaacaaacagcaacaaaaaacctaaataaaaccctgaaatgcatgtgttgagtgcctgtgatgttccaggtctgaagagccatcctcgctgctgaggataatggtcctgtgctcccatgggacccctctccaggcgtggtcttttctcccaccttcctctcccagctccatacctcctccatctcttcagatcccccaccccaccctcctgcccacttctgagagttgggccttgcctcttcccagagcagtccccagtgagtaggggctgtcggcctcctcccttcccacagcctcctcccacctacatgccttcctgtccctgtggaagctggagggatccttcctactccacaccagctcctccctggctctggatcccagcctcccatcttccttggggacttcattccattgaytactcactctgtctccccgcatcttcaacttctccttcttgatctcttggctccttccactctggctctctcatcttaaaagaaaagaaaaagattccctataccctgcatccttctccarctacgatctctgatctcttctttgcagtcaaacatcttcaaattgttaaacctacacttactgtctctacctcctcactgcccctcccctttctcactttttctgggcctgttctggtcttcctctccttctgagagaaggctgcccttgccaagggacccagtgaccaatgtgtcaccaaatccagaggacatttttcacgccttatctcacttgacctcttggcagcatttgacactgttgtctactcccgctttgaaacatgttcttcacgtggcctctctgacacttctctcttctgctttccctcccagctctctggctatccctcccagtctgcgtagagggcctctgttcctgctgcaccgctggggctccatcgggtcctcctctaactttgctacaagctctctggactgtctcagctgctcctgtgacctcagtcaccacctctaccctgatgtcccccagatctgcatttccagccgggtctctctcttcatacccatggagtgtttgcccagtgcccatagccctctctctctctcaacatgcccaccacccaacacctgctcctccagtggggtctcccccgtcccatgaaggcactcatggcaccttcatccatccaatgcccaaaccagaaatagagaagttgttctccttcctagttcccgtttccagttaatcaccgagccctacttcctgcggtgttttccaacccatccactcctcttccctgctgccaccaccctgggccaggccacagtcatctstcgtctgagctattgtggagctttcttggtctttctgctgagtcttatctcctttgatctattctgtgtacttccccaagtggtcctgagatgcaaattggactgtgtcatttcctctcttagaactccacaattggccaggtgcggtggctcacgcctgtaatcccagcactttgggaggccgaggcaggtggatcacttgaggtcaggagttcaagaccagcctggccaacatggtgaaaccccgtctctactaaaaatacaaaacttagccgggcgtggtggtagtcacctgtaatcccagctactcgggaggctgaggcacgagaatctcttgaacccaggaggcggaggttgcagtgagccaacaccactgcactccagcctgggcgacagagtgagactccgtctcaaaaaaaaaaaaagaactctacaatgactccccattgcctttgggatcatgttcacagtgcctgagaatgctactcaaggcccctgggtctggccctctctggtttttccactgcccccttcactttaggccacaccatccagaactgctggccgttctgggctgcctcgacggccacattcccactgcttgcacatcctgcttcctctgcctggggcaccccgacccctgtccagttacctcctccaagaagtcttcactgatccctccactttggttgtgcggaaggcttcttgggactctccccgaccccttgagtacactgtcatggcctcgtccatcccgtcaccactgtgtcatgttctgtgttgttaattccttgggacctggattattcatttctggttttacaataaacctggctgagtgtaggtgtctgaagtgaatatagcccagagrggtcaggtgacaacctcttttctgctgtgagatgccctgccatctttcctacccccatcatatccccatctctctggcctggcctcccagcagctgtccctccagggacatgttggacatgtcgagagagagagccgtggacactgggcaaacgcccagtgggtatgaagagagagacctcagctggatccagggacatccccagagaatctggagctgagctgatggccgatcctctccaccccactgctggrgagttaccaagctacagggaccttaaccatcactgagttgtccccgacctttgtgtgtgtttctgacagggaaattgaggcccagagcattagtagggcccggtggtccaggtggtcttgggctcaggtcctgcgcttatgactttgaacaagtcatacctttcttttctcatttgaataacagctttattgagatataattcacatacagtaaaattcctccttttaaagtgttcagttcagaggattttagtgtattcacagagctctgcagtcaccacagtatacgcctctgaaccgccctctccttatcagggtgatgatggtacggttccatggggtcactgtgagaactcattaagaacatgcatttagagggcttggcacagtgtctggccaataggaagcctttggccagcaggagcagttatggttattacttcaggtcaccrcatgagagccacctccccagcagagctttccccctcctgccctgtggccgcttctggacagtgacttgaggaggtataaatgtggagaaggcggtgattgcagttgtttaaaagccctgagctggctaataattgagtcagctgcaactgctcccatcacctaagccagtgattctcaaagtgtggtccccataacagcagcaatagtatcaccagggacctttgtagaaaggcatattttccacttcaaacttactgaatcagacactgtaggaataggtcccagaaatcagtattttaacaagccctccaggtgactctgacacccaccgtagtttgaaaaccacaaatctaagcaaaccattcactttttcatctctaatcctcttgctccctcctgaacgagtgggatagtcatgggatggggagaygggggaaatggagaggaaaggttggataagccttgtgatcagaccagctggggagagccagccaggcaacacccgcctgtctcattctgcctcctgggctgggcagggagaaagaacatgggccacaacttgcaggcagacatgatgggcaaagatgtcctagaaagtggccgctagtctggcctgtctgctggggagattagagagggcccaggccagccagcacccatgtttcatctatatttgtatagatggagaaactgaggtcccagagggggccagagagaatccttagaaagtcctttgwtggatgaatgaagccacaccctagttgtggcaggcatgagaccccagctaaggggctccttcaccttgtctcctctacccctgacctccagatactgatctctcttctgctgtccctgtgtgaggaccacccccactccaggaaggccaaggcagcttgagggtcagcctgagctggggttctagctgcagctctgccactgattcactgtgtgatcctgaacaagtctatccctccctgagctctatttcctcagctggaagatatggataattattcaggtgcctggaacacaggatcttttctttttttgagatacagagtctggctctgtcccccaagctagaatgcagtggcgagatcacagctcactgtagcctcaacctccctggctcaagcgatcttcccacctcagcctcccgagtagctgggaccacagatgcacacccccatgcctggctaatttttgttttgattttttttgtagagacagcatctcacaatgttgcccaggctggtcttgacctcctggactcaagcaatcctcccaccttggactcccaaatgttgggattacaggcatgagccaccrcgcctcgtcccaggatgttttctattagtccaagtatatcccttcaaatgtaatgagagtatcaagggtatagaaactcttagccagtgggttaaagcagggagaagtgaagtttgggggctttttaagcagcgtccgccaaatggagatggtcaaggtcagaggcgttactttttaggaaagacatggggcagccagaggagtcagggatggatgtgctttggggacctcttcagtgggtacaaactggaggctttggcttggtaacatggtgttttgatgtttggttacagtgaactcctgctattcatttacttagtctttcaatagtgctgtgaaatcaatcaagcaatcggtcagtcagaataaggggcaagagagtggagatgaggccattctttcagagaggggatggctggggaggcccctccaaagaagtggcattggaacagacctgggtgaggcagaggaaacagtaaagcaggttcaaagcctggaggtggaaatatgttaggtgtgttccaggactggcaaggaggccagaataagtggggtgcagtgagccagcaggagagtgaagaaggtcaagtttggaggcgggggtggaggcacagaccttgcagggccttgttgtcagtgccgaggagttggactttccctctctaagtgcgatggaagtccgacgagagttttgtggagagcgatggtttccagctgtgcattgtgggaagatgaccctggctgcgttgaagggagtggtcacattcaggcacagtggaggcagggaggccaggtaggtgccagatggtggcggcttggttgggatggtgcgacctggcctgcccagggatagattctgaaggtagagccaatggaatttgctcagaaggggatgtgcagggggagggaaaggaagaatgaaggagcctgagccctgggggagccgtggtgccgttactgagatgggtaggctggaggtgaggaggacttgaggacaaattgagaactggtgtttggaggtgttgggtttgagaggccaccagacatccaagaagagtcattgagcaggcatttggacacacgagctggacacctgggagaggctgccacatcctcactcctgctaaatggcagaggcgactgtggtcaaggggtggggcaggatccaaagtgggcttttcttgtttttgtttttgtttttgtttttgtttttgagacggagtctcactctgtcgcccaggctggagtgcagtggcgcaatcttggctcactgcaagctctgcctcctgggttcatgccattgtcctgcctcagcctcccgagtagctgggactacaggcatccgccagcaagcccagctgatttcttgtatttttaatagagacagggtttcaccgtgttagtcaggatggtctcgatctcctgaccttgtgatctgcccacctcggcctcccaaagtactgggattacaggcgtgagccactgcgcccggccttttttttttttttttttttttttgagatgatgtcttgctcttgttgcccagactggagtgcaatggtgccatcttggctcactgcaacctccgcctcccaagttcaagtgattctcctccctcagcctcctgagtagctgggattacaggcgcctaccaacacgcctggctaacttttgtatttttagtagaggcggggtttcacgatgttggccaggctggtctgtaactcctgacctcaggctatccacccacctcggcctcccaaagtgctgggattacaggcatgagccaccgcacccagcctgcattttaaattttatattagtttgttattaccgaaacaacccatgtttgttccaaacaatatattagaaatactggctgggcgagtggcttacattgccagctctgggaggcagaggcgggaggatcacttgagcccaggagtttgagaccagcctgggcaacatagttcaaccccatctctacaaaaaatttaaaaattagccgggtgtggtgtcatgtgcctgtggtctcagctactcaggaggctgaggtaggaggatggcttgagctcaggaggtcaaggctacagtgagtcgtgatcatgctactgcactccagcctggttgacagagtgagaccctgtctcaaaaaaaaacaaaacaaaacaaaaaatagaaaatacagataagcagaaagcaaaacaaaagccaaatcacttaattttaccacccatagataagccttgctgactctgggtacgtgtgtaaaaaccatctctgtttcaaacattgggatcacattgccgttaaggttttataatctgctttcctttttttttaaattgtgaagtggaaattttatagatgtgtaattactgacatggcaagaaaagtgttaatgatggccaggcttggtggctcacgcctgtaatcccagcactttgggaggccgaggcaggtggatcacgaggtcaggagatcaagaccatcctggccaacatggtgcaaccccgtctctactaaaaatacaaaaattagctgggcacggtggcatgtgcctgtagccccagctactcgggaggctgaggcagcagaatcgcttgaacccgggaggcggaggttgcagtgagccgagatcacaccactgcacttcagcctggtaacaggatgagactccatctcaaaaaaaaaaaaaagcaaaaggaaaaagaaaagtgttaatgaaacattcaagaagaagtccccagagtggcccactgctgcctgagcttctgaggtcagctgagaaacgggactggagggtgtctgtcaaggccggggtaaagtcttaaaaagtcctggctgtggccattccccgaggagagggctgcatgagataacctcatgaaggacccttctggtcctaaaccctgcttcagctgcagtcccgatgcaggtacatgtggccgctgccttttttgtgattaattattgaacatgaggagctggtgctcttctcttctgttctcccgtaccccgtgtttttgctgactcagctctggtctggaactggccgaggaataagctcttctcgaactcattcactcataacactttaccgacatctgccacctaccttctcaaaccaggggtatttgctgggatacacttgccccccaaaaaggtcaggaacccctgtccaggaggtgtaagtgagccagggcagtgccacgccctttgcatgtcttccttccatagcccccacttcatagataacgagatggctcagagaaggcaggtgacagtctcaaaaccacacacacaagcaggactgggatccaaactcaggtctctctgaccccgagctgctgtccttaaggtcaccacraaacatgaatataaataaagccacatagaaggtgacttgggccacacatagggaggcaagcatcgggagttggcagttctgaaggggggatagtggggtgcgggaatcagaggctccgtagagctttgtagcatttgtgttcctgtaggcgtggacgatgagcagagtctcgcaggcacagacatgaggtgttctgcgtagcatgcaccgtgccagcaacggtgcagaggtggggagactggggacatctgggaaggctggcgggtcagtacacagagatgtatttccagagaagcctgttccctccggagtctcctccagggtgtgtgcatgttcagcacacccccatcctaaagaggggtgctcctggaggccacctcattcgcctctgctgtgtctgcagcctgtgacctctcacctcgctctccttcacccatccacataccgcaaggccaccagtttctctcctcatgcccttggtcctcttcccatccactgggaggttgggaaccctggctctaatctcagctctgtcctgggcacactgggcgacaaagggtgagtccttcttcctcttcgggcctgtttcctcgtggtgcactgggggatgagggaagtattggatgtgctagggtctaaagttccttccatttctatgtctctggttctgggccactctgtagtttcatgctgtctgcagggaagttcctggcctcgatggcccagctccacactgcccaattcccctccctacatcctctccctgctgcatcattccttctctacctgtcctccatgatcctctttccttttctagctgtctcgttacttaattccacgaaggcaggggcagttgtcccaattctgcagatgaggccaggctcctgccactttggagtgcataagaaagaaggtccctccttcatccgctgaccttccctgagccctgggctgacctctggggcacttctcccaagacatcttaaaaccaagctggggccaaggccaccacttgtggatggctagacctggaggaaccctgagtcagtctatttccactgccagacctgctactcacagatgagtgactacctctctgagctgcagcctgcagcagggggcaattgagatagttgtgaggtccagtagcttggggcttgagggctgctgcctttggtgcccagcacagagctgtaactccagggaattccaattctgatttccacataattttctgaaaataatgttctcctctcttggctctgtaaccccctgccaggggcaccttggctgtcctgtccctccaacaatctaaccctctccytyatgttgtaattgcagatttttgctggtcttcagctgcctggtgctgtctgtgctgtccactatccaggagcaccaggaacttgccaacgagtgtctcctcatcttggtaagtgctgggagtccgggactgaggggggctgtgtgaggtagcacctctgggctgggagtccgggactgaggggggctgtgtgaggtagcacctctgggctgggagtccgggactgargggggctgtgtgaggtagcacctctgggctgggagtccgggactgaggggggccgtgtgaggtggcacctctgggctgagggctgaaggtggaaagaggcttctcataccatggctcagagagcagcttgctgtgctgtgttccctcagctgtggctgcccctctctgggcatcatctccactttatagcaagtgttgggggacctcctgcctctatgcaagggcttatgatgggtccagaatagaagtgagtaggctccaccccttctcaggacaaaatctgcaaactccacgtgtggtggattttaggtcagtttttgcctaaacacaaaacaccaaatggaagcccctcagagggagacagctgacagccagcaaccccttttgtcaccaggtcagagttagggagtctgagacagctgggacagggagggcctgttgaggagcagaaaaatccgatcakttcatggggaccggaaggggaggacacactagggcttttagtcttcttgcaggaggcggagggggccacctgccctccggaatcgtcaagtccaggaaactccaggagaggggtccgaggaggccctggtccccctaacccagggactcttggctgggtccgcgctgtgacctgggccccagttctggagactgaggaccagaactcaggcccctggtcccacaggaattcgtgatgatcgtggttttcggcttggagtacatcgtccgggtctggtccgccggatgctgctgccgctaccgaggatggcagggtcgcttccgctttgccagaaagcccttctgtgtcatcggtaatgaggcgcgccccgcccgacctgacccctgaccccaggagccagggtgacgcctttactcccaatcccgactctgaccctggagacccgcacagattcagcggaccctccccctccctccccagtcccctgccacatccccagaagtccccgsctccgggtccgtgcgcggggtaggctggctgtgatctcgccgcccccgcccctgcagacttcatcgtgttcgtggcctcggtggccgtcatcgccgcgggtacccagggcaacatcttcgccacgtccgcgctgcgcagcatgcgcttcctgcagatcctgcgcatggtgcgcatggaccgccgcggcggcacctggaagctgctgggctcagtggtctacgcgcatagcaaggtgaggcctgcaasccgcgcgcggagacccgagggcgtgtctggggcacgaccrgagcgggcagggcggagagggcgaggtcagaggggctgtctccgtgctgggaaggggtgtggcctgcgggggttggagccctagcaggaggcgaggtctaagsgggtggggcgragtggaktctgaattaggtaggggcgggcctaggagtccggaccggatcagggggcggggccggagaggcggggcttgagggtttcccctggatgcttctgggtttgaagggaccactcgtaccacaaagtgggcagctgaggtgggacttgagggtggggctggagcggggctagggtgggccccaggtggaagcctgaaagtgggacttgggggacggggcaaggtaggccgggtgctggagtcctgagcctggaacctggagactcaaggcaggcggggtgggggtgggggtgggaatgggggtcggggtagggggagtgctggcggtttcgcgaaggccggggcagggtcgccgtgatgggaggagctgagaaagaaaagcgagcctgggactccgggagatgggggacctttatccctttcccgtgtggaagccccccacatctcccaggcaggcacagcgctcctcaccgcgcccctccgcctgccccgcaggagctgatcaccgcctggtacatcgggttcctggtgctcatcttcgcctccttcctggtctacctggcygagaaggacgccaactccgacttctcctcctacgccgactcgcwctggtsggggacggtgcgtgagggtctttgtagggctgcccttctccctgggatcctccctgggaacttcccgaggtctgcccatcgtgactcctgactcagggttgagcgggcctgcccctgccctctcactagagctgggacccccctgagaccagccccaatgctaaccccccaacctgctctggtggacctgcctctgtccccagctagccccgcacatcaagaccttgtgactatacccctttcccctgaccagcccaggagagggagaatccatctatgaccctaaccagcccccgtgggtgaccaggggccccttccctcatgatcaggctcctacctgcctgtacccccaacaagccgtaggtggcccccgtgaccagtcctgcctgtaacctgtttgtgtctccagattacayygacaaccatcdgctatggtgacaagacaccgcacacrtggctgggcagggtcctggctgctggcttcgccttactgggcatctctttctttgccctgcctgccgtgagttgcctcctgctcagttggtgggggaggctgagggtgggacctgctcacccctgtcacacatttgcctggggagcctggggtacctcagaggggcaaggatggggacacccttgcagcctcttactgccccaccactgcyagcacattcccccaaccatgccctatccctctagggcatcctaggctccrgctttgccctgaaggtccaggagcagcaccggcagaagcacttcgagaagcggaggatgccggcagccaacctcatccaggtacaagatgcccgggaagaagccctaggagcagggccgtgtgactgcactggtgtgtcaaccctgtgtgctgacccatgtccccagcccaactgtgacaccactttgaagctcaaaagggctatgtgactttcctggagccacatgccaagtcacacacagagccaggatgctcactgacagtgccagaaacttccccctgcaccaaatgcctggtttagggctagccagaactgccctattgcccaactccagcccaacttcacagggcctggggaggggcggagcccagacaggagctgggaggcctctggtggagacccactgctgcccccatcagctgtgcagcagtaagcctgccccacttccagcaccttcattcattcattcattccacaagcactcacacaaatgaagagargatggtgcagacagggcttttaggaatctcaacatttagcaggtgggtgggcctgcaaagttgagctgggcaaggagacagaaggaacagccagaggggtgggtaggaagccaggagtgtgtggtctcagtttccctctgtgccatggcgtgttgtgactgtgtgtgggctgaggccagggctctgattttctgtgaccctgggactaggccttggctttttctagtcaggggtgtgtgtaagggaactccttgcaggaaatgcttcagggaatactggcccagtccacctctgcctgctccctagcctgtcaccctctgagccccaaacccaagcctcactcagcccttccttatctctcctccccagggtagaaccctcctccctgtcgctgttatctccagccaccagctcagccttttcttcttagcgtcccttggggcacaatggccactgtcccctgggagctggccttctgaggggcattgtaggggcaggcggctggcactgtccatgccaagagacagctrgtattgyggtgcccataattaatgagacagctctggcagctgctccccagcccatgccaggggcctaggcaagcaggaagtaaaaatattcctgtcttaggagggtgcctggctggtgaggtcagcagtggcagccccttaaggacaagaggcatccaaagaagggaggcgtccagggcccagctctgccttgtcctgcctagcagcctccatgcctccctgctctcactgatggccacactcacagtccctccctggctcttcctacgtggagggagagggacagtctctcctcctgtctgactttcatccctcctgctgcagaggaagctcggcaagcccatggatgctgaggggttggtaggtaatgcttttcctcccctctcagtccttagtattcccatgggcagtgacaggcagctgggaaagatggagtggcattgctagtaataataatgacattctgcaaacatttgcaaagcacccacatgtgccagacactatatttgcactgagaatgcagcggtaacaaagacacagcttgcagtctagggggagagaaagwtatcagtcaaatacacaatgaataggtattcatcaaatgtgataaggggaataacaggagtgtttaacagaggaacctggcatgaagtgcctactatataccaggcactgagcttggcatttaatatacaactgttcatttaatcctcacaacaccctggtaggcaagtagtgttacatgcgttttacaggtgaagaaactgaggtcctgaagctttacttaatttgtcctcactaataaggggcagagctgggattggaaacccatgtctgcctgacaacaaaactccagctcttaacctctatgctctatggcccctggctctgacattgatctgctttgtcccctcggggaagtcgtttctccctaggccttactttcttggctgcccctgtcagtggctgtggaattggaactggcctctggctctgggtaacccacaactggaccaaggactgggttctttcaggggagagggctggtggggactgagaggcctcactgatgccccatcccccacgtcccccataccaccaggctgcctggcgcctgtactccaccgatatgagccgggcctacctgacagccacctggtactactatgacagtatcctcccatccttcaggtaggtcctgctgggggtgggggtgggtggggggctggcagcaatgccctttgaggacaagtggctgagactcaaccctggagggtggaaagggggtgatggctcccaggggagcaccctgggctggctctgcagatcctatgtaattcagagcctggagtgtcctttattccactctgctatgcccagggaagaggtggatactggacatagggcattggtgaagccctgccccatggctgaaccccggccctggagtgctggcagtgtgcatgctcacccataggtgatgccatctagggcagtgatacagccagctcgtctcccctcagtcctgaatgggggacagagttagtggatattgcagctggttggagaaagtgtgggatgggcagaaacatgtgttccagacttaggtgcatgctcctaccctgaacccccatgtaggaatatgtgcccacttttactgggccagtcagcagcctcagggcccagaagtgggtctgccccactggcccgggccaggctaagactgcatgggggtggcaccaggagagggattattaatagcatcacaaaggtgcgtgtggccaggtgcctggctaggccctcaggcaggaatgaaaaccatggagcccagctcggtcccacgggcaggcgggcatcaagcttgtggctggggcaggatgctgtgctcagcgcttctgcgggtgccttttttgcctcattagttctccaggagaagctgttgcgcgattccactcgcctctgcacctggcttccccatccctgcgccctcccagccctaggggcttcccaggggagaagcaggagagaaggggccgggaagaggggctcccagcatcacactggtgcccccacatctctccacccggcagaggcaagctcctacctcagagtgggaaggtgactagattagaagagaggccttttgttcaaggctgggcattcgagagtggggcagggctgatttgtaagaaatacaatgtgtatgagggaagatctgggggtgggggtggtcagatggtctaggacctctgcccagaggaacagagcctagtctggagattctggatccactgggcatctgctccctggaccttagtttgstcatccatrcaatgggaaggcaggcaggagagagggaagataccctccttggctcatggcagcagaaaatggcctggagagttaggaagaagccacggtcccgaatctagtcttcaaaaacccagtggcaagagtgagtgctggaggggaaggaagctrggctagccaccctgtcacacygccctcctcacctccatctccccttaaaatccagagtcagatctggagggaaaggatgtcagggccactgctggcctctctgaggaggcacggcacgttcaggcagtcagcttgatgggctgagagtaagctccttgcacggctgcccttgagctgtgccagccttcacatccatgcttggcatccctgggaaytgggggtagaaagggagtggggaaggccagtctcccactgtccaccctgtcctattctggccgggctgtcagtgaacacctctagagcagcaggacctggcaagatctgagctcaggagctctgtgcccactgggtgaggggggtggtgccatggccctgcctgccactgatggtgccctctcctgcagagagctggccctcttgtttgagcacgtgcaacgggcccgcaatgggggcctacggcccctggaggtgcggcgggcgccggtacccgacggagcaccctcccgttacccgcccgttgccacctgccaccggccgggcagcacctccttctgccctggggaaaggtaggggccccgtggggctgccacctcctcttgcttctcctcctcttcttccattctctgtcctcatcctctctcagacctgccttcagccacttcgtgggtgtctgggcctgtttgggggactcctaggccgtcagagggccagacaggtacagactgagggcctctctggaggggtcaggctggactcacctttttgtcctgtggggctctgagggtctgagtgggagagatgtccatgccatcctttcccatcatctcctccgttcatggcattgtcctctttctttctctgttcccacgtyccccttactcctccatccctgcacccccatccctcccgggaagctggacagaggaggaggccactggccacaggtgcttacggctcaggtaatcgtgggcaccatcctggggtgtgagggcagggaaccccctcccccggcatgttgctctaggagggacttagtactgaactcgcctcttgggaacgagatgccagctggaaagagagctctgtgattaagacctctgtaggacctgcgtaaactcagccagtgactaatgttcctttcttgtgcagcccttgtctgcaactttgctaatcccagagggtcctcttggggttctgtttccttccttactgaggtacactttggcgctcccagccatctctttccccttgaactgtctctcctgaagctttttacaaaatcttgaaagaagaacaaagaacaaacaatgcttacccccacataaacgttcctaaagagaagaatttcaggcatgtttggataagggaagcccgtccactcacagcatgggaaagtggctgctcttgtagaggtttagctttgaggtcaggggttaaatccccctcattctttttccctcgtcctttacccatctctttgttttgtctcatcttcacacatcacccctgaaccagccaaatggacatctggcctttgagcttcaatgtcattctgagccccaggcccagaacaaagaataggagaagaggcgagccgcccagtgatcagcaggggaggcgtggtggaagctcgcctctgccacccgatgctgtgtgtcctggaggaagccttcagtcattctgaacctgtgtgtcctggcggaaaatcggcagtgtttaggctgattggggctctgggtactctagagtttctgggctgaaaaggcctagggaggagttttggtgcagaggatgcagggagcagcctcccttccttgttctcagtgagggcacttctgggccaggggctgaacaggaagtgggtggagagggagagtccctccaggtctggggctggagggaggggaagcgtgactgccaggccaggctgagagctccctgggagagtagggcccctctcagattctctgcccgaaggtccctcattgttaccttcatccctaccaaacatagtttccaggcggaaactcaagagtttttgtatcccagcaatcctgtccaggacctgagccagggctctctgtgcttccagttcactctggtctcattttgactgaataggaaggcaaggggaatggacattagcctggggcctagtacctgtacrctccccacggctcctttggtccctgacacccccagggcccaggaacagattactactaagggcttggctgtcactgactcccagcctcgtatctatctgcctgggaggggacttggcgagtgtctgggacacagggtgatggtagtaaagtggccctttctcccagggaccccagggggctgagccatggtttgtagatcagtcaccaggctcaggcccaatggccrtatcgttaatcgtggctgtctagacygccagccaggacacccttcctccaccaaaaacacacacacatatacacactcggttggccacacctctggtggtgcttggggatggacctgggccaagtgtgcccacaggaagtggtgctaaaggagcaggatttcctgggggatggcattgccagggccagcacctctcctcttcagggttttgcaatgagtttatcaaaccatggtctccagacctcctgcatcagcatcccatggrgtgtttgttcaaaatgcagatacctggacctgtctccaagcccacaggatcagaatctctggagaagagacacagccttctgcatatgtaacatggtccccaggggatccctatgcaaagtgtgagaacatctacgttctggtgatggggctggaggatgatttaggtgggggtccttctttcccaccagctaccggaggccggccccatcccagcagctccccacactctgcccacagcccctttcccgctaacctctgttcgtgtcttattctcaaacttccagccagatgtttaataataaacggagtttctttcggatccacgccagctggagaccgaggtaccccctcrcctgctcctcctgtccccactcctccttgccccacccaatttgggggctggagaggggacaggatgggccaaggacaaggtgcatgtgcctgccgcctgccgtctgccttgggtgcccagtgaacccctcgcctttctgggatgcctctgctaggtctggggcatgggcccagggtgccaggaggggcacgtgcaggagccttaaggatgtgtgctggctctgctgctgatgccctctgtgatcttggccaaattgcttcccttcttggacctcagttttccgtctgtggaatgggcagattgaactagaggacctctgagggtccttctcactctgacttttgccaggccttgggcttagctttctgtctccctgctacccacctggggacctagcagatgcctgaaggagctgggtttggcacctttgccagctccaggaccccagctcttttagcggcatctccatggcattccttggtacctgccctgtgccaggacttgctctgtgcactagggacacggtgatgaataaaacatcgtcctcggagagttgcaaagagtaattgcagctcagtgtgatgagtgcaacaaagggaggaagcacaggggctgtggagcccgggtcaggcacacaacccagaggaagccctaaaagcagtgggtttcagggagggcattccaggcagtgaagcagcacggacccaagcaaggaggcaagagggagcacagtgtggggaaaaaagctggcagcccagtttggcccccctgagactggacatcagagcgaaggttgggggcagagctgggtyatgcagaacctaaaagcccagtgtgagcttcaccctgttggcatgcttggcagcctgagctcatggagtcctgggtttccaaaggtgcctctggggccctgtgggctggggtcccggagctaggagatgagtggcagggctcctggctgcccatgtgtgcttctgctgagaggtgttttttcctagaaacgtgggttctggaccacaatctagctactacccactattcrtgtgtccttgggcaaatcacctgacccctttgcacctcagtttcctcagatgtaaaatgcagatgtaaayagggtctgcttccactaaaactggacctggctccaataaatattggccttatttgatttggtatgttcagcagttaagatcttatttaccttaaaagaaaatagcttagaaaccatggctgtgggcaatggtttgagctgaagcgttgagctaaggagtytctgggtcaggcccrccattttgcaagcctcctttggctgtggagggtgtggacaggaaggacacagccatggcagaggccagtggcgaggctgtttccatagtccctgaagaggggctgtatgtggcttcagaagtcgtaggctgcctctgttcccccagtgagagtggccctgggagggcagatcatgaggccctaaagaaagtccttgtggaagtgagttcaaggggttgggaccagcagggcagcctgggcagagctcggcctccccagcagggcagccacagtccagcccaccccatctttctcccaggtaccaacagatccttagccagagtttcttgaccttggcatcattgacattagataattctttgtggattgcgactatcacatgcatggtaggatgtggaacagcacccttggcctctacctactagatgtctacctactagacattgccacatgtcccctgagtgggggaacttgctccagttgagaaccactgctctacaccctatcctgattgcttgacccagaaaaagaacatagactctgaagtcagagaaggctgggttccagttcttgctccatctcataggagctctgtgaccttggccaaatcatctcacctctttccgtgtatataaaatagggatggtaaagaccgcccaccacacacagtggctgagagaactgaaagaactaaggcagcctgatgggaccctgcacgttctgggagcctgggaggggaaagagctttttggtgcccactgtgtgccaggttttcttccaccttcttttagctttcagacttagaggagctgatatgagccattttctgggccctgcccaaggaactggaatccagacccactcctgggaaaacagtgccttcttgcattaaaaaggagctcagggcctctggctggctggaaacttacagaaccccacaaaccagactggaagcttcctcaaccatcacagaatcagagctggaaagggacctttcaaggtctctagtgcaagccctcgaactccttcctccataagtcctgctgagtgcaagctcagccttgcttgcattacttcttttgacagggaggttgccctcttctccagaacgccattggagccttatgtggtgggcgcagtgatgtggagttccaggcccttggccaaagtgtcagggccttctccactctcctctcttcctctccctcttggaggagtggaggacaggagaargggttgcacggaccgggcagggtggagggtgcttgccagcatgagggagcctgcaggaatggctctgcagaggaaagtttgggagagccaacctcaaactttgattggaatctttgggatgtgtcgatggagtcctgggccagtggagagcatgctggatagtgggaactgggaactgtccctgtccttttgataccctcagggcccccatccttgacctattaacctctcccctctgggcagaggccgccacccctaaggatggccctacatcctggccaccttcctgaaggtgcccctggtttcgaggtctccctcacttcagcaccttggctccctcccctccaccccatgccctgggcatgggagaccccagttcccacccaataccgaaaccagaatctcttctctgctcaacccttgayctgaaagcctctgagagtaggtgacacggtgtcctcccccaactcctgccccacttcaggtctcctctaaggctggctggtactctcttgatctggggccccagacatttggggtgggtccccctgaacccraacctgaacctgtcggaatctctagtggcaaaccacagcaggggaggcagcgatgacgtcacagggcatgggatggaggacatttgcrtaggtcctaccccaacagccataacattgtccttgaacctcttggacacagagttactctaccagatcatggttaaccagggcttgtcctggggaatgaggcctctgctaacttgttttcctccaacgtttggggaacrtggtggggagttggatgcgggaagggaagtctgagtgcatgtgtagacgtgcacgtacacgttcacatgcacacagactgtgtaaatgctgttgaaccgggagctcagtaggcagtatsggggggtagatctttagcggggatccaagaccacacaggcaggatgtcaatcaaggtgggctgaacttaggtaggagagaccacagaagaacatgttatcaaatagagaccctcactgagagggcaggcaccaggcatggcctgggcatacatgtgggcccagcagctagaaccatggggccgaggccctcagtaggccatcacgctgcacrcctccagggcaccactgcatggaagtctgtgtgatggagtccttattttgcagtgcactgcctgcacagctgtacgaggccctaaaaccctgaccagtgtgggatcagatagccgcagcagtggggagtggaggaaaatatgaaatgacacatgtaaacacacgccaacatatgtacacacaccagtgcctgtacacccacactcgcacatgtgtgtgcacaaggtgtgtgtgtgcatgcgggcgtgtgcacaggcctgagcgcgcacacgtcttctgtgtttgctgtgaggactggaggcctacctccgtgtgcatggccaggtgagcttccgaccctcagcagcctgtctgtgcccaaaggggtcgccacccccaccctctgcccactcacctgcgccaggcccagctcccacatcctcctgtctgtgtctctgactttggatttctcccactccttccactctgacatctgtctcctgtgcaccccttatctgtccgggtgatgaggggtgggatgtgggtggtggggagaggatctgcttcgactgaccccgaatcagcctcttgtaggagtgagggcctcccttaccacatccttgttccatcccaagaagtctccgcttggcggggaatccagacctaatagccacccccaagtcctaagtcagctttgtccccactcacccccacccccagctctggctaacttggctctctcccaacctgcctgccctgccagcagccggatgggcatcaaagaccgcatccgcatgggcagctcccagcggcggacgggtccttccaagcagcakctggcacctccaacaatgcccacctccccaagcagcgagcaggtgggtgaggccaccagccccaccaaggtgcaaaagagctggagcttcaatgaccgcacccgcttccgggcatctctgagactcaaaccccgcacctctgctgagggtaagcccccggggggctgagtccgatcgagggccrgctgagggtggcagggcggggacagtctgggctgggagcagaaagatctggctcgcgtctcagctctggaactgatggaccgtctttgggctctggtcttctcatctgtaaaatgggcattataatatttgctctgctatacaatggacatcagactgtttgggaatcacgtggagggtggcatttcataggggttagcagcacaggctttggagcgagactgcctggatttgcatcctggctttgtcacttatcttaggcgagtgacctaatttctctgggcctcattctcctcattcataaaatgggaacaataatagcatccacttcctaggattattgtgaggattaaatgagataatccatggaaggtgaacagaagacttttgggaatatagkaggtgctcaacaaatagctaaacacaaatgtactttggaagcggcaggaatgcatccttgatgagccctgactatgcactgcccagcactggcttatctcatttacttctcccagtgaccctggaaagtaggttctgtttttgtccccactttacagacgtgggcactgagatctctcagcttgtgagtggcagaggtgctctcctcaagcaggtctattcagctccaaagcccaggccttctgcctacccctcttcacccagcccaggctgcaagtatgagactgtggaccatgctgatgtcacttttctgagttttggctctgctggagacttccactgtgatttaggcaggagactgcccctttccatgcctcagtgtcctcttcaggaaaatgagagggttggaccaagccccctggaagacttctcccagctttgacatactttaggcccctgggtggggagaggtggggtgagtgcacaaggatgggggatggggacagctccccctttggccttggagggaggggacccagccatgctgtttctgcctgtgctgtgtcagccctcaagatgctgctggctgacacctcagagtttacagaaccccatagaccagtctttgagaggtgctgcccatagaagcctgggcacagctggtgcccaggacctcccttccctgtcctggaagctgtccgggctcttgccactgctcctgtgaggcaaggacagcatcacctctctgcgcaacacagggcactagcctcagagaagcttctctcattcagggaagaatggtttgttttaagggccttccctagtagcagagctgggcctgggagccagccacttgggtgtccttccatcttagctgaaggagaagactgtgtgcatgattacatgcagtgccatcaaaccccttatctctggggctcactgttctgcaaggtggaaccagtggggcttcctccagggctttgtgcaacaaacttgccctggactaggccagctgtgccctaaagcagctcccacctacccaccaggcagatgtttaccctgactggccaccggggcagatgggcatgcaacacactggrgctttccaccctggggagggcagtgagacacaggagcccccaagaaggttctgagccctttctgggcctctgtcttcctattggacactctactggtggtttggcatacaagggtcggatgggaggttgggagtggccccttyggtgggccacttgccccatacctgccttttcagatgccccctcagaggaagtagcagaggagaagagctaccagtgtgagctcacggtggacgacatcatgcctgctgtgaagacagtcatccgctccatcaggtaagactgaggcctgaggcgagcacccccctccgtgtgccacccactgctgctccccatctgggcgggtggatcacttgaggtcaggagtttgagaccagcctggccaacatggtgaaaccccgtctctactaaaaatacaaaaaattagccagacgtggtggtggatgcctgtaatcccagctacttgggaggctgaggcaggagaatcacttgaacctgggaggcagaggttgcattaagccaagatagtgccattgcactccagcctgagcaacaagagtgaaactgtataaaaaaaaaaaatgtattttttatggtgggtcttggtcaaaaaagtttgaaagcccctgctctactggctgtctccatgcctcaaaaattaagcagggaccagggtctcctaggccacggcctaggcatggatctggcctccaagctccttggtgtgccgtcctggcctagtctccatctccagcctgcagctctagctccagaaaccccctcaacctccaagttttctgggctccccactttcttccctggctgatacacctgcccacaagcctcttttcttgtattccttttaaaattagagtcaggctgggcgtggtggctcatgcctgtaatcccamcactttgggaggctgaggcaagagaatcacttgaggtcagaagttcgagaccagcctgggcagcatagtgaaatcttgtctttgcaaaaaaaaaaaaaaaaaattaaaaaattagccaggcatgttggtgtgcccctgtagttccagctacttgggaggccaaggtggaaggatggcttgagtgcaggagtttgaggctgtagtgagccgtgattgagctactgcactccagcctgggtgacagagtgacaccttgtctctaaatagataaatagataaaatcagagtcagctggacctgtccccactaccccccacagtctgaagcctctgcttacccccttttcacccatccattctctcccctccatgtgcccagtgtcaaggacatagtacctgacctgccacctgacccaagccagctctcctgggccaccccaccgacctctcagccagcatgccccaaacctgctcctcttcctgggctggttcccatttcaggcagtggcaccaccatccacttggtcacccaagccatgggagtcatcctggactcagaccagggagactttcagccccacctcctgaactgctccaagctcttccatatctcctcccccatcccctaaagctagtttccctgcccacgcctctgcccctccagggtattctccacacaggctggcagagctggcatgctaaagcagagtaactgagccgggaacagtgggtcacacctgtagtcccagcactttgggaggctgagacgggcagatcgcttgagtccaggagttcgagaccagcctgggcagcatagtgrgacccccatctctttaaaaaataaaaattaaaaaaaaaaaaaacagagttattgatgtgcctgccccacaatgtcccattgcccagtctctgccagagatgcagggctcttcaaagcacaccccagcctccttctcgaggctgatctcctgtcttctcataccatggcaccctgaaccccatcctccaccccggctggttgattaacccctttccatctcatccctgtttctgctacttggaggtaggggaggctgggagacgcagcagaggctgttcatggtggccaagcaggaggtgccctggtgctggacaaggggatagcaaagagatggagagggtgctgggaaagaatccctgctctaacaggacactccctctgagccccctcccccaacaggattctcaagttcctggtggccaaaaggaaattcaaggagacactgcgaccgtacgacgtgaaggacgtcattgagcagtactcagcaggccacctggacatgctgggccggatcaagagcctgcaaactcggtgggtgcaccgggcctgttgggaggcaggggcagggaggcagcgaccccagccctgaatgaagtctgaggccaacccccgagcacccccaagggctcactgctgcagctgagtttctagactgaggaggtccctggcttgcagtgccagcctgaggccagacccagcacccgtcccaaggmtgagaaacaacccaaccatagtttctctgtgaggtgggtcctctgtgcaagccctattgactcataygccttgsgggctttstttagaatgactgtttcctggtcctaaaataatcagcctaaaataatcactgacctcccatctcccaagagaataggcaaattgtcctcactgcccacctcttgcctctggaatcctcccacatctctctggtagacccagcattaggaagaatcctcaccccaagacccacatcacctgcaccttgcccttctcctcttctggcctgcattttcactgtccactcattcatttaatcactcgagaaatagtcagtgggcatttactacttgccagcctgtggggatatggcagaaagcgcagcagagttcccacacttatggagctttcattctagtggaaggagaataagtgataaataagtaaaactggaatatgtcagacaacgataaatactaaggaggaaaataagggtcaggctgttagggtttgcaattttaaataggtgagaaggttctagagggaacagcaagtgccaaggacttgagaggggcaagtggctggagtgttggcttcagcacagcagggagcctggtgtggctgcactggagtgagaggtagraggtgaggtcagagggctaacggcactcagagagtgtaaagtcctgtaggcccctgcaaagacgttggtgttcatcyaggatgagctgcaagcattggagggttttgtgcaaacgactgacaagatctgaattgtcttttaaaaggatcaccctgggtgctgtgttgaggatggacttagcggagtgagggtggacacaggtagaccaatgagaacctgcttcagacttccacgcatgagaccgtggggacttggaacagagtggcagctgcagaggtgggacaagtggtcagattctagatacattttgtaggcaaagttgacagggttttctgatggggtgttaagagaaagaagagagtcaaggatgaagctaaggtttttggcttcagcaagaggaaaaatcgagttgccatttgttgacatggagaaggcaatgaatggagcaagtttcggtcaggagatttgggaggtgccgggtttgtgatgcctatctgacattcaagtggagtgttgatctggcagttgaatagagaagtgtggagtgcagagcagaagtacaggatggagatgaagatttggtgtcgaaagtgtagaggaattgaaaattatggatctgaagacatcaactagtgagtggagtaaatagagaatagaggtcccaagagtgagccttggatcctgcagtgtttccaggttgcagagatagaggaggaactaacaaaggagactgtaaaggagaggtcagggaagtaggaaaagaactgggagagggtggtgtttcaaatgaagaaagggtttgctggaagaaggggtgatcagatgtgttgagtgctgctagtaagtcaagtaaaatgaggacaggagttgatcaatggatttagcaacatggggttatttgggagcttgacaacagtagttttggtgaaatggcaggggtgaaagcctgactggagtaggtttaagagagaaggggaggaaaggaattggaggtagaggatagagataacactttcaagaattttgctgcaaaggagagcagaaaaataaggtgaggtcagttctagccttgtccacccaccttaaaagtcacattcccacgtgtctccactcctcccatcctctttccccttttccccaatccatcttttcttttcttttcttttcttttttttttttttgagacagtatcttgctctgtcgcccaggctggagtgcagtggtgcaatcacagcgcactgcagcctcgacctctccggctcaagtgatcttcctgcctcagcctcctaagtagctgggaccacaggcatgagctaccatgtccagctaatttttaaaaaattatttttgtagagaggagggcttgctatgttgccaagtctgtctcgaattcctgggctcaagtgatacctccctacctagcctccccaaatgctgggattataggcatgcgccactgcgctgggcctcctagtccactatttccattcctctttcaccagacggttgttttacttgtcaggttcgtgtgtggtgcctttgcttggccagtggagaaccaccagagcaggggccagtccctccaccctcaactcagcctccatctggcagggcaatggccccttccctcagattgcctgtcccctcgtggtgccttctccttcatcaggcaacctataattcttgtggaagggagggacggcgtgtccccgggccctctgatggttcccttacccttagggtggaccaaattgtgggtcgggggcccggggacaggaaggcccgggagaagggcgacaaggggccctccgacgcggaggtggtggatgaaatcagcatgatgggacgcgtggtcaaggtggagaagcaggtgagtgtaggatggggtggcggagctggccataccaagaagctctgggggccgcggtgacatggggaggatgcgtttcccacagccacagcccaagggtccccgagaagacctaagagccccctccccggccgaagcccccgccctcgccgccagacattcccataaacccgccctctcctgctaagccccgcccccaggctgcataagcccgcccataaccttcagataagcctacctcagttccccctactccatttgaccccgcctctcagttgtcgctgtagctcgcggactatccccatcggtcacacctaaccaccccccgggttatgcaccagtgcccagcttcgcccctcgctctagccaagctccacctttccaggcgggatttgtgcttcccagataagccccgcccactccaccggctagggtccgccccgagacccaagccccgcccccggccgcgtcccctccggtcccaggccctgcttcccagctgcgccccgtccccaggtgcagtccatcgagcacaagctggacctgctgttgggcttctattcgcgctgcctgcgctctggcacctcggccagcctgggcgccgtgcaagtgccgctgttcgaccccgacatcacctccgactaccacagccctgtggaccacgaggacatctccgtctccgcacagacgctcagcatctcccgctcggtcagcaccaacatggactgagggacttctcagaggcagggcagcacacggccagccccgcggcctggcgctccgactgccctctgaggcctccggactcctctcgtacttgaactcactccctcacggggagagagaccacacgcagtattgagctgcctgagtgggcgtggtacctgctgtgggtgccagcgccccttccccacctcaggagcgtgagatgccaggtcgcacagagggcagcagcagcggccgtccygcggcctctgggccccccagtgccctgcccactccatcaaggccctatgtggcccacctggcaggggcacagccccgggagtgggagcgggcgctggggccctgggccctgacccagcttccagctatgcaaggtgaggtctctggcccacccttcggacacagcagggaagccctcccgccaagtccccgccccacttgggggtgggccaaggtgcccccacaggtacccacaaagcacaggaccctgccacaaggcaggtggacaccatatatgcaaaccatgttaaatatgcaactttggggacccccatggggtctctctgtccctcccccattgggagctgggcccccagcagtagctggtctcaggctgcttggccaccaccctgtccctattctttggcttatcactccttcccctcccagcatggggcctgtttctcccctgccctctcctaagggcaatgcctgggcctttcttcccatttgcaagtgtcagctcccaggggctccctcctcctgctgggtggccactcccctccttggccctccagacaccactcatagtcagcacaggtttctgtatcctccccaaaactcccagacagtgcttcgtggacgatcgcacaaacatagccttttagtttctccagacaggaagaaagcctctcacacttaaacatgcaatgacgtgacacacttggagacatgagtgcagagccactcagccgctcctgggcctctgcagcagatgccagtggactggccttgcagggtgacgwccactaagaggaagacccccaactccatctgagcaggagaaggagctttgaagtaacccgagagctctccaggccccacccagacctttacccgctccccttcttcaagaagatctcctcctctctggtccaggagccctaacccactgcctctgcctgtccccaagggcccgcctccgtgtctccacagcacaactcgggcccaggcctgacaccactggagagaccccaggcccacttctagccaggcctgtgccttcctagtcactctaactcccagagagaataagaatgcatgtaatagctataccaaccgcgcatccggctttcacatgcactgtctcccctccctccacaccccacttcttcacttcaattggcagcgccacatccaggcgtcagcccccattcactccaggaacactttcttatccccacccctttgctcctcttctgcaaagccaatgcaggtggcaggaaggtgaggggtagtggaccaatggcaaccctctgtgggaacaaggggccgaggccacgctgcctgcatctcgtgctggggacctgcatgcgccagcaccagggcttggactggatcttactcagtccatggtgcccagcctctgccccaacatgccctctgcatgtgaccgtcatgccctggatggagccactcctggctcaccccacctgcactgcactgtccccagagagccacccctccacccactcagagacagctgtggagagggccaggagaatgggattaccctatgaccaaggagacatgggaagaagccctccttccttccacgatcgaggttccgccatcaactcggttctcggatatgcaagtacctcactttgttaacttattaacttattggtttcattaaagttttcaagaggaggtgattgttcttggttttgttcagtggctgtgaggtgaggctcctggtttgggggtggggacaaggagatttggattggtcgggactctttgttgtatacaacaaaaacccaaccctgtatggtttaaacagacaaacaaaaagaaacttattggcacagagaactgagaagtccaggggatagatttggtttcatgcacagtgagatctagatgcttaaacgtgtcaggactcttgtttcctgtaagccttcctttctggcaggctgacctctcatggtgaccagtaaaattggccaccactttcctaatagtttgcatcagtcaagatcaagtcaggaaggcagaaacaacactaagtttttcagcaaaagaatttattataggtaatgggttacactgatgcaggagggctgaaagaacaaaagagaattttctctaggtgactctgagatagcctagagaaaataactgcagaaagcagttaccactcccagagctgcaagagtataggaaacaggttggggttatcagaacccacaagcttgcggagagggagcccggtagtgttggggctcagagatctgaaaaggaggtactccctggctggtgctagtacctcttaggggacacaatgaggcttgtctgggagtatgggaaaaaagccgaagtctgggatcaactgttgcaacctggctgttgctgataaggataggaagcaaaggaagagagaagtctccacttttcttgccttccagtcttcccctagtgccccttattgtcaaagctagcgaacaaaggagtgatgtggtttgcagagtcccagccccagtatcacagagttagaaggctgcacttggaactgaaagacaataacatgggcacgggccacccctttggacacacagtttccacaaacatcaatccatacatacttgaaccgccatataacgacagtagcttccacctagtaagatgaaactgtcctttatacaaatgaagacactctagtcccctccccctaaatgggaaaaacacaacgtcccacggttcaacagatgcatccatctccaggggttagtcactgaatccatatttgggttaagtattcctctaattcaggcacaattccacctacaactaaacactaaagtaaagttgatcatcacatacaatgtttatataaaatatgggagaaaggaggagggaggaaaaaataatatgtacagtgcacacacacacatgcacacacatcccaagcaaggaaggaagtacgcatagccgcaatcgacctctttctggtatctctggtcacagtgccatggttggtatgaataatttccttattccattgcccttccatgtttcctttgccctcagccaacacctcagctttttagggacctttttttttttttttttttgagacagagtctcgcttggttgccaggctggaatgtagcggtgcgatctcagctcactgcaacttccacctcctgggttcaagcgattctcctgccttagcctcccaagtagctgggactacaggcatgtgccaccacacccagctaatttttgtatttttagtagagatggggtttcaccatgttggccaggatggtcttgatctcctgatctcgtgatccacctgccttgtcctcccaaagtgctgggattacaggcgtgagccaccgtgcctggccagggatctttatatggtggagtgacccagataatcattcctgaagggtctgaatcctcagcggtcctgcatgggtgggtgtcacagcttttcattgacttttgctatcatacatggaagtacttattatagaaaggccttagagaatcccttgggttccagacttagtcctccttgccctgttgtgtggcagcaaccaatttccgctcggtaatgaagatcagtcatgcagccagtgtattaactctttatttttcctgctggttgagtggcatgaggagcccacaatggcctggttaaagtttaaacctccaatgtaatgaaaactatgttgcctcccttcccttgaaaactaagacctccaaactagcagagctcaatgctacagggaccagaggcagaagttttgtgagtgggtggagtaggctgaataatagccattcaaatatagcaagttctaatttctgggacctgcaaatgttacattataaggaaaaggggcctttgcagatgtgattaaattacagatcatgatatggggagattatccgagactgtctgatgggcctaaatccagtgacaaatgtctttttaagagagtggcagagggagatcaagtcacacagaagaggagaaggtgatatgaacataaaaacagggactggggtgatgctgccacaagccaaggaatgccagcagccacaagaaactggaaaagtccaggaatggattcttgcctagagctctgaagggagcacagccctgcacacaccttgatttgggctcagtgaaactgatgttgaacttctggcctccagaactgtgagagaataaatttctgttgttttaagcaaccaattttacagtaatttgttatggtaaccacaggaarctaatacggcggattatttggtgtcatagtgagagaagccactctcaccagctcccttggattcctggaaccttatatcctggctatgtcaatgaggataaacatacctgcttcatgatggaaagggtccagtgggatcgacctggcaccaagtggctaggtggacccttgcagagggatgatatactaagtacttagcatttgtcttggctggaggcaggttggacatacagtgtggcattagtcagatcagccttgacgagttacgttcatgttgttgaacctgtaaatagtctccattctggccaccatgaccacattgtacataaacatatggagaatgcgctggagagactagggagagaggctggctgacatccatccaatgtgccatcttgtccatcgaattatcaagagctgcctctgccatggatgactttgggtgagattttacttggaatacaaatatcttcatattctgtgtcatttctgaaagtccatctactagtctctcccagtttttcttatggccagtcctccagttctgtgctttctgaacccctgaccatccagccaaaccattagccactgcccataaatcagtgtagatccatacttcttgtcatctctcaatcagacaaaatggacaaccaaatgtactgaaggacaggtaggatggagccaggcctgggaactggggtggtggcagtggtggtgatgttccaggaaaaggcacagtatgtgatagggtccagaggcaccagtgagtgtggtagatgaaaggaacagaaagaaatcccgtggctggtcccagacagcaacggagagaggggtgcaagatgggactttagaattaggggtcaaagtttacaggatttcattaatcattccaaagagataggacttagccatgatagcagtggggagacaataaaagatttttctcaggcagcacactggggtagatttgcattttagaattttttttttttcctgggatggaagatgtatttgagggagtaagtgtgggtgtggggagagcaggtaggagactgctgcagtcacccgagcaggaggtgctggtaacccgaacaagtcccatgacatttcactaattgagttaaatgtctattgagcacccgctatatgccagaccctgcctcagcacaatatacaggatgaacagacacgggagaacaagttacagccctgaggtcatccagcccctgggggagacagatgcacaattaaccaatgcacagctactgtttatcttctaaatttgcctggctcagcaaggagagtttgcaggtggctctgggagtccccaaactgtcatcaaatacggccttgacagcagatacaattttagcttggtgtgtcatttatctattgctttgtaacaacttattttaaaacttaatggtttaggacagatgtggtggctcatgcctgtaatcccagcactttgggaggccgaggtgggtggatcacttgaggccaggagttcaagaccagcctggccaacatgatgagacccccatctcctaaaaattacaaaaattagcctggtatggtggcgtgcgcctgtagtcccagtcactcaggaggctgaggcagagaattgcttgtacccgggaggtggaggttgcagtgagccaagatcatgccactgcactccagcctgggcaacagagcaagattctgtctccaaaacaaacaaacaaacaaacaaaaaaccaccaacaaaaaaccttaatggcttaaaataacaactattttattttatttactcttgattctgtgggtcagcaatttggggtgaactcagctgaacagctctgctggtctcacctggggtcactaatgtgcttgcaatcatctggcatcaacagggtctagatggcccaagagggccttccccacgtgtctgcaatctggtgtgagttggtctgcaggcaagacggctcatctctgttctatggagcttctcatcctccagtagattagactgtacttcttcatatggcaagagggcaaaagcagaagccatcaggcctctggaggcccaggctcagaagctgtaccaaggggctcagctcactttgatgggtgctctgaatacgttgcgatgtttacactcttgtagatctaaaaaaacccatgcagttatttctctatttagataatttatttcatgtacttttgtttttttgagagtgcagagtgcagtggccactgcactgggccatatttcacgtacttttgacagctccaattgttaaaacagtttcgttttccctctgagaagctgagaggcacatcttcccctaccacccacctctgtgtatagcaggaccgtgatagctgctaccacggtgtgttggtctgtgtgggatggcatagcaaatatcatggactggaaggtctaaacaacagaagtgcatgatcacacagtcaaagttctggaggctggaaattcaagaccaagttatcagcagggttggtttcattctgaggcctctctcctatgattgtagaggctgccttcttctggtatctttgcatgattatctcttgttctctatgtacacaggtctgaggtctctctctgtgtcctaataatctcctcttcctcttcctcctcctcctcctcctcttcttctttgtgttcctagttttctttttcttttcttttttcaagttttattttaggtttggggacacatgtgctggtttgttactaaggtatattgcatgatgtgcatgatgctgaggtttgggatacgacagaacctatcacccaggtagggagcacagtacccaacaggtcatttttcaacccttgatcccctccctccctctcccttcttgtggtctgcagtgtcaattgttgccatctttatgtccatgtgtaactaatgtttagttcccatttataagtgagaacatgcagtatttggctttctgtttctgcattagtttgcttaggataataacctccagctgctcaagttgctgcaaaggacatgatttccttctttttatggctgcatagtattccatggtatatacgcaccacattttctttatccagtccaccattgatggatacctaggttgattccatgtctttgctattgtgaagagtgctacaatgaacatacagttgcatgtgtttttttggtagaatgatttattttcctttgggtatatatctagtcatgagattgctgagtggaatggtagttttatatttagttctctgagaactctccaaattgcttaactaatttacattctcaccaagaatgtataatcattccctttcctctgtaaccccgccaa

SEQ ID NO: 12325 - DNA, 19641 bp, Homo sapiens
tccatctcaaagaaaccaaaaaaccagcttctgccttagtgtatcaggctgtaatgaggtcacctattctccaggccttggaaaagaatccagggtattttttgcccacgtgccaaggatttgtctctaatcttaccaggctaccagtctctctagaaatggtcccccagagccaaggcaaaaacagccccactcaccaggccccccagacacccaaatagtccccttaccatgttggtaccactgtctcaggtttgggctgaatcatagcctcaatgcaaaatttcttctggccatttccaaaaatcagatctacccttaaaaaacaaagatttggctttccctttgtgaagaaatgcttccctcccccagctatctccagttcctcagctcatcgtctggcactactgtgagcatcacctagaaggccactgagatgtgccaaggagagtggtggggatttacaaaccagtccccgccctttatggtaggtgccctcctgtcctgcagggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgtaggtgctgctgcctgacctctcagtaggaacmtgtgtggagagcctcacctggtggggacaatacgagatgtttggggaggagggatgcttagagacaaaggctgaggagaacaggtaggcttcagcatcacagcaggtgaactggactccatgtggcgggcacttcccaggatggcctataatcagaacctggggtggtcagaccaaccaggactctgatggtgcctcccttccacttctgcccacctccccaccccccaggagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactcyaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggcttatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatatagataccagtgtctttttaatcagttaacagccaaatcactacgcattcattggaccagtcattccccttctcttggtcttagttttctcatacataaaacgaggccgagcacgctggctcatgcctgtaatcccagcactttgggacgccaaggtgggaggatctcttgagctcaggagtttgagaccagcctgggcaacatggtgaaaccccagctctacaaaaaaaaaatacaaaaattagcctgctgtggtggcgcacacctgtagtcccagctgcttggggagctgaggtgaggggatggcttgagcctaggagatcgaggctgcagtgagccgtgttcgcaccactgtactccagcctaggtgacaatttgagaccctgtctcaaataaataaaatggagagcttggaaaaaatgattcctaagcgtccttctaattccagcagtccctaaagaacaggtggtcttccgaatgtccaccagagccccagcatcacacaggccccttggaaagtcagtatgtgaatccagtctccaccctcaaagggctttgctctggtgcagctagacagtagtaagcacagcagctatgcaaagccagagcaggagggagcaatcttacatcagcaactcctaggagcctcagtggctgggcatatcctcacccatatagggtggggaaagatgcaggccagcacagccaggtcaggcctgcactgtaccccttgtgctgaccaggggccaggcacacaactccagggccacacgtcgtgtttataattggagtatagggtttgcaggaggaagagaaggcataggggagcagcaggtcagtgcagtataacctgataataaccaccaccaacacttatatcactgtgtgccacatgagctgcttacatgaattagaactatctcacttactcttcacaacaaacccattttatggataaggaaacttaagctcaggtcacacaggcaggaagtgccaaagcagacatttgactgcaaggctgaggttctagccagcccacctatgtgccaggaagctttgggtgggtcatttcctttctttgggcccatctggctatggggtatttgcatgaggagacttgtgaaggcccttcaagctttcaccagtgacaagttccaatatcataacttacttagaatatattttctacttggccactgtgaggttctaaccatggtcactgtgaaacagtcagggtcaaggctgccaaacaagttgaggccctcattttctaccaactccttgacactggggttttttttttttttttgacagtgtctctgtcgcccaggctggagtgcagtggcacgatctcggctccctgcaacctccgcctcccgagttcaagtgattctcatgcctcagcctcccaagtagctgcgactacaggcacacgccaccatgcctggctaattttttgtagttttagtagagtttcaccatcttggccaggctggtctcgaactcctgacctcaagtgatccgcctgccttggcctcgcaaagtgctgggattacaggcctgagccaccgcacccggccaacactgggatcttgtagactgtgctgttcattcagggtattcccaatgagcaccttgctgaaccctaacaacaaacttctagatgtgaccctcaagacacagggactaaaggtgacactggcatatgtaggcaggccagacatgctgcaaagctgggcacccaccccaccttaccctcttcgccaagagtatgtaacttcctactgagcattgttgtgagaactcattgtgctgagttgtttttctacactatcccactgaaacctcacaacagtcctatagtataactactgtttccctatcttacaggtgcttagagaggttaattccatagctgttaaggggtacatgtcctgctgcctgcaactctctcccgtgggcctttgtctcagatccagctaccattcagactccagacccctgcaggctacactgggcatgtcattaactttgaagactgtcaaacagaaatggcctggctgcagggcagcgggaagcagccctcttcaggggaggagggcagtcctcacagagcctctggtcatcaggagttattctccttggttgcccaggtgacagctcaggtacaagggaatgagacacatcagggagaagggggttggttcactgtggcttagaggcatcattccccaaaggagctcatatctctttgaacaactcaataggcatagctttcagggaccccataagccacatacccaattgagtcattccacataggacgcccaaccttatggctttttaacaagtgtttatagttcacacagaaaactccaagtgctgataatttacaattaggaatcatgcttaccataagtaatgttgcactgaaacagctaacatacttttatctggtttccagacaaaaagaactagaaaggtaaccaaatgtcaagttctgcaggaaaggagaggatgattcacgctgccataacctctggggtcaaaattaaatgttgtttaagaaagaaaaaaacccctcaactttggaaattgtttcaaaagccaaaagccttctaatagtgacccagaatcattaaaagcactcgaacgggcctcagacccagtgcacacatgctgcagtgttggagaggccactccgtgaaccccagcagtccagtagcccaccaggtggaaaggcacaggtgccagaggtctcatggcatcagcttcatgtgctcaccctcaatggggggacagggagatgacactgactttgtgctgagctcaggagggaaacaccaaacactttgggaggtaacagagatctaggccccacctaaggccgaatccatgggagtgtggggcatttttctggaacactccgccctccccagccgtggctccaccctgcctgctggccgtggactgcattgtccagacactctttgtgggggtcttatgggactccttaagattgatccctgaggtgtagcaatggtgggccaaatggacactgttccggccctcacactggtgccacactccctcgttggcaagagcctgaaggtgaatcatccctccttctttaccaccaaaacaaaaagtgtgggaaaccttgagaagagggtcccaacacttctcccctcagcagccctcagctttttgcagcctctttacctaagtaccctgagtcactggacatggtcttgccaccacattccgtcagggcagagccacagcttccagccttcagcccagaggcagtcacagccaagcatcagaactgcggctctgtgcctacagtgccaaagccactgcaggtgctcacagaggctggcagcccacagtacccagggcacagacactaggctggagccactcaagtcagagatactctgcagtaactggggctgggccctgtcagagccaggtggggatctacaggctggaggcagcacgctaggggagggcttgagaccaagggaggctggagtgatgtgggtcccaggacctggaaagctatgtttgtaactctgctccccagagttcgctcttcttgatcatccttgttctctcctgcacctggctgggctcattcctcttccctatccctctgccccttgactggccttcctgggcaaacagcagattgtgaagtgggagctgtggggaagaggggatggcatgcctgctgtgggttcagggattgtggccatgtgggccacccagtggacactgtccagataacatgaaaagaggccatccacagcggctcagctctctgcccctcatctttgggccccacctcacattcataaagaggcttaaattctagggttttttccttcagttcaagatgaggtttgtcagtgaggtcacagacatccagcaagagggttaacggggctgcttatccccccactgggaacccaccactccaagctgcctgcagagcacctatactttctaatactattacctaatactagagagccagagacaccgtaaataaccttgttatcttatatttatgtatttaaaagatggttcataaatgtgtttagtgcttaccatgaaagacaatttttacccccatctccaaaaagaagtagaactgattcagctcacagaaggctgttaaaggcgccagagaaatatgtgatgcagtggcttaaagagactgccaggaagagtggggaaagttgctgcactcaagtcaatttgggaaatttcatgcagaacagccacccaatagcaaggcctctaggtaagtagggagaacgcctctggtcatgttcaggtgtttcgtctgtcaaggtgcttctcccggacagctatttctgcacagttcaacacgacttgagttggccatctcaaaacagctatagcctcagttgctgtgagggcacctcatggatgacagaggcaagaaaggcttgagggagagggggtgaggcagggggagcttggagccgtcattctctaaccctaagagctgtggacacaaagccgagcccaacctggctgctgcccgggcgggcaaggagagggcaccgaatgcactctccccagagcctcgcactgccaccagttgaggcctgcgcccctctcttccccgcacaccatagcctcttttcttgagtgctctacccaaactactgcctcaccccctaggaaacaaacatttggtaacatcttcagaaaggctgctttcaaggaaggcagcttctctacgctgtcaaacagctttcttagttgaagcatctaactgtggcaccatccttactgcccccaattggggcttccagaagcagtgtgggcaagcgctgccagccttctgcagaatgatgagcactggtcagtcctgtgctgataaagactgtgtgtcacccacgtcttggtttctccaacagcaggtaacaacctcatcttcccaaagagatagatagctacgcctgacctatttttcagggctcttctggacagcagcctctgtctccagcacagagaagggcctggcgtcagggggagccctggagcctaccatgtgcctcctgctccatcttgggagcagctgggccctgtcagtactcagtagagcctgggattggtgactgactaaagagggaggtggaggctttaggcagcagcgctgaaagaggtggcaagaggtgacctgcatgggaactggggcctgaagagacatcactaagkggggaagtgtgtcccacagccaagctgcatggtgggtgggccgctgggtctgcttccagtgtgtggtgggacccacagggagctgagttttcctgtttgatttcccgcacccagcctgcctgtggctggccaagaaggcattgttgaamctcatgagatcacagaggtagctgtgcaggccccgcccacttcctataaccctggttctggcygtccmtgtgccaagcctccaagttccctgagagctaccggccaggggtcggsaggctatgggagctcagggmaggcacctcccatgctcccgcgggagccaccaggacatgaaggtcataggcctctcctctcctcctcttcctgtttgacctgaatgcccccaggccaactgcctcaaggattccatttgagaagatgcaggctgggtgtgtggggagcagtagaggggctggtgtgtgcacatatgtgcacagctcaggacagaggctccctggacttggggcgggggcactagggccccaactctaaccctcgttctgccctgttgacctctgctctctggaccaaaaatggaggactcagtctagactagttcttagggtctaggagccaccttaagttatgtttatatgcaaaggccatttttctgagaggccatagctttcatcagtgtgccaaaaagcgtgagatcctctgctctaaaagcctctgccccagcgctgcctagtttcagagcccccgatggcctcacatggggttttagagcaggcagagaagctgcaatggggccaccagccagtcctcagagtcctgggttaaggcctcctctccaggaggccctgtgtaaaggttttctctgttgcctggaggcaggagtgaactggtaggcaggaaaccctgagggtacctaggaggcccctagcctgtgggttggggagggaagacaggacccctggggccactgaaatggtggagctctcagagacctgagttctggtcccttctgccactttttgggcagatcccgtcttcccacaggccctgtgtcttgctcagtccacgtgactctgctttctcatcctaggcctcaggtgggtggcaggccctttcctgcttgccctctgccctccctctctctggccctgcccagtctctgccaatctgtgtacctcccaggagccgggacactccctgagtcctctgggagcccttaagccayactgagaacacagaccctgggagaagcagccagcagtgaggaatcctggaaccccttcccagggagagccttcccatgacccccatgaagagatcagtgcaaacacaggtgtcagagcccttcatggagtcctggggtgaggagtccctgccggagctacccrcagagcagtccctgacggagtactctgacctcgaggaggctccctcggcgcacactctctatgtgggccatctgaacccccagttctcagtgccggtgcttgcctgcctgctgcgagacaccctggagcggctggagatgccggtggcgcgggagcacattgaagtggtgaggcggccgcggaaggcctatgcactggtgcaggtgactgtccacagggacaccctggcctccctcccctggcgcctgcagacggccctggaggagcacctaatcctcaaggagctggcagcccgtgggaaggacctgctaytgagtgaggcccaaggrcccttcagccacasagaggtaagtgggacttttcccaagcaagctccaaagcctcaccccaagggagagcctctgagtgggagtggcctgcagagtggggatggaggggtgtctctggggaagcagggacaaatctgcaaacttgggggctgccactcaaatgaccatggcttgcggctggtactgccagctttctctgggaaaaacagtttgcctcaagctcaagcccgacgtttgtgtgaagaaaggccacgaggggacctcctctccttaggtccttttacattccagcctctgggcctgggagaccctagaagacacaggggkcccgattttctccttggcccaactcatttgttcaattgacaaacatgaacaccccctctgtgccaagagtaaggcagggatgagaggcccagccaggcccccaggaagccctgcatctgtggccagagctggacagccacccrccgagctgcaaggtggctgcgctcagagctgtgagagaagacaggaaggtttgccctgctctctggggacagattaacaggggaagtgaaatccaggccgggacttagggagttggacaggcacttgcaagggaggacattccaggcaagggacacagaatatgcagaggaacctgggggcttagagggagtgtcatgtctgcagaagggcaaaccatttggtgtccctggagctcccactaaaggctgcagggggtgctaaggaaggaagttgggccagaaggtagggtaggggccaggtcaccaaggctatcatccaaggcaaggctgaactgctggctttattgggtgggacatgggacgttaggrtaggtcactccatgagacaggtgattttggtttcttttggtgtgaaaatgatggtgtttaaactgttgcagaactaaaaggctctgtggcttacatttcaactcaatttcacatttgtatgaagtttatcctgtttctaagactgataaattcatcttctctggggagctgcagggctggtagggaggtgcctcagtctcctcaccccaacccacgctcatgaaagaattgtgaggagtaacaatctgccttgaagttagcgtcactaaggagggttggctgggcgcggtggctcacgcttgtaatcccagcactttgggaggctgaggcgggcagatcacgaggtcaggagatcgagaccatggtgaaaccccgtctctactaaaaatacaaaaaaattagccgggcgtggtggcgggcscctgtaatcccagctactcgggaggctgaggcaggagaatggcttgaacccggaaggcggagcttgcagtgagccgagatcacgccactgcactccatccagcctgggtgacagggcgagactctgtctcaaaaaaaaaaaaaaaaaaaaaaaaacaggagggttgacatgaaagggtgagcctggaagcagggaggtcagggaggggctcgctggggaggcccagactaggaagtggccccgaggaggctcacaccaagccctcgagcagagcccaaaccatgaaaggagattcaggaggcgcagaagaaagtggggattagggcggacttgtcaatagcccagcaagtagtgggcaaaggtttgaaatcaggaagtgggtggggtacctgggagtccctctccattcagggtactgcagctctgtcacagggtgctgagatacctgctggaatgatctggttctgggcctcaggggcctgtctgcaacccaagtaagaaaaamtgggcccacacatgtcccagcacccagccctgagaagcagaaatctcttcttccccaccaggcatcccacagctcacctgggaagggcccagcttggcagggaaaggagcgctgactggaaccctcgatccagcagggtttcctgcctcggctgcaggagggtgggcagaactgggcccctcggcctggtgaggggcatsaggatgtccgtaagagtcaggctgcagcaggggcctgactgggggttcttgcagtccttctcagggtcagggctcccatttcctggctggacccatacattcattcttgactaccaccctaggagaaggaggaggaggaggaggacagtggcctgagccctggccccagtmcaggctctggtgtcccgctgcccacctggcctacacacacgctgcctgataggccccaggcccagcagctgcagagctgccagggccggcccagcggcgtgtgctccgacagtgccattgtgcaccagcagatcgtgggcaaggaccagctcttccagggtgccttcctgggcagcgagacccgcaatatggagttcaagcggggtagcggcgagtacctcagcctggccttcaagcaccacgtgcggcgctacgtgtgcgccttcctcaacagcgagggcggcagcctgctcgtgggagtagaggacagcggcctggtgcagggcatccgctgcagccaccgtgacgaggaccgcgcacgcctgctggtggactccatcctgcagggcttcaagcctcagatctttcccgatgcctacactctcaccttcatccctgtgatcagtacctcggagaccagcgtccccctcaaggtgagcctgcaggacaggagggcctctgggcctgtcatctgtcatcactcagtaagacgatggcctgcactcctgccaggcagtgctggggcagggacgggactgggggccacaggagaagaggctggggatggcccctgtgccagccctgctggcctgccctaaggaatcagtgagcaatgctgagcagcctggcaggatgggggctgccgaccgtgaggggcggcgcctccagagctgctgttgcccctaccaaggtgatccgcctgaccgtgcacacccccaaggcccagagccagccgcaactctaccagacagaccagggggaggtgtttctgcggcgcgacgggagcatccagggcccgctgtctgccagcgccatccaggagtggtgcaggcaggtacggaagctgaggccagtgggtggggtggagcggagctgaccccagaccccttcagccacccactgagcagcccagggcaagccaccatggttccctgggtcctgcatcaccccgttgaacccaaggggttggaatacaatcacaccacatcccatactccgcgggtaggtggctggtgggaaggaagaggcccaagctctctccttttaaaaatctatgcagtggccaggcgcagtggctcacgcctgtaatcccagcactttgggaggatgaggcgaacagatcacaaggtcaggagttcgagaccagcctggccaacatrgtgaaccctcgtctctactaaaaatacaaaaattagctgggcatggtggcgggcgcctgtagttccaaatactcgagaggstgaggcaggagaatcgatcgaatctgggaagcggaggttgcagtgagccgagatcgcgccactgcactccagcctgggcgacagaccgagactccatctcaaaaaaaaaaaaatcctatgcagtatcctcccttcaggggtgcctgaaacccctcaccctctacttgggcagttaacacactcgatcttgagtgagggagcagagagactggaatgttgagatgtcaccagaaaaccccaaagactatacactgcattttaggggaggccctaaagcggcagagggggcaagacacagtcccaaggaagagctttttcaagagggaaacagagaatggaggacaagggaccaacagtgaggaggcacatggcctgcccagcacggaggaggctcccttccatggctggcagccggcagcttccctcaggctgacacggttgaaggtggcagcaggccgaggggcctgacttttcccctagctgagaaagctctcaggctcctgggctttgccttcctccctcagtttggccccaggtggaggacggacaggcccgagaccaggcgggcttggccacatgcttttcccatgtcccctcagaggtggctggtggagctgggcaagctggaagagaagatgaaggcgctgatgatggagaaggagcagctccagcagcagctgcagcagcacgggcctgtgtcctgcacctgctgtgtcctgtgagggccctggggagcaggcaggacggcacggcactctccacctgagacccagggatttcctgtttgagtgtaaggccaaccagtaaagcccatgcgggctgctgagaggcggacagggactccttcaacatggcacatgagcaggcacccatgtggcttcaaccctgacagacccatctgtgtagccaagaaactgctctcagccctgtccccaaatgaccttactttcagaaasaatgtgtaaaaccctgcccagagctcccctagggctaagctataagggattgtccttctccctaaaatgctcatttggcccaggctgaggtctgtgactccagttggctacacagtgccagaaaggaatctgtcatctcaggaaagcccctcaaagatggcgaggcatatttgatgactgtggttacagggcaagaggccaccctgcagcccccacccctgacttgctggaacttgtgactgtcaaagctccattaataaattacatgcacctgggacaagaatggttctttctaggacactgggtcagccggtcagatgctgcagggtcatgagtcccaggcccagcccacctctgtccaggaggcagaggacagacctgcaagggcagggagcccagcccctcagactccagtccagctctgtcttaaagaccagggaccgtggggcaaagtgctatgcctctgtgcttcagtttcttcatctataagacagtgacaatggccaggggcattttgtcaccatcgggccagtgccctgtgtctacgccagctgtggcacagagcagcacctcacactaagggtctcagttcctttccaagacccctctggtccagtaagaccgttagcttaaaacaaacaaaaaaaaccagactcctccagctgcttcctgcctctggccgtttctcctgctgtctccaccagctgagccagaggctgcaaagccagagtctgatcacactcatgccgcacctgcacccatagccctccaaattcttcaagagcaaagcccaaacttgatggcctacatggttctccaccacctagcccacccaacctcaatgtcttccgccccttatgtaagccacttcagccacgcccaccaacttgtttcatttgcactcctgcctcggggcctctgcgctacatagcggcctatttcctttcctcttcaccttcaagtccatgcttaatttcccacccaccctattttaaagacaccacctcccagcactgccactcccctgctcacttccacccttggtctccatctatgaactaccacactctgtagcttatatttggtgcttcccccactgaataactgctctgggggacaggggtttgggtatggctggcatatggtagacacccaataaatacctgctggtgagacaattaaggatactcctaaatttggggtctgagccaccagaaaatcaccaaaccttgttgaacagggcatttcacaggactagtgttccacagaacacacttcagttgatcccctaaaacttgaagaccctggccacatccacagcagacacagatgagaactttggaacccccagcccctccactcaccagccaggtgacattttctgggtgatcacaactgctctgagacctggttttcccacttagcaaagagcacacaacccctgcctcggctgccattcatgctggttagggaccaatgtgatcacagacacctatatggtggcaggttaccaaactcctgctgctcaccccccgagctgccccaaggtcaccaagactgtttgaaaactacacaaatgtgttactcaagaaggaggagtggcatttctgagcaccttccacggtccaggtaccatgctaaatgctagtccaggcaccacaatcctcggaaatgtttttsgggggaaaagagcagatttctacaaaggaagggtgaagtcaggcttcagcccagctgctccagactgctaagaactgcccagatcccctggactgaagggaagttccctggactgaaggaagttactgaagggaagttacacatagctgtgcctattgttaggtcacattaagaaaggaacgaggaatgtgaccagctttcctccccatgagggagaagcctccggggacgggtcagtaaacactgggcacaggttgccctcctgtaaatccagcttcagccctatcctgtctgccacagccagcgtggcggggctgctcgagctttgcaagctctggagagccatctgggatctcttttttcagaaaccttacattatgtggccagcacttgacaagtgatcagccaaagtgatcttaaacataggggcaggaacttaattactgggaggctttttcacaccacccacacacccagccattgtgggggaccatgatgtcaacaacgggcgtgtcagaccctcagtttggggaatgtttgaaaaaaaacgggccagacgtggtggctcacgcctgtaatcccagcactttgggacgctgagatgagcagatcacggccagcctagccaacatagtgaaaccccatctctactaaaaatacaaaacaattagatgggcgtggtggcaggcacctgtaatcccagctacttgggaaggtgaggcaaacagaatcacttgaacctgcgaggtggaggtggcagtgagccaagatcacgccactgtactccagcccaggcaacagtgtgagactccatctcaaaaaaaagactattgaccaggtgcaatggctcatgcctataatccctgcactatgggaggatcgcctgaggccaggcgttcaagaccagcctggccaacacagcgagaccctgtctattaaaaaaaaaaaaaatttaattagctgggcgtggtgatgtgaacctgtagtcccagctacttggaaggctgaggtgggaggatcttatgagcccaggaggtctgcagcaagccgtgcttgtgccactgcactccagcctgggcaacagagtgagaccctgactcaaaaaaataaataaataaataaataaaatttaaaatgaagacaatctcctggtaccaccaggtgggagaagaggttagaattatgctcaatcagccacgttcaaagtaccataacaagcagttctgctggtgaagacagtctggcccactgctcactggctgtgtatatggggtacccacgtccagtgcctggcagaggaaaggaccaccttcctaaatcatgcttatccctcccctttctcagtcataaatagcaccataatagcacccatgcaccttttcatctcgctctacatgctgagaacctgtatttgaagctttatgaaaaattctggttcctattaaaaagaaagcctcatttcttagtttttaaacaaactctcaggttgtctgctgagtcaaggctgctcacctgcaggagcacccggcactgacaattcagctgactgcacacaagcaagccagcaacgtgctcagacgcttcccatctggccaatgacataaagagaatgagaagcaaagcatgtctcttgttctgccttactgatttatttcttaagttagagtacacatcgagtctggccagaatatagtgccacgtagctatgcctattgctaggtcacattaagaaagtaacttcatattgccctttcaactgcagtaacaccatcctggaagaaaaatggaccctccagtcaaagctgtctatatatgagagggttttagaggaagtttcccccaaaagattctttgttctgtaagtgaccccttgatgcaaggagtgtttcccagccctagaaataggaagcgcagccacaggcatggggattttaaaatcacgcttcagagacagacatcttggtgtttcatgttgacaccaaactgaccgtccctttgaatgaggaccagccacagttggcactgagaattccccccaactcagggcagtatagagattttgtctctggtttcatggcttagtggcaagcaataccctgaggttcccagcaccaagtgttcaaatcctagctaaaatcctctctccatgctcggtaagtccatgtggcacactttataacggtctaggtatccaagggaaagcgacaggcaacgcgctagcatctgcaatgatgcgaggtagttgagaaacaaggtgaccgatggggcactctgcagccccacccaccatcggttcccatcgcgatgttctgccgcaactcaagaactgcaaggagagtgtcacgcaacaggcagacaccacagaggagccagtacacgtgatgggacatgcaagtgacaagtttcccaaatacctttccgcataataaaataatcttaataaaaacataatttaaagaaagtctccaaagccgagtgtaaagtcagagctgtaaactctacccaagtttgaagggtctcttgaagaatcatccctgtttaaaagaaaaaaaaaagtgggaattatatgatgtacattaaagtagaaaagttagaatttctagtcagctgccatgggaaactaagcctgtttttcatggcagagcagtagaaggagcctactgggaataattagacgctaaatttataattcctacagaatcagaccttttcaagacctcacacatcgacttctacaaccacccaatgcaagcattctttctccacagcacctcgtaacagtgtcactaacgggcaattctccacttgcgaggcagtcagaaattccatgtaactgaccaaatatctacctccttcactggtaacagttcttgttgtatcagctccttaagactgtgaaacagcctatagcaaactccctggtcaggggattaatgagtccatccgtgttaaacgcttacctagcacacaggccctcctcctgatactaacttctcatgcctacccaccacctacttaggctatgccaggacagggggtcaaccaaccaaggcaggaggggaaacagctgggatcagcaggtcagaccggcactgacccagcaccagaggcccactggtgatgaacacacggtgtgcaggattcagggaggtccccctgcccaggccttagggcaggagcggtggaaccacacacccatacccctggttcttattccagaccccagatgactgacactccctcatttgatacctcaccagcagaatgcgtacttctgccaacacagtccacacagttatctcaaaggacatttacatttcgtggcagtgcccacagttattgcactttatgaacctacaaaccctgtcacttaatagacaaacattcgacgtctatttggcaattgttccaactttgaaggaattccagaataagcagcaatcaacaaaaaaaagttctctaagcagtgtcagttttaaagtacttcctgatgaaaacctgaggctctgcagaaatgacaagtgccacattgttgtatctgtcccttccttcaagatctccaaaatttacagctacatcaaacaatagggtctaagaattcagaccctccccttccccgccccagaactggtcagactggcaccagaatgtagtaatcagtattgagacaactgcccagtgaccatgctccccaagctgtcatccccagggcaggactgggaggtgcactgcaacttggaggaagggctgcccatttgatacccacaatgacctcactactttcttttctctctcaacctctggattatattcaagacctcaccactttcattcctggcagataaaaattttcagccctaaacttccatgatattcttgcaatcgcagtgtgttatcaccatgtttttaaaaactaaaactttaaagtaccacttacgctacaagatcagtcatgatttattgatggaaacttcagttcggtgatttcagagtcaggggagctgcttccactcctgtcactataggtgtccctgtagaattcagatggtttacgcatcatctcccaccaaaaactcactttacgtccctgtttttgtaaccacggttcctacagggacacttgcctgcacatggcaggaatcacaaagactgtttgctacataatatatttaacatgaaactgcagaaagatttccttcttctagctacaaaagatatacattccatttatacttcagtcacacaccctaccaccaactctgagtactggttctggataaaggtggcaatgggacataaacctacccattgtggcttacttcccaggaaaaactagttccccttaacatggaccagagggtcctacgccaagtgtgatctggtcagcaccaccagagctcagatgctgcagaaagggggacctggccaatatgccagggaaacaccgtgagaaagctccgggaaaggagaggaaactttcaccccaggcgcctgtggcttttttttcttatgactgactgtgacgtgttgctgtaatgaatcagcgaccacctaaaggactagagaagactaatggattactgaagcaaagagtgc

SEQ ID NO: 12326 - DNA, 42445 bp, Homo sapiens
gcagattgccagtaagagaaaaaggcagctccaaagcttcgcctttaggcggccagcagagctgcacgttcacttccaaggcaatctcctgctttgtgagcccctccagtacgatattgcagagaagttcaccatcctctctgacctgtcagcttttgtgtctccccaaagttttgtcttctccaggcttaatgtgcccctcattactacatatttctcaaaagtgagcaaaaccacttaagcatattatacttcaatgaactgtttttttttaaagtcaacaaaacccttcagatgtgctctgagatggactacccaccttcctggaactcaaagaaatttgactaatattcctaagactgccctagcttttctatgagcccagtgaattcattccctcattcctgcacatttcctgagaatctaatctcaaacacgaagatgatgcaacatggtcccatagcctttaggacaagacagtaatcaactaaagcctttcgtgatcttcagcaagataaatgtgctatattcaacaactgagtttttgaacctaaatgcaactattcatgctgtcatgttatttcaggatcatccttgccatgtcctgtgtcctatggaagttctccaatatgatcgtccccatcacaatcatgtcatttgggcatttattatatgatcaggaattgaggtaagcattttacacaatataagataggtattaacaagtccccttcacagatgagaaagctgacgcttacggagactgattaatttatgcaaaatgatagactcagtttgtgtcagagcctcaccagcacacctcaatgacaaatcttactgataataatatttcatgagttcggctcaaaaccaacccatttatgagagctccaaaggttcactgttatcgctaatattcaaaatactattcccttgcactgataaaacatacgcatgtaaaggttttattttttggccttttaaaagtatagttattttgctggctttgtccaaatacataggaggagctgcaggttaaatttgggacatgggcaaaacttccaaaagagcttccatccagtccaccatatctgcaatgccacatttttgttgcagggaaaaacgcagaaccatgaggtgaccatgacatgcagcgaagctaaatttttacaaacaacaaatcaaaaatgttattagacactagtaaatattttatggtaaaagcagcttttataagtatttgtcaacactaatctttacttcctctcaaatatgtgtaatagaaaactgctgatattgaaaaggcatgtctattttctgagactgaacattgtaaaccatttagtcggaagactttcttagacctgttatgtcctgatgaattgtattcttaaaaaatggaacgtgaaactcaggatcatagatagtaataaacctaagtgtatattttattaagagttctatgtatcatatatttttgtcaattaaaaactaaaaataaaaagttccgtgtagacacttgattatctacattctctagacaattttttttgtccttctaaaaaacagtggaaacatttcttcctgctctgtccctctgccctcccctacttccccatcccagtactgaggttaggcttgcaaaaggctaatgattcactttggcttagtaatcagtagatccctttcaaaatcttaacttcaaagatagatgtgtcttccattgtcaaccaagactgtttggactcactagttcacttctacttggaaagtacttgatagaagaaaaaaaaaattgcaaagtcttaactttggtatttgaattttataatcatttggaatcagttttcttccattcaaatttatctcagtcgaaactgttcaatatctgtgtttttatctcgtttttacagtctgtttatatccaaaacttagaggagactcccaagtggaaacggggtcaacacagctaatctctggcttgagttaaaaagcaagacttcttaatcttgcagatgctaaattttttttcaaaagactgttaagtaactttttaaaaagccaagtctcagcccagtgcggtggctcacgcctgtaatcccagcactttgggaggctgaggtgggcggatcatctcaggtcgggagttccagaccagcctgaccaacatggagaaaccctttctctattaaaaatacaaaattagccaggcgtggtggcgcatgcctgtaatcccagctgctcagaggctgaggcaagagaatgaacccaggaagcagaggttgcggtgagccgagatcacgacattgcactccagcctcggcaacaagagcgaaactccatctcaaaaaaaaaaaaaaaagccaagtctcaacttctttgtaataggaaaatatattaatatatattaatattttgatagaaattttttaccttgagagtaaatattatgtaaattaattctatttgcatatcaaattagttaacctctccaatttatgaatagaaaaatgagatgataaaaggaaatccaatgacagaaatccattgtaaaggcaacagaagtgaaaactatagaaaactgaaaaagcaagactctttattctaatactctcgactggttaaatatgacccaaaacaaactgttacccagataaacacttctatgactatagcaggagagaaaagatgcacggctaatcaaaagatttttcactgataaaaaaagggcccaaaaataagggtaggtaattgagaaagcaaatattataactggccacaagcaacatccaaagtaatataagaataaagataagttcaccgttctgttaaaaacatttaatgccatagcaataaatgactccgagttctctttgagggaacaaagtcaccactccattcccaggacttcggtccaagggaaagaaacacacttgaaactcttcctctccaccctcaacagaagcacaaggcacagcagccagggaacaggcaaaccagtctctaaagataaataacctctcagagaaggatattcatccaactacacaaaagaaagatacagtattactagttacagttctaaaccctacttcggatttgtgataagaaaaaagactctatgtaattaaaacattgaagaaaactggtacgcctcaaactacactgacatctagtcacaaagcattcagagtaaccctgacttggaggtaggatttttgctcatatttttactacaactctacacagcacaaactatgcacctggttttcattgaattcaatgattgtctactaaatattcactccaagcaagcctccgtcgctgatggtcataccttccccggcgccgtcatcctgtcattctcctccaggcaggagagtactgtgttccaaggaggctgttgtgaccgtttatcagaactctcaaaaccaaaacagttgtccagtggttaagctttaaataggaaaaatatcacctccatatttttctcattatccagtggcttctaaagcaaaagcttaattatcatttaaaatgtggcctaaatgtccacggcacggaagagcagcgcagcagccatcactttcttactgacagtcactgtgctcttacgagaagctttcgctataaccgtacatacagacataagacgttctaatcttcaaatccaacaccactccaattccaggaaaaaaaagcactgagatgttagcacactggagaagcaaccattttactccttcagactacagttccatttcagatattaacttacaatcacttggagggcagacaggaaaggggtagcagaaggctaaaatccaaggttgtctggggtcccaataaagaggttctgtagctgtttgagaacttggctttgcaaactactttcttaggccgaagaaaaactcctcggtaaactgttggaatttcaccaaagtatcaatcacggcagcccttgggactaatccagtactgctggactttcacgcatggtagcccgtataaacacagtacatacagcaaggttcaagcaagtcttggcaaattttaacagtggagaggaagactgctttattttgctatattcttgggttaaatgtattcgcttaaaataataaacacttctccgagattattactggttagttcagttttgaaatactggcaaggtcatttcaagaagaaaaacgggagagggagaggtatattttacataagataaaattcacacttttcagtgtccggttctgagttctgacaaacgcatttatagtggcctcatcagcaccacaatcaggctacgaagatggggtaactcttcgaggattcttaaaagcaaaattgatttgtcagcatactttaaaagtatttttgcttttgaaacatcaccttatttatttagaaaagcaaaataacacggtccgagtggtcctaacccgcgaatgcctttgcaacactgaaatgccctcctcccaacaccggccgggcaggggtgagccccgcagccaggggcgcgcgtcactgtcagctccttttcccaagtggagaccgggaaaagacaagagttgcatcgccgggctggagccacgaggaggaagagttaacgccggaatgacaaactctaaagcaccgaattgcctctccctagtagggcactgcgcgtgtggagcacggccaggggcgcgtgggaagaaagacgacctatttcctacgtccgtcttcctaactggacggcgcgggaggaggcgggggctggtccccgggcaccctggtgggcaccgagaactcgcagagaggaacataaaaccgcacagccttccccgagcagcgggktgacgggaggaaggaaggaaatgggagcgcgacccggccgcgcgcagagccgagccgactagcgcgaggggcccgggccccacccgagagcaggcgcgagggccggggacagcggggcaagctcggggagagcgctgcctgcacctggcaccacctcgagaccgggtggcgcggggcccgggagcgtgggcgccagaggggacagggcagcggcgagcgcgcgcctctcgccccgcagggcgcccgggcagaggccgaccggcgccctccgaccccgccgggccctcctcgccctggcccccgagcgcacacctgccccttcaagccccggggccacagcggccggcggggaccctggcgggggcgcgggccggacttcggccgaggggcgctggccagggcgagggacggcctcgcagagctcggagacgcggcgcgagtttcccccgcgggccgcgcgggcgcagagaccgccgccagcactcacctgcccgcttcccctagcgcagcgggaacgacgtactccggcccggaccccgccgtccgcctcaaccaacccccaggcggtggcggcggtggcggcggcggcggccggacgggaggggcgggacggcagcctgagacggccccgcgaccgcggcccaacgcttctcctcccgccccggaccccgcccccgggccgcagccgccgccgttcattggcccacgcttcggacgcatrggcgcggccccgccccgccacccagccggcgttccgttcggggtcctccccagccagtgggctggcagctcccgggggcaagagcggccggctcagccgccgccaaccacgatgtcgcaactggctgcgttcgcccccgccagagctttgattggacgaatctcgacccgggccccgcctacgcgcccaagttccgttagcaggttcggttgctccagaatgccttttcgccccgaggggcgggaccgacgggatgggccctgtggctggctcctccctctgtaagcagcagccactgacccgcggggcgggcggggaggagagcggcggctcgttcctcttttgagagctctgctttcttcccattggttgacaggcatcctactctctccgcccctccggtcgcttggtggcgtctcaggacgcagcgtgatgacgtaggtccccgacattccatatacaagatggccgcagtcggcaaggagagacgtcgctgaggggcttgcctgaagcgaggggtgagtgacccaccgactgagggcagcgccgcccacctcccgcgtatctggaggtcggagtaggttatggccaaccgccgctatccactggcggagtctctctttccggattctgcctccctccgctaacctccggtacacattgaactttgcgggcgacgcggggttgtggggcgggcgtgtagagagggtctgaggcgccggggcggggcagggaggccggactcaccctagaactggtagcggccctcgcactggggggcagtcagagttggggaactttctaggggttgggcaaaaggggcagcggtgttaaccgcgcacagtctcacagccacagacttctcatatctccccgattatttcgcggcgtattagtcccaaccttggctaggcctgaaactttttggaggttgttccatgtctagggtactccgactttggagttttggagagccacgtaacgagggtgcggctaagatgaggaaaaggcacttccgggattagatttcgttcttgcccagacatcgtctttacggasccgctcctggtggttgatttggtttgttatgagagaaattgttctttagaaaattggagcgtaagtctagaggttatgtgacagctcctaaacgattgtctgcccaagataggctcggtaatgctccctaaatttagactgccagttaaacggagctttcgctaagtcatctgaggttaggaactatttctaagagcatttcttaagggtggtcttctgtgtttttargagaaacttggtgatgtttgtgtatctcgatctaaatcgctgtttacagatacctagcacaatgccttgcagttgtaggtgcccgctaaaggtttgtatgaatgatgttgctagaatgaaagcgaggagctttcagcgcctagaacactgcctgacgtttaataagccctctgtattgctgaatgaaagaatggatggatgatggtagtggtagtagtattgatagacatttggattaaagtgcccttaggatgcttacctgttaaataatcttgactatgaatataataattatccaagattgtcttattcagagtgaccaccgctggtgtcttttagggtttttttccctcttttatctcatttcgattatattgtgatgcattattcaagcatattagttgatttctgggcaaatcctgtttaaatttgttccattttgaaaatgtagtttgcactaacaagcaataaaaactattcgagttgttaatgaggttcttaaattttaaatgctgtttctaaaattgaatgtcataaagaaaaattggtcatagctgtggcctataaaatgggctagttcatttcaggacattatatttgaaagcagtgactctgctgagtgtctgaaagggaggacagtgttttctgcttgttttctttaaaattggataaggacaaaaaaatctagaggaattaaattcaaggtaattgaggagattacagagtgatcatatttttaagctcaggtaaattgtataccagagtatttgcagatgactttataaaatcgttattcttagattttgaaaaatcctaaaagtacagttaatgatagaagactagaatctggtaaatgtctgttttcacatagaaccattcgatggctcttggctactaggaacctattaataatctgttttagaatcttgttggaagagccaacaagtttatgagtacttgggaaaggagagctgattccctgaagccagcagagcttcagtgagaaaaggccaggtgaggccagaggtggtggctcacgcttataataccagtactgtgggaggccaaagctggaggatcacacaagctcaggagttcaagaccatcctgggcaacatagtgagacctcaccactacaaaaaaaaaatcaaaaaattagccagatgtggaggtgcatgcctgtagtagctacttgggagactgaggcaggaggatcacttgagtctgagagatcaaggctgcagtgagccgtgatcgggtgactgcgctccagcctgggcgacaaagcaagaccctgtctcaagaaaaagccaggtgacacaaatcatatttccttttgttacagtttactagactggtggtgattggggattgttggacataagttcatttaagtttatttaggacatagtcttccaacaagattctaatactgtgtgtagacacaagagttaaatgtgcattggataaggtgtggttagatggatttatatccatgcaaattaccaaacccgaaatgttgattaatgagttgatgtaagcctggggagatgtctttggagatatgctgcaggactctggtcttgcccttactcggattaacactttcttaataccaactttaaatagataagcagcgtgattctcaagttaataaatgcactcaaaccatgtagtgataatgagcacattagatgacactcagaaatcaaagatttcttaaaggctgaaatataataataggccagaactggccagatataaatttactaggtgagattgtctcaaaaaaaataaaaaataaataaatttacttggtgtgattacatttacaaaacctgagttttcctggcttgacaaaagtggttctaggatgtaacattccacttaaacagaagaaaagcagtgtctagattgagggaaggcagtatcttggtataaagtaagactagttgtgatgctgcttgctagctgtgaattagtcaggttgtttcgtgtctctggctccattttctcagtgataaattgtgaggataagaaaactagcttgcagacatgctgcaacgcagcagacacacaatggacatgttactgcatgttagttaccacccccctcccatgtgctatgcacatcatatctgttttgattcctaatatttagggaggacttgaaacactaaaaaaaaagaaaaatcatgatgagaaaaatggttagatttgtttaccctagagaagagaatgtaaaaattgcttttacctgtttgaaagacaatcaatagataagggaaatgtattttcaaggcttagtttaaggaccctggtagaagttaaagagtcgctaaaaggtagatttcattcatgcattattttatgccatctgtgtagcagatctaggggatgaacaggacagataaaaatcaatatagraatacaggaattatgtgaacaccagttattgatacccagcaatgccataggctgttttgtaaactaatgaggtttcattgataagtggccaaatattactaagaggggatttcgatattgggtgagataattgagtggtgacatttactattgtttccataattctaaatgttgaaaatatatttagtcttttatgatgtaaaatgatatttatgaagcacattcctgaaaggtgctgctaaaatgccttgacaggttgcttgtttatggattttcattttgcagagttcataaatctcagtcattttcagaggaatcacaagctactaatgagaaaacttacaactttagggtcttgtgaaaaaataattgaagagtaatagggaacaggtttatagacctgaggcaaaaactttttcagggagttctacgattttgaggactgtctctattctgtttatgtccataatattttcactacatttcatgaattgtttatattctgccttggaacctaaagggaccaggagtttggccagttacagaaggtaaaacaattgaatatactyacgatttatccgcttgtggaccgaggttcttttccattccagtttcatccctactggggtattcctaacactgttccccgttctgcccctttcccctcaacagatatcttggcattatacttcctagagaatatggaggtactcttgagattttttagttacttcctcccccttaaaagattatttaaaaatatctttctcaaacttttccttccattctcaggggaagaaagagctttctttctaaggttaactttcttgctgtgctttttattatcccttgaccagttagcctcccttgttctgactcctctagtgattcctttttgtttttactggctgcagacatttttcattctcctttatgctgaaaaatatataaaaaccaaaacaataacaaaacctactccctactattccctgttactctctttgagaacagatgcctcaaaagaataacctatttccagccaggcacggtggcttatgcctgtaatcccagctactcaggaggctgaggcaggagaatcacttgaaccctggaggcgggaggttgcagtgagcaccactgcattccagcctggatgacagagggagactctgtctcaaaaaattaaaaaatgaataaaaaagaataacctatttcctagtctgttcattctttaccaccccttgcagtttctacaccttctgccctattgcacttctaaaaatgttattttatttatatgtgtatatatgtattttcttgaaatataatcctataccgtacaaattacccatttaaactgtacaaatcagtcgtttttagtatttgcagagtcatgaaaccatcacaattttcagtgtctctaataaacaactaatcaccaattaaagtaaactttccttagttccttgtcctttaacttttctttagcatttgtcactgttgactaccatctctggtttaaagctgacatcccatggtttgttttgcaacaaaggatgcaaatttccctacttcttggaccagtctttttccctttctctaatttggtgattcttagtctgcaagtgggtaaatcataagtgcattcaagtctgttttaccttcctgtcactgggcaaacgctcgcctttggtgattcttcctacttggtacaagttcacagagttctgtacccagaccccttccttcttcactctccatccctccatccgtcaacatgactttatagttatcacctctgtgtagatgaaccccaagtagatatgttctgtagagacttcaactggcctatttatctgtctgatagatatttccacaaaaggatcttaaagttcttcaagcttagtatttatagagccaaattcttttcctccctccttatcaaaaccagctttttctcttgtcttatccatttgtctttttagtatcaccctctgtgtcagtcaaacttgaaatcatctttttccattctttgcctcatggccaattatgacacacacaccccttgttccagctgccattgtgtggagacaggtgtattaggcattacttgaactgctactataatctcctaactcttcctctttctgcatacctctaaacagcccttacctcattatgttctctccccttacatgcgttattatttgtggcacttgattccctgacaaatattcatatatttctttcttattgtctctcccactagaatgtaagcttcctggggcaaagaccttacttatcttgtgccctgccatgccattaaggcctggctcatagtaaatgctcaggaaatatttaaatgaaaaagtacatggaaaactgttaggcgtatgtatattaaagtagcaattcccaactgtgaataaattgctaagatgtgctaagatattgattccctcagccaactgtccagttgccttctgttctataagaatatatgtacatgtttaacacttattaataatcaaacaccagaaacatttacatgcccaaacagtagaatgtatagataaagtgtgttgcattcataggatataactgtactgtacagcagactttctcagctttggcactattgacatgttggaccagataatttcttgtcatgggggattgttctgtgcactgaggacattcagcaacattcctggcctctacccacactagatgccagtggcaaccccccagttaggaaaaccagaagtgtcttcagacattgccaaatgtcccctggggggcaaaattgtcccaggtttaaaaaccactgctctgcggcagtgagaatgaacaaatactgctttatgcaacaacaggaatgaatcccaygaacttaatattgagcagaagaaaccaaatgtaaaagtggtactgtgtcatcgcacagtccttcaaaaacaggcaaaacaaattgatggaaatagaggtcagaatagttatctttgggaggatagtcactaggaaagaacgaagagagcttctggaatgttggtactgttctctttctcaactgaatagtgttaacacaggtgtgtttactttgtgaaaaacaatcagccatacacttataattagttcacttttctttttgtatgctataattcaaatcacagtgttgtaatttatgaaagcagtacccacacataagcaagtattccttggctatcgagggattgatgaagataaggagtcctcctggtctcctattcagtctcatctgactttttccccaactttttattgtatgaaagaatagtgcaatgacaacttatttacctgtggacacatgttcgttttttgccatgtttactgtgtggttgtgttttagctgaaccatttgaaagtaggttgcagacatcatgacactttacccaaaatacttcagccttcatctgctaagaataaagtcattctcctgtgtaatcacaatatcattattacccccaaagaaaattaactgacagtaattccctccctaataccctctaatatacaatttatacttaaatttttccaaattgtttgaaatttcttttttttaaaaaaaaaaaaaaagcaggatctaatcaaggttcacacattgcattttgttgtagccctctttagcctttttaaatctaagacagtctctcaaaatgttttttcataacactgttttgaagagaccgggtcagttgttgagtagagtgtctcaccttctggatgtgactgatagtttccatgttgtgcttttttcacttactcttgtaccaccagtatttattgtaaactggaagttcggtcaaaagtttgcttaaatttaggttaagcttttgggggacaagaatactacataggtaggtgatatttatttcacattgcatcacatcagaagccatgtaatgtcaggttttcaccctattagtgatgtcaagtgtgatcattttgttaaggatcaactgtattttttttacagtagttaatatccatgctagcaaagtcgcatttattatcagtagcattttattatcagtagttatcagtgctagcaaagtattattctctatatgtattaatattatggacacttggattgtatgttcactattttatgatcaaccacagttatttttctttttgctattcaaattaccttggattagtccagtgggcacccatcatggtggctcctatgtcttttttttttttttccctagcaaatcattccttcagcagtcctatgtcttttgataagctttgattagtctgagtacatcccaggcaggctccaaccccagactggaaagaaacctgcttccttttagagggtattggtattgaaaaagttaagatttcagaattaggagtgtcattccttcttggtacttgaaaaggacagaaatgggatacatatatatatatwtttttttaaccatgatttattttgatatcttcagttaaagtttaacattacagatttgtttcttaacatttggttttctgcatgtgtgcatttgttttctttgcactgaaaatcttggttcctaacaacattagcatttacatatttgctttattccacaacatgcaaaaaaaaatgtgtttgaaaattacaacattaatgacactactaacagtacactaatgaagttttaaaatttcgttggggccagccactgtggctcatacccataatcctagcactttgggaggctaggcgggaggatcgcttgaggccaggagttcgatgctgcagtgaactaggatcatgccactgcacttatagcctgggtgacagaacaagactctgactctaaaataagtaagtaagtaaataaataaacaaataaataattcttttcagttatttttgtccttagaatatatctcactaagcatgtaacaatatcagaaattacttggaagtaagtttctgtgtgattttgttgcccatttggtttgagttttaggatttgcttttttatttttagttaagtgtatgagtatgttaaatatttacatgattcaaacatcaaagttataaaagtactctgcagggagtcaagctgaaagagcacctaatggccacattggaataatttgagcaacaaaataaataatgatagtattggattataacccaaagaataaaatactcatgtctgtactaaagtaaataaacaaatgggagagaagaaacaaatattaacaaaatgattccaaataataaatgttgaagcagtgaaggaaatagaaagtcaccattagaacaccacagttgtaatcgtctcaggtgaatgctaaaattagtagatgaaacttgaaggagaaatagacatttgtatagtattttgcattgtaaaatatttcccccaaaatatttacttactagtgggtggttttaacatatgtccacaatttctttgatatctctgcctccagaaagtagagcttaattcctttacccttgagtgtgggctggacctcgtgacttgcatctaaggaatagaagataggaagggaaaaataataatttacagtgagaaacctggtagactccatcttaaccaagagctcatggttaacagcagtaagttgttctgatatcacctgcacccaaatatgatgtgtagttaatagtggttataccaaagttaatttctttttttggataaatgaaccatggttatggaagatgtttacattggggaagctaagtgaagggtatagacaaaactcatctatctttacagctcttctgtaaacgtacaattagtttaaaataaaagctttcataaaaaggcaaagctgtataaaaagatatatacatagagaagtcttgtttccattcctgtcttttccatcctgtttttccccattccttattggtaaatattttttgaattactttaaaaaaatagagatgtctggctgggcgcggtggctcacacctgtaattccagcactttgggaggccgaggcaggcggatcacgaggtcaggagctccagaccatcccggctaacacggcgaaaccccatctctactaaaaatacaaaaaaattagccaggcgtggtggcgggcgcctgtagtcccagctactcgggaggctgaggcaggagaatggcgtaaacccaggaggcggagcttgcagtgagccgagatcatgccactggcactccagcctgggcaacagagcaagactccgtctcaaaaaaaaaaaaaaaaagagatgtctgttttttcccctcctttcttacatagatgctaacatactgtgtacactatcctataccttgctgatctggaaatttctccatccagtacttaacgatgtttctcattctttttaatagctgtggggtatgctattgtgtgcatgtgtcatattttactcagccagtcccctgatgatgggcgtttgggttgttcatagttttgccattataaataacactacagtgaataatcttgtgcacatgttgtttcatagttgtgacatttcatagttaggacaatattttcagagtcgattcccagcagtgggaatcctgggtcaaagagcaaatgcatgtgtaattttgttggatatcgtcaacttctctgtgacagttggaccattttgtactcccaccagaagcttataagaycacctgcttctctatagctttgccaacagagcaaattgtcaaactttgggatttttgccaatccagtaggtgagaattgtatctcagtgtgatgtctgattatgaacaggtcatattttctgaggttttaattaactggtctcccccgccctttgaacagtgcccaatttaatcagtcacacacaaaaatgtaaattattagttcaagcttttctccaggtamwtaattcttcctcttggagggaagatcagatttccttcagagctaccaggtgcaaggaggagaatattcagccccaccatgtcaccttccccaccagaaatgaggcagatacacagaaaaggttaggtttccagatgaactggtgggagccctggcccagaacctggccacagagctgctgttttcttgctaaccagactaacctggctccagccagctctttcagaacccttttgataccttatttgaaagtatctgctgtctctgatccaggttacaaatgacttatttctaacagtggtctctagatgagatccttcgttgttgttgtttttttctttctttctttctctcagcatggagcttttggagagtgtctttattctgagtgaaagaaaaggaagaggatgaaaaagcaagaacagtttaaaggagctccttctctcatggaccacttccatccacccactccccaaatcacaagatgcacatttggtttacatcagtgaattcagtgatttgtgcagatgtgaattaacccaatcccatgacttgtctaagtgaaagtgcctacatggaataaactgaaaaggggtgctggatggaagagatgsttagttttagaacataaatctttgtcaagattaagacaggcccaggttttgctgaagaatggaatctggaccagcgttagaggacctgtatgtctagtgaagaaaaaccagaagaaagtgagatatacttcgtttcttccaaaactttgtcaaataaggttaaccctttaatctcaagagagagggaggaaatagtcttatttttaaactaccatgaaatttgagatttattaatattagtactggggtcatcttacagtattgtgttaaattggctctggagttagcccgggcttgtaactggcaattgacagtgtggtttctataggaaatagtgatcccaaaccaggtacaatctatgattctagattgcttatagtatggagtattcctttccaactttgtttttctctttctcataggattctaacattttcagagaaccttttggaaagaacaagcctacttcaataaatgaaggagaataaagaaaattcaagcccttcrgtaacttcagcaaacctggaccacacaaagccatgttggtactgggataagaaagacttggctcatacaccctcacaacttgaaggacttgatccagccaccgaggcccggtaccgccgagagggcgctcggttcatctttgatgtgggcacacgtttggggctgtatcctgactctccttggaatctgttacagataggctccccactcaccaccaagaaataattagattctgtagacaaaatatatagtaatttctctgtaccagagcagttcttaaatatctgtttgaatgttgtttctggtgggggtttttctctttctgatttgtcattttaaaggtgtagacttagccactgaggaggtggccagccaggaggatatgaggcacccattaggatcacagttgaggctgggcacagtggctcatgcctgtaatcccagcactttgggaggcctagacaggagcatcccttgaaatctggagttcgagaccaacctgggctgcagtgagccaagatcacaccactgcactctagcctgggtgacagagatgctgtctcaaaaaaaaaaagatcatagttgaagtgtttctaaagggtgttaaaagtataaaacttcagcttgctaattcttgtaccagaattctgacaccctgagattcccatctcattactttgccactaataytgtttactttaccattgattttgttgttgttgtttgtctttttgtttttctacatttaactaagagtataacctgtaaaagttattggttagagtccttaaccagaacaacagacactatgataccctggcaactggaataatttattttcatcgcttctatatgtttcattccttcaagcaattcccaagatatgtaagtgtttgaattttattgtaattctctgtcatatgttattatttccacacagtttggtggactaattataagctctatttttctcatattttccagaaagtatttatttttatatggtatatactgcatataaacaaaatcaagtttgaactttttttattccaattagccatgttcaaatcttttcacttaggccaatatggaccatagtcatattgcgctttgtatgaaagtttactcccrtggtacctttcccagcataaatttgggcttataattgagactcaacaaagaccaagaaagcaaaatggaacagaagttgtctmtgccatatcactcattcttcrgttactcctcaagacgtgcattgtgtcttactctctgtgggagatagagtagctttcagtccaggataagtggtatgacatgcacagaacacgtgatggaaagtgaggccatcagaagatactgataaaagagttgtggcattcaaggaggagacaacttacatcttggagagagcagggaaagtgctaggaagaaggtgccagcattaaggtaagccttaaacgtacatagggcatagccatgccgtgatgggctaggtcagtggtccaacagaagctagcataagcagaggcagggggaaccatgtgacacattgtcagcccagccaggagcttgatttggcaggaaggaaatgatgagaccctgggtggataggtagactgggtcagaccacgataagcctcgaatgccagacttcagaaatttggcttcagtgggtgaacaatgcagtaattaaaaggtttcgtgaaaatgacagacttaacattaaagtcattgtgttgatttgttagctaagattttagttagatttatatacatgccttcctcactggttgtgaagttcttgaagaaggagaccatgttggaatcagttttgtacccccggcagagtgtctgacatctagtgtgatcaggattatgtgaggagagtggcatgtaggaaggattggagtgggcaaagagaagctgaagacagagcagttcagaccccagtgatatagggactgagctaaggttgaggcaactggagggacagtttcttcatccattcaggctgctataacaatatgccttagacccaataatttacacacaacagaaacttaactcttcacagttgtagagactgggaggtgtaagatcaaggtgctggcagattctgtgtctggtaagggtttgttcctcataaaagggctccttgcygcatcctcaaatggtggaagggaggaacaagcccyttgggcctcttttataagggcagtaatcccattcagaatcatttcccaaaggcctcacttcttcataccgccaccttgggaattaggtctcaagctatgaattaggacataaacattcagaccatagcagaaagaaaaggaagcatgggcagtgctgagatggattccacaggactgtgctagaaggaaaaggaagcatgggcagtgctgctgagatggattccgcggractgtgtttagttgtgctctttctttttccacggcaaagcttgctgtttagggagttaatttcagattggaatatgagaagaaaatttatttatgtgactcttttcctttttggcattttctttgtttacatgactttttttttaagaaagttaaattttaaataatttatgaagctagagtttgggggatttatatrtataaaatttccttcaagcttctagagtatcggagtatttgtgaatgataaaaagaaaggtaggggaatgaggaagaccagtttattacgaaggccaaaatttattgtatctatttctgtgtgacctttgataacaaaaatcaagaacttttgtttccctyttaggtgacaggagcctgttgcctctttctggctgggaaagtagaagaaacaccaaaaaaatgtaaagatatcatcaaaacagctcgtagtttattaaatgatgtacaatttggccagtttggagatgacccaaaggtaagaatgataataacttcctgccttctggtcttgattccttatggtagtattgtacagttccacatgttgacagtgcctgtagcccttgtgtctgccagtctcttgagttcctaagagggccttctgtagaagttacttgatgcttttgtaagaaaggagggaagatcgtgtagcctacacttactcagtgcttccttatgtgcccagcagtattctaagtactttggggcagtggcacatttcatggatatgagcaaaaatcctcttaattgccattaggactctgcttcttaagtgcagtggtgatggcagggttacaactccagctagcttctgggtcaaacaaaagtatgtatgctgtatgtacacatacacatgcctacatatgccatgtgtcttttgcttctaaagaatgttggaaggtatcaacatttgcagcatttttatgcacccagagcttgatactggtcacaccagccatcctatcttttccatacagctcacgccagtgtcagcaagtggtgctcaaataattgtacatattttgttgtgtttttaaaataccacttttagggacccatggcagtgttcctccactcccattcgcatcaagttccccttgttgcaacctcagtaacacctgttaattatccttcataacatttatcacagtttgcaattaaatagattttcaaaaatactttaggccaagccgggcagattgcttgagcccaggaattcaagaccagcctagccaacatagcgaaaccccatctctactatataagaataaactggccaggcgtggtggctcacgcctgtaatcccagcactttgggaggctgaggcgggcggatcacgaggtcaggagatcgagaccatcctggctaacatggtgaaaccccgtctctactaaaaatacaaaaaattaaccgggcgtggtggtgggtgcctgtagtcccagctactcgggaggttgaggcaggagaatggcatgaacccgggaggcggagcttgcagtgagccgagatggcaccactaccctccagcctgggcgacggagcaaaactccatctcaaaaaaaaataaataaactaatattactttaaaaaaaaaaaacctttattattttttgctgggcatggtggcacgcacctgtagtcccatctacttgggaggctgaggcaggagaattgcttaagcctgggaggcagaggttgcagtgagccaagattgcgctactgcactccagccaggacgagaaagcaagactccacctcaagaaaaaaaaaaaatgctttttttttttttagagcagttttatgttcacagcaaaaatgagtggaaagtacagagatttcccatataccccccacccaacacatgcacagcttcccccattttcagcatccccccgaccaaagtggtacatttgctatgactgatgagcctgcattgacacatcacccagagtccaaactttacattagggttcattctcagtgttgtacattctgtgggtttggacatacgtatagtaacatgtagccaccattatagtatcatgtagtctattttcatagccttaaaaattctctgtgctccacctgtttgtctccttctccccgctaacctctggcaaccactgatatttttactgtctctatagtttcaccatttccagaatgtcatcgaattggaatcatataggatgtagctttttcagattggtctctttcacttagtggtgtgcatttagatagtagtatccattagatgatttttatcaaattatcacacacataactccctccccttctcagctgtaagatgcatgaaagcaaagactatctgttttgtctaatgcctcattcagtggcaggacagagtaggcattcagcaagtactcgtggaataaatgtcaaactaatggtctgaggaaatttctaaatcacagttaaagctaaagcgatgaagttcagccccattcatggtgttgtttttcctaactagcttgtattgtctcacaatagttatctttttctctgccaagcattatgtatgtatatacaaaatgtatagtcattctcctcattgctttgaggagttaacaagggcccagaacacttttatacatattgtggttgtgattaacactagtattttctaagtattgccaatgtgggtaactcttttgaacttaattataaatccattaatctgtttataaacatttgaacctattaggaactcatattaactataaccaaaaatgcagttttatagaaataatttcaccatcagataatgttttcaatgtgcatgggtatttgatttttactgagtagtggggccctgtgtcctaacgtgataagtctgattgtaggaacatgctgtggttcagtcacacccccgtcacaggggcaggtgaaccttgtggctggcaagctgtgcttaaggataaggcatcacacagatctgggaccacagcagggcatggactcgtggcagctgctggtttgtgccatcccagsgtgccttggagaagccccctttacttttagcctttacccactgtaccatgaagtcaggaaaccaagccccagtccaggaacagtgaaagtagaagttctgaagctcctgtgccccagaaaatgggaaaagaggggtcaccataccaattaggtctgaatgggggagggggctttgcaacctgccccctgcctctctatctcgcgcagtcttccctggtcggagtcggggccaaaggaaaacacctggagctgggagcagtgaagacattggggaagatgttttcctctgcagacaggagggcaattctttagtggaggcagtataagtatttaggaaaaataagatcatgagtcccatggaacattttttgccttaattagctttattttaattgtgtggcttttctctgtaatattcgtttcagcctttgtgttgggcactagacatgaggcacgaggcagaacagacatggtctctgctctcatggactctgcagttgagtggcaggataaattttaatcaaatgagtatataactatttgatgatgagttgtggtgtacgctgtaaaaggtcatttaaggtgctgtgatagcattccacccagggacccaggcaagtcccccggataaataggggctgagggaaggcgttcctgaggaatgatgtttgctcaaagacctataatgaccccattaattgaatatttggaagacagagggagggcaggccctgggctatcctgtaacagtatgtgggctacagcctgcaagccaattggtacacttggtaaaaagaattgtttctaaatttagaggaagtgttgaagcttctgggaagcaggtggtgacaatgacattcaaagaaaaaaattgttttgttttgttttttgagatggagtctcactcttgttactcaggctggagtgcagtggcacagtctcagctcactgcagcctctgccgcccaggctcgagcgattctcctgcctcagcttcccaagtaggggactacaggcgcctgccaccatgattggctaatttttatatttttggtagaggtggggtttcagcatgttggccaggctggtcttgaactcctgacctcaagtgatctgcccgcctcggcctcccaaagtgctgggattacaggcatgagccaccatgtccagcccagttttttttacactgtgtgaaagtttctaagattttaaaaaactttcatgagaaaatgcttgggaaactaagattgaaaaaccttagtcttgccatgtaatttggaataataattatagaatcatctctgtatcctataaaataataccatgcttctaaatgaaagccagtgacctgtgggtctctgcacctgttgatgagatttacagtcctctacaacgccctgtctttgatgccaaacaaggaattctctcaaattgtcctccccgcacacagtgtcttggttgtggtttatgttgtctttaagcagtaggtacagtcggctgtacaggggctgagttcaagacattagttagagagtatcatcaaagaggacattccattaacgatagcaacagtaaaatatccaaggttaaaccttgtggaaacctcgttagtggggtggaaaggactttaaaacaactaaaggactgaaaagatattaataaatttttggaaggaaacttcaatatggttaaaaatctccattctccctaattattctataaatcctctgagtttccaatgagaatattaatagcatgtatgttttctgtaatgatactaagtaaaatggttactaaaatttgagtgagggggacatgcagaacccagaaactgtttgaaaaagagaagtaatactggagctattgtatcccacccaaatccctttgatcctggtccaggagtagacaggcagatcagtgaacagaaaagatagtgtgtgtgtaggcagacatacacacgtagtttaggaggtgatttaggtagcattttaaataaaattggaaatgatcatttattcagtaagtgttgttgggatgatttatttcaaataaatgaaagatttaaacacaaaattgatttgcccccatttgcacgtaatacactatatgtgtacatgagtatatatacacacacatacacacacactggtacaatttatctctgagttttcatgaggctggctatcataaactctttcttgcttaaaatgttttcaatgaaaattcctaaaagattgcatttttaaaatttgaggtcttgaaagaaattacaatttagtcaaattatcaataacgtaaagatctgttttgtaaagggagactcatgtatgtattgaaaataataatatttttaaggatcttttgttttcagtatttttttttacattacacctctgctttgtcttcctgtttgagatcttttcagaatttatcagtgtctctgagcatgttaaaagtctgagtgggagagaaaggaaggaaaggcagttgctaaaatataacttgaagagagaataaatagacaggaaagctcacttttgtaatgctgcttgagacctgcaattgtaattactgtcctaacatttgtgattgatttttaggaggaagtaatggttctggagagaatcttactgcagaccatcaagtttgatttacaggtagaacatccataccagttcctactwaaatatgcaaagcaactcaaaggtaagaagaaagttttcagaagaattttttcattctgaaatcaagtctttataatttgatgacactcaaattacgcttctcaaaagcggaaaacaaagtttgatgtgtgaaataccaagggcatggcttgctcagtcaattcagcattgcagctgctaatgctgtttccttttatgtataaacaggctctgtcatccagttgccaagtgatgggagaggcaggaaaatgaggcagaattttttaaatggactaataaacttagccttggagccaggttttccatacatggtggttcagcgtaggtcatgaggaggargaaggggtaggatgtggacccacatcattcatccttgtttcccacgcaaaagctctttgctgtgtatttgagtggtgctgaacacgtggtaggtttttaataaatacttgatgctgcctgtgaatttttctattgctattaatttacctttttgtccccatttctaggtgataaaaacaaaattcaaaagttggttcaaatggcatggacatttgtaaatgacaggtatacatgttcaaatgttgattaattacagtattttaaaataggcagagactttatggaccatttcatctaaacccctcattttgtgtcagaagaaactgacttgccctggcttgaggagccagttaatggcaaagctggggctgacgtccaggtcatctgcttcccggcagagggtttccttctgccctgccgtgtcatggtgttgtgaggtgcygaaattttatcaccagtctgaaacataartccaaaacaatacactggagaattttgaaaactaattacttagagcccatttggttttgcaaaaatatacttcctggtatagttttagagccttaacactcttttgagaggccagggatctaatgaggggccgtggtgggaaacagaatgcctgtgaatggagttgctgccagccccatcccactgcagtcagtgaagcttctcttacatttgacttcctccataagatttcatttgaagaaacagttgagtggctaggatttcaacagtttaaataacataagtcattttcattggtgtagcaatttttggatgtgctagaattcttctgattctttaaggaatagagaaattactaactatggttaaagtaacttagtygggtacctttagaagagtaaagacgagtttatttatttatagtactttaattaaatttaggggagaataagcaaattaatggttagttatggcatctccrtgcactggtttaatcataaatattagatcatattatctaacctttttttttcttgttgaactagtctctgcaccaccttgtcactgcagtgggaaccagagatcatagcagtagcagtgatgtatctcgcaggacgtttgtgcaaatttgaaatacaagaatggacctccaaacccatgtataggagatggtgggagcagtttgttcaagatgtcccggtcgacgttttggaaggtaccaggcatgctaagcgttctcgtgagggtgttccatgttgagatgattcttccatgtgtaccctgagtcccaagaatggattttcccagatagacrtatgtgagcaatatttcagaagcatcattaattaaattatctaatagtttccactttgtccaaacacatacttttggtaaactaaaaatacacaccagtgttgcacacaacgaagatggggtgagttgtaaatgtgattcatgcttaggtcctcgtaggggtatcataactgattctttatccaggtaaaattttatttaaaataccaatttgtgtaaaatgtaattgttggctatcatttagacatctgccaccaaatcctggatctttactcacaaggaaaacaacagatgcctcatcacaccccccatcagctgcaacagcccccatctcttcagcctacaccacaagtgccgcaagtacagcagtcacagccgtctcaaagctccgaaccatcccagccccagcagaaggacccccagcaaccagcccagcagcagcagccagcccaacagcccaagaaaccctctccgcagcccagttctccccgacaggttaagcgagccgtggtgagtgggctaaagcaggccctgggtagagcaggcwttccaggtggcggcaacacctgagcactgttcccatttctaagcgagcacagggaacaccggaagcagggggtgttcgccgaaactcgcagtccgactgcttgtcggtggggagcctgaaaacaaaggtgctccaaggacaggctgcctctgagaaccaggagggggctctctgcccggctccagccctgctgcctgtttcatccctgccagggttctgaagcctgtcggtgtcgttgccgtgtcctagcagtgtcgttgtgcatgctgcttctgtgcagctgcctgaccccaaacagtggaccgtttcctgcacccaagtggtcctgaaacttagtgtttactcagaactcaccattcaggaaagctagtcattctgtcttatttggtaaatggaaagaggaagggagcagaaatgatgatctggtaggtgccgtggtttgccctgaaagttcaggctagaaataatttttgtccgaggctgttcacagtgactgccgtcgctgattctggtggtacctggataatccattttyttctcatcatactcaggatcccagttaacaattgtgtattttcttttgtaacaggttgtttctcccaaagaagagaacaaagcagcaggtaatttcctgttctgatgtttttttagttttatgtgtttatatgcaaaactttaaattcttagccaacattgtttcttttcagatctaaattggccttaaatcttaactttagagctcatacaaaacttttccatcagcattgtctttctgttcatcacctgatcatagattctaaaattgtgctcttacgaagctatcagtacagaaaacattactggcaataaaaatgtactcagtaacatatataaaagtataattatggctgtaggagaactgttgctgcaattttatttttagagactatttacccccatcacagcagcaggagtcctctcccaagcaccaagccacagcagatgcgggggggcagtagggggtggtgtgctgcccggacagcaccagcccggcccagcccagctgcccttgcaggcaaggcctctttgaaacacacttgggttgaggtgctgtcacatgtctagaacccaaagttagttcatgtcaatattggaaataaacagaaggagtgagcaaaattggaacaattacaaaacagaaagttagaaatgttttgtcacagggtcagtccacctatcatactgaactctttgaaggcacagaccctattgactcatttgtctttctttgttacttggttcttagttccagtagttcctggttcttagaaccatgttctcggttcttagttccattcattaaactgctgtgaaatcttccagttatgatagagctactttttttttttttccagtatatttgagggaatgatgagttcagtacaggtgaattttttttttttttttgagacagagtttcactcttgttgcccaggctggagtgcagcggtgcaatcttaactcaccacaacctccgcctcctgggttcaagcaattctcctgcctcagcctcccgagtagctgggattacaggcatgcaccaccaggcctggctaattttgtatttttagtagagacagggtttctccatgttggtcaggcaggtgtcaaactcccgacctcaggtgatctgctcgccccagcctcccaaagtgctgcgattacaggcatgagccaccgtgcccagcctacaggtgaattttttaattagcttcaaattgaccgacattaaatgttagacacaagaacgggctacactccatgccacatgaaatgcaattgagttgacgtgcaggtctgtcagaggcaggaaacaaactatatatgaccttgaaggaagagttgcatttgagcagcgagagcagagggggaggatggagcartaagttggaagtaygcaagtgagcaaaggaattgagaatcaggggaaatggagaggagtctttctggaatgtgatgaattgaaaggcaatagcttctgataggatctaaaatgtgggttaggaccagatcacagagtttacctggaggactgtgagtttggcagaggcaagggaagccattggagatttagcaggggaatggcagagtctaaattcatttgagaaggagtcccctggcagcagtaaatagggcaagtggttaggaatggggagaatcttgctggcactcatgggaaacatggtggcctcagcatgctggctgcggggcaggaagggcagatccggaggaagctttatagaggaactcagctgcactgtgccatgccgaaggctactggctgcagagggctgcaagcactcgaaatgtgactgggtcaaattctgaagcactgacaatgcaaaatacacagagatttccaagaaaggagaacgtaagacatctcattagtaaagctttatattggttacatgttgaaataaaattttcgatctatcgggttaaataaatttttatcctttttccttttatttccagagtcttgctctgttaatgcaggctggagtgctcctttttcttgttaaagtggttcctggcacacttgtaatcccagcactttgggaggccaaggcatgctttgagcccaggagttccaggccagactgggccacatagggtgaccccatcactacacaaaacttaaaaatcagctcggcgtggtggcgccacacctatggtcccagctacttgggagactcaggcagcaagatcacttgagcctggttggttgaagctgcagtgagccatgattacattactacactccagcctgggtgacagagcgagaccctgtctcaaaaaataaaatggctcctggaaagtttaaaattgtagatatgtggctctcagttatattgctgttggacagccctgatgtagacggctttagctaactattaccagctgtggaaaaaggcaggaggtgggtccctgaggtgagagtaatagcagttataggatacagaggcaaaaggtagwgtgtgaggtgctgattggtgggtctagggatgggccatggttttggtggcaagatggacgctagaaatgtaggtttgtagttgwccacttagagaggggctttggactctgaggaagagggtgaagagagaggaagtccctggaacttaaattgagcctgtatttgagatggaggaaatccagagaaagaggccagtgatggcagaggagactcagatctgagtggtgtacaagccagaagaaagtacatttcaggaagaaaaagcctcagcatgcaaacagaaaaatagggttctttttcagttgtgatgtgcacgctgccttcttaaacggatgagattggacttcccttgggctgccttggagacctagtgctgtcattgtggattctggctgcgtgccgctgcctgaccccggaagggtgggctgtttcctccacctcaaggggtcctgactgctgggcttttgtgagcggcacattcttcctgccatcagtgtgtcaacctccagagctctgctgactccagttaatgtgctgcttctgacatgctgccaactggaagtcagtatttgggaaagagagaataaactatgtctaagaatgaaaagatagagattctcttgtggaaccctcaggggactcagtgacatgatgttgctactctggacccttctttgtgtcctctgtaccagggaggactccagataggtcatacatgctcatgaagacgttgctctgctggtctcacatggtcggaaggacttgagtgaagtggtcagcaaggaaacttaggtagacatggaaaatgggctgcctgtgggaagctcgcaggtcttttggagggaggtggcatttaatttgttaacaggattcatgcataatggtttagctgaaaccttcttcaagttcccttaaagccttggtcatctctgttgtttttctcccaaagaaatctctgccagtacatttttctttatgacatgcttattcatgtgaagaagtatgagtggttttctaatctgctttttctttgtagaaccaccaccacctaaaatccccaaaattgagaccactcatccaccgttgcctccagcccacccacctccaggtaagcatctgctgaagcagcttggccagctgtgcacatcgcctctgaatgttggacgcagcaggtcctgggaacttagaaaagggagactggggcccagattgacaatgtcagccacaggcaggaatctttgcaaaattgttcttgggctgggcacaatggcttgtgtttttgatcccagcactttgggaggcggaggcaggagaatcacctgaccccaggagttcgaggtcagcctgggcaacaaagtgagaccctgtctaaaaaattagccaggtgtggtagcacacacctgtagtcccaactacttaggagtctgagatgggaagatcatttgagccctgggcagtcaaggctgcagtgagctatgattgcaccaccgtactccagcctgggtgagagggagaccgtgtctcaaagttctgattttgaccaggtattttgagaatgttgtaaattgttaagtatatctgaatattttccgacctctcacatccagaaatgctaaactacacattgtattagaatcagttttaggaaagaaagccaaaccccgccttctgagatagaggcagggttactgtggctactaggctccggccgcccctacacctgcttcctattggcagtgtgtcgtcttagtgcattctgaagaataagcaattgtacagagagtaaatgaaagagtgaaaagttctcaacaagtagtacatggtaagctggaaagcctctctgataccgctggcaatagaggagaaaagctgtaaagtagatggcattctttacctgtggcaccatttcagaaggtgatgcgctagagaaggccagagtgacctgtgcttgctctccaaaaggtggtcgatactccggaggcttccaagcctctgtcagcagctcctccagcctgctacactcactgttggtcggtgcacgtggctcacactggggctgacagcactgtgtgcccgtaacagatgtgccacagattacatttctgttcctactcaatcatgatagtgtttgtgctttgggagaacagaggcgtcattttccactttggggccaaatcccaaaacccccaattcaatatgaaccttacttaaatgcctgtggttgctcatgaagcatttatggagcacctcctcgccaagtgcagttcccctggtccgagcctggggctgtgccttcactgaggagatgggtggtttatctggggagcctggggcagccacaggggtgctgctacctccagggcactgagtagctgctgtggaggcctcagagctctgctccctcccccattacagatagccaggagtaggcctgggacttgagtgggacctgggtgccagatacactgccaggaggccatggctgaagagagcagggcctgggaggcgcagtaaagctgggccgtgaggaagggagggaagtacgcttcctgggaggccctaggccatgggaagaggcattcaggtcagcagtgatgtttagggagcagtttggtggcagtgtgtgggacttggtcaggagcaagtgtacagagagggaatggggtgcccaggagagacccccacttgctgttccagctcagtcacacagcacaagggcaggcacactggtgacttgaagattcaggctacagggtcgagtgttggaaaagttgatttctgcaaggtggaggagcaggcctgtgggcccaggtggctgtggagtgacacacaggaggcattgaagggtgtcagcacttttctgcacctcttttttagtcagctcctagaaccacagggcatctggccctgacctggagccaaagccagttatctaaggccaggcacatatgaccttcctacccggtaggctggcggggtgctgatgtggcacaccagtggcacacctgttaccgacctgatgaaatcctgctcatgctcgctttggcaagatcaaacgggttgtgtgccaatggccacgtctacccaaccaggatgtcgtgctgtgccttgcctaacccaagtgcctggggaaccagaagcatcttcgtggctttgtcctctctatgttctctggaaccagaaatgttgctcctgtggtctgtctcctgggctgccttgggaaaggacactcattctgtgtgtttggctacctgtggtggggtgttgcgatgtcattttccagtggtctgacggtgacccgggatcacaggccaaaacatgttaaataaggctttggcagaagggggcgtgagggctcatgggttgggaggcgctgtgggaggggcctgaggctggttctgagcacgagtatcttgggcgtgctcaacacctagtgctgcctgtccctgctgcacacgcagcacgcacacacacgcagcacgcacagacatgcagcacgcacgcagcacgcacacgcacacacatgcacacactcctctcaaggaggctgctatctgagagcacacagtggggtttgatgtagcctctcttgagtagaatagaacctgaattgctgcttcgatgggtacaccgggaatgtcagagacttgtacagaattgttttaagtgccatcacattcatttgactaactctgaggttttctgcaaaatgccactgctgcagacaggagttcagtgtggccctgacccctggggtcagtttctgaaggcagaaaaacagaggagcccccacacgttttgcactaggaagagggggctggggccagggcacaagggggcttcgggtgctgccgagactgcctgtaggtggtgtggtcagggctgagggagggaaaaccccaggtcgtcgcagacagggtggagggccttcttgacagatggtggggagacatctggtggcatcaggacatggggcatgggcccatgcgttgggccacagaggaggcgggcagctgctccctgctcctctgtaaagatggccctgaagggccaggaggcactgaaaaagcaaccattgctggcggaggccgggcactgatgcgtctctctcctgcagaccggaagcctcccctcgctgctgccttaggtgaggctgagccgccgggccctgtggatgccactgacctccccaaagtccagattccccctccggcccacccggcccctgtgcaccagccaccgccgctgccacaccggcccccgcccccacccccctccagctacatgaccgggatgtccaccaccagctcctacatgtctggagagggctaccagagcctgcagtccatgatgaagaccgagggaccctcctacggtgccctgccccccgcctacggcccacctgcacacctgccctaccacccccatgtctacccgcccaacccgcccccgccacctgtgcctcctcccccagcctccttccccccacctgccatcccaccccctactcctggctaccccccacccccacccacctacaaccccaatttcccacccccacccccacgcctcccgcctacccacgcagtcccccctcatcctcctccagggttgggcctgccgccagccagctacccacctcctgccgtcccccctggaggacagcctcctgtgcccccgcccattcccccacccggcatgcctccagttggggggctggggcgggcagcctggatgagataacgtgagccttttttccctctttgtttttttaacaagattttctaatcgacttgcagagtagttgaagtgggtaagcagcagggtaccttgtataatgcacgacagttgcagtatgggaagaatggaccgggcccctgggataaaatcagagtggtcctcacacctagaggacggggacaaccagctttcagagtagcctcatcagtgcccttgcagtctgactgtgtacacttggttcagctaatgtctgagagtcctgcactgggttactttatamtagtgaggacgttaaccagccatattggctcaataaatagcttcggtaaggagttaatttccttctagaaatcagtgcctatttttcctggaaactcaattttaaatagtccaattccatctgaagccaagctgttgtcattttcattcggtgacattctctcccatgacacccagaaggggcagaagaaccacatttttcatttatagatgtttgcatcctttgtattaaaattattttgaaggggttgcctcattggatggctttttttttttcctccagggagaaggggagaaatgtacttggaaattaatgtatgtttacatctctttgcaaattcctgtacatagagatatattttttaagtgtgaatgtaacaacatactgtgaattccatcttggttacaaatgagactccttcagtcagttatccaaataaaagcagttctgaaactatccctttctttgttatgggtggaaggtggggctccaggccttcgcagtctgtggcttataaaatgtgcagaggccctccttccagaccctggggacgcgggagaggcctggctgcagctcacagcagccacagccaaccccactgcctcccaaggcactctgggtggatccgcacagctgcctgccaagccagcctgcccccatcctgtgcctgccttggtttcctttggaggacctggttgagttccaaaccagtttgaaactttgaagccttgctgcgtagaacrcacacaggaacccgggggcttggatttgaaaccctttccacttctggcctgtgatgagacagaggcagctggaggagcagcggcctcactgtccaccttgaggggccacggctctgtctgtggaaggggccccgactgagcccccatctgcggtgcttgaggggccttggccctgtctctgcctgctgaccctgccacccacgacagaaacaagcactgagcacccagccaggaggctcacaaagaggcctttatttatctagctcaaagtagacactatcacaatcttgtttgttactccttttactaaaatagttcaaatcaatgtttttaccacactatmaaaaagttctatttcttcttgtctccccacgtcagagtggttgaatagaaggtagaaacaggccgggagtccacgggctcccagctctaaacggcgccagggcaggaaggggtggctccaggtctcactgtggcaccttctacagaaaatagacgtagctgccgggcccggggacagaaaccagacgttccagtccatctccaaaaagcagcacaaatactttgccccacagtatgaaaaatatacacctctaccgctctgcagtcatgcatttagttttaagaaaaaaaaaaaatcagtagtatgtatcttgtttcctcaagtttcaagaaaaaaaaaatgaaaggtcacttttttctctttaaacactgatgtgtagctagtaacttggataaaaaggtgccaccctacaaaatgtgctcagcatgttctgaggccaggatgggcttggccacctgggctggggcgaaaggagacctccatctgtcacagtggaaactgaagccgagtgccagtgccgcgtccggcttcaagatcaagagtcagagcctttgaaatggaaagggggcatctgaaagggcacccccactgggggctttcagagctaaggctccagaaggaagggggtcgccctgctagtgacggagctgggagtcaccctgagctacagcacgcccagatttcccctgtgggaagccccatctgaccttctacagcccacggctctgcaactgccacctgtactcaggtacatggcgtcgctgctgctggcttttaaaatcagctattagtttgagatgtgacagtcgccgacagggttctgtcctagaaagccatcccagtgccgtgttggctcaggggtcaccagctttgtgctgcctccgtaacagcaggagggttctcaaagcaatgttccactgatccctggatgccactgcagcattaaagacagggtcagtccccttgaggggaaaggtggcttcaaggctgttctctgggcctgtttgcaggagatccgcaggtaccaggagcccgtacttattgcttatttcagtggtggccacgccaacctgacccaaacatgatgcacacgggctcccagacttggctgccactcaaaatggacccacagcccttgggctactctgcggttctttggactgcaagacccagaggggcctctgctcagctgcccactcgggcaagaatcactgggtaccatgagcagcaggtgttcacccaacttcacgtgtacacccctagtgaccgggagcgcaccacctgacygggcgacactccttcccaaagagcctcctggcaacacccacggcaggagcgccacaccatcccatcaccagcacccacttacccccctggggctaagatggggggcgtgagcctttcccctgagagcaaacgggcagcaagaactgctcagaatagagccgccagctagggagagggacagggcgrccatctccctcctcttgcctgcatccccagccctgggcctgcatgagacctgctgggtaggaagacagcctctctgggctcttcaggtggggctgagcagcccctggaagagcacaggagtctgacgaggasctggtgaggtcctggacccaagagctagggctgcttacagtggcatgagcggatgtggggaagcggcctgtccccgtgctgcagctgtgggatctcccctgtcatgtgccacacatcaccccctctaggccttactttcctcacacacacagttttctattgcactttacagtttatacatggtcatttacactgaagatctcacttgatgccagaatcctgtgaggagggccttatgctgcccattttactactgaggacacgggctcagagtggggaggcaactctccacccgcagcgactgcaaggcagcagaactcagctccacccggcccgccctcagccgtcggctgttggctcacgccccctcagtgaggacccctgccctgtggcgctggatgacctggagccataagcatggccgaaaaggaacctcagagacctgtttccaccaagagcccagacaggctgagtgaactgctaaaggtcacaccacaaactaaaggcagaacctggccagacacgctccttcccaaaaagaacagaactctcatctgcagcctacacagctctgtccacagggacccaagatgcagccaggccctgggggaggtcacagccaaccagagccccagctgtggcccagtgctgcccatcaggaaaatcacatgtggctcagcccagaaactctccccaggcccttcctgttactggcctgtcatgtaaaccacgaaaagggacgtgcctcaggcatggggcaggaggagcccaagaagggcatagcctggacagggtggcagggggacattgcagagactgggggggagggggatgacctccaaaagcaaggagcagcgggcatcgggtggctgagcacagatccccaggtgtgagggcaccctgacctccaaggctgagggtcacaggaagggcccagggcagcctccagccagccacagatgtggtgagtggccttgtccacatgccggggacccagtgcttggggggcctgggcccaggccacggcatttgggcaagaagtggtgccacctgcgtcaagacccaggtagtggtggtctctgtccagtgtgggtggcagccggggagtagagggtttgatgagtggcccctccatcccaggcaggacagaggagcctggacagttcccaggctggatctcagaagcagcctgcagcctcttgctcatggagcccagggcccagagggggaatgaggcgtccgggccgctctgctgcaggaacagtcgcagcgtctcgtcttcccaggttgctggtgtatgaggcgggagatggcggcttgggccagtgcatcggacccatggcagctgggccagggcgggcagcgtcctatgtacagttcaccacagaggaagaagacaggggctgggctggaggtcctgcccgtgtctggggcctgaaactccccctggggacccccagcagggccagtccacgtccacagaagagtggccctacaaaggccccttgaactggttcccagacaggtgctgccgtatggagggcttggagctggctgcatctcccagctttctccagaccacctgtggagaggagagagatgtgagtggtgggactcacccgcgtccacctgccgcctatgcacatccgccgcctcatcacggcagaatcacccacgtcctcagagccatggggccaggagggacacggaggccactgcaggcccagagacacccacaccaggtctttgcatgccgcgctaactatcgggcctgagcaggtcactgctggggtgtggctcagccttgcagctgtccagtggggtccacaggccccactaggtgatgcgggggaggggctgcacagttcagagcctctcgccccccctttaagtcctgggttcagaccctatgaaactccttccccgatggctcctgcaagcacccccaaggagaccgccgatggtgctcagctgggtcgggcacggggctctcctgggcagccccagcctggtgggctggagggttccacctggacctcctgctctgagcaccatctgcccagccagcagccacagggggcaccagcaagctgagaggcccgggggccagcacccagggaacacctggggtgaacaaaccagtcccgggggggtggggggctcaagctctatccagaaccccaggcacggcactcctggggagggcggatctgcagacaccaggggccctctgggaagggcagggggcagcgagatgacaacgggccagggctcctagcacctctgaggcctccccccagctatccaaggtcacccagccttcgctgagcattcgagaaatggagtcccacatggggaagggtatggccatgctgggtggccctggtcgcactcccagtgccaagcctctgccccccacccctggaagcctcacgttgcacatctcgcgaacgatggccttctccttctcactcaggtcctcctcacagctgtcctggagctgccggtccagattctcgtgtacctccaggacctgaagggaacgggtctcggggtcaggggcagaggccaccggcagacctcgggcaagtcacctggcccctgatcctcagcctcccctgctgcgaaccaaagctgaggaccctgagccgctgggcccctggggacaagcgtggaaaaaactgaggggcaggttgtcatctcaccctgctgacactggatgccctacragggaagcagctcatggctgggccacccgggaggaagtagacaggctgggcaaggaagaccctcagacaggtggactcactgcaacccagggcccgctggagatgagtgggcactcgccacgtggagggggtgtgagtaggcgtggccgtgcatgcatgtgggatgtcatggggcacgtacgtaggaggaagrggggcatgggagtggggactgtgctcaggtgtgcacagcctggaggaaccggagcccatcggactcaccagtctgcacctgcagaggctgggcctggcagacctgaggttagttctagccccactcctgcccctctctctctggccttagttgggtgcctgccctccccgaccccaggcctcagtcttgttaggtgcagtagctcagggatggcagacaggtgacacacttatgactgccacctctgagttcaacctcacagtgctccaggcagccatggtcacccagccacccacacacagatgaaacctcccacccctgccacttggatacccctaggtgcaaaggtcccacagtctcacagtgcacccagcatctgaggacttctgagggagcgggtagtggccctcaccttcatggcatgcacgacagcctcgggcttctgtcctgcagggctgtagccagcagaggggggcgagggcagctcaggtgcggggcaggccgggccctggggaaggcaatcacacatctcagctcaccctggctggctcccacaggaatgaccggtggctcagacaaggcccccattctgaggggccagggcccaggcaggaggaaaaggggaccggggtgaggcagaggaggcaggtgtgaggatggagacccaaggagcccacagccagtctggccagtcccgcccaccaggtcttctgcagatgaaatggtccctgatagcacagaggcaagaggggcagtccagggcccacccacacctctcaggctcctctacaacaccccacagataagacctagcgtctgttttgcaaggaaagtaagttcagcctagggagggcaagagacccagatcacagcaagaccaggaaggtctggacttaaccctggcacctgactccaaactcccttcccctgcccaccctggagccaccggtgggcgaggccggcttcgccctgagcactccctggggcctgcctcccagctgccacctcccagccctgcgggatgaattggctgccaggtgcccagctcccacatcaggccttggggaggggacccagcctctgtcagaagctgcatgtctacccaggggcaggcagtcccacccccagcttcctgcctggaagggtccatgtggctgggaagccaggtgcagggctt

SEQ ID NO: 12327 - DNA, 27867 bp, Homo sapiens
  misc_feature (1)...(27867): n = A,T,C or G, or insertion/deletion polymorphism (see Tables 1-2)
atcttgtagatattttcacatatttgtgaaataatgttatatacaaggtaagtcattacgacatcatagcaaaactggaaacaatgtaaatgtctttaagtagaggactggttaaatgacttgtgatatatctatattatggactatgacatggctattaaaacaaatatatatatatacactggtaagaaaaatattcaagatgtgtgctaagtgtaaaaggcaagatacagggccaggcgcggtggctcatgcctgtaatcccagcactttgggaggccaagtcaggcagatcacgaggtcaggagatcgagaccatcctggctaacacggtgaaaccccgtctctactaaaaaatacaaaaaattatccgggtgtggtggcaggcacctgtaatcccagctacttgggaggctgaggcaggagaatggcgtgaacccgggaggcggagcttgcagtgagccgagatcacgccactgcactccagcctgggcaacagagagagattctgtctcaaaaaaaaaaaaaaaaaaaaaaaaaaaaaggcaagatacagagtactgtgcatattaatgccttcatttgtataaaataagaaaattacatatatgttttgtttgtatatgcataaaataactggaaagataagggaaaaaataatattggttgtaaaatggatggtttggggacaggaaggagaggaagacttttcctagaatgtcctttatacatttgaaaatttttttttttttagcaatagcaaggtttattgtttattgtgaagagcgaaaggacaaagcttccacagtgtggaaggggacccgagcagattgccctacatttgaaatttttaaactgtcgttgtgttaactgttgaattaaaatttaagtgtttggtctgaaagtattacttctgtttctttgaatctygaggtactctaacatttaatgtttatcatatattcagatgagtatggaataagatcatgtatcatctatgttatttaactatgtccatattgtagttttccaagctaaattatgacaattatactctatatctgtggtttttaaaaaaatgctactgtcagagcacatcacattatgtatatagtaagcactttgtagatacctgccaaatttatttaaataccttacatttggcttccctaccagagcagtgcctgcagtagaacaaattgagcttattgtctaaaactcttagtaattgtacagttactcaggaagtcactggaagaggaaacgacaatggtcctaaaaattagacgaattatagcaaagtatgactttttaaaattttactcaaagcagtgggagaatataatacatttttaaaggattattggctggatgcagtggctcacacttgtaatcccagcactttgggaggccgaggtgggaggatcagttgaagccaagagttcaagaccagcctggataacatggcaagactccatccctacaaaattttttagagctgggcgtggtagctcacacctgtaatcccagcattttgggaggccaaggcgggtggatcacttgaagccaggagtttcagaccaacctgaccaacatggtgaaaccccatctctactaaaaatacaaaaaattagctgggcatggtggcgtgcacctgtaataccagctatttgcatgactgaggcacaaaaattgcttgaactggggaggtggaggttacagtgagccgagattgcaccactgcaccccagcctgggtgacagagcgagaccccgttacggcgagctgagatcgcaccactgcactcctgcctgggtgacagagcaagaccctgtttcacatggcggggtcttgctctgtcacccaggctggagtgcagtggtgcgatctcagctcgccgtaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgatctgcccacctcagcctcccaaagtgctgggattacaggtgtgagccacctcacctggccagtactttttttaaaaaaaattagctgggtgtggtagcatgcacctgtggtttcagctacttgaaaggctgaagcaggagaatcacttgatctcaggagtttgaggctgcagtgagccatgttcaagccactacattccagcctgggtgacagagcaagacttgtgtcaaaaaaaaaaaaaaaagaattattagtaaatggttaaaatttttagttttgaagttgaaagattaaacttgttatcttagagattgactgatagactctgtcaccaatcatattaaaagatcagcaaataaattttagtgtctactatgacccagttttatactaggccctgaggatacattggtgagctaaaacagaggtagttttacactcattgaacatacagcccagtgagggagacagacattaaatagtaatgttcatgtttgattaattacaaatgaattaaatgctctaacaaaaagcaacagattttcttatagtgtgtataaaagaaatctgatgtagatatatggtatcagggaagatgtagtgcttctggacctaaaaaaaaaaaaaacagaggctgtgcagagtccacatcatgctgtccatgttaggtatttcagtcatttccagatttatcaatgatctattgctgtgtaacaaaccacacccaaacttggcagcttaaaacaactccacaattctgtgagttcactgggtgattcttctgctggtcttgcctgtggcggctgcattcagctgggggctgagctggggggctggtcttccctattaggcctctttggtctggtggtcccaggattctcagaaggtagactgaagctgcaaggcttcttgaggcctaggctctagaacttgcacatcaccactgttggttaaggcaagtgagaaggctagtagtctagattcaagactgaggagatagattccacctcttggtggatggaatttgtggccatatttttcaatttaccagtctatcaagtaactaattaataaatagttatttactaagcattgttttaagaactggaaatcaaacatgaataagagacagtaatatataagttgccttttttccttttctgtggagtacatggtatttgctcattgtcattccattttccatagagatcaatatttgtgaatgtttttttccatagtaatgaatgatgaaatgaataaaatataaacagtagagtcttaacctaattagagaagaggaggaaaatccctggggattataagtaatttttagtctttccaaatttgcataaagaaacatattttgtagtcagaaaagaattagtgctatgctggtgtagccatgcagttataaatgatatctataagcacaaaaattaatttagtagtgataatcttagggaactcaaatttttctttctagttattatcactttgctatcaggtttattttagctacttttcttttctttcttttttttttttttttttgagatggagtcttgctctgtcacccaggccggagtgcagtggtgcgatctcagctcactgcaacctccgcctcctgagttcaagcaactctcctccctcagcctcccgagtagctgagattacaggcatgcaccaccatgcctgactaatttttgtatttttagtagaagtgggttttcaccatgttggccaggctgagcttgaactcctaacctcaagtgatccacccgcctcagcctcccaaagtactgggattataggaatgagccactgtaccccacctcttttagctaccttttaaaggtggtttcttcctagctcaaactttacccttttgaataattctgaattaatgaataaacattatatgtaaaactaataacaaagacattagctacctggaattttgtttttgcaggaaacatcccataacaacaaaagtatttgatttgcttagagagttattttattagcagtaatagcatctaactttccaatttttttttaaatctaagaatgataagaatgctgcttttcttctgatggaaagtgacaggctaatcatcagtttacccagagtgaagtggacggaagcagcactgaccatggcgtctcagcttcaagaaaaatgtattgcatttattgtagacaacttctccaagattattcagagtgaaaattttgctcttcttttacaggtactatgcctaaattatatcctatatttagttccatctttgtgttctgatttcaattatgtaagagcttttaaatgcaggttgcttttgattaaattaatgtgatttaaataaactccatagcagatggcatgtttacataggatttaaggcagtgatggacaggatatttggctcacaagatgagaaaggcgagagggacaggtttgagtgccctggcaaggcacagtgtaattctggccaactctagccctccctcagcaagccacattttagaaaccaaagtcataaaggtactgttttggccagtaatacaattatgatccatgcagaattctctgtcttattgggaagctactttctctaaaattattcacagaataactcctattgtttatttctaggttctgtatttagggctatgttggcttttaaaaactgtgtgtccaacatggcacatgtatacatatgtaacaaacctgcacgttgtgcatatgcaccctagaacttaaagtataataaaaataaataaataaaaataaaagctgcgtgcatatgcatatatgcgaattttttaacaaagggaaaaaatacgatttctggttgacttcatacagctagttataatgatctgttacgccagactttcacatttcttgtgcattttatatgtattcctcttaaatattaatttctgtgttttatagtcacaagcaatgagcagcacagccgatctgttggacacaattttaaaagcaattgaagaaaatatcaccactgaaaatagctgctctcttcttatggctctggacacactgctgaactctgacagtacaaaggaaatggtactgaatgtaatgaaatttattaaaataatgcaatatttgaactaagatttttagatgtatgtgcattttaaatgttgcagggtcattgaagctaggcagtggatacctaggggtggattaaggtctctacttttgtatatgtttggaattttttataatactaaattttaaaaattccgtttgtctccaaatggacttcttataaaagtttagaaattgrcagtttggctgggtaattttaaatttagtgtgatatttagcaacattatttggcacagcataactctcgtatttctccctggtcctacagtaaattttctagatataaaatgtatattttagatataaatgtatattttagagtttttaatcatcagtgtcttttatttttataatcttaatttttctcttcaaaaaatcatattttaaaattaggctgggaagcaaaattaaaatatttatttttaaatacaattaatcagtggccattaattaggtaattacaaattattggcattctgtatttgttcgacaagaatggtttttaaaatgtatcatatttattactattccatagagcatttgaccttgtaatgtcatagttgatatgaaaaggctgtggaaggtgttcatatcaagggcattggtgttttaaaataacatttggttgaaaagatgagattttttagctttgtgttcatttataaaattttgttattaataagtcttcataaataacatgtacccaacgatcttaaaaatctaaatgatgacatcattgatctagcttaggagtaagtagattctgaaaggaataatgactggttgctatgacaatgtggctctcaccagctgctgatttgttgcttgaacacagggttttacgtgcaagatccaggctctgcgtgataagctgtggatcttcctggttcagtctttctatgctgttcgtcacacagaaagctggaagctgatgagcacagatgatcaacagaaaatccaagcaggtacgttagccttgagatatttcaattcttatgtaatgatcattgtgacmgcagatattttgagggcattctgrtaagtgaaaaggttaacatttgtgtgcttctgttggataataggataactgaaactggtgctcatatgtttaggcagttttaataaatcatgctttttagctgttcttagaaaatgaaactcatttcctttatatatatatatgtttctaatcttactatacattagcaacaatgttctaggcaaatttgcttacaagcattcttgtgaagagattaaaagtgtaagaaaatgtaacccacatagaacagagtatcgaacatactttttcctcctttttaaatatgttttgtcataaagcttttccatctttttcataagacaccctttcttgtggttttgcctggaatagatggctttatttcacaactgattggttcaatgatgtggagtgtgctattgcggactgtccctcaggagctgcacagtggtctgtgacatttaataggtatcatctgaaacattagcattaaacaaaagatgtatatrgctcagaacatgtgtttaaaaaaaatatcaaaataaaaatttgagggtgtggaactgaaaatgtcttcatgactatttttgggttaaagcaggtgccttagataaaatattggcatattcagtgtgtatactttttaaaacattttaagagactgaattttatgaagcaaacattttagtactgtaaacatggaagccatgtctgttaaaatatattttgagaatgcataaatatttaaattctttagtggtatcatcagaataggatctgcttttacattataagcattacatgatagtgtagctagatgtgatatgaagagcacttttcaaagaaattccattattttaaacaaaaattatgagaagaatctcttagaaattggacatttttttccttgtgactatttctgtgctgatttttaaatgatggtttatttttacaaaatttatgtaatgtaaagtaacaagataagatcagcattccttcagtaggtgtcttcagctctcttccgattagtagcaaactttggttttctctattttagaggatttcatagttaagttgagcttctgtgttctttaattcttcaaagtgctaattaaaaatacatgtaaatacccatatttaaataaaatgttattggtaatccaactatccagctaatccaacaatcctttttgaattgtcaaaaaggacttttcgttctgttacattatatcagtgtaataataatgttttaatcttaaataagttgaattataatgagttctgacttatgcataattacttcattgggaaacccagataaaggaatggttctgggttgtctgttactacatttcgtatgtcatagttgagttactgacctttgggagaaattttttagtttaatttcttcctgtgtattattgtgcagagtcatttgcttactgcaaatcagtcctatagtgccattttcaggatcctgctttgtcttatagcacatatcctatagaatagagatcatggaagatgcatggtagttacagataatttaatgtattttttattagctgatttaataaaaatcaaataattttcagagattgtatatatttcttcaaaatatgtcttaaatcccagtaaccttcaaaagaaatacatttgctaaactatatttgtagctctcatataattattccagcctacatattttcctgacattcaaattcttatttgaagagcatagacatgagttctgcaataaattcccatataaacctaacttataaaatgaatttttatttaattataaaaagaatattttgaagatkcttattttattttcagtagaaccttatttttttattttctctttcctccttcctcattatatatctgcaaaaccagaaaatatttttaatttcaagagtatttttacatttagtataaacattttctcatatttaatagcttgtagaatgttacatttgctataatctgtaattttttgtaatttggagaactaaatgaaaccaattatctaaaatgtcacagtttgagaaaattctcatgtttttctaaatgtatgaatcttctctgtgagattgtacagttcttatttattaattttaataacataaaacctaggggccagagaataagatagaaaatgaggttcttttaaaaaaattctaaaatataatagggagttgttttgtatactagattggtttcaggtttattaagttatttccatcaaaatataaccttttttctactgacatactatttttcctttacttctaaggtaataataatgttccttataaaaacaaattgctgtttctttctacagctgcatttgacaaaggtgatgatcgaagacttggcaaaaagcctatattcagtagctcgcaggtaaactttctaaattttataggtacaaatgaaaaagataacaaattatttaaagcttattattttatatttcagaaaaagttttaaaaatctattcattaattgaagctatttcttaatggaaaatttttctttttctaaatcaagtgaacatttaataaatgttttaaagtgaattttttatatccagttggcactggaagtatctacctttttcatttccttgaaaacctttttggcagctaacgtattagagctatttcagtctattagaagttgtttagaactctagacctaattcaatgtctrtttttctaattagcctacttcttaaaaaagaagattttaggctaggcatggtggctcacgcctgtaatcccagcactttgggaggccgaggcggatggatcacctgaggtcaggagttcgagagcagccaggccaacatggtgaaaccccatctttactaaatacacaaaaattagccaggcatggtggtgcacacctgtaatcccagctactcgggaggctgagggaggagaattgcttgtacccgggaggcagaggttgcagtgtgatgagattgcaccattgcactccagcctgggtgacaagagcgaaactccatctcaaacaaaaaaaaagattttaattcacataatgtatttttggtgtttttgaaaaaagcaattagtactaagagtacaactgtgttttactttaaaagttacttggtatacttttatgaggtatctaaagtagttgaattcttagaaggtagtattgtggttgctgaaaactagagggagggagaaagggggagttgttcaatgagtacagagtttccattttgcaagatgaaaagttttctgttgtgcaacgaagtgcatgcagctaacattactacactgttactgaagtgtattaaagagtacttaagtgtattaaatggttaagatggtagatttcatgttttgtgtgttgtttgtttgtttttgaccacccacaaggttatttggtgtttttcttataacctgaaataaatttgtcttcccaaaaatgttattaattatggttagggttcctagctgacttacagatgttcacttaaccaataatatattcaaagtacaaaattattctaacctctgtgtggtacaatgatagacatacattgagagttccagtttggaatgcaatgaacgtattgccctagcagagtggaataggaaatccttttttcttcctcatcagccagttgataggaactaatgcagctccaagccacaactgagagttgtcatggcttgaggaagaggtcaagctccaaatgtcttgagtgagaaactgggagactggagtttttgccaattaacctcttaggattgtttccaaagtgggtttcacaagatacgagctccatctagcatcaactataagttggagagtagctacacaccatagctcctctttttattttttgagacggagtttcgctcttgttgcccaggctggagtgcaatggcatgatctcggctcaccacaacctccgcctcccaggttcaagcagttctcctccctcagcctcccraatagctgggattacaggaatgtgccaccatgcctgcctaattttgtatttttagtagagatggggtttctccatgttgttcaggctggtctcgaactcccgacctcaggtgatctgcccgcctcggcctcccaaagtsctgggattgcaggcgtgagccaccrcgcccarccccatagcaactctttatagaccgacgatgcatattataccttgaaagtgctgagaaacactaaagaatacttttgaattgttgcatccaaaattttccccaatgttatagctatggaatacgactagggtcccgacaacccttttaaagcatattatacgattccacagaacatactctaggaaatggtgcactaggacatttttttctgtgttycctgttatccccgtgttttttaaaggcccccaggaattagcctacttgccttcctatcccctrctactcaccaggcttttctgccttccttgccttactgcagaatagaacaaagtttcattatttttcctcatcctcctgactttgtggttgtctaagtcttttttctgttaagaacaatgggaaggaaggaagtttcccccagaaagacagtgatatgctgaaatggatgctggacacaaaatcaaaagagttcaaattttggctttgcatttattatgtgtcatctgtgagtcttagtttgcttatttataaaatggagtaataaaacctagcaggattattgtgaaaattaggtgaaataatttatgtgcaattatctggtatgtagtaagtgctcaataaatgtggagcaaataaatgtgttttccaaacagggatgagctatctaggaggtgggagaaagttaatcagataagacagggaaagaggttttttgtttgtttgttttgttgtggtggtggttgttgttgcctgcttcatttttccttcatagagcgatttaagaagaatgcttagtaccaaaatacttaaggataaaatatatgatatctgggatttgcttcaaaataaaatgggggtgggtgtgtatgaaataaaattggaattaataatgaattaataatttttagagctggctattaggtacgtgaggattcattatactcttctgtcctcttatgattatgtttaatttttcctattttttgagacagggtctcactctgtcacccaggctggagtggagtgacacaatcacaactcactgcagccytgaccttctgggctcaagggatccttccacctctgcttcctgaatagcaggcataggcccaagctaccatgcctggctaatgtttgtatttttttttgtagaggyggggttttgccatgttgcctaggctggtctcaaactcctgggctcaagcaatccgcacctggcctattgtgaaatttttcaaggcatacagctataccatatactatatagatttcacccatagcgtaatacttcaagatgcataaattcaaggatagaataaattaagtagattcagtgttaagggtgggaaggagttctaaaagcagaagtcagcctggttttaggtattaaaaatagagaaatgttttttttttgagctaagatttgagcaagaaaacaaaaaatgaggaccaagcctatctgaacgttttaaatgttagaatcctagaagactgctgtgaataggaccagtctctacgctgtggacaggcataagctgagacccaaagctgttaataatttctgaaatgtcccaggctggttagaagcaaaactaggacaagaatctagtggttgttttatcaccgtgctttccttttttctaaatttaaccaagttatttattgtgtatttttttgtgtgcacccacattcatatatgttattttatctttgacagcttttaatgtaattggaagcttttcatatttaaaaatagaccttaaactgcatatcaaaatatgcaatatatgcccagcattaacaacattgattacgttttttgtttgtttgttttttgagtatccaatatgtgacatggtgccgagggatacaaaagatgaagagagcacaggctctgcctcagacctctacaatctcatacagcttccaaaggaaaaaaaaaaccgtttgcatacttacataaagaatgacaataggacgggcgcggtggctcacacctgtaatcccagcactttaggaggctgaggtgggtggatcacgaggtcaagagatcaagaccatcctggccaacatggtgaaaccccgtctctactaaaaatacaaaaattagctgggcatggtggcgcatgcctgtagtcccagctactcgggaggctgaggcaggggaattgcttgaacctgggaggcggaggttgcagtgagctgagatcgtgccactgtactccagcctggcaacagagcaagactccatctcaaaaaaaaaaaaaaaaaaaaaaaaaaagaatgacaatatcggccgggcacagtggctcatgcctgtgatcctagcactttgggaggccgaggcgggtggattgcctgagctcaggagttcaagatcagcctgggcaacacggtgaaaccctctctctactaaaatacaaaaaaattagccaagtgtggtggcatgtgcctatagtcccagctactcaggaggctgaggcaggagattgcttgaacccaggaggcagaagttgcagtgagccaagactgggccactgcactccagcctgggtgacagagcaagactctgtctcaaaaaagaaagaaaaaagaaagaaaaaaaagaatgacaatatgatcttaaaatattatcctagaatttctaccaacttaaaaattttctttgttccctttcatatcaaggttggttctaaggaaaatgatgaagtaggtatgtttatcttcagtgccattttatttgtccctttttagcctatttcagctatttttaggatcccttttccttcgcttcctatagccagccagtgctatactagtatcttatttgtacaaaaaccaagctttgcagatgtagtgtattgatgtgctgtgcttcctaggagcttttaaaaaaaaawttttttaaataaggactccaagaagtaaaggattcttcccacagaggattaagtctttaatgataaaatttctggcacttggaataaggttgaagagagaatttttattgaaaatctttataatgtccctcaaattatgctatatagatgacttcggtgtgaggttaaaaaatgagctcaagtcctgattccatccctcatcagcctgagacctggggtaaatcacatacctactttaatcctcaatttcttgtctaagaaatagaaacagccacaggagctagttcatgggactgttgtgaggattaagtgggatgatgtatacaaaagatgtagtataaaacatgggagtaagccttctaaaaaatcatggatattatcattcctcagggcatcctgaatctttatagacattaatctctatcaaaacttcatacattaaaaaagcyttccttttatttatttatttactttaatagatagaatagcatgcctttaaaataaacacttatgctgtatttcagatttgattacggtaatctaagacaaagttttgatccaaatgatcaaagacagttcaagctttgaccttaaatcataatatgaacttttctattttttttctttgaaagactggcttttggaaacataaaatattatatgttaaagatttcagtcaaattacaaagtattttttttcttttttatagcaaaggaaacaagtttctgactctggtgatataaaaatcaaatcttggaggggaaataacaagaaagagtgttggagttatctctctactaataaaaagatgaaatctgatggattaggagcatctggacattcgtcaagtaccaatagaaatagtataaataaaactctgaagcaagatgatgtaaaggaaaaagatggtacaaaaatagcatctaagattacaaaagaactaaaaactgggggaaaaaatgtttctggaaagcccaaaactgtaacaaaatccaaaacagaaaatggtgataaggcacggttggaaaacatgtcacctagacaagttgtagaaagatcagcaacagcagcagcagcagcaactggacagaagaatttactaaatggaaaaggagtgagaaatcaggaagggcaaatttcaggtgccagacccaaggtactcacaggaaacttaaatgtgcaagccaaagcaaagcctttgaagaaagctacagggaaggattcaccatgcctcagcatcgcaggaccctccagcagatccacagattcaagtatggaattctcaatttccactgaatgtctggatgaaccgaaagaaaatggatcaacagaagaagaaaagccttctggacataaactatccttttgtgattctccaggacagatgatgaaaaacagtgtagatagtgtcaaaaattccactgtaggtgggttttagcactgtaatttttaatatctcctgacagttaaatttccttcaaaaaacaaaaacctaaacctgtatttgggcttttatttagtttcagatgccaacagaatacttatgtatatgtacttatgcaaacagagaaaatggtagtccttcccactttaatatttcattttgtttatagtgtctaaccagtaaacttacacgtttgttacatatttaatgtattctctcttatgactcactttttcttaatttatagccataaaatctcgacctgtttcaagagttaccaatggaacttccaataaaaaaagtattcrtgaacaagacactaatgtaaataacaggtaggtcttcattcagtgttttaacctatctgttagctttctctcaaagttaattatatactaactgctagctaaatatttttaaaatatcttttattttttgttaatgtatttacataatattttaacacagttttttatttattaaaagaaattagtatatgcaaaatgattgaggcacaatatttaaaagaatatattaatgtgtactatggcatatgattataccttgctttattatacttgatctacagttttataaacttaaaaagacttatgagcatatgatttttctattttcaggagagatgtattttttatttcttgaaaaaaactgtttcaggtattggtcttttaaaaagttcatgttttggaatctaagtgtaatactgaatgcaaataattttttttagtgtactaaagaaagtcagtggcaaaggatgtagtgagccagtaccacaggcaattttgaagaaaagaggaactagcaatggatgtactgcagctcagcagaggacaaagagtaccccatctaatcttactaaaactcaaggtaaagctgaaatagtactggatatcttgaaattatttccttgtgtaaactggataagccaaactctgatttgcaacttcagtagcaaataagcaaaatatggttttactcattttatgtttgtttcacaccatagagatgagattgtaaacttttacttttcagacaggtgttttgggatgtaggtttggtttttgttgttctgttgttgttattgttgagacagggtcttgctctgtcacccaggctggagtacagtggcatgatcacactgcagtcctccttcctctscctcccaaagtgctgggattacaggcatgagtcaacacacctggcctctgtttggttttcattgtcttttrtgagagaaataattaagggagtcactaatttatctgcatttctggtccttttaaatattatgcccatgtttcttgaaagttccattgataattataggaatttcatttgtaaaactggcactaaagagctctataaaaagtaatagtgcaggctaggcgcggtggctcacgcctgtaatccaagcactttgggaggccaaggcgggtggatcacctgaggtcaggagttcaagaccagcctgaccaatatggtgaaaccccatctctactaaaaacacaaaaattagccaggtgtggtggtgtgtgcttgttgtcccagctacttgggaggctgagacaggagaactgcttgaacctgggaggcggaggttgcagtcagctgagatcttgcctctatactccaggctgggcgacagagcgagactctatctcaaaaaaaaaaaaaaaattgataatgataatartagtgcagtctaaacaactataatacataaggaggaagaatttcccttccagaatctgtgtgagtccattgtttttcagtgttctgaaaacgaaaagagtactgatcagattgcataatttgctaaaataataaccaattttcaaaattgcttttatgtatcaagcattaacatatgtaaaagcagttcktaaaatgctaaaaacagttttgatttagattatgaattattactgaaaatcaattaaaaataaggtagagaaaacattttcatatcctagtaataactaaatgttaaacattttaaaatatttgataattctgtttggcagatttgaatgtccaaaatatcatctctaagactttcaccagtataaacaaatggattccccaaattaatccccttctttccagtcagcagttttagtttccactggagatctaagttgttaatcctaatgagctacagtaataataatctggttatgacaagtaaattggttttattcatgtttgaagaaaacaactgcaacaattttaacagttctatttattttatatttagcttgattctccttttcagctatgtagagcacactatttttttttctccaaaaacttcaaagggaagacctttcttgctcctttgataaaagaaaatccgattttttcaccctcatatatttttgcaaatccagttttggcataaaaatcaagtctstttacttgaggaagagagatcctattttagtaatttttactgggaccctggagtagtccctctatatttttaattgaaaaaatttttttattttatcatgtaactgattcctaatctgtgcttgtccatttgatcatagatatgttacccttccattgtgttcttgattttattttttctgaagtaattttaaaacaaattactaaattttactcacaaattggaggtgatattacattactgaatataccctcttacttttcttaggatcccaaggagagtcaccaaactcagtaaaatcttcagtctcttcaaggcagtctgatgaaaatgtggcaaagttggaccacaatacaactacagagaaacaagcacctaagagaaaaatggtcaagcaagtacacacagctttgcctaaggttaatgcaaaaatagtggcaatgcctaaaaatctaaatcagtcaaaraaaggtgaaactttgaataataaagattcaaaacagaaaatgcctcctggacaggttatatcaaaaactcagccttcctcccaaagacctttaaaacatgaaacatctactgtccaaaaaagtatgtttcrtgatgtgcgtgataataacaacaaggacagtgtttctgaacagaagcctcacaaacctctcattaatcttgcatctgaaataagtgatgcagaagcactccagtcatcctgcaggcctgacccacaaaagccattaaacgatcaagaaaaagagaagttggcrttagaatgccaaaatatttcaaagctggataaatcattaaaacacgaactggaatcaaaacagatttgtttagataaaagtgaaacaaaatttcccaatcacaaagaaacagatgattgcgatgcagctaacatatgttgtcattctgttgggagtgataatgtaaattcaaaattttatagcaccacagccctaaaatacatggtttcaaatccawatgaaaactccttgaactctaatccagtttgtgatttagactcaacaagtgcagggcaaatccatttgrtatcagatagggagaaccaagtagggagaaaagatacaaacaaacaatcaagtattaaatgtgtggaagatgtttcactgtgtaatcctgaaaggacaaatggtaccttaaattctgctcaagaagacaaaaaatcgaaagttcctgtggaaggactgacaattcctagtaagttgtcagatgaatctgctatggatgaagacaaacatgctacagcagactcagatgtatcttccaagtgtttttcgggacagctatcagaaaaaaattctcctaaaaatayggaaacatcagaatctccagagagccatgaaactccagaaactccatttgtgggtcactggaatttgagtactggtgttctgcatcagcgagagagtcctgaatctgacactggcagtgctaccacctcctccgatgacataaagcccagatctgaagactatgatgctggagggtctcaggatgatgatgggtcaaatgacagaggtatctctaaatgtggcactatgctgtgccatgattttcttggaagaagtagcagtgataccagtactcctgaagaattaaaaatttatgatagtaatttaagaattgaagtaaaaatgaaaaagcaaagtartaatgatcttttccaagttaattcaacgagtgatgatgaaatccctaggaaaaggccagaaatttggtctcgatctgcaatagttcactctagggaaagagaaaatattccacgaggcagtgtccagtttgctcaggaaatagatcaggtatcttcttcagcagatgaaacagaagatgaaagatctgaagctgaaaacgttgcagaaaatttctctatatctaacccagctcctcagcagtttcagggaataattaatttagcttttgaagatgcaactgaaaatgaatgtcgtgaattttctgcaamtaaaaagtttaaaaggtcagttttactttcagtcgatgaatgtgaagagctgggatcagatgaaggagaagtccatactccctttcaggcttctgtagattctktttcaccttctgatgtttttgatggcatttctcatgaacatcatggaaggacctgctattccagattctcacgagaaagtgaagataatattttagaatgtaaacaaaataaaggcaatagtgtatgtaaaaatgaaagcactgtcttggatcttagtagcattgactcttcaagaaaaaataaacagagtgtttcagccacagaaaaaaagaacacaatagacrtcctatccagtagaagcagacagcttcttcgagaagataaaaaagtaaacaatggaagcaatgtggaaaatgacattcagcaacgcagcaaattcttggatagtgatgtaaaatctcaagaaagaccatgtcacttggatcttcatcaaagagaacccaattctgacataccaaagaacagctctacaaaatctctagactcctttcggagtcaagttctgcctcaggaaggtccagtgaaagagagccattctacaactactgaaaaagctaatattgctttatctgcaggtaatgtacagaaatagaaatgctaaatgcataagaaaataagtttataaaattttaaagttgtatgaagccctgaatgttatattttagtcagatagaataattacttaagcaacagattaaaattttaaatgaaaaatgtcttaatatgaaaattactcattctttattgttcacttaaaatcctaatgaagaagtaatatctagtaaaaattttgattgttatatagagctaacctactaagagattttaaatgaaagaataaaaagaaaaacttagtttgctgctatttagttatttatgtataatttaacacaagaattcttgactattagaaattttattatacattggatatgatttatagacttgatagtatataagaggcctgtgcaataactctagtaatatgtaactaaaagcactgaactattttaacaactagattgattattacaatttatatacattttacagagattaaaattttcaggatctgtctattctaaagttttcaaataaaaagataaatttcctaagagattatatttagaagcaatgataatatatgaaaaaagcccaggcttatttcatattgtttagatgattttctgtctaattgttttgtgttttttgtcttccttattatagtaattcagactaatgacccacatttaaaatatgcaatagtggctgactgagtagctattgtgtattataactaagaaaaatactgatcagtagtttcctgttcagcaaaatcggaagaataaggaggtctttaaagttgtactttttcgtttgtttgtccttgcttgcatcttcctttgcatgtgcaatatacaaataagcctttaggtgaaatgtatttatccctgccttttgcaacggacttaccctaaaagtcatcatcaaaacactawgtcttttttttttctctttttctattgtagtgaattagatatatgtgcacattctatgtttatgtttaaatgatttatgttttctgtatcacaagttttcaaattaaagtatggagaattattgttagttgcctatgttgattttgcttytaaacattacccttgaattttaaacacataaaaatgcctcaaaaatcttgtcaattttgtatagawgttatttttcccattctgtgttttttttttttttttgactatcrctgttatattgtgttaatattctacaaaactctgagggtaccaacgtgcaatttttacattgtgtagtattatgaattatttcaggagacatagatgattgtgacacactggcacaaacccgcatgtatgaccatcggccttcaaaaaccctgtctccaatatatgagatggatgtaatagaagcatttgagcagaaagtggaatcagaaacacatgttacagatatggattttgaagatgaccaacattttgcaaaacaagattggacactactaaagcaactgctctctgaacaggattcaaacttagatgttacaaattccgttcctgaagacttaagtttagcacagtatctaatcaatcagacactacttttagcacgagatagctcaaaacctcagggtataacacatattgacactttgaacagatggagtgaactaacatctccacttgattcctcagcgagcatcaccatggctagtttttcctctgaagattgttcgcctcaaggcgagtggacaattctggaactggaaactcagcattaagtgttaacattttggaaaaatttatgcyactcctttattttttgatgcctatattatatccaaatgataattgcattagccggatataaactttctttaatattgagtctttccaatttaatgaggtaaacatagtttatttattaatatatcacatatagaaaaatgtttttctaaagtttttgagcatgttttctctaattattagagaaattagaagacttataaggaaaccctagcttcagttttcctttcctagctgatgatttgttcacttaatcattattcaagaatttaaaatgtgaatgcagaagtagatcagtccctttactttttgctctgcatagggtaacatagtaatttaacaataaaaacttaccgtgcttgtgtccattcatgtagagttttctgtgactaacattcaaactcacatttaggtgattgaggctgatagctgagtgttggggaaaatcttagctttcccaacaattcaggcccaggaaattctgaagcaagtacatctcaaatttcaaccacatcattactaaaacaagagaaatggaatttcctgtctctctcttttggggatatatccacagaagggaatctgcccttgttcaaaagcatagacttcctttacaggtagtcactcattctccattttccattccatgttagggatatgttggaactgcacctgcaataagccagcactaaatataaacttgaaaatgagtatataaggcaattgagttacggagtttaaattgtgtgtatgtgtatgtatgtgcacacacacgtttgctttcttggtgtgtcattagacaccagttccttatttcctggatcagattgtctttcagtctgtaattttggtagtaagtcaaagataaaaacctttgctacaaaatgctacctggtagcgagtacttgggtacttttgatattgccaatgggattatgagatttcataaataagcctctctcaaagctttgtgactcataattctctgaaatatgtctgaagcaaggaaatagtttagaactccttttctaaattagtaaagtcttcaaaaaataatatgatctataactgtattgaataccaagtcatattaatgcacaattatttgttctaataacatagttatgttacggttagctgctaacctattataccataaatttgctatgcctttttttaaactagctctgtgaagaggggcactcgttcaagaaacggttactaactcattcattcaaagtcaagaaacaggctctggatttaggcacttgggtgtaaagaaaataagacttgattcctgctctaaaaatatataaataaataaatagtttagtttctagtaagaggacatgggggtataatgtaagaaaaagttcaaaatatagtattacaaaaactttgtaacttagagctggatgggaatttagagattatttcgttttctctcttcaaattccaaagaagggctctgatgcccagaggaattaagagcttgcccaagatcccacagctaatttgtgggctaggattcaatatctgtagcccacaataataccactttggtattatttctaccacacaacacactttatttttctcacaaacctgcgatcaaatacatttacaggtagtttgcagtataaagaagtattatatgatagagtcaaagacagcacaaattcccaagacactgttttctttttcttcaaatatgaaactgttaagtgttattttcaaaaaacttcctcagaagttcacaaatttataattgaaaatttcttttcccagctttgaggtcttaaaatcttcttaaactgctaaacattaaaatctactcagtttcacatcacatctgcaagtagataactaactaggaaggcattttgcttatgtaataaccacccagagaatttcaggacatattgtgttttcatagcatgctcttttgtgaaccacacatctaccagtctgtttgctgtgggactctttgtactagtgcctcatcattcaacaaacaaaaattgaaaaagaattgctgacattgatatagcacttacaacatgctagatgctatgctaagtgctttaagtacgcattaacacatttaattctatgagatatgtcttcttatctttattttacacgtaaggaatctaatgtagaatccttaacctggatgtgctaccattgtagaagaaaccaaaggagaaagtaacacactacactattgtttgtatgggagcccagaaggacagcttgtcaggaagaggttagagaaaacttcttagggcaagtaatagtctgtgactgcttcagaatttctgtggaggagttttattagctgcaatctagttgaaagttaggccaagggacttatcttgaagatgcacttgtatagcgagtactttgcttttacttagtatgttgcagataataaaaatacaaatctttttaaagatgctttttgtacatagtttacatgagattgcaaaactccatccatacgaaatatttttttaaattttgatttgggttgcttagggaggactaatgagatttatggaaagggtttaaagcccccattataccatgttttggtgaaaccaggtaacatctgatgctggcccaaggatgaataagaatttgcttggtgacagggcagtctagatatggcactacattaaggaatagtgaccagggtgggtactgagtataggtagaagaatagtaggagatagggctaaagagttgagctggtgggccggtcatgatggctcacgcctgtaatcccagcactttgggaggctgaggctggtggatcacaaggtcaggtgattgagaccaccctggctaacacagtgaaacccagtctctactaaaaatataaaaaattagctggatgtggtggcacgcacctgtagtcccagctatttgggaggctgaggcaggagaatcgcttgaacccgggaggcagaggttgctgtgagccgagattgcgccactgcactccagcctggcgacagtgagactccttctcaaaaacaaacaaaaaaaaaaacagttgagctggtgctgggttcccaaagttgttactataaatgcaatcttcaaagtgtttaagccttggatttggtgggtattatgtcttctttattatgcattcatttatttagtttaacacaatgtatttccatgttcttgggaaataaccacctacaactcacaatgagtaatgatcaaagttgttttttaagtagttaggtaacataaccagatgtgttttagaaagataaccggcagtaatgaagatggccaagtatggagaagtgccctaaacctgtcaggatgcaattatgatagttttgttgaccttagaaatagggaattgagaaggatttggtaatagagacgttaggtgggttgagactagaacttggtgaatgattacatggtgtcagaagatggaaaggaatttttaaattgttgtcagaggctggacacggtcactcacacctgtaatcccagcactttgggaggctgaggcagacggattgctttgagcccacgagttcaagaccaacctgggcaacatgacgaaactgcatctttaaaaaaaaaattttttttttaactagctgggcatggtgacacgcgcctatagtcctagctactcaggaggctgaggcaggaggatcacttgagcccaggagttagagactgcagtgagctgtgattgtaccactgtactccaacctgggcaatagagcgagaccctatctcaaataaataaattgctatcagaaataacattcgttccacacattgagggcctactatgttcccaaaactttgctagtgctgggaagaaaaagatagatgacatagtatccatccttgagcatctcaatctaataagggagattgttaaataaaaattgcaaaattgcaatgttaagtgttataataaagctgagtataaagtgtaatttggagtgcttggatgggctcctttgctctctaaggattagtaggaattcataaaaaggcacactcttggcagaaaaagttcaaaggcagtggggaattctgttctgtatggctagagagagaaggaaatggattggaagggcaggggatgaagttggacaggaaagtagaatccagagattaacaggatcaggtttgcattttagatgactggtagcaggatgtaggatggaatggagcattgtgacaaggcaaggggactaatgagtcgattgcaataataaaagcttgaatagggcagtggcagtggagacagaggagtggacgtgtttgagggatttaagaggtggaattgaaacccttggtgagtctttggatgtgggaaatgagagatgggaatcatcttaaaagacagttttctcactagggtgcctgggtggttgatgatgtcattaaccaaaaacaggagcaagtgtaggagtgaagatcagtttaatttgggacacactgagtttgagatgcctggggggacattcaggaggctgaggacaaaatgctgtggaatagtcagaaaaagaaaagcctgagacagagactgaaccggcacattcagaagtagaagtaggaggccaaggtgaggagagattaatgttttgtttgttttgttttgttgaagcagggtctcagtcacccaggctggagtgcagtggcgcaatcatcactgcagcctcaacctctcgggctcaggtgatcctcccacctcagcctcctgagtaactgggactacaggcatgccaggctaatttttgtattttttgtagagacagggttccgccatattgcccaggctggtctcaaattcgtgggctcaagtgatcctcctgcctcagcctctcaaagtggtgggataacaaaagttttttttttgctttttaaaaaattcaatgttagcaagagaatgataagtttgggagcttcatatgatgctttagaagtgtaaatttcctttctgataagcagctaagcaagctatatcaggaatgtagctttttggttgttttttgagatggtcttgcgttgttgcccaggctttgagtgcagtggcatgatcatggctcactgcagcctcaacctccctgactcaagcgatcctcccacctcagcctcccaggtagctgcgactacaggcacgcaccactccactcggctaattttttattttttatttttgtagagacagggtcttcctatgttgcccaggccagtctctgaactcctgggctcaagtgatccttctgccttggccacccaaagtgctgggattatgggcgtgagccaccatgccaggcttgtagctttatatctttagccctttctcctcttgggatctaccattaaggaacaaggcctgtttaccgccataccaccctgaatgcgtccaatctcatgtgatcttgaaagaaagaaggccagacatggtggctcacacctataatcccagcctcccaagtagctgggactacaaggcacctactgctgcacttagctttatcttttaactcatattttaaatgtcttctacaaggcacagaaaaataagtagttgtgttcatttttaagtaaatagtagtaaacagtttcaaatgctgtttgagatgttaattaaggcacacacttagactagtccatttgatttgaaaattaggattttatttgtgctttttgttaattactggcttttaaaagatcagtagtggggcagaaactagactagtgggttgaagggtgaataggaaataagtaatacttattctttcaaggagcttgactgaaaaggagacagtggtagtttgaagatattgctgtttttaagataaaaatgatttcagcactttaaaaataaaaagttggaaatgatcaatgaatcaaggatcatcaagaaagaggcaagaggaagtaagattaagcacaaagagtatcaactgataggtggcatttcaaggaacttcaggtgttgaatatctaaagcaccaaatgcgtgtggacagcagtgaagataaagctggaaatgcgccggcagaccaacacatgatgagccctgtaggtggtggacaaagactatgagcaagccatttaggcaaacatctgaagaatttaaaaatcaaaggcaaacaaataggactgtttcattaagatcacttgcattctaacaggttatgatgaatggaaagctgatggttcctggttggaaaaaagataattttcaatttggacatgtcacatttgagatgcagttgacacacccaagatacataatatattgtctttcaaaattcagaaacctaataaaccatgatcttaataaccgccactccatctcctg

SEQ ID NO: 12328 - DNA, 103012 bp, Homo sapiens
cccacacccagcaactttttgtatttttagcagagacagagtttcaccatgttggctaggctggtcttgaactcctgacctcaggtgaggtccacccatctcggcctcccaatcctgcctgttttgatgagaaaagtttttaagaaaagtcaaggaaaatcaagaatagctacacttttaccacagcagaagaaatcatggaattacagtgggaattagtgtaatggcttgactgatctgctagtccaggacttatttcagaaatgtgtcttcttcaaacagattgtattagtgcaccaggcaggacttctttggttgtaagtgttgggaacttaacttgaactagtatagaaaggatgtctgaaatcagagagctgattgcattctctttctctcctctccacttctctctgctttgatctccctgactggcttcctccaaatggtagcaaatatggcagctcctggtattatcagagagggctcaagactggctggctctaagatgtaagcaggcagacctggggatgagcttaccaactctggatcacctggtagaggagatgctagaaggttcttctggaagatggcagctctcatttgaacccctggtcaaagtaggggatgggcattcctgaaataagagaagtgttggtctagacacatgacccaacagctttctgtgcatggctggcactacgttttccttcatagcctggtgtgttttagtagcataaagtgaagtgctatttggttttagactctcgaaaatcgcagaaacagcatcatttgtgcagtagaatagagtaggaaaaattcacaccaacatgtccatatgaagtgtttagggaatggggaggggcagctggtccatctttgttcctgagcccgggtctcagtgggactgaatctagaggtgggagctttgaaatgtgcaaattggggcagggatagaagttgaggctagaaatgaggcagagacgaatatggctgatgcagcccagatccctgaggggttattgctggatgattctggacattattgagcacagctaccactcactctgcagaagagaaaacagagttgcaggaagcttagttgacgtgcccaaaacctgtggtgagttagtagcaaagaaggcactagggcctcattcccagagatccgctcaactttccactctgacactcgaggaggcttaaaacaggcacagggatggaatgagaaaccccagctgccctctggctgtggggtcagtggaagcctcaagtcctcttccttgattgggcttctaatccttcttgtcttgaaacaggcctagttgcctcagtggagcattttactttaagctgattttggaatgtcacatacctcctcttcaataagaggaaactccagcctcactgcaacaagcaaatctattaacatgattgcagatccatcactgggagctggttgggagggtgagaagagtggacttgagctggccctccaggaatatctcccaggatatcccagcataaaccctctggtctattctgggaggcagggaaacaggagcctgccccggagagactgaacttaggaacacactgcacagccgcaatccagggtttacaggacaaagatcgaggcacccttcagcagctgtctggatgctgggatgcggggtgtggcagatgctgctgctgtggctgcgacttccctttgagtcctggagactgtgatggaactcggatgcttagtctgttacacagtctgccactgcctcttaacattcagggagctggagtcttcatattggcttctctatgactgtgtgtatgttcaagttccttctagcagagcctgagacagggtgttgtgcaagcgattactgagggagagctcccaggggaaacctagaaggaaggcaggaagaaggatgagggcaggagaagaagccaggcaaggagtgggttctgagaagtcaggctggtcccatggcaggtgttctgcagtgagaatcctcttgccaagtttttctggcccagaggcaatggactggagtgtcacatcccacatcagacatcactggctgtgggccaccccaagggagatgggctataaccctgtactagttatcaactgctgtgtaacaaattgtcacaaaactagcaatttacgacaacatgcatttagtatcttgggtcaggagttcaggcttggcttcactgggtcctctgctggggtctcagaggctgaaacctccgtttgggagactacatttctttctgaaacacggagtcttttcaaagctcacgtagatgttggcagaagtcaggcccttgtggttgtcgagttggggttcctgcttccttgcttgttaggagctgctctcagctcccagaggcccccacatttccttgccattggccctcacaggatggcggctcactttgtcaaggccagtgtcttagtccatttggatggttgtaacaaaatgtcttaaacttggtggcttaaacaacaaaaattgatttctcatgtttgggagtttgagaagcccaagatcaaagtgcccgcagattcggtgtctggagaggtcctgcttcctaactcgtgcactgcaccttccctctgtatcctcacatggtgggaggatggagcagtctctccatatcctcttttataaggcactgatcccattcatcaaggcttctcctctacgacccaataacctcccaaaggccccatctcccaataccatcactttgggggttagaatttcaacatatggatttttgggggacatgacatccagaccccagcagccagcaagataatctctccctgccgtttcctaagacagagtcttctgtgatccctgggtgacttcccacgacccaactgtaacctaatccaggaagggacaccattcatttttgtcgtgttcaaaggctggaatcagggctcagcttccatttgcacgcaaggggggtggattacgcaagggcttgactcctgggggtcatcttggaattccacccacctcacacaccccaatgtgtccagaagagacagatcccagcatccacgaacagtcctccaggaaagggcgtgggtgtgaaccactaacatttgactctcatctgaggggagtcttgcagaggcacccatgggaccttccacactgtccttgcccgcaggagaaagggcagccaaagtctcagaaaatcgccatccctcaggccaccttccaatcccatagccgtgtatctggatggggaggccccatccccatcagggccacagctacaagggagcttggaaaatggagttctgaacttgctaacttgtgtagttaaggacaagataagggaagaaaatgggaagaggtgccaagagccagttcaagcctgcagtgaaggggaaacagaattgagatattccgtgacttatgaggtgaactgagagattcagtgacttatgaggtcccaccgatggccgggcctagatccaggactcaggacgtttagggcagctcaaacttttgaggttgttttcctcctgggatcaggtagcagagaggaactggaaatgtaagtgggaatccacatagtggtgattaaggaagaaagctgccatagaacccaaattctctcttgttagcacaagggaggtttaccatgagtttctggaagtttctagagccatgggcagtgctgaagaggatctggatcatcaatgagtaggtgcagctaaatattaaagattatggtttcctactgaatgggagcttttatttctttaaatcatgttctaaatgatttcttgcccttgctgtttaaatatagccatccattggtatccatgggggactgattccaggaacctccatggatacccaaatccacagaggccccaatccctgaaggaaggtggtgtagtatttgcacataacctatgcacatccttctgtgtacttcaagccatctctagattacttataatacctaatacagtgtaaatgccatgtaaacagttgttatactgtgtcatttagagaatgatgacaaggaaaaacatctgtacatgttcagtatatatgcaatcatctactttaaaaagcatttttgaaccacagttggttaaatccatggatgcagaacccatggatacgaggtcgactgtaatagaaactttcaataccaaggaatgcatctgcctagcgattttgcgaaaaagagtgtatttgtatttgaaagaaaccgtggagtggaaacacctaaaacgtgcttgttcagttaacctcagtttgctgagctgcttggagcatggggttgtaatcaaaggttgtcttcttcgcagcagacaatgttctgggagaaatagtcctccttagtgctgaagttgcagactctaaccaagggggtggcagcaagtatccccggtctctgtaggggcttgagtcaacgcctgcactgtgcagagaggatgagggcagagaattggatgccgctggaggggcgtgttgtccttctacatgtcatgcaggcagcgcggttctatactcggagcctctgctcagcgtgtcttcacctaagaaccccataattcaggttccatccttgttccctactccagtgctctgcaagtgagccctttggtttagagatgggttgggcttctttatgggagaggaagggagccctggagctgcagaggggagcaggcattctctctggggtgctgtctcctttcttccctaaattggagggagataatccatggaaaggagttaatgatttctttgctcttcaaacttggtttggaaggatctctcagtcaaaaagaacctttcggatgtctcttgatatttcacattaatggacttttcataaggaccacatgatgggagagcagtgagaagtttggggatggccaaagctgggttgtcatttgagctctgttactaacccagactggacaatgacgatgtcacttactctctcggaacttcttttcttttcttcttttcttttcttttctttttttcttttttctcttctcttctcttctyttcttttcatttcttttctttctttcctttttctcttttttggagtctcactctgttgcccaggctagagtgcagtggcgccatctcggctcactgcaacctctgcctcctgggttcaagcaattgtcctgcctcagcctcccaaatagctgggactacaagcgcctgccaccatgcctggctaatttttatatttttagtagagatttagtaggggtttcaccatgttggccaggctggtctccaactcctgaccttgtgatctgcctgccttagcctcccgaagtgctgagattacaggcataagccaccgtgcccagcctgtttctttcatctgtaaaatgggaccacaatttcacctaataaaagaagacatctttctatttaaaagggcttagggtgttgatgtttgtgataaaggagagaatgtatattgaagtgttttgaaatgtgcaaagctttctagaaacagaagttcttactcaagtattttcccgaagctttggcaagataaccatttttattaccccgtctgtgcctagaatgggcctataagcgccacaatcagaatcattagatatagaaattaagagaaatgtagcctccttttttttgccggtgaacagagctttggttaacagaaaaccaaggcgattttaattgctggtttttctatttgaagggggaagttattagtagaagtctcaattcagaaacttcaagaagaaatgggagggtgtggtgagggtaagcgggggactgcatttcctgttttcctttcagatggtgttggaaaacattgcaggaaaaccatggatacccacgaagaaattccaaaatttattctttttgacgccaagggcccagcccaaaaggtgacgagtaggagtggtcaatttttttttttaagagttggggcttgcaggagtccagctaaacgcttgtagggtgaagacagaattcagagggtgacatcagcctgagcgggggccagaagaaacagagtggaggagtctggtttcatttacagttttgggtcagttctgcagtgaggagggggagaggaggggtcggggagggaggaggaggaggaggaggagctggaggaagccctgactggtatccctggccccagtccagtttggagctcagtcttccaccaaaggccgttcagttctcctgggctccagcctcctgcaaggactgcaagagttttcctccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggtaagtgtgatttctcytctgtttttccaggtttggggctagaaggaaatgctcttaacctgaagtgatcctttctaggtagcgttagtggctcttacgttcatgctgatcgccagttttctgtacatgttttaggtctctggaagattccgctgatttttctttctcactttatggcaatgggatttccttaaattggttaaggtcatgattgcctaagagtgtgagcacttttccaccgcgtgtctgtggctgctacacgcgccctgtgcattccgggcggcagtgtgtttcggcccatgatttatttaagttactgccgccttctaaaacccattcgggatccgctttgtttgcagaagcgtctttgctgaggactagcatagctccctgccgggcggctccgctgggagatgttctctgagctctctgggtggtgacactaggtcagggtgcaacaacctgcatgggttttctgcccagggccgcccatgggaaggtcctggtggagcacatttgctgctttcacaagattggagtaactctggtgctcaggatcagggccaagtaaagggtcgctcagtcattgccgtcaagctttcgtctttccaggaacctgaagtctctattggagactttgtcccttggggttgcttaaaggagttgcaggggtcagaggagaagaaggaattgggcatttgggcagcatgctgagtgtctaaggcagggcccctggggctgcagggccagcccatgctgcacagaggtgaggccagtgccgagctgggaggccccgagggctgttctctggcccggaggatgcagggtggggctcgggccctctcttgctgaggatggacacgttcgctgacagtggccagcctgtttggggaacctgtttcaaggggmctactatgttagataatgaacgggtattgaagtatgggtggggtcactgggagggactagggagtggttaaagaaaaatctgcttccacaggaagcyccaggagccagtttcgaggccggtgcagaccccaggagcaaacccctctgagcacaggggagtctgctgtgctggatggggaggcagggctgtggycccggctgactggcttctctccccacatacagctcaccccggcgaggaccacagggtgctagagctgcagggtgctcagagctcacggggatggtggatgctcaacctgggatcccccagctccccagggtcccattcttaatgctgtaaaaaacaaccgaaatggctttaaaatcgaagttacattgctcctaagcaaaactatattgaaaactgagtgggtggccgttgatgacattactgggacttctgaggtttttgttgggctaaagataatggaakagatttttggtcagaagccactgatgcagtagtttcctggttttcaaaatgagcaaccaggggctctgagatgcggaattccttgcccaggccagggagcgagtgcctgagatggcagtgaaatccttccccattgaaggagagcagacaagccagtgacggaggatcccaaataactcacatctcgttgggaaaactgctttgggctcactaagactctaccaatgaaccgagaaagaagggaggtggaccgtggggcgggggcatcggttccgtgaccggaataccggggctggccgccctgctcaggccacctcctgggggtggagggcgctgaaggaggggacctgtatgctcttctttctgaagtgggcttgtagctgaggatgaaagcctgggtggggaggcgtggcttttacaaagatcaggatstaggaacagctgcctgtctggacttctttgtttagggggtttcttgctacccagaggtttagttctctcctttcctcactcatggtcgagagaagccaggaagcagacactgagtggagcagagggcttgggaaggaattccatgttggggtgaagtgaggctgtcctggcttttcctatccaggcattggagggtgtggctacagcacctttctgggaggtggctggggaagcctctagaatgttagcccttggccccgctctttccctgcttggcagggagcgtgttccaccccactatagttgtggcccacaggtgaggggacatgtggcaaatgtccaaacctggggtctgaatgatatttttgatacgaggtaggcacctttctgaaaaattgtctttacttcmcacttcattttatttctaaagcattcaggactcagcaaattgcactgactttatcatcagtgccttttgtgatttcctatcctagaacttaatacgtccccgatsagaaagtaggaagaagctcctctcttcagtcgattgttgatttatggttccaatgaggctgctcatcctgaccttagtttcaggaacggaacccatagacctggatgcctaaagccagcttgaaacaagaccgccttctttggaagctttggaagctggcagtgactttttgccagcgaggtttcatttgtttccttgctcagagtgttcagacaactggatcaagcgtagtcttcaccagcggttgatatcacctcccacttatatgtgaaattccatgtttaggacttaaaattcaccggcaagtcgtgaatactattgcgtgacacttccttgcaggcgcagtaacagctttagcaaaaatttttatttgaaagttcagttttgtcactgctctttttggaagaagctgaaaatctgctatctcttgggggaaggattgcaggcggtttccatctgacagggatgttgtgtaccaggcagcttttccaccctgacttacgggagcaaacttttcatggtgtcctggctgcagcaagcaggcagtaaaaaayacatcactgctacataaatagctgacgatttgaggagggacctgacatttaaagaaaatcctattagctctagctaagaaaatgaaagccgcaaaccctccaaattttaaagtgggggagctttaaagtttcctactaattcagacagccatgaactagacaagaatggttatcttcattctcccgtttctagatacagcttctctgtttccactgtaaaacttcagtggaattcagtgtaaaaattcagtgcaaagaaaggacaatcctattctttaaataaaacatgttgcttgccccctctaatgtgtggtcatgaatgtcttatttccagggagtattccacaggtcctgattttgcagagatattcccttcaacaattcactttgttaattttgaaaaatataatttttaatacattctggtcttatagtccattttgggaaagagatgaaattttgagggctgggcactgtggctcatctctgtaatcccagcactttgggaggctgaggtgggcggatcgcttgagcccaggagtttgagacaagcctgggcaacatagggagaccttgtctctacaaaagcgttttaaaaaattaaccaggcatggtggcatgtgcctgtaatctcagctacgaggctgagttgggaggatcacttgagcctgggaggttgaggctgcagtgagccgtgactatgccactgcacttcagcgcctgggtgacagaaccagaccctgtttcagaaaaaaaaaaaaaaaaaaagaaaagaaattttgagttagcacgttcatcctggtctgtttttgaaaaggcagtttggttttctttcctctagagggaggtgtatctctgcgagcttcagaaaaatctctgaagtggtgcctggagtctcccagggtggagtttcagggtttgtagtaactcagtgatgaccatctcagcagagcttgcgggcagttttaggactgatatttcaatacatgattgtcattattatatttattgtggctgttcataataacggaagtgtacatacgttagagctttgtttttcttctctgctcaggtgtaagtgtattgagatgaaattgtgccatcaaaggaggcatctttgttcccaaacaattgcattacaagggtattcagcaaataagacattttataggaagcattttacccatatctaattacagaggtttaaatgaacagtcgggtgcttgagaaccaaagtaggtttgcatattcatgccattgcgtatccctgtagaattaccggattttagaactgtaagggtgctcgtgacatgtcctttgatactttcccctaataatggacaatgggttttaacatacttttaaaaattcacacaagctatgattatgaatgtctcgtcttgaatatttattaatacaaatatatattactgactctcagatttatgtctgttcgcttgagataaccagcattaagactctgagggagacaattctagctcagagcaaaacaaacaaacaaacaaacaaacaaaaaaaacaaaaacctaaccctttggttggtctttgtgttctcatgtttacttaagtttaacaagacctattgtgcatcatggccttgagccctgaggttcagggaggggatatatcccyaatgctaaawgacgagttgatgggtccagcacaccaacatggcacatgtatacatatgtaacaaacctgcatgttgtgcacatgtaccctaaaacttaaagtataataataataaaataataaaaaaagagaatacattcttggggaatattaaaaaaatgactaagacatagccccctctcttctggttggcaaacatataatttctgtttggctaattgaaatatcaaaaaaackactaccttggtggatggtttctccacgccctttatgcttcagatgaagaaagagagctcagagaggtatgcccagtgacagggccacagagctagtagcagaattgtctgatgtttccaatatgcagacatcttggaatctggacatttcaagggggacaagcctttaagagtgtattttagggtgccatgtggagaaaggtactcttcccattcccagtcttccttggagtagcctcttttaagttgattcagcagaggagtaactgttgcttaaaaaaatctggaaagaaaaaggagagaagaaaaaaacaaatacgaaaagttctgccaaaccttctcccaaaggcaaattgttagtcttgtaggggtctggctgcattcagcatagtatgatcctactgttctcctgaagtttaaactcatgaawtacagagaaacatttgagaattgcaagtggccagggaaaagtacaatgggaaatgtttctgtaaaaccccctgtgtgtgctatacattaggttttcaggaacccagagcatcaggaattggtcactggaaggaagagctcatggctcggtttaatttcaaaattaaaaattgaacagcagctggagttgactcagatctcaagggaaaccattccaggaaactggtttttcacttctggaatcttcattagttgattcagcagcccagggccggtacccagagttagcgccaactcagctaaacccacagcyggcccggcggtgcaccagggtgctctgtttctaactggggctgcagaaaacccatcattcatcagagcccagggcaacagatggaagagagcagtcgcaggactatggcctgttcgagcaacaggcarggagccttcttttacacaaaagggaggctgggagagattggccgaccattgctgacagaggcagtaaggaagtagaatttcccaggttactgcaataaatccagcatggatgatattttatcagatgttccaacttgatttttgaaaaggtttctgttttcaagaatgattttatcttctctacttgattataaattagactagaaaacagacaaaatatctaacttttctctttacaaagagagcacctttcagccactttaatcatttacagtggaacaccacagttttggaaaggtcagtagcaccttagttcattgccaagaaggaaaagacaggaataagtgccaagctccaatttggatccagcagcgtcacgtggcaaggagttggaatggagtgggcatttgtgcaatatttcttgaagcattttctaatgcacctttcttctttaatgttgaaatggaactagtctctgcctgatgtttataattagcagtataagtgcagacaaaatcttgtctggctgccgtatatttcagaatgtggaatgtgttttacatttgcatggtggcgtctagcttttcaaatcacaccagatatggaactttctgcctcatggttattatctgcaatgctaggaatatgttttaaagtaattttttcaaatatctgggtaattaatctggagtttcttaattgcctttgtaatgggaaggagacccacctctgaggagcttggcctaagcctggctgcaggtcggcatattcttacaggtgctctcattcacagagggagggcattggtaggggatgtccaggccttctctttctgcattgctttgttataatccacaagttgcagaacaggtgttgctttgttagattttaccaggaagagttgaagatctcgaatccgctactccatatctaacaaggacccccgtaagtgacaaaggaccccagtaggtgacaaaggaggtctagttaccctgcctgatgagaagagttttaaaatgttgctatcacaggatacacattcagtttgagtcaaacagattattgttctagagtattttcatagaatagaaattcaaaggccaggtgtagtggctcatgcctataatcccagcacattgggaggccagggcaggaggatcccttgagcccaagagtttgagaccagcctgggcaatatagtgagatattgtctctaccaaaattcaaaaaaaattagccaggcgtggtggcgcacacctgtagtcctagctacttgggaggctgaggtgggaggattgcttgatctcaggaagttgaagctgcagtaagctctgatcatgccactgcattccaacctggacaacagagctatactctgtctcaaaaaaaaaaaaaaaaaaaagggaaaaaagaaagaaatgtgaaatccaagttgttaaataaacagtaaaaaaacaaaatttgctatatttctttggaggtttcttggagctcttccaaaacattttcttttgaggattctcctttgggtctttcaaacaccaagagcatattaaattccactctcctcctaccctaattgcaggacttaataaatcctttcttagcttcctccctgaggaaaagaacggggactcctttcccaggattcgtgcaaaaagagagagaaagagtgagaaaaagagaaagaaatggggcgctccttcttgcagtctaggaatgggcgtggcaaaggcaagggtggatgagtgcctcaaatttactgaaatttgactttctatttcacagtcagtgtgcacggctctcccactgtggtctttgactatttccactgctcccattttaaacaggacaattaggaactaacagaagtcccagaacttgataggagggacaggctgattttaaaaagcagtgcttggagaaaaccaaataaatgacttcaaaatggaagctctggatttatttgagtctttgttttcaaactatttccttgtgtgcatgcgtgtgtgtctctttcttaaaaaagatttccagacatggaaaatgaaaaaggttttgagtaggctaaatgaaaactaatttacagaattgcaaaatagcttgggaaatcatattcattggaatatgattgaatatgatttcaggttgaagggccatgtagggcaatctttctratgaaaggtatccttttaaatttcaaagggatagaaactaaacggaaaaaggcacctcaaatcctttttagaatgaggcagagtaaacaaaaagatgaataatcctaaacagaaagatgagaatgaaaatgtgatgaatgtctcttattgaatctgtttcctttaggacacagaatctaggatgaaggaacagaccccttccagcccaaggatctcaagcagccaattctgagtctttttttcatatttgaaagaatgatagtagacagccgacttccattgacatagaatctgtggtgtgtcaccaccaaggaagtctattttttccccaaaaggcatggggagtttccttgagatctgggccaaatctggcacagcctctagggtttcccggggttcttcccatgagctttggaaatgctaacttgggttagggttctggttctatsttgtttttatctatgtagctttgaacaatcactttgccttgctggggtttcaatttctcagctataaaatggagggaaatcagccatcggatggttgggaggagggcgtgaaatcccacccacaagacagaagcccaggaaacgttaccagcactctcctctctccttcctccgggagggtggtgtcggggaatgagcgcggatggctgcctcattccctcttgttgaagagggcgggtggtcatctggkgagatggtgtttgacatcttttaataatctaaatgaaaaagttctccaaaatttgctgccagggaatttcgtttttttataaatggagactccaggacatgacaaacaatagaagagagttaattgcaaacgaaaatatcagcaaatattcaacagctgggctaggagcccacgagccacaagacctgcttcccgcatgatggcaggaaagtgtgtggggccaaaggcgtttttcccacctgggaattcagctcagtcaaaccatatgggttctgaatcatcagtggagcctggataacgcattgtcctacaggcattatctcccgtccttttcagagctggaagggctcctttccttctcttccctcccctcctcttccctcaatatctggatatattctggataaaataattcctgtgcacagtgtatttatcccattactttgtgttccaatgggaagtatctccactgagggggctactcctccaaagattcacatcttgaaaataaaaatctttacatatgattttcaatgaactaaaagttcattttactcagaatggttgaagtaagtgagtgatgtcttagacttcccggattttattttgtaactatttagattgtattgagcactctggaagatgagaaatgtaattttggaattgctccagagtgagcccactcaatgctttatatgtgacagaatcagtggattcaaaggctttcactgtgtgaggtatgggaatgattaagaaaaccattagcaaaacctgctcaaggcataattcacttgtgctctttgtcaatgctccctgcacaggtgtctgcagctcttcccatcccagactcaacagtgaggagacagctctcatcttatcaygtcctattttttccacctggattacaaagccgaatgctttacaaagagcctctataatactcttgtgttctcattcacaaacaaaaataccacttaaaatcatgcctcttgaacatggattaaacatttaaagtaatcgaactggatcttccagaagatttgcattaaaatttttaattgaagcagtgatgcttaaacttttggggggtgaggagtggcacaactgccttttagaatcacatacaaacatggacccttatctccagaaaaaccctcatccatagatgcaattttgcactcaactgtgggaggatcatagactctttgaatctgttgatcccgtattaaaacattgatctggaccagttacaataatacaggttgttttggaaagaacaggccattttcttagaaagaatctagcaggaagcttacctttgctaaaaaaaaattgacgctcaagcttgatagaacgaatcaagaatagcacatataaaatgtacttttatattattctgaagtgtatatcattatttaattgaggtcatacaaaaaattagatattgcaattgctttttttttttatttgaagaaacactcaggaatgggtctaacagactgtagggaagaaaggtagagcttggtggaaaagtctggaaggttcccagggttgcatgggcttgagggattcctagagagtgaaggggcaaagttggggctgtggcacggtgggggtagggtcaacctaagtggagggaggagaacaggcagtccagcctgtcgggggtccctgagccctgctgtgctgcgaccgggctaaagcttgggagcattatcaaaccacagcacaagcactggagactgctcttctacattgtgttaacatatatccatgtccaaaaggcagtgaccattgcaaggsaaaaaaaatcgggctgagcttttgcaatactgccgctatcaccactcattgctgtcactttgttgcagaaaaatatctgttctgttgataactggcctcctgagcatcattagaacagcattcctttctcactgttgatgcatttccaagagactgctgtattgacaggtggttctattttagctgctgagatcatggcttcaagttctcagaatctgaatcacagggtacatttgtttcatcacaggtggtactttttgttgactttctttggaaatccaaagccacatgggtcctggtgttcattcccttgtttgtggcttcatctgtctccatctcaccaatttttggcgggtcaggcctagggcccacactgtgttccgtcttcctcatagctgggccgcaagatttggactccagcttctccctctgggcctgacctcaggcaggaggaatttcacggcaaatccacgggactgagcttcaggtttcctttgcacccacttagctcctgtccttgactggcagcctcaatcactctctgtggctctccctgtacctttgctaagtggtccatctggacactagtctgctgctccattcatggcaaagttacatcactcatcagcyggacagactctcctctgctatcaatcttcagrtggcaaggctgagaacattagatcatcctcatccctgatttcattagctgtatggggaaaatggaattcctgtgctacacaacagacaaccatgaagacttgcagagcccatgggggcacctgtggagagaggaagattaagatagagatacaaaagctcaggccttgggtggagccgattccaaagctcagaggatactagtcaaggcagaagccatgtttgcaccaggtctgaatgttcatattagattctttcccactttcatgagactctgatcttctttgccaaaccctaacattttgcatgacatatactcttttcttatttctttccaaatcttatttagaagtaagggcaaacattgtgttatttgaatacagcggcatgtagacacactttaggatgtttagttgtactgttttttcctagtagctcttaaactctatcacacctcaaaaaagagatgctgcacttacatcattcctgttaaattgatggctacattttaggggtagttacccatgcttttaaaacctggcaaatgatatttcctgtcctcatttctattttaattgtggtaaaaaccatataacataaaacatactatcttgactatatttaagtgtacagtacagcagtgttaactatacgcaccttgtgctacaacaaatatctataactttttgatcttgcaaaacagaagctctatacctatgggacagtaactacaactgcctccctcctgacagcccatggccaacaccattctaggttctttttctaagactttgactactttaaataccttcacataaatggaattataaagtaatgcatttgtcttttagtgactggcttatttcacttagcataatatcctcaagattcatccatgttgtagtagataaaaggatttcattcttttataaagctgaataatattccttgtatgtggcatgtataagacttagtataatacagtaggccgtgcacagtggctcacgcctgtaatcccagcacttaggaaggctaaggtggaaggatctcttgagcccaggagttcaagaccagcctgggcaacatggcaaaaccctgtctctactaaaaatacaaagcttagctgggtggggtggtgtgtgcctgcagtcccatttactcaggaggctgagaaggaaggattgcttgggcctgggaggttgaggctgcagtgagctgtgatcgtgacactgcactccagtctgggtgacagagkgagaccctgtctcaaaaaaaaaaaattacagtataagtggtgtaataacagtgcaaagtcctaggagaactgtaggaatagcagttaatgaatttaacaaatatttattatacacctacaatgatacagacaggcattttgccatactctgtgctcagagtgtggctgagcttcacagtcctggaagactctttgtttatgataaagcagccttggaaatctataatcaatttcataattgcaaaaaattccattgtgtgtgtatatatacatatatatacttaaccaaggaagaaaaaaacctgtgcactaaaaactataaaacactgttgaaatgaattaatttctttattcatctcatctattgatggacttttaagttgtttccatcttttggatattacaaataatgctgaaatgaacatgggtgtgcacatatatctttgagatcctgttttcacttcttttggatatacycaaaagtgggatagatgaattatatgataattctgttttcagttttttgaggaacattcatacgatggaggctagcctttccccactgtgtagctttgttgaagctcaaagatcatatacatgaggttttatttctgggctctctattctgttccattggttcatatgtctgtctttaagtcagcatcatattgatttcattacaccattttgtaatatgttttgaaattataagtgtgaggtctcaagctttgctattttccaccccttcattctgttaatgtggtgtatcacattgattggttttcatacgttgaaacatccttgcattctagaaataagttccacttggttagagtgtataatccttttaatgtgctgttgatttggtcagctagtattgtgttgagaatttttgcatcagtgttcatcagggatattggtctgtatttttcttttcaatattggccttataaaaatgagtttgggggtgttcctttgtctttaatttttttgagaaaagtttgagaaggattagtgttaattcttccttaagtgtttggaagaattttccaggagagacatctggtcctgggttttttgttttttttttatggaaggtttttgattaccgattcaaccccatactaattttaagtctgttcagaattttttttattgcttcatgattcagtcttggtggattgtatatttcaagcaaatatctattttttttctaggttatccagtttcttggtgtgctattttcctcacttcttacagatctcatgtagtcttgtcagtctttccaaagtcttgtataaacaatttcacgtgcctgatttgctctcatttccccttgctttcttcagggaattgccaaattattcctgatgcaggggatataaaaccaatctgtaagcatttggagttttagaattataagatgaaaaaagtcacatttcaaaatctgacatatacttgatacccagaaagatgtttttgattttcattcacactgatgctgaatgcctttacatgctgtaatctgtgaaacagacttctttttaaccttcaaaccctaacagtgaaatgatgatgaaaactcaatctccctagattatatgtatttcagtttcttaagtcaaatggaatttctaatttaactgtagtctacactatatcatttccaatatcaaataattcttcctgaaactcaatataagaaaaaatgacaatattaactagtgtcatgaaagttcatgctgataatgagattgagtctggtccttcccctgggcttctccggggaaatgtcagtcgtctacccattctaattctctcacttggtcacagggaggcagtgagctccaccatcaagggacatgggtcccacttacagttaatggagtccgagagagcagatatttgcaaacccagtgatctgggctcagtggaggcctgggcaggtggagatgcctttggttgctgcttcagaggagtaagagcttagcaaaattagacatggagaggaatagcccatgaaatgtgtttggggaattctgggttaaatcaagtacagcaggtttctttactttatttttcagaactgctatatattaaggtatattgtaactgttccagaaggaggcttggtattcagcactttccaaactgcgttgctcatggaatgcctgtttttccccttagaacatcgaatggaatgggtgttccatgaaatgtgctttgggaaatgctgatgaatgaaacgttgctggagaatggtagttagagttcacttaccatccattccgcgtcaggcatttaccaaacaggctaccacatgctcctcacagagggctggaagagaggcatggctatcattgttctgtgttatagaggaggaaatggaggctttgagcaagtataccacctgcctgaggtagggtatggtggatccaggatccagatttatctgattccaagcaccttgtctttccccaacatctctggctccttttctgattcctaaaaagcccaaattcaggctggtgaacttgattgaaaagttgctatggaatcgtggggttttcatggagaaataaaaatgttcttcttatcctctcatcttatgaaccctcagtgtggcaggtgctattgagcaccaaggtgtctgaatagttgtgcaccttggccacttattctctgcacccccattttttcctgtaagcatgaggatcagcatctacctctaaggataatgtaaagataaataacacacattatgaaaaattatgaaaaactgcaatgatcacatagtagatgctgaataacttttgataacatggcacccaaaacagcggtttaataacatcctagcctacctgtgtcgccaatggccttgttccccagtactgttacccaaacctctgaaaagggaacccctgaccagagagctcctaactggggaacccctggccagtctgggtaagaagagtcactgacatgcacatcattgcaaaatgaaaatgagcttctcgttcaaatgttttaagaattccaagatagcaacatcaaagcatcaaactgagcatggggcccttcagagcacagggtcctgtgggcagccccgtctgtggtctaagaaaaagttaaaggaaaccagaatcctgcattaaggagaggagaaaaaagatgctgtcctggcaaggggacttcagcctagacagaaagaccctagctctctggaggggtcttaagggagaccccagcccccaagctgatctcttagattggagattggagagtgaagaggctgtcacaagatcttgtggtaggaagaaaaggtgttggcaggggaaaggtctgatggcgcacgctactgagctgaagtgaatgtgaacttggctggtggggcatcatgtgtgcggcccccagaggcgcgtgggtatgggagactctgcatcagggcagttagcctccaggtctggcttcacagtcttactaattaaatcaccccaggctcattccactgtgagattggaggttggcatatggcagattttccttggaggaaaagtgctaaatattaatagagaatatggacaaggcttgacatggtcccagctgctgtggttgggttgcatttggtgtaatttgggcaaagcccgttctctccataaactgaaactttcctctgagsttcttttaaacatgacttacaaacttaagctgggtgtcaaaacctgatgccttgtgcctatgagtgcttttactcctgacccatttccattctgctctttgcttaggaatatgctatttccaaattgctgcgtacatcacttagggaggaaaagaaggtttaattgcatagctttttagctgtggccaaagtaatagtcactagattcaaaaattctcatttatatgtttaatcaaaactatctttcataatggataaatttttcattcattagtaatttgaaaaagaaagagaatattttcagattgtggagaaactactatgaatgcctattttctaaaaatgtaattgtgttctttgaactatgtttaagaatgtccagagaggagagtgagcagtgccattacaggtgacctatgttctgctaacaagaagaggtctgaggtccctttagacagagagctctgcctattcacttctcacttacctattctttaccttcctcccaccttcccaccttgcctcctcccttcctccctccctccttccctctctccctccctccctccctctctctctttctttctctctttctttctttccttctctctttctttctttccttctctcctctttgtttttcttctgcttctttctcttcttctccttccttccttccatccttccttccttccctccttccctccctctcgccttcctttctttcccttcctttccttccttcacttcttccttccttcccttctttcacttcttccttccttcccttcccttccttcacttcttccttccttcccttctttcacttcttccttccttcccttcccttaccttccttctcttctcccttcccttcccttctcttcccttcccttctccttccttccttccctccctccctccttccttccttttatatatgcatatatgtgcgcatgtatgtatctgtatagatttttatctatctatctatctatctatctatctatctatctatctatcatctatctaactgtctatcatccatccttttgctgctggttcaaagaatgaatcagatacaaagtcttcttggaagtctaaaaaggaygtagaaagcatgggattttgagagattttgcataatgagagtcaaaaactgatcattccctttgccctgttttctcttttaggttcatatttggtgcttagacaaattcaaaatgaggaaacatcggcacttgcccttagtggccrtcttttgcctctttctctcaggctttcctacaactcatgcccagcagcagcaagcaggtaagagccagaaacgtccttgattttgtaaaaaggaatatcattctttgattttagatcttagacatcaggcactgacatagagcttagatatgttcttaaggtagctaagccatttattataggatagtcagataggatagttytaggatttatagrccttttcagatactctttatccagtgagagatgacctatttttattaaaacttgggtttggtatcttggaattggcttgaaaatgatttgtttttacattggatgtgaacggaaagtttgtatctcaaatgttttaccacctgaagggactttccacatttctggcattggctggtctctgagcacataaagtagggagaagtcaatgattgagagtaaaaactattttccctgaaaaatacaaagatcaccctctctctctaactccagatgcaggaaggcatttttcatctaggatccttgaatctttaagatttctgtttcccaaaacgaattaaaagcatgggttctaattaactctattaaraatttgatttcagagttttagaaaagtgggaaatgcttcatgcattgcaagctggaaaggactcaggtgggtctccctctccttgacccagagagcttggcctctgagggattcttyctccaggccaggttgctcttagatggagggaagtctagtgtcacttcaatggaagaagaacgtgggttggggcatcaggtcagcctgaggtaagtagagtccagcagcaagcctggctcacagctgcagaagggcacctcctggggccactgacagcctgataccctgagctcccacccttgagggagaactgggttcatctggaaaygagatagataatgtttgacatctatggagacttttctggctctgaaaaatatgcagtaactaatagagtacagtttgttcatgctcaaaaaatctggaaaaaataagtcttttcccttctctacatttacacaagtcctcctcgcttaaagaacatgtatttattatatttatttttcacgcaaattacccaaagcattgggggttagtgaatggaaaatagcaatttttacttttccytttttgtcaaggcccggttttgtattccaaactaaagaatgaatttataaaatgatggttggttgtctgtgataagacttccttctggtttaatcaggtgggtcttggggctcaaactgccacagggaatcatacttgagttaaagacagcccaggaaattgtttccccaatctggagcatgctactggcccattcatgatggtctctgagtatggaacttgggctagtgactgggcaccagcagctattgagtgcatgggctcaggtccctggttcccaggtaagtgagtctaccttcctgtattatcagtgaggtgtgaagtgtttagtagmagtatagtgtaaaccaaatttgtttaggaaggctttgcaytgataggaagtaattgcttacatagtagaaaaatctaaaccaatgtctttttttaaagatgtcaaaaatggtgcggctgctgatataatatttctagtggattcctcttggaccattggagaggaacatttccaacttgttcgagagtttctatatgatgttgtaaaatccttagctgtgggagaaaatgatttccattttgctctggtccagttcaacggaaacccacataccgagttcctgttaaatacgtatcgtactaaacaagaagtcctttctcatatttccaacatgtcttatattgggggaaccaatcagactggaaaaggattagaatacataatgcaaagccacctcaccaaggctgctggaagccgggccggtgacggagtccctcaggttatcgtagtgttaactgatggacactcgaaggatggccttgctctgccctcagcggaacttaagtctgctgatgttaacgtgtttgcaattggagttgaggatgcagatgaaggagcgttaaaagaaatagcaagtgaaccgctcaatatgcatatgttcaacctagagaattttacctcacttcatgacatagtaggaaacttagtgtcctgtgtgcattcatccgtgagtccagaaagggctggggacacggaaacccttaaagacatcacaggtaatggcaaygccaccaagctacgccctgccctgctgttcttgggagatgagcttggcaactgctggccttaaagcaacagctaggatggygggygggccagggaagagatgagtgttcacaggtttaaaaacaaaggtttgatttggaatattcttccatagtcttctccccaagtagggcattcacctacatacaagaagagtctttttttaaacaactaatattttcagtctaaaaaaacccacattctaatattatgatcccacaaaatacctctgccttccttagaaaagaaagcctcagagtggtgaggtgtgcatctgatcaaactcctctatttggtgttgggatctgtttcctttaaggaaagctccctgttggagagtgcgtgaactgagacgggagygagggcatctgtttttgtgtccagtggactagcagagagcttctctcttctactttacggagttaatttaagagtgttggtagaatcggaattacaagaaacctcagctatgatccagtctagattgattttggaaaaaatttagtcctgaatggttagtgacagccggagctggaggctgtgcatttgggctgtgggtctggtcttcttatttcttctccatgcggtaatcatggctgtgcccacagagactcttctaattctaatggagttgatgagaaccactctggaagtattgagagcacacggacattgcatcgatgtgtcatgtgcagttgcatgtacagagctaattggccgacaggttatttaaccagttaagcctgttagctctccttccagggctaagtgcctaaatggccaatggggaaggaatttgacaagtacaatttcaaactctaccataccacagcaactgtratgagtgcccagagcttactcatcagcgatgggcagagcagagggacctccccttgttagaaaatgagtccatgcagccatttgatagttggtagcagagaattctgggtggaatgagcaggaaatgagagaggaatccagggggagagttgagctccagaaaggagacacacatgttctctgagatggagggaaggcatgagaaaaggggctgtgtttccaagatattcaggtggataagaggcacattgagagagttcaagttgagttgacatccatcatctcaataaaggagggaagcagtggggcttgggggcttggagggattgaagttatttttgatcagctgctatagggatgtgaagaggggtcacaaaacattcaggaagcaactgctgatttgaagtggcatccagttgctatcagagattacaagtcagtgggtgtctccattagtgtggatccctgcctttctgcagatatctcaggcactcccaggatcaaaggagttcccagaactggaacttgcaaagagggaacaatagagaggacagaagaaaattttctcagtaaggaaatccagagtggtagctagtaaattcctgaaacagcctgccatggtgtcctagctgcatggggagctaatgagagctggaatgggccaggagacctctgaagagccagaggatgagaggccaggtctcggaaggagagtcctggagacagctgagtgtgcaagttggagacgctgctggtgtgtagacagggagacctctgagggccaatcgcggggctggaggagtttccaatggtgctcagtgtggtcctcagatgtgtaggaactatagagagccagccactgcagaaaccagagagggtggtgctcacaaaggttgtccatacagaccttaaagtctggagatgaccacagagtctgcagtgtgaacgcaggctgaacataatgtaactaaatcatgtaggaatgttggagactctcttctgtgtatttagtaggcatgaggaagtggataattctttgaatcaaaaaagaatgagtgggcaaccacatggcataggggaactgatcataggaagcaagatttatgaacagatttttctcctacacttttaaaaatggttaccaccaagatggccaytgggacaggaggtaggaggtgaggtgactgatggagagtcagtctcttgtgaatacacatggatggtggggcaggaaaaagagagttgaggcttggaggcacacatcactctacaggaccacatcggagggacagcagaagaattgcaagattgcaatcagaatrctggagcagttgcagagaagcagtaccagatgtcagtttttcataacaaggattcagaaagcaggagctgaagagagatgacccaacatcagcagaaaggaactagctgtcttgagcaggcagaacttgatgaagaagagggtttcagaactagccagctccagggtgtttcagaagtttgttcataaaatggttttcccagtggttactcctgatttcagctttaacggggctggcagtgctgatgcccttacctgtgggtctgcttctccataggaaagagtgagaggcagttcaaacactgcaaagtgttccctgcttccaaatgacaggcctcacccctggcattaccacacaggcatcagtcctgccaaatgacaggaaaagctgggtgtctccaagagcaccccaaaccaaacactcaggttaccaggaaatgacaagagggtatctacaaygaactgcactsctcgctacgatagtctcagtatcattaattccctgatccatcacatttcggaatatcgggataataacaaagacctaccaaaaaatagtgaaaggggctcacgcctataatcccagcactttgggaggctgagacgggaggatcatctgaggtcaggagtttgagaccagcctggtcaacatggtgaaaccccgtctctaccaaaaatacaaaaattagccaggtgtggtggtgggcgtctgtaatcccgggaggctgaggcaggagaatcgcttgaatccaggaggtggaggttgcagtgagccaaatttgtgacactgcactccagtctgggtgacaagagtgaaactctgtctaaaacaaacaaacaaacaaacaaacaaacaaacaaacaaacaaacagtgaaagggaccagtagagaaatggaacatcttttattgacgttttgttatactcacaaaaatagctgagtttgcctttatgtttaaccattatgtaatggacaaacaatgagattaccatagtgaatgctaaatgaaactaccaacatcgtgtgtttccacacagatgataaaacctttgtttttatgccaagaaagcatctctgtcttctagtgtccaagccactagcagcaccagggcagaaaattaatccattcatgtgtcttttctaattaacatcactctgcagttcctcctagtaccacgtcccgctgcatgttccacggcaaaaacataggataataatcttaggaagaacagtacatctctgcttatagttttttggaaagccagttagaagagcattatagagattgctaattagttagggctgcctcttcttactacctgtctgctgggtaacttccccatagagtgttcttgattataaaacacacatatgtgtaaaatatgaacgatcaccactgttgtcaatgaactctactcaaataatcaatctctaatggttgtgtttttaaaaatccctctgtcattctttaaaaaaatgaatatacctgagatataaaacctttattttaaaacaaaagctaaaggtgacagggaggattttggcatcagctttcttttctctgtaaaggatgaagatttttaaaatttgtaaaatatatatacaattttgtgttttacataggaaacaagaatgggaacttgtttttcttaatgaaaggaggcatcacatgagctaagaaaggcattgtgcccacaccagtgagctcgggaaaagagcttccagggatgtcaaaggaaactgtgaattttccttggacactgtaaaacttttctgtagaaaacaccacagaggatgtgatacataaagcatagaagcagaaaaccagacaattttaaagcttttaaattgtgcatagatctgattccttgtaacattaacattggtcattggtccgccttgctgtacacaagcacacatggcccctgtgtgcccttgaggcttcagctctcttgaataacaaagcatgcccttgtatgtcccattattgtgtgtgtaagaggataatgttgttattcagtgatgacaaattatccaacgtgtttctatgactggccactgtagatgttcagtcttttacaagagaatgttcaaggattttccctcagggtccatttatcttatttgcatgactataaatttcaacccaaaagtaagttacaaatggagaagaaatagtgttatcctgcgacttagggatcatttttaaaagcttgactgtattgatcatatttaatccttcttttaaacgtcttgatatgctgaggaagtggcaaatccttccgtgtcctttgaggtcattggtttaggcctgggaaatgttgaggaattttgtggaatttgtggagcctctgtattatgcaatgatgtaggccatttctatggccttctgtgtaattcacaccccctggcaccacactctcttgaagatccttcaggaatcttatattttggctgaacagtggcaaatgctttgggccctaatcaagggcctagtcttatataaaacttttgtgtggcaattactaaaaacacaagatcttaattactgtagcacaacaattatcctactcattgtatcttataagaaggattgtgatagcaatgttgccaggttaatatatttccctatgcaaagaattaatctgcaaatatattgttaggaactttcttgtatattaggaagggaagagggcagttccgaacctggcaatctctgtttcagttcacacaatgagaagagcttgggtaagaatgtaatttcactagagcagaactcttcaattttgtgagacaagctttggatccttttctacagtgagaacaaaaacaattttgttggcacaaggaaacattaattttaaatataaaatgttcactgtcattgaaaagatcagagatcagagtgaatggtcttacctataatattaccatcatttaaaaatgataccctgagtgtagttttctggaatcccagaatataaatagataagctcaagctcacatataatctcttcttgtccctaacacatactcaagttatcaaaaacatcgactagaataattgtgctcctccttgagtttaaatcagccaaatttaaacattcgaactgatgctgtgaaatctctggccctgacttttagatttctcgatccctattcctccctcagggctgctatataaccccgttctcagcatcaggttgggaattctctgtttgccattatgggggagagaagaggtcttggtcagctgtttttctgccctttgtataaccccaggctaattctaatcagggtttattcgatgctcatggtccttctaggtaactagtttaggatgtcataaaaacaaggttggataattatgtcatgaccggtttcatatcactctgcttaacattgttctgcattaagtgactgaatatagaggcaatgacaaaataaatgaacaaaacatcctgcccaatcccagacctgcatttgagttttatgcaactaaacatcatttgagaaaaaagaacaacaaaaatttcatcaaagtattttttacatgaaaactttaaatgtagtttgagttctgattcacgaagttgcatgtacaaggtcattttggtttttaaagaaaagagaagaaacaatagtttctgaaggcatccagcaacatactgggttgaggaatcaccaaatcgtgactctgttttgtagctgtggatttgtataaaaaattattctaatcatttgaggaggcaggagaaatgaccaaaaattagaaatcatctctaaagttttggtaacctactcattgattttccctggtaggtttggtagtggacaattcatgctactacttttccctccaaatttagtggaaatttctagaatatgtacccaagattgtcccctsagaaaagtgaatatgatgtttggaaatttaactatgaggatggcacaaatgaaaaattgctataaatgtcccttttttacaccatgatttctaagaggttgcctcttatccattcagaatgcagaactgaaagagaatttcacattccttcatcaacatgtgttttgtttgcccatatttcgtgtttcttattggtttccaaagaaacatgtcagaacactgaataatgcatgtggtcacttgttctaatgctttcacattttttgcatttctttcttttaaagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttytccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttgggracctccaggagaaattactgccgtacattgttggcgtggcccaaaggcacattgtcttgaaaccgccaaccattgtcacacaaggtatgtatcctcttctcaccatctgtgtgggagtggggtgttgtgtgtgttggtttacatagacgtaaggtgggtaccagcatgattcgccacgggagaagctgtaagtacccacagtccagtccttccctgatgagctgggtcctggatgtcatgtttgtgatgtcatgtgtgcggaaaaactaaagaccaatgagtgagtgaaagctcttacgagagtatgagttgctgagaaagcgtgcttttaaggctaattcaacaaacctgttgctttgagattattaaacatcaccgtattaactacttataatccagtcttcctaaaaatgggcttgaggggctcattacagttctgagaaagttactccaggacyatggcattgagctctaaaagtcagtgttagaagtgtgctcatagacagagtatctttccaaaagcaaagatggagtgagggtgtctcctcaaagtcattttgtgctagggtgctgagagttatacttctgaaggtaagaaataacagtgtaatcacttgatgaaatatttatgaagttttttttttcttgtgcttgtgaagtgtaggagtaattctcctgagtggcaatattaggatacaagctcaaatggagggcctttggcaaaacagccaattggagtggtttaaaaaacaaaaaaaccaaccaagtcacataacaaatatgcacttaacaaacataggaggtatggtgggggcatcaggatgcatagcctcctctaccttttgaactgttttctgagacatcagtcacttttcagacctatcaatttcattacctaggtcaggccaataggatgccatttggtaaatcagggacacagtggcccccaacagtttccagaaacacccaactcacttccagtgttgcttacacactgggatgctctaatgagattagtccttgactataagaccttattcttcattttccttccagagtatgggctcaatgaaaattggtgaatggataccgaggctcctataagactctgattatcatctgcaacmaatcatctaaattttcttgggtgaaataacacattgtyacaactcttatttgctaactttataaataaagtctgggtctacaagataaatattgtaataagatactgctttacccattgtatcaattacaattgatcaagggaggttttcctttgataaaggagtgaaaataatttaaaartaaccattttggagaatatgccattgtatgaaattaagagtagaagattttaaagtcttaattaaaaacatcactatctatttatttaaggagctgacctctacttaatagtgccttgctaatcattagttctagttgctgcattcatgtaaaggcaacacaccacatttccttacaagggttacaaaattcacactgagttagattgaacttgcctcaaatgattttaaaccacagcttttgttgtaataaaaattacaggtagaaagctcaggctatggcatctctacttaatctgtgcattggaactgtgaccaggtgatgtagcaagaaaagtatatgtgagtgttgccttctggagaaggctgtgtctggcatttatttaagtttgaaaggtcaattctgtgtggcttagcttttgctgcatacagttttccagcttttcctctcacttgatgggaccataaaattggcccaaatcctccagatgagctaatagagagactagaattttgaaaataatgttctgaatgcaaatggacattgagaagcaatggaaacagtgtrcaggactacatgcccggtgcctggagctgctcatgctcattccatcatggtgccgttttgtgactctggcaattaagaaaacaatcaagtgaaaatttatgacctgctgaggtttctctgagcttgcatactattggtgtgcatcccaaagtatagaagcccagagatttccctatgttttgcagacaccgacgatgcaacatggctgtagatgggaaagctggtctctggtcttgggtcttctgtggacctgccatgtgatcctgggcaggtcatgcaacctctctgggtttcgatttcttgaatttatgacaaaggagttgcaccagatgaagatatgtctgtaccaggagaagtttcaactttttaatgaaaatgggcagcacatgacccttgtttcagattttccctagccaagtagagtttcaaccccttgattacaaacatcatgtttaatatcaatgattaacttgtaaatattcaacaaatatccttgactatctggcatgtgccagacactatgccaagcactagagatatggtgctgtttaatgagacagatgtggctgctcgtctgttacaggataatggggaaagagacaataataatataaactagtgaccaggcaaaatattctgagcatgataagttgcattggggcattcaacagggctgtgataggaagactggggaagggaattttagatcaggtggatggaaggccctgagaaggtgtggaaccgaaggcagatgagcatgcrgagagcagggggaagagtggtccaggcagaaggaagagcaggaggggtggccctgcaacaagaaggcacttagtcccttcccagaactgtcagaaggcagtgtagctggagcacactggacagggagcctgaggttcagactccctggatgcatggaagctggagaagcagctgctgtagggggatgagaagccacagggagtggagcctgtgggttgggagccaatggcagaggaaggtaggctgtgggttagtggtgggggcaggggctctcctctgagggcttctattttctcagagacagatgaggaggccttggaggcagtggcagagggctgagcagagagcacagccatgagacagtcattctggaggacaggacagccaacttcccaaggaggcatgggaggatggtgggcaggcacaggtctcctgatgggggtctggagttccgagcgtggcatgcaggtaccttgttgtgtggtcttctccaggaatgtccactgcttgggtgatgcatgaggaagactgtgggcctgatggaggctttcaggagagtctgatggaggtgcagggatgaggcatggaggaaaacagagagaggcgtgggaggagggctgaagagggttgtgccatgttggtgaggagtagcaggaccttcaagttcatctcccaacaaggcagtgaagtcaggccctgcagagccacattaaagagataagacagctgtgtttgggttgatatttatgtcaagtggaaggaaatgcgtatgcatccctgacgtggctcacagaagagtcagctgtgagaatcccaaggtttttatcactgggtcagaggagattcatggtgcagcccccagagaaatgaaatgattctgcaaagcctaggtgaattgcgtcagagtcatgaagcaaacataggaattcagttattcttccagttactcaatatttttcagtgtttactatatttggctaagcatggttctaggcatatcatctgtcatgagctcccatgacttgaataaaaatcaaacgtaaatgacctcttacctaatcaaaggggactctgggacagagcctctgggaaccagaggtgcatttcagggttcccagagctgaatccttgttgggtgcaaggagactaggccacttgtttcattagatctagaaggtattccttcccgctggctcatcgggagaacttttagtgatgcagtggtagggggagggaaaacgtgggagggtaggggatgatatttatcttctcccaccccaagagttgtgccattgctggtacttataaagaagaatataacaatctgggccacttggtataggagcaagtagcttctcaggtcattgttatatgagtatttgtctatttttctgtcatgtgtgatatacatagtaaatacatgagtggtagattcatggtatagcatatatggaatttatatgtgtctatatacgtgtatgtgtgtatctatatacatatatattctctctaatggtacaaaggtataagtcttctagagatctacacattagttttatctgcaaagatattttaaatcaaaatgaaggggtagcccagagagacagcatgttctaaattaaatgaaggaaggaaagcccagaatggatgttcataacaatgaccatgaaatattgagaaaaggttcaatgatgttctgcacacattgttacaccagtaggcaactgtgttattgtattaaggacgttggtgcataacatgttacccttctcttagaacatagaccttgtcttgatgctacaggtgakyacccagatgaggcactgctgtcttcatttggcatgtatcagcgattctcaccccaggcatcacgctcccagcttctggtccaaacaactagaaatgaactgcatttcaaaaatgtgttctaggctggatgtggtggctcacccttgtaatcccagcactgtgggaggctgaggcaggtggatcactcaaggtcaggagtttgagaccagcctgaccagcatggtgaaaccccatctctaccaaacaaaacaaaacaaaacaaaaattagccgggcgtggtcgtgcatacctgtaatcccaactactcaggaggctgaggtgggagaatcgcttgaacccaggaagcggaggttgcagtgagctgagatcatgccactgcactccagcctgggtgatagagtgagattctgtcctaaaataaaaataaaaataaaaatatgttctagaaggtagctctgattcttagaaagttcttccttaccttcatcccaaactttgtttcctttgtctgcttttacaaaatcaacttgccatgcaatctatctgatggaatacagtaacagaggactcttttgcaaaacagtccatctcaggtttaatcatttatgttcctctacttcttggaatctctgtcaggtttttgggttaggtgttgtggtcttaacagagttcatggttcttgcaatatgggcagggtgcctgcacatggatacagcagttcacagtcactgtgagacagttatcttattgagatgtttttgctttatggtttgcctttaagttatcactgtcatattacttaggatctttaaaaacaggttttttgttttttttttggagatgaaatctcactctatcacccaggctggagtgcagtggtgcaatcccggcttactggaacctcctccttccaggttcaagtgattctcatgcctcatcctcctgagtagctgggattacaggtgtctgcccccacgctcggctaatttttgtatttttagtagtgatggggtttccccttgttggccaggctggtcttgagctcctgaactcagatgatccacctgcctcagcctcccaaagtgctgggattacaggcgtgagccactgtgcctggccaaaacgcaggtctcttaagtgaaaaatgtttgyggcacttgctggctttgatgctgatttcctttttatacgttttatgttaagtaattctttcgtctgtcaaatgaagacagggaatatagaactgaagagaacagggatgtgcaggctctttcagcttttgcacttgacaatgagcattttgaaatsaagactgtgaggcaaagggttctctgagcagacatcagtggtttctttaattattcaagcaatgacttcactctggccaagttgtgtatttacggcagaagagaacttattgaattttcagtgacagcatacaaaacaggtggctactaaaactaaatttgtttttgtgcaactattttgtaaaaagtactgactgggcagggtggaaggtgagccagctttcctccagcaggtggggaggcaaccataacttatgtgttcattaggacaaattccctttggggtggccctgtggtcacgttggccacagtaaatgagggtgtcctttaaatggagttagctttgttgaaagtcattgttgattgtgcttggtaaggccattctaattgccttatratgttgccacctacagtcattgaagtcaacaagagagacatagtcttcctggtggatggctcatctgcactgggactggccaacttcaatgccatcygagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcaygagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgcygatcaggctgagctggaagagatckctttcgactcctccctggtgttcatcccagctgagttccgagccgccccattgcaaggcatgctgcctggcttgctggcacctctcasgaccctctctggaacccctgaaggtatggtggtgatggcttcagacacacaatggggtggtctccaggcagggcctttaagaacaaaacaaaatgaagtgtgtttgtgtttagctaagagacaacaaatgatgaaaacagcagcaacgaacatgatttattccaggtttccttttgcactgggttcaggattgtatggtttacaatgtcatgcaatgaaatttcatataagaaccatatgatttaaaccacaggaccatgggccaccacctgtctttgaagcttctggccgaggaggtcacatctcagttcttatcgcttgtcagatccctgtgttcttctgtttctactggtgatttctgtccagtctcctcctcatcaccaggatgtagctttcctttcctgagttgtccatctacttctaaacagccccagtctgagctgtttagggcacagtgtcctcagcttttaatccctctcttctctctcgttaagggattaccctcaatgggaaagcatattgaatggctaagtgtggagttcaaacctagtggttcttcaaatccctcatttaatatgattgccagtggagagttatttttaaagacattatacagatctatgagctaatgagttgaagaaatacaattcactgcccttaatgaagagaagatgagcatcacagaatgatgctttcccaccttgcagactcgatcactagaggattgcctgatgcaggcatgacccatgctgcctggatgcatgctttctcttcacactccctggtcttctatatccatctctttctctctcttttaaaatttttcttaaaacttttaatccacactttcatagccaaagttcaacttaggatacaattagttgtgaggtctaaattacagtagggcatcagggaagaaataaaaaataaaattttaaaggcacatggtaaatgtgttgggtcaaatacactattttgagaattatactttttattcttgatgtgtataagtttggccaagcctagcaactagtctccttctattttgctgtgtatttacggtcccatcatctcactttgggggaattcccctgttggatgattgcctagcaagactgtgacttcctaataggagaagagtcccagtggagaatgacaaacggggaagtctgaagaagacttcaatatgagaccagcctacttttgctattttttttagccttaaggaactcgttttctcaggttagtgagggctaactgcttctgagctatggatggaagaccctctgtttgtgggtagaggtgagccccagaggatccagccaggcaaacttaaacctggctgggatgagtgatatggactgatgcagcaccttcatagtattcatttttagggaaggagtgtttggtttcaaggattctgatcacttttgttgtctgtaaacattctaactttgatgttgtagctctctttgagccaacttggttttgtaaactcggctaccaatatgtctcacaaacaccagccaccaccagaggaaaatatgcagccatctgccatattttacaagatgracatgctttgccatgctgactttctctgtgttctaaatgttggcatgtgtgcacgtgttgtaggcacacatgataaaactctccgtggttgtgtatgtctcacttttttttctgtgcttcactgcagttcactcaaacaaaagrgatatcatctttcttttggatggatcagccaacgttggaaaaaccaatttcccttatgtgcrcgactttgtaatgaacctagttaacagccttgatattggaaatgacaatattcrtgttggtttagtgcaatttagtgacactcctgtaacggagttctctttaaacacataccagaccaagtcagatatccttggtcatctgaggcagctgcagctccagggaggttcgggcctgaacacaggctcagccctaagctatgtctatgccaaccacttcacggaagctggcggcagcaggatccgtgaacacgtgccgcagctcctgcttctgctcacagctgggcagtctgaggactcctatttgcaagctgccaacgccttgacacgcgcgggcatcctgactttttgtgtgggagctagccaggcgaataaggcagagcttgagcagattgcttttaacccaagcctggtgtatctcatggatgatttcagctccctgccagctttgcctcagcagctgattcagcccctaaccacatatgttagtggaggtgtggaggaagtaccactcgctcagccaggtaaacctcccctgttgccgggaactccctctccttcctcagacaccaccctggagggtagtttgccagtctgaactcaagagcactgtggactgtacaaagacaattggctcccttccattgaaatagtttgaatggggacttgagacactgtaccagcaaggctggactctgtctaaagggtgttcacgaaggaaagtctagaacatccagcttatgttctgtccattttgcctcaccctttattcagaaggattttttttcctctaatgactgtgaggattctggagttcgaatccagatttggggatcatggggtggagggagacagagagagatttttcttacatgaatatgccttgggattatttaaacgttgaaattgtatttttacatgatttttaaatgttcaacatctgctgtatctagaaaattatttgttataaaacaaacaaagggtrcatcttcatgcaatggtaaaatggtttmtaggggaaggctaacttattattattattgcaaattattatggtggtaagatatggttgtatcagatctaccagtctgctaacatcacacagatgaatggcaagactaaaccaattgaaacctaatcaaaatagttctaagaactgttttaactgagaatgttatttacattacacrttgcggtgccatagggcctgtcatctgtgtttcctattgtctcattacaacagawtgggaagcattgacaaggagcctgacccacacagcagtaatgggcactattgtgggtcttggcccgtaacctcaaatttaatgatttgatcattcaattacagcagattcatggcaacccagttatctttgagtggttgacccatatcagccccccctttttttttctagagattgagatcaatttttttaagcaaaggtatattaagggccatgttttcaatacttttatttgtaacagtttgaaactgctgtctgttttcctggagcgattgccacctgatgtaagaacacaacccagtggggcttttccctggcttgctttattgaagaagcatgatgctagatgggataggctgttctagttactagctttgcaaatatgcactgatttgaaataggacattttcaagacaagtggtatgaatttgggttttctcttctcttgctggcacagtggtcatcagatgagtttcaccaactcctgttgtcaaatggtgctgggctgaagtcgctttggttcctgttatgctctcgtccctcattgtatcctaatctaccttcattgcagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaayggagcaccagcaccaggtatggtagagaaatgctagttgctctgccactcagttctctaatgcatgagttgagggtaggctgctggccactggtccttagatagaagccctccttgagtttacaggaaaggtggaaaattaatcacctgctggtttcagcaggaacaatagaatatgagatgtccctccttactttgattctctagctgctctctcaggagaatgagggtgagtatttttaagggcattagattatttcatagtaagacatgttataaagatttagatatcagtggttaaaatccttttttaaaaacagtttttatggtatgcataataaaagccatatcatatggttacattgtacctaaaacagccttcatcttcatattcacccaatgcctttatattgttataattccttcattacattcattaaaaattaaaggagtagaagaggyagataactttccaccataaactctgcattaaaatcccccaactgctaattgacactgccatgacttttcatttaacccctttaatttagtgataaaaatgcagtgaagagagtaatttcccctgtatgccttttgatgaaaaatgaagactccagagcctctcctttgattactgggcccattggccgttggcttgggatggtaactccgacatctgggttcygtttcctcccattaacccacttgtgactygcagcaactcaattgaaacctcccatcgataaaatgctagtggttgtgcaggtgctgccatctcatgtctctcctcccatcccaagttttttcttgaatacatctttgaaagctaacaatactcttcaagcattgaaaagttccaaaataaaaggggtccctatattggtgtattagtttcccattgctgttataacaaagtaacacaaatttagtggccaaaaacaaaacaggcygggtgcggtggctcacacctgtaatcccagcactctgggaggccaaggcgggcccattgcctgaggtcaggagttggagaccagcctgaccaacatggtgaaaccctgtctctaccaaaaatacaaaaattagctgggtgtggtggcgggtgcctgtaatcccagctactctggaggctgaggcagaagaatcacttgaacccgggaggcggaggttgcagtgagctgagattgcgccactgcactctagcctgggcgacaagagcgaaattctgtccaccccccgacccctccactgcaaaacaaaaacaaaaacaaaaacaaaaatccttattatctgacagttttgaaggctggaaattggaaaccagtgtygctaagctaaaatcaaggtgtcaacaggctgtgttctttctgcaggttctaagggattcttcatctgctcaccttttccagcctccaggggctgcctgcattccttgcctcctggccccatcctccatcctcattgccagcagcttggcactttctctcctctctgacttctgtttccatccttacatcttctctctaactctgaccctcttaccccctcttataaggacacttgtgattgattacattgggcccacctggctaattccagggtaatccccccatccccaaatccttacctgaatcacatctgcaaagtccttttctcaagttcggggatttggacttggacatccctgtgatgctcttatgcagcccacctcgttgatatgaaattgctgctctgatgtcctgtgtgagttaccaggctgtcctcctcccagtttcaggtgaaaaggacgtggtgtttctgcttgatggctctgagggcgtcaggagcggyttccctctgttgaaagagtttgtccagagagtggtggaaagcctggatgtgggccaggaccgggtccgcgtggccgtggtgcagtacagcgaccggaccaggcccgagttctacctgaattcatacatgaacmagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacrgccgacaggtctggggatgatgtgcrgaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtacgcagggaactctttgcatcctcactcagtgtcattgtctggggctacttgtctggactgtgggccacaaggtgttctcaattttgcttttcctgccatgtgaagtgaaaactaaaattacaggaaaatttaggaacccacatgccctttttggcctcgatgggcagaaatggcagaggttcaaggggggagatgctaagattcatgttttggggcaaattaaattctccaaaagggacatatgtgcagcttggaattcaggactccttaactttgcatgaaagcttctgtctagatatccaaagggaggggccgtctaactgataacgcctgttgcgtatcagtcctgcgacccctggtaggtttggtcagcagccttctgtgaggcaggaaggagtctgaccagggacactctgcaagctgggacatagactctgaaatattggtatctccagagccaaggtgtgaagataattttgactttgcttggtgctgagaagtgtcttaactggcaggaaggccacctggctcttatgaccatagtttattctattttctttttcctgttccctctttctaggcctggtacaataaactaaaaaatggtgggagccctggtgctgagaaggaaggaggaaagatatatctacctctcaataaatgtcctccaagggccactctcccgggtcactcgggtggggggggttcacagtggcgaaggaggcagatgcggccttgctccctcatatgcactcacttgcctgctcttccaagaggagagaaaagaaggaaagttggggaggagcggaggaaggagtaaaagcaagtgaaaggaaatcactgcaggatacagtgggtgatgagggaggtgaggatgattatttgggtgcaactgagaggggcttggtttctcctcgctggtgyctggggaagagagcagtgtggcccaccaggtttctgtgggatgttcctgagcatttatgatcaggtaaatttgggcaacagtgggataaacaaagtgaaagaggctttctttcttcctaactaaggcgctttgtgtgtctccaacacaagaaaggaaatgcaacatttccaaaatgtatctgcctrcaggaggcctctgtgatgctgtgtcttggccccagattgccgaggatggactttgggaatattgtcacagtgcgggtgcagcttctgttgtcaggaacgtacatttccacaacgctgtggctctttgcccactcactctcctgcgctccagaacagcctccctctttcccccttctccccattcggaggcttctctcacacctctcctgacccacctgactctcagctggtaatcttgagtcctrtttctccaagaaaatgcaagtaaacccaaagagagctgtccccggccacgtcatcccgtggttccttgggtggcctgyctccgcttcctcagctccctttcctctcacctgctcagtggcaccatctgcagttccctttcttgctcttgtgtcaccctttctccactgtgctggatggttccatccatgataaaatgcattgcttcttctctcttaaacaccctctctgatgcgccacttcccctgccagcagcacctgtctcctaaagacttatctatactctaaagttcctttcctcccatcctctctgagcccaccctactttgtcattcacccttgctcctcccccaagtgctccagttgaggtcactccatctgacaaggtccctgtctctggcgaagcccagtggctgaccctcgggtccctgagcagcacctgatgcagtgcaggtcacgtccttcccaagtaccatcctcgctggtgctgatgaggctcttctgattctgcctccgtcgggtttttcatcctttgctccccttctctttgatgtgtaaacactgaaatgcccaggactcccacttcttggacttttaacagtggtgattggtgttaggatcccctgcctgtgaatccatgacaaactgggcggtggctcatgaacgctaagaatttggtgacgatgaaggtgaagccatgctcacatttgtttcgcaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggtggagttcctgctgwacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggygtcccgcagttcctggtcctcatctcgtctggaaagtctgacgatgaggtggacgacccggcggtggagctcaagcagtttggcrtggcccctttcacgatygccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccaggtgagatgggggcgtcrgaggttctccttggagcattttccatatgaaaaataacaggctcaaaggccatggtactcataataaattaaattaaaataaaggttgtatgcccttacctttatggtttttattttgagacagggtctggctctgtcgtccaggctggagtgcagtggcatgatcataactcattttaacctctgccttctgggatccagccaacctcccacttcagcctcctcagtagctaggactacaggttcataccaccacgcccggctaattttttgtattttttgtggagacggggtttcaccatgttggccaggctggtctcaagcccctgagctcaagtgatccacctgctgcggcctcccaaagtgctgggattacaggcctgagacaccgcgcccagcacctttatgttcttcatgcccaccagccagaccccaccaggacacacctgcgactgaacaagttgggtctattgctcatggcatccagggagaatgcataccgtggcaaagcatgagggcatctccataggagggtggccggaaggactggggggacttgagctagtggcaggtcattttgtggaaggcttaaagaaatggaactgtggcctggattggatgttgtcaagacgtggaggtgattctgtagctgtatcttaagtcttacctagaagcaggatggccttggtatagattggtagagaagagcagtcactcttattaaccaggacagggagtgtttttgtcctttttgtggtttgcaccatgtttttctttttgtctgtgttcagatagggttacaatgtggtctcattttcatcttgccccattgtgatcacagagtagccttgtctgttgtgggggtcctgtgagatcatgtgtgctcaacaggagarccccaaggccatgtgtgctggaccagctccccaatgcgggggctgattctctctttcttaaacagctccatcacaagagctgctcagcttccactatgctgcatttacaccgtaaattgcccaattgtgtatgaggcaaagggcaggttgaaatgtgtggagtagcaacatacaagtttaataaaatagcatctgaggagtacctaaaattctaactaataggaaaatgtggctcatctttctcaggatcttttgattaattttattgttaaaaatgcactaggctgggcgtggtggctcacgcctgtaatcccagcactttgggaggccgaggtgggctgatcatgaggccaggagttcgagaccagcctggtcaatatggtgaaaccccatctctactcaaaatacaaaaattagctgggtgtggtggcacacacctgtagtcccagctactcgggaggctgaggcagatgaatcacttgaacctgggaggcagaggttgcagtgagccgagattgcgccactgcactccagcctgggcgacagagcaagactccatctaaaaaaaaaaaaaaaaattaaaccagttatttaatagaattaaatatttttaaaaatgcgctaatgtaaagaaaatgagtcagggtgggtgggggaagctgggcatggcggctcatgcctataattctagcactttgggaggctgaggcaggaggatcacttgggcccaggagttcaagaccagcctgggcaacacagtgagaccctcatccaaaaaattaaaaaaaaaaattttaatgaaatttaaaaaataaaggcacaggcatggtggttcatgtctgtagttccagctacttggaggataaggagggaggattgcttgagcctgggaggtcaaggctgcagtgagctgtgactgtgcaactgcactccagcctgggagatagaaagagaccatgtctcagaaaaaaaaaaaagaaagaaaaggaaatagaggaataatagtgaaaaataaaaacttcatataaatgctagagatgtgtgagcaaaaaggaaatacgagggcacaaatgcctggggagcattaatgtgaccccttggatatggcactgtgttatacgtaccctgcccccatgggctgagattgcgcagcatgctgggatggtgttgggctcctcaggggtctcacttgctaagtgatggccttggacaaggcgagaacctttggcctcagctgtttctcttcttgtacaacaaagatatagatcccagtggccttggtctcttctggtagcaacagttcatgattctgtagattayggtagcccaagattgatttctaaatgctccttacattttagaaatcagtagtaacccagaccacaatgccaaaatttaaatagagtaaattcagaaagacacgttttggataacttcaaatatttcaaggagcagaaattgttttggtgtaaaaggtccaatttttaacggctaatttcaaaaagcccgagatacaaacaacacaggcatcttgggatataatcttaaggttgattaggattatggtgcaaggtgcacaccaaacctgggtgagggctacttacacactgaatgtttccctttttcttctttgatctgcagcagttgagagtgatgctgcagacatygtctttctgatcgacagctctgagggagttaggccagatggctttgcacatattcgagattttgttagcaggattgttcgaagactcaacatcggccccagtaaagtgagagttggggtcgtgcagttcagcaatgatgtcttcccagaattctatctgaaaacctacagatcccaggccccggtgctggacgccatacggcgcctgaggctcagagggggktccccactgaacactggcaaggctctcgaatttgtggcaagaaacctctttgttaagtctgcggggagtcgcatagaagacggggtgccccaacacctggtcctggtcctgggtggaaaatcccaggacgatgtgtccaggttcgcccaggtgatccgttcctcgggcattgtgagtttaggggtaggagaccrgaacatcgacagaacagagctgcagaccatcaccaatgaccccagactggtcttcacagtgcgagagttcagagagcttcccaacatagaagaaagaatcatgaactcgtttggaccctccgcagccactcctgcacctccaggggtggacacccctcctccttcacggccaggtatgcaccgtgtgacccatgactacagagtgtgacatcaacattttttttttagttaaaaaagtaatcagtagtcatttttaataattttcttctctctgggttgtttcttcagataatattagaaattaaatactggaaaagtagttccattgaaattgcagaaggaagcatattattgatcttccatcactcctgagactaatcatagccccattgaaaggttctgcagtgttgcactgagataattacaaactcattggctctcagaataggatggcatctttgaaatcagccagtccatgccccactgaatgtgactttgaagttggcccatgcctactggccagatgcccaatayagtccaggtcccctcattccttggcctggtgggaccatcagggagcaccttcctggaagacttgcagtcgtccacctcagcttctaccccgtgctcctggttctcgtctttggggctgcaaaagcaaagtggatctctccaccagcccatatttttctttgtccctcctccaagtaatcgccatgtagacatctgaagcaaaccattagggttggttcttcaaaggggagcagtatgcctgtttccctagctcactgctccctaccaggctgcctgtggcacatctcacatccctcacactgtctctcatcctttctcctctctattccagtctcagttgcttaattataatcaagaaattaccctccacaccactgatattcagccagctcctacaaagctctcagaccatcatccaaaggttaaggggcctcttcctattttccaatctgtttctccyagtccttccttgctttgcacctcacacacatctcttcacttccaggaacyatttaaaattcttgaccacaaaggaaacttctagtggcatttcctaaaacacttgagatcacaaatgtcaaagccaggtccctattgaattcttgtcacaatgccattttgcacgggataactgaagttctctgtcactgagttttcacagagtgtgacatcaaataatttttctcctttcctttttgtttagaggatttatcattcatcttcttgtatttagcatgtttgggagctgcaaattcaggaactacaggctaaagaggcatggatttgagtgaaggtttcactgtgaataaattattaggaatgtcttatttcagttatttaattttaccttttgtgtatttatgttctgggtctggaaacctaatctctccttattttcactttaatcacttctagagaagaagaaagcagacattgtgttcctgttggatggttccatcaacttcaggagggacagtttccaggaagtgcttcgttttgtgtctgaaatagtggacacagtttatgaagatggcgactccatccaagtggrgcttgtccagtacaactctgacyccactgacgaattcttcctgaaggacttctctaccaagagrcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcrccacagcgttccgcgtgggcaacgtccaggagctgtccgaactgagcgagcaagttttggaaactttgcatgatgcgatgcatgaaaccctttgccctggtgtaactgatgctgccaaaggtaactcccattatgtgcatattttccatcctttcctgttgacatttgtgcctctttagctgtctggtccctggtgctgacctctggagtccttaggcatttggttgcttcatacatttacttatacccactgggactggtcctgacacccacctcaccactacctagggcgttcttccaagacaagagtagaagtctatcatattttgcttttataagatttacttttctcccctattccttaatccctcaaacaattcagatttattgattcctgtgtctaattatagatttattagatcaagtatttgagatcagaatatttgattttcaagtgcttttaatttaaagcacaaacttggggtgcatctaaacaccagtggtgtatcatcacaccaaagttaattaacaccaccaacaaagctgactttttaaaatagcttactatttggcacctaacagctaccctcatttctctctgtgagaggggtggatagaattkcttctcaaagctcacacacacaggatctcattttgcacttgagtgcgatgccctggtcctctgcctgggttgtccctactgctggtataagtagagttcgtctcctcagccccagctgagaactcatcacctgcatttctcctttccagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtctgtggggccagttggttcaggtgctccctgggaaatttccaaatttttactggaaaggaggaagcccttcccccaagttaaatcctcttcatgtttcactggattgttagtgtctatatggaaaatcccttagttattaactgatctaatgtcatgtactgtcttcctcattttggtagtcttacgtaagctctaaaagaatcctggaaatcagtagtttaacttgaatgagttgaatttgtgattgatttatgtttaattatagtccagtcaggtacgttctccactttcatttctctgtgtgtatgtgtgcatgcatgcatgtgtgtatatacatgcatatatattgtgtagacacacacaccatgtgagtttgctagggatcatcatgaagtactacagcctggcgggcttttggaacagacatttattttctcacagtcttggaggcttgacatcctcgaggtgtcggcagggctgtttctcctgagtcttctctgcttggcttgtaggcaggggtcttctccctgtgtctccacatggctttctctctgtgcatgtctgtgtccaaatctcctcttctaaaaggacatcagtcatactagattaaggttcactctaaagatctcattaaccttaattacctctttaaagaccctatctccaaatacagtcccattcttacggtactggggtttaggacttaacatacaaattttgaggggacacaatttagcccataacacatgcacacatgcacacacgcacacacacccacagacatgcacccacatacatgcacgcacatgcacccatacacatgcacacacatacgcacccacacacatgtacacccacacacccacacatgcacacacaatgcacccatacacacacatatgtacccacacacatgcacacacatgcacgcacacatgcatgcacacatatgcatatgattcgcagaaactacatcttagaaatatgagaatgagataaaaattgtttttattgtcattgctgcttgtcttttttaaaataaattaagcactcaaatatactcctccattttaagtgcaatatcaaagtcttgtgaacatgggtaatcattcctcaacttgggccctcagtttccttaagtgtaaaatgaarggcttgagacagcgagtctctcagttttctatcagcagtctgcaacactcctttttagttttcctgggatttgacagctctcttatctgcaggtggtcattcattttactgatggagcagacggagatctggctgatttacacagagcatctgagaacctccgccaagaaggtaggtgccaaggctttctaaatatgasaagtaaaccctggtgaggcggggtgtactgctctgctggagagaaacctctctgctaatgcagcgccccaagggagcagcgttgtcttgggagactcttcctcccagcgttgtggcccttcatcacctgcttggagctgtgggatggagctaacaaaaattccttctgtacttagacagctttactgttgtgttgtggctgttcaggtggtagaatgttcagaaagcatgatgcttttgcaaaagatcatgacgtattgattcatttaacttcatcacataaactaggaattagttactaataaaaatacattgctctatttttggtttgcagttatcacagttcaacatttaataacactacacccaaataatacaaagaaaataatgtaagcaatgacgtaccaaacataaggtgacagccatgcctattatcagatgtgatctttgactattcacttgctttggcgtttggtagcactgactatcagaaagtggatgccattacagaagtgtaatttatcctaagaactttctatttattagcttacttttcccaagcaatggagatgaggctgctattatctgattttggaggtgttagtatttcaatacttcccacagcatactcgtgttacagagggcctgagtttgagaactcatgcatgaatacacttcatggatgccacttcctatatttttagtaataggtttagttattgacataccggaaacaattattcagcagagtccaaagtttgagtatttcaacaattcagagtagccagtaaacttgattaaatatatttaagttaaaagctaaattttacactgaagttttctttaaaaatgtagtcaggaaaaaaggacattgcattttccacatgcctaggtgagctgtattaaatgtgtctttctttgcaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgtgagttttttttatgtctttatacacagaccagtgtagataccacaccttttggcatttcaagagaatgaagttaattatcagcaggtgaatggaggtggggggggggccttggtagatagttaaatttatttaattcacttgggaactgccttgttgccataacacatgtgaatctggaaatggagatagcaaatcgctggaaatccagcgagctggaaggggatcctgggcgcgctgaggttgtggccttagcattttctctgctcccttagcaacggcctcttttaacaccattgcagggatgcaaaccatcgagattgtccatcctccaattggaaactgtgtcaagagcatctgaaatcttgcatgataaaaacaacatgcaggaaaagaaaggctgtttctgggtggagaagtgctttaattgccctccctagtttccctctgtgtcaatgaagctccctctgaggcttcctcattctccccagggccagcctctctcagctggaggtgtgacctcctgggtttagactggggatggagcttttggaagatgtggggctgagctgcgaactcagagattctttgatggtagcaacagtggactgtggctatgagaatgggaggaatggaccttcctttcttccatrcttctttgcagggytagaatcaggatttttttcctagtggaagtaggttgagttagctcacaaatctgggatatgggagaaagggaaagctcttggaagctcgttggaagaaagtgcatgtgcccaccattagtttagcagatggaaatgtatttgggcatgccctttcccacataaggtcaggggccagatgggatgagaatgtagagggtgtctgtgtgacctggagttgagaagcttttggctccgaggccaggaccacttgtgcctgctcccaccatggctgctctggaagcctctttctgggctggtaccatatcccatgactctcaccctggttccaaggaagggtggtcatggatatctgttctggaaccaccttcagtcttggccatctgccatttgcttggctttgcactttggaactggaacatatgtaagttatagttaagatctgatgatggaaacttctagaaataaggtccagcctgcagtgatattgtggataagatctatyttactttggttgttctttactttcctattggtgacctcccatctgcaccccgaccgccaggagctgggccctcctgacttcgctggcaatttctatcatatcgtcagtcgtccagcaaatgtcacctggagggacttcatctcacaccgtgaaacccccacacatccgattttgacccttraagcgcatttatgattttctgctgggcatttcttgagatctgaacatttggtttctcttcctttcggtaggacaacattgccgagaaagcttgctgtggggttccctgcaartgctctgggcagaggggagaccgcgggcccatcggcagcatcgggccaaaggtayggtggctttacccttgcccacgcctgagatgaggtgtcagaagcccgacrttactttggtggggtaatttctctaacagaagagtgtggagatgaaggaggagacgagagaccatttcttatgttagaaggaggagctctgaggggcagacctgcgtgctgttctgctggggcctgttccagtgaagatggttcaggcgggaccctccttttgcacaggataaggggatctgtgctttaacagcttggtccttcatttcataaaataatgttaaaggcagctggcgtccctgacagcagcctggctgcgaatggcagctggaactcatagcatttgctctgagtcagtaggaactaacaggctttcttggcagagcaggagccttagagatcctgatagagagaatcgtgacatggtgtactgaggggaaaagcagtaacagggaaagccatgctgagttttagtgctgctctgccaaatgaagggggaccacagggattcttactstagagcaaagaagaccacgggattaaacagaggacccrattactttgtttcagggtattcctrgagaagacggctaccgaggctatcctggtgatgagggtggacccgtaagtaaaaattgttttagtccctaaaatttcaccccctccttgatccttacccattgggattgcattgtggatttcatcatttgttcagttgctgatggctttccctttgggagaaaaattaatttatacttttcttaacaactttgcctggatgtctaagtacgataattgaagtatgacaaatgtgggcatgaagggtgggatttgttcttactctgtttcagaaggagggattaattggtttctgagccagagggacaccgaatttgcacacccagtatctactagattaagacatgcaagtagagatgggagtgagctgaggggcagggacacagcaggagacctcaccagggctttaggggttaccccgttaagggtagtccctggaggggatgttgctggatcagatcatcagtatccgagggtcttggggatggacagaccccagtagcagggtccatgggagcaatgcccaagacagacacctgtctggggagctttgggaccctagatcaaggtccagccctgggataggggacagaggggctcacgaggaacagtgtggtcaccagggcccagccggcagggctcggctagagaactgggaatcaagcatcacttggaggagctgtcagccyggtgggtcttcccgggattcagcacccacagagacacagtgctgggggccacccacccttgccccacagggcagtgctgtctgcgctgctaccctcccagatctcattcccttcagggaaactgcaggttccaggccaggcctcatgcaggggcccaagaggctccctggctcacgtagcctcgatcgrcgttccccatggtgaaatctgctttctgctgcatgctgttcacagtaccctttacgctgctgcaagcccggcagagaaagggtgatgaagggctccagcttgcaaaatgcctttgtctctcacaayagggtgagcgtggtccgcctggtgtgaayggcactcaaggtttccagggctgcccgggccagagaggagtaaaggtgaggcgtgggtgatggggttgctagcgtggggaggggtcaggtgactygcagtttctccagatgctgccagggagggaggcgctggtccaggcttcttgacctcagcattcagcagcccgtgacctctcattggaaggcagttctgagcagggtgggttcaggagcaggggctgcagctggtggggagcctgagaatggagaaatagtttcctgtggaaacatgaagaagccaggaaaccctcacaaggagagaacatgggccagggcggagggkaggctggtgcccacggccccggccctggaccgtgggagcagtcagggaagggagtggagtgagaggacagcaggtgggttgaaggctggtgaacttgcttctctgtttgctgaagtttgaaggcaggtgctgaagggaagggctgcaaagttacaaagtcagctccttgccctgggttttggggtccacccccgccggcccagggagccaagaccacccaagcattcagttctagttttagttttaaaacatcgcacgtggtggtgagagaggaatccaaaggggtaggactctaatattacattttcagacactgcaacattcaaatggggtggagtgggggaacagcccttggcctcttctgcccgagggaccagccctgcaggaaaagctaatgcttcccctatcgccttgccttctagggctctcggggattcccaggagagaaggtatgcaagcttggttttgttttacaaatggaaaactctcccagtatttctcatttcttcctttgccagaatagctttctatacttacctgtccgccttattccctcttagggcgaagtaggagaaattggactggatggtctggatggtgaagatgtaagtgattttactctaagtccaaactgcttttggttctgaagattccagaaactaacaactcagtctgtgatagaaattgcagcaggtgtgacctttaatccttgtctttggcagggagacaaaggattrcctggttcttctggagagaaagggaatcctggaagaagggtaggtgtatttccacggtggtgctattatggaaagaatatcaacatttcatttagggaatagttattttctttcctcatatacatcaagcccgcttcctccaggcagccttccctgacctcccctgtgagtgcacccattacatcccctctcagctctgacacattacagtacattttcttgtttcgagatcacatcccatagggcagggactgagtttgttttgttataaataaatctccagtgcctggcacaaagtgggtccccaataaatattcatggatttactaaacgaatgaaaaatatgtggaagtgaatttgccttcatggtgaatgagtaaattgtaaacattgttctagttaagatttatgagttgaagaatgtgatttttagggtgagataaaaatggaaacatctagtttttagcatccacttgtgctttttctttagggtgataaaggacctcgaggagagaaaggagaaagaggagatgttgggattcgaggggacccggtaaagatttctttattgacgatttcagacctgagcctggggaagagggttgttgggaaagggggatgaaaggaagaattctacttttgaaattgctttaaaacaygttgataaaatatgtgctttgtctttttcttgcagtttgggggtttggggagatgtgttggttctcttgctaaccagataatcatttgcaagtcctgttatacaaatatctgagaagtttccaaaaatgtggtatcagggcacttcaaatttgcttttggaaaagagaagagtttgcagcttttctcattttgtgtctctgtaaaacgtttaagcaaatgagcagtacaagctagcctcttcttccagtccatcctgcctctgtggccaaggataagcaggagtgagcctggggcatcctcctccctggggaagaacgattgcacctgtttggggctaagagtgctttgctgatcccgtgattgggtttcgtaagacctgcatggatgttacctggatgggttgtggccgaagggcttgtccctygaagccttgcatgcaggtccttgctaatatttccctgaccatccagtccagtggcagctgctttccttccatatgtggctcatttccctttcccatgttgctttcagggtaacccaggacaagacagccaggagagaggacccaaaggagaaaccggtgacctcggccccatggtaaggtgctgcacattcctagactctccctgtactgagggcaagagaaaggacacacttctcggctcatcagcagccacagaggccaaagaygtggcctttaacactgcaacgtagcctaagattagcagcagagtccccgtgaaggaagtctccgtggggaaccagagtgacccttgccaagtggggcttctcagcagaatctgtgcctsttagatatttacggaaggtgcttgttaagccaaaggcttgtagaggtgggagtgtactgaagtccggtgcatcctgcaaagtgtgcaactgtcctgcagacrggctcttcctctgtgaatcgaccccttkccctgcaatgtcttgtgcagcatttcagagctagacattcttctctgcagatgagaatctcatgctaattttccccacaccagggtgtcccagggagagatggagtacctggaggacctggagaaactgggaagaatgtgagtgccattagggctttggggggctctgtgacaattcttagtgccataagatctgcccaacatgacctggtgcatggttagtccacagctctgcagtgagtgaatgtaaaaggatttctgaaacggttgttactccaatctattttcattcttataatttccctggtgcttcatctcttctctctccccaattcttgctctccccaaaaacatactgaacagatacttttaaaaataatatctttgctactttcaaatatcgggccaggtttgatccaactaaatatttaagaaacccaaatggaaatcctaatactgggggagggagggaataaggggcaagagggctgagggagttgtggatttgttgtttttgtaattatctgtgggtttttggggggatgmtgtaagtgaaataaaaaaactagatttcttctttttctggcatattgcatcttgcaatttcaagacatttcagaaatgtctgtagcagaatagctccttgtatgcctaatcctcagtcttgttgaataaatgctaaagtcaaagtgatgtgaatgatctttctgaagccaaccaaaagcttccaaggtcctcgggcacagacagcatctgccttgtagctgggagaagaccagtggtgtagaagtttgtaacctctcagaggaaattcaggatgctggtgggtgcctaggggaggtctctgctcrgaaatgaacagagcacaaaggctgcaagctggggctgggtgctgggaactgggccctcagccacgccctgaggggcagtggctcgttcggcccggcacttgggccagtagagttcgctggggtgaggggctttcaaaaggagcgactcaccaaaatcaaattgatggactatgggcatcattttgctttgaaaattcagaagaaaatagaaatttkgaaaatatcattttaaaatgtttgagcactatttatttatttatttttaataaattgtaaagacctggatcaactgcttggaagtgagcattatttttgaataatgctatataatgaaaaagaagctatataatgaaaaagaagaaatactcatcaaatgttacaatgggctattacaactcagcgtgtgagcagagccaaaacttggtttcatgaaatgacttaaaattgagtagttcatacaattaatttcaattctacacacaaggtagaaactggatttgaattcggtttcagtcacgggctcttgaggactcagttcttccttttgtggtctaatggcctgctatcccttcccttaggaccacagtgccaggctcaggccaagctgaaatgtgtccctcccactgggcttcagcatgcctacatcccctttctagagtctccgcaggcggcctctggcctgagcaatgtatcactgagtgctgctggactctcatggaactctagcatgtctcttttgggaggggccaggccagattgttggtttgtagaggagaacagtgtccccttgtctcaaattttccatggaaggtggccaagatcttccgctgaagcaggtggcattacagcgaataatggcaaactggtcaccgcagatcactgggctggtccattggaagtggagagtgaggttcctaggttgatgtagcagatgactgagccccacaacagagctagtcggtcacagcctctgcaacaccaaccctaactttgcaaagaccgcctgggacattcataaagtcccaccccaaacctttctactgctgaggaaacaattttgaggtggaaattaatggattacttgtgaagtaagcccacatgtttgaactaaaggtcacctctggagcatccaggaagatgttgccaagtcgtgagccctacctaagtacacgagacgtttaggtgcacatgtgtgtgcttcagrtattttacttaaccgagtgtgtgttgtgtttggccgggatcacttggagaacctgggactcccttccattataattaatrtatttcatgacttctcagtacagttgggaaggtggaagaaaaatagacaggttgacattcccttttcacattcctcatttgaaactggctgggatcgtgcagccaaaaggagtcattattttgcttggcaggtctgcagtaattctcaaaacttccattgggtgattaacaggagcagcaaggaagcaaaacttcacccggatgagggtggaggaagggtgtctgtgtgtgcgagtttccccagggctgatgaggtgtggtttctggttcttggcacgatgtgggtgcttgggaagattcccctgagtaaccgcagaataagagggtgaagtctgaaagagctctaggccccatgcccagcgtcccatgctccccctcacagtttgtgggactttttcttccacagggtggctttggccgaaggggaccccccggagctaaggtgagcctcatgcagtgccccctggagactctcttcaaacagcccagatgccgcccagcccaggagtgaaaaacactctctcctgtgaacccaaagcttcggagacagataccaatcaatttagaaagttgatttcgccaaggttaaagacatgcccgtgacacagcctcagaaggccctgatgacacctgcccaaggtgttcggggcacagcttggttttacacattttagggagacatgagacatcaatcaatatgtgtgagatgtacattggttcggtccagaaaggtgggacaactcgaggcaggggaggaggcttccaggtcataggtagataagagacaaaaggttgcattcttttgagtctctgattagcctttcactgaatacacagtttaccagaacagtcacctatgccttagttaggcttagtgaaaaacagggcgaaggaagcaattggatatgcctttgtctcccatgagcagagggatgactttcagttctgtctgtcctttgtccacaaggaatttccctgtgggcagaatgtgagggaggtatkcagcttaaaaaaaaaaaaatctggccaggacggtggctgatgcctgtaatcccagcactctgggaggctgagacaggcggatcacctgaggttgggagttcgagactagcctgaccaatatggagaaaccccgtctctactaaaaatacaaaatagccaggcgtggtggtgcatgcttgtaagcttgtaatcccagctactcaggagcctgaggcaagagaatcacttgaacccgggaggcagaggttgcagtgagccaagatcatgccattgcactccagcctgggcaactagagtgaaactccatctcaaaaaaaaaaaaaaaaattctttgtagctatcttatttragaatagaatgggaggcagctctgtctgatgcagttcccagcttgacttttccctttggcttagcgattttggggttctgagatttatttttctttcatcctccttgggctgttctggctcccgaggctctgtcagccgtctccttaaacagcctcttctgcagagtctagagaaaatggtgcccagyggggacttggggtccaagtgcaggaaacatgactgaggcagtagtgtcccgggcgggcgcctcttccagaacgtgctcacctatctggccatcagcaacccgcaacttcccggtgtctcggtcctctgctttaggtctaaatgatccctgtttcacaaagctgtccgaggagaggtgaggcaagagtgagraacaattgtagaagtgcagggagacagctggctcctgtgctcagtgtctcacctggggttaccgctttgatcatctgttacctctggaagagctgagttttccctggttgctttccaagtccctggcccagaaatgactgtagagcaaagagctgacattgacaggaaccatcctgactcctccctgcatcttctcttatttcaaagggcaacaagggcggtcctggccagcygggctttgagggagagcaggggaccagaggtgcacaggtgagtgcttccgtgtgtgactgtgtgccctctgatatytcacaaatcatttaaaaaatgattgggtggcatttatatccggaaagttaaccattttaaagtgaacaatccagtggcatttggtacttccacartgctgtgcaatcatcacctctatctaggttcaaaacacagtctcgaaggagacctgtacccattagcagtcactccccatcaccctccaccccgagtccctggmarccactaatctctctctctttatggatttgcccactatggatattttgtataaatggaatcatttactaggcagctttgtgtgtgtggcttgacggagcatcatgttcttgagcttcatccacattgcagcatgtagaagcacttcattcctttacatgrtggaaggatactctgttgtgtggctacagcacactttgtttatccactcattggttgatggagatttaggttgttgccatcttctggcaattgtgaatgatgcttctgtgaagattctcctacacgtttttgtctgaatgcttgttgcttgtatacattttaagctcacttgcctattcacgatctggattgaggcagctgctactgcagctaagacaggataattgtgggttttggtggccrtttttggccagcagaagtgaggttccaggccctgtgggatgggcagatgccatgcagaggcttctcatggaaagtcacctcattagcactcacgatggtcttttccttcctcagggcccagctggtcctgctggtcctccagggctgataggagaacaaggcatttctggacctcgggtaagcctgtcctaataccagccccctctctagctgaacagagggcacattkycaagcaggctgagagagtttctcggatgatgctattgtagacagacctccctttagctctcctctttggcaacaaaaaccccagatttaacctcaggccttgcagtgactggctacttcaccccaagaaagtaagagtttccttttttggtgctccatgggcctctaagtctcaattctgctccttccaagtgtccctgggtggaaatcaggggatatgcctcaggatggaatcctggaaaatctaaatctaccaaaatgcttagattctgcaaggtgtttcmcctttggtccctggagatagccccttgtgctyatgtattttgtatagtgagtgcctcaagttcacccatgagttcagcacagaagatggcccttaaacttgctgtgactgcagatgttatcttgcaawgcagctatcagcaatgatgagcagagacacactgtcattgctgggctaggatcaggtgtcacggaattacrtattcgggtttccctcatgkctgagatgatattgagggaggcatcctatcatttattaccaaaaaatgactaataaactggtaacgagctcaatatgttgctacataaatgtacaaaaatattttatggtggaagcaggcaagaacttgcttagaaagtccttctctagcttgaaagctgayaaatacatatctttagacgtttttaaaaaacatttacttaacttgtaattaatcaacaatttaagatggtatagatgcaaagctattcaaatagttatccagtagctccagaaacatttattaatttgcactttttcaccatctcttttatgttatttgtgggttgsgtagactgtaccacattttaagagttaatttcatccatcagtttattcattcacctaacaggctttaacatgcccatatgtaccaggtgctcactgtgagggtgtgaaaagggaggcagaataaagtcacataaaatctgggagcttgccgtcctgtcaggaacctaggatatgtacattaataactgcaacatgcattaatttgtgaaaactggcactgagaggtaatactcatgttttaaatttgtgcatgccatttctgtgcatgtttatatttgagtccgtagccccgtgctcagagctgagtgcttgggatttgcaggtgggacaggttccatgcccctggcgggctctgacttccatgcaggggagagtcaggtttcagagaccaatttgcctggacggttggccacttcactgacacattcctcccctcctgctccagggaagcggaggtgccgctggtgctcctggagaacgaggcagaaccggtccactgggaagaaaggtttgtctttagaaaggtagagctttcctgaggacagggaccagccaggcacacatgcccctctccctctttggtcagtctgtctgtccctcctcttyagtactactggttcccactccagcctcccctgttgatcgcggcttggccagtggaatcattgtcccccaacaatccccaccataattcccaccaccatccctgccaccaaccatctctgctcagagggctggctttctcctggccacagccctccatcagctgccaggttttctgctcctctcttgcttggcttgtgccaatagtgcagcaccctctgagccatcagagcagccgggcagtgcttggtacagtttcagtataatatggaacgagcagtctttaaacaygggcagtgcacgcacagtggctcagctaatcacatttagatcatccaagagccccgaccctgactgtcctggataacagcaagtctgctgtatgaaggctgcctgagaacctcctttctatcagctttgagataaattacaatttgtcataaccagtccgaaaagactgcatgttctctgtaaaagaaatgagttcctgtgaatccacgatggtctctgcctggagagtgttttggggttttatgctgggctcaatgcccaccgccttccrtgccttcttctcccagttgttactctctcttctcatcagcccgtcccccatgccacgctggtgaaaaggacaaacaaaaccctcctggattcttttccaggagtttgcacatgaatgttgcaatttagaaaatcattccaccgaaatctcaaagrtgaagtcagcatgttgcagcacccttacctagagcaaaagcatggcttggcatcacactgtaagccagccccaggccacagggtctcagccatgtttctcatgtctagggtgagcccggagagccaggaccaaaaggaggaatcggsaaccggggccctcgtggggagacggtaaggtcacagcgcgcttggggtcaggctgtcgctgactctttgctggaaggtgcaggaagccaggagagggttccaaataaagatgagccttgcttcttgtattattggggatacggctggaaatactgaaacttgctcatctgcggcaaattaatttaacaagttttattttattggcaggggtagagaggtggggcgggccgtggggagagacattttttcccctgtgtttttcctgatacaagagaatgtagaggctaatgaagcttaaactaccttcatcttaggtcccgcaaatgctttgcaagcataactagatgaagcttttctgcaaagaagtaaatgtcatttgggttaaaatggaattggatttgattaggtctcagtccagatggaaacaatttcttttgaatgagacatcttaggaatagaaattattacctcagtaactcgttttttaaatgctatttaaaaatgccccaaaaactcaccaacaataattttgtratgtacatttctacgttacaaaagaataaagaaatctacggtccattgtgactttttccaaaaggagtcatggcacctaacactgtataaaaggaccaggttgatctgactgttttaattccaagcatcaaaatatttttctgtctttcatttttgtcttttcaactaactgaagtttaaaaacgaatctgtttgtattacttttaatctcagaagcacagggaaaaaatcagacttcaaaccattgaaggaaatctcttcctgattctgtttctagtaatttgggtcaacagatctctagttgttgatatctgttgaaaactgtaaattaactaagtggcaattcctacatatgttagagatagtaatgtacaattcacacamgttcttctgattcttctgattcataattaatgacgtccagttctgaatgctcctcatgagagagcaacaggaacagatctgagcatgctggggggaggtgttggaaaggagggggtctaggggtgatgacttggaaggaagggaagggatatggggagggggaatatgacctgggcctgagagatggagttcagtgttttggttttgaagtagaatcaaagacttacggatgcatagaatcaaagtaaccatcaagattcctgtcaattctaagattcttggggttgacgagtctttgattctacatccaaacagaatctttaccaaaagcaaccagcagttctttctatgttagtccgccrgtgccattttgctacgggagtcctttgagcccaccgcctacagaaatggtcttgttcacacttggaagataggacaggagcaggaagtgtgcctactcctgtaccttagtctgcaaacatttcaggagctcaaggatccacttctcaggggcagcggcagggcagagacggtggttatggygtgccaggcatggcgacctacagtcacatctctttcccactcttagggagatgacgggagagacggagttggcagtgaaggacgcagaggcaaaaaagtacgtatctgctgaggattatccaagygtccttgctgccagsaggctccaaggacaacttctgatgtgttgtgttttaaaagaattatttctttaaaaattgtctttgtatttgagtgagtgttttcktttgatgactcagcagacatttctttctttcaaggtcaatttattttasatgaatttaaattagaaccaagtattaaataatctatttttcctttatagggagaaagaggattycctggatacccaggaccaaaggtaaataatccctggtcggtgaagcatcatcatgattttgggatggctctggtatgtccatggactgagaatcagaatatcttggcattagtcttgggtcagccactcagttaactgggctaccctgagaaagacccttccttccytaaaatactctctcatctgtyaagtggaggtcataatacgtacttgtcctggtgtttatgagatttaaataaaatatgctgcaatcaaagtactctgtaagctgtgaaatgctataacctacatgatagtatcattactgattaattaaattaagaccatctgcaaataccacaaatatagtagtaacccactggaaaagtgaatcaaaactaaccacttggctgcccgggaaaagtgtgacccacacgtctcctggatgtcttaccccacggrccckcagtgagatcttctgttccaaagcttactgtgccacttctcggctttcttcccagggtaacccaggtgarcctgggctaaatggaacaacaggacccaaaggcatcagaggcygaagggtaagtttgcgtgggccttggctgcaggtgaggaatgagaacgtatgtctcaatgtgattaactgctgaggctttgacaattatccttcacttgcaccctggccagggatagcacagggtggaaggaagggaatcctgagccccagaccaatgtcctcagggtgccaccatggctgtggtccatggctctcctcctgtaggtgtattcctcttcctccaactcacctccagggtcgccagcccagctcactccaggcacagcacccacctgcagtctcraatctcattatgggtgactgggaagtctgtgcagtcactttgggccatgcccacccagacggccaggcaatgggagtgaatgaggcatggcaactgcttctgaagcctctaggcttgcaagcgagccaggccaaggccatgggctcctcagactactggtgctgagattcctcttccttaagctacttttagccctgatagctcttttctttttattctttgtgtgtgtgtgtgtgtgacaaggtctcactctgttgccaaggtctcagtctgtcatctgggcggagtgcagtggtgccatcttggctcactgcaacctccatctcctgggatcaagcgatcctcccacctcagcctcccaaagtgctgggattacatgcatgagacaccacacctggccagattattcttcaatggatgtttactcaccctcttaaaatggcagagtcttcaattagcaaattgtggcctagatctgtgtaaatgttgctaacagttattttcagcctgaaatgtagtttaaaaagaaacataattatcttattaatttgatcagtgaagacagtcaaactagatcatttaatatcccaaagagctttaaaacattggatgattatctacactgaacgcattagctaattcactgtctgttacctattctcctgggagtccttagtaatcatattagtggttcttgggaaagcacctgtcttaccttagcctggcagagaacacaatatacaacacctctatagttggtgggggactcccattggctttgttgaggttgcttgtccctaaacttgaatttaagagacattttagctcccttaaagtgagagatttttcgtggtgatggagtcccttgggttagatcacttttacygtaccttccaactataggagccttaaattctccactttctgacacagttgaacaatgtttgttctgctccctctagggaaattcgggacctccagggatagttggacagaagggagaccctggctacccaggmccagctgtaagtatttatccagttctgacccrgccacctggggctgggtgctttacacgtggtccctgaaaacttcccaccatctgctttgctcacaagaaaatgtgctctctttgtatttgcttggttgtcaaaccgcctctctgacatcatgatgcagcaaagagattttgaattttagagtaacaagaaactttaaaaaaataggtttcatgggatatcctgtcatctagggagtattgtaatttgcctttatagtttcctggcataggtgcatttgaggtttgtgtagaggagaaaccaaagaggggaaatctaaataccttttgcttgcatcttgtagaagcagtgtaattatgccaggccttggtttgacaatgcttcctgtggtctatgaaatccccaagggagctcctgatttgtggttaaatcccactagtcatgctgccaccaggagccaggagggcatcctcccacagcccttccaaacctctttattgctaatacctttgttttcttatttgaatttctccatatattgtccctcaatattgaaattggtgagtttcaaaaaataatggaaaagataattcaggagttggaaaatcattcctagaaggaaaggttcagggcttagtttggttgaattagggaaaagaaagctggtcaggtgggtctgattgctgtctttaagtaggtgaagtgttggggggagcacattaagccagttcctgcagaagaccaagcaggcagaaatagcctcctggaaagacaactaatggcccatgagatgcctgctgggctgtcagggtggtgaggtttaggcatgggacactgagggaagccacgagtcagtccctagagctcctcggggtggaattcagctgggatgctttagacacggagggagccagggcagctcaatgatctctcactgccccttcggcaggggacagcgtatcaagcgtgtgaaagggagctcttttctcaagagaagcagaatctagacccaggttcactcgtgggctttacatggattggtggtgagcttcctggtttcagaacatgagactatttcaaaggccaaatgacctcccagggaaacacatttgctccagaatcttctcttttttgctttgcaagggataagatcaggtttagagggagaggctgtaaacaatcaaggttatccaggggcccctttgtcttgctctgtgtattyctgggggccaaagcctgtttattcgaattccccatctgctgtgcctctcacctttcgttccttggttttacagggtcccaagggcaacaggggcgactccatcgatgtaagttgcatgtgtccagaatgactcattaacctcatgagcctttgatttgctctctttacatattcttttattttcttttaaagcaatgtgccctcatccaaagcatcaaagataaatgccgtaagtacatgattttctgttgtctcacaatgcatatttttacattcgaaattctcacatggtagagtagtctctcaccctttcttctctttgcttcttttctagcttgctgttacggtaagttgattttggtgactttctcctaaggaaaggaagcctcccttttgtagtaagtacartttrtctttaaccctccaccctctactttccacagggcccctggagtgccccgtcttcccaacagaactagcctttgctttagacacctctgagggagtcaaccaagacactttcggccggatgcgagatgtggtcttgagtattgtgaatgacctgaccattgctgagagcaactgcccacggggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgagraayggattcctaatgaggaaagtggctgttttcttcagcaacacacccacaagagcatccccacagctcagagaggctgtgctcaarctctcagatgcggggatcacccccttgttccttacaaggcaggaagaccggcagctcatcaacgctttgcaggtctgtgctctgtgcgtgctsttggcatctccctttcttctggggctctgagaaggttctcagacacgtccatgctcctttgtggcttcatgtcvcatagctcctaaaaygtccccaatgaggccatctgcctgagaacttctcttgtgaggtctccaggacaacctcgtggctccagcactacagggacgcctacatgcttgtagcactgcccccaggtccctcctcacatgttgacagctcttgccggttagtgatgctagtgttggtgacactctctatctactaacaaggtggtgtgacttgtttgctttattcatgaggacctggacgtttgcatccttcctgtctcctcccaagatggccccctgtgcacactctgagctgtgtcttactgtgtactgggcatttgcttcccataactggctggtgaggtttgtatcatcagtctcacctcatggataggaagatcctgctgttagtgaggtgctcgtgagaggctaggaccctagtccattagactctgaaacccatgtgctgatgatacccattccagtctccactctgtcccaatcggccctgaaggtgaatatccagggtggccctggaggcctgtagtctctcagtgaggtccccaaaactatgccgactcagcacccccaatytacaccacaccactgtgcaaagctttyttcagtgaggccccaagggtcagcccatggagaggccaagtgtcgcttgtaattctattaaataactggtttaawtgtggggttttttttttttttttttttttttgagacagagtcttgctctgtcacccaggctggagtgcaatggcgtgatctcggctcactgcaacctccaccttccagttttaagtgattctcctgcttcagcctcctgagtagctgggattacaggcactygccaccatgcctggctaatttttgtatttttctttcttttttttttttttagtagagacgggggtttcaccatattggtcagactggtctcgaactcctgaccacgtgatctgcctgcctcggcctcccaaagtgctggggttacaggcgtaagccaccgcacccagacaactagtttaattcttacatcaattaatatttattcagtgcagttctggcgatactgttcaagacagatgggtgatgggtaggaaggagtccacccgggagtcaggaggccttggcctggttccacactccccccacccatttaaagtaatgtgcacgccacttagcgtccctgcgtctcagatttttcacctgtaaattgagactggggcaggatgattgctaatgtcttyccttccacattggatattctatgcttttaccacagcctgtgtcggcgaaagacattgggtcatcactgccattcctcagggcttgttctgccgaacacaggatgatttgtgcatagagcgctgggcttgggaattcagtgttgaagttgggctaccggccatgtgctcttgatggggggattcattcacataagtctgtccttgtgtgggctgagggacccagaaccacgtgagtttcttagcatggtttcaacgagatcaaaaaattgttcattcattaattatttgctcattcattcattcaaactagctatttgttaaatgaataattactaatcgtgtgccaggtacggcgatagacaggactctttgcmcccactgggagtgattttgttacttgctttaaccacacctgagagggtggggaagggatggagctcccatattgttgctaaaaataacgataagattaagttcctactatttgccagaggatacaccagttactaacatttattatctaatttaaccctccaaatgacaccattaggaaggtattaccccccattttacagctgaaaaaaactgaaacccatttgaacgggatatgaactccagctcaccctagtagaataaaacctatgtctttctattatactcagagcctaaccccacccccaaatgagaagatattcccaatactgccctattgggaagttaatctattttattgatgtagctttgatttactcctctgccatattttcagatattactgatcatgtaygcccctaccaaaattgttcttttgtttaaaccagatcaataacacagcagtggggcatgcgcttgtcctgcctgcagggagagacctcacagacttcctggagaatgtcctcacgtgtcatgtttgcttgggtaagctgtttctctaacaggaagatctgctcagctgcaattgcaaaacataatatccatgggagagtgagagaataatgatgatctgtaaaaagagcttgagttyaattgattcacaaagcctcgtatttaccagagtaaatactactgcagcagtttctatattaaaaatggacctcccaaaacagagcttctctttgatggcggataattcattttataggtaacaaaggaggaggcagtttctgcttaagttttgacattagaatctagaatgaaaacattggcactagtgactttctagaacatatttcttcaaagagtggcagagaagtaatataatttttcatttcttttaaaaatgccagcacatggtatgctacaaagattttaggttagtgatttgtttcatctactaagtattaggtgatagaaactgaaatctggccataatcaaatcaaggcaagatataaattggttttggttgtgatgttttttttttttttttttttttttttttagacagagtcttgctcttgttgcccaggctggagtgcagtggcacaatcttggctcactgcaacctctgcttcctgggttcaagcgattctcctgcctcagcctccagagtagcctagattacaggcatgcgccatcaggcccagctaatttttgtatttttagtagagacagggtttcaccatgttggccaggatgatctcgatctcttgacctcgtgatccacctgcctcggcctcccaaagtgctgggattacaggcgtgagccaccgcttccggcccgcttttgatcttatgtgatcattttaatcgcccaagtctcccagcagattgatgagctgtgtatcctgctgtgggtgtcacagaacaaataggctgccatgcttctttctagacatctgcaacatcgacccatcctgtggatttggcagttggaggccttccttcagggacaggagagcggcagggagygatgtggacatcgacatggctttcatcttagacagcgctgagaccaccaccctgttccagttcaatgagatgaagaagtacatagcrtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttrggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggargtatacaccttcgccagtgagccaaacgacgtcttcttcaaattagtggacaagtccaccgagctcamcgaggagcctttgatgcgcttcgggaggctgttgccrtccttcgtcagcagtaagtcctgcgtggcacagcatgtgccctggcctggctttatgctcgggccaggagaagtgtaggaacagtcatggaaaagacaaccgatgtgttgacaggaactgtttcattcattgaacagacatatattgacacctgccatatgccacaaatgcttttaggagccagagtaagcagggaacatgcagacagtatccttgttctcattgattcctttattccaccacatttgaccaagcgccacctagtcataaggcactcttggtgtccttaacagtttacaaatgggtgggcaaatggatcaaatgcacatttattacgcatgacataataggctggcatgtcgcgagagaagtgatttctgttaggggcaccggggaaagcttctagaaagagttgctttgatcggggcttagccaccagccccgtgcttggataccactgggtctttgctcatggggctccccctccctggaatgctctccaccgcacttcagcagcaaacccatattcatcttcaaagttcaattccaatggcttctgctcgccgtggaagctgctgctcccaaggcctgctcatggttaatccggacaccctatttagggcatctattacctggcctgttgatcatttatttgtgggtctgtggtcccctagactgctctttgaggaggtgcagcctattatagtttccagagcctgtgtacagtgtgcagcccagggtcagtacaggcaaggcttggaacagatgagggggatttataaagtataaataaacatgtatatgctaaatgtttattatttaaggcaatgttgaggtctatgaaaacagtattcacatttgtgaaggtctggcccccaaaagattcaaagaaaaatgtgaagcaaaggtaatcccccaggttcacccacaggtcactgttcctgtcttccaaagattaaaaacaaaagctttgttcaacaaagcattgagaaaatctgaaaagcagttgcattataatctgatgtccaagagtctagaacttgttgaactctccacttgatttttcttctatccctgtcttctctctcatgttggataaatatatctttaacttaatcacccaaatattgccaaatagaacatattggcttaccatgttttatggatccaatgccatcatactttatgtttaaaatcactggacatagtttgtctgatatagttaattcaacaataattatgggctaaataaatgttatgtgattcatttaacttgttgacagattaattttaattttcatgttattagcatgcggttcaattgttttctttgttttttttctttaggtgaaaatgctttttacttgtccccasatatcaggaaacagtgtgattggttccaaggggaccaacccacaaagaaccttgtgaagtttggtcacaaacaagtgtaagtgattataattattgtcttaaaaattgtagcgctgcagggaatgcacaggtcctccaaccacctcctgactttatgggatgaggaccttgaaatccagaaaatgtgacttcccaaaggtaatgtgggtcatgcttctcaaataatctgttttatcagttagcttttgccatgtaacaagctacccaaaacttagtggcttaaaacaacaaccacctatttattttcttacttaatttatttagagacagagtcttgctgtgttgcccaggctggactgcagttgtgcaatcttggctcactgtaacctctgcctcctggattcaagcaattctcatgcttcagcctcccgagtagctgggactacaggtgcatgcagccatgcctggctaatttttgtatttttttttcagtagagatggggtttcgccatgttgtccagccttgtctagaactcctgaactcaaatgatctgcctgcctcagcctcccaaagtgctgggattataagcatgagccactgggcctggccaacaaccacttatttaatttgcaattctgtgggttagcaatttttgtttgggctcaactgggtggttcttctgttttctcyttggatcccttatgtttgtggtcagctgcttgtcagctatagagctgctggtctagagtggtctcagatgggctggctcatctctgctccatgtggtctctcattctcagcaggctagcttgggtttgttcaccaggtgacctggcagggttccctgagagaagacaagtgtgcaaggcctcttgtgacctaggttagaactggcacactgttacttctgccacgttctattgaccaaagcatgtccaaaggctaacctagatttaagaatggaaaactaggcttgatggaaggacttgccacattacattgaaagggcatgggcagagagaaggtagataattgagaccatagttccaaacaatttaccgtatctggtgtgaaatgattacgtaaaagaaggattggatacatcaaaaaatagactccatgtcttcttaaaattattaatgctgtgataacatgtaatgatggtaataataggaagtcatgtgcatgttctatgaagactgacgggaggggtgggagtgggcaggactgtggcacccatgccgatgctgctgcctggcccatgtgccrtgtttcatgccctgctccatctcgggtgccaaccctaggagcaaagagggcagtgggggcatgtaacagagggctagctggggtgatgtggctgcaagaactgagcccctgcagcgtgtcagcaatgtgtgctccttaagagaatgtcacagtgtgtcatgctttggagggaagtgcagattctgcagattctgaacttcgtacacagatgagatgtgaacgcaaatgatccttgaaaaatgactatctggcytacgactagctgactctcaagatggggaaagagagcccatctcttcctactgcagacccttctgtctatcaccacttaagtccttcagctctttcttttgacctcagaaggagtggctttaaatctcagcatagcaagaatgaatatcattgctaaggccactaggacccttatcgtggcactggatgcttcatttagctttgtagcctccatttttctaggctctaatgattcgtattttttctctgaaaccttccctgaaattggctcaacctttttatctttaggaaaacagaatgaatgaagtaacctagtatttgaagtcttatgatattaacttgaaaatatattaatacttcctaggacaagtagcaagatatgactataaaataatatattttcttctaagatcaagaaagctatgaagtgtgggtccttgttgttatgtctgtttgattaggctgctattctctctagatattggtaatagatcaagaaattgtaaaaaaaaatacacatacacaaaaattaagagaaataaaaaatatatatactcccagtaataagccctgggagcaaaatagtacatgctaactttataattttccagctcaacatagcatttgattgagtggatattttcttataatgtaagtagctaactactgatttcatttaatttttggtgtatgttttggttggttaattgctataatgagaacattgttggatattattcattattgtctcttattttctctctgcctttattttagaaattgaaagatgtttttgtagaacaatataagcttcatttttaatggttctatttttcaatatgctgttccatatctttttttagggaggcacagatccttaaaagaaggaatttaatatatgcactgctatacataatctataaaaactattgcatgcattttgctaaaacaaatttaatgtagctcatggggttatgtctttatttattttagatagcaggtaaaagtagaggtaatatttaatttgtcttaacagaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagayggccactgttagacccccagtggyggtgaagccagcaacrgyagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccrtgggtaagaaagcccttgctagggctgccatcttgtgacatcctcatttcctgctccagggtgtgttcctyaaagcctgcatgtaacacactcagaatacagtccttgatctgggcttgtacacctggatgatgtattttaagaggtgttggttagggattccagcctcccactccccatcctgtgccctcaatcctgtcttgcgrtagggatgggaagctstcattctctctggaatgtcagtgggggcacagytcacctcacctgaaaattgagttgtcttaaactaaagggaaaagtttccgtgttgaaataaggttttagctcctatttagggagtgagagagacagaaagaaaaacgctgcagttggttcttaggcagcaaggcagatgtttctgggctggtgtatggagccggactcgcctaccttagaacatgccttgaaaaggtctgggggagccctttgcaactgcaaactttgtctctgcctcatacccacagaaaaggggccctaagctgtgtgctgtggcaatactgggtgttcagtccagcagcttgaaaagtcagagcctggaccatcagtcattccccaagsctcaaatctatgctcatgctgaccatgagaaaaatattgaaagcaatggcaaaaaccacaatgactctgcaccaacttaatatatttcagactgaattagatacaaaaggtagatggctttaatgagaccaagagtatgttattttatcattttcctaaagaagatactggaagacactaccgaatgtcacaagctgtaaaggaaggctcatgataaaatggaaattatcttcatttgatgaacagtatgagagagaaagcagaattcctttaaaagaatttcatgtcataccctaaaattttatgacttaatatattttaaattatggggctcattttgtagcaaacacaacttaggattagtatgctgcatttccaaagtatcttcttaacaggcgagatttttaatagaaaaaaaagttgatgaataatgagatttttcattactgtgaatttcacatttcatgtatgctgatagattataagagcaatgttttttaggggcttgaacaagaaattagttccccrcctcagctaaatttcaagtcaatttgtctgttaacacatccctttcagatttcctctctcgctcatgcactacagtcatggaggattttattttttatcttcacgctctgatctatctttcagttaagatgtcccgtgaagtccaggtgtttgagataacagagaacagcgccaractccactgggagaggsctgagccccccggtccttatttttatgacctcaccgtcacctcagcccatgatcagtccctggttctgaagcagaacctcacggtcacrgaccgygtcattggaggcctgctcgctgggcagacataccatgtggctgtggtctgctacctgaggtctcaggtcagagccayctaccayggaagtttcagtacaagtaagtacatgatcagtacaagtcggtacctgatttctatgtagagtatcaaayaggacacaaaggagacacttacttattgaatctattctgaaataaccacaaattcraaaaacaacaacagcarcaacaacaaaacaactcagcctgggtgctttggtggcagcctaagcttataaaacacagaatggaaatgggattccatgtgggatgcagtcctgccctctgggtcctgggctactttttggaggaagccagatccacgtcgcctgagcacagccctttccaacattgcacccgggaaagatggccacgtctcccggtgagggctcctggttgcccaccaccccgtccaggtttccatgttcaggaaaacaccagccagtcactggctccttagggagtaatggaggtgtccctgaagtctcaccgccccgggggtggaggatgtcgatagctgagtctccctgccctgatctcaccatagttgggctctgcccttggctggctgttgtccccaggggcccccccatttcactgaggcctgcacttgagtgctgtcacagcttttcttaattattcatggtcccctctctcatctttctaaattcttctgggttcccccctcccattcttcttgacccccactgctccaggaatgtgaagggaaggctcctcttttcttcaggccaatgctattcagatcaaggaaccagcttgaggaaagggaattcccaccagtgccatggattaggcccatagagatatgagtccaaagacccagtcaaccctagggctctattttcctggacagcagcagaagaggctgtctgggaagtgagaggatttgttcagaagttcagggatcccctcccgtcgcttattagctcatggatccaacttgyagcccacagcataagtcgtggatgtagaggtgtcttggatctgtgtctttcaatcaccactccccaacataagacattaatcacagcaggcaaccttatatcagtcactaaggattcccaagccctcctgtttctgatttacctacgagttgcatatatttttcttttatagagaaatctcagcccccacctccacagccagcaaggtcagcttctagttcaaccatcaatctaatggtgagcacagaaccattggctctcactgaaacaggtgagttgtgaaactattaggtccattaatggcactaagaaaatacccatcttgattccaatttaacttcctgggttctaagtcttagcccaggcatgacttctatgggggaaaaggtccacgtcagctctgtgcagcccaacatcatcttattctgcataatcccaggtgtaaatggagtcttactttacctgtgatcagactcagtgaaaatttgatgggaggtgcttttggggctatcactagaattcacgtatccattagacatttctcctgtgcctcatactgggactcgagttgatttgtggtctgtgatgctgtgaagattggcgtttcatttactcagtgatttaatctaataaaaaaactgcttagaagaacacaagacaaatttggctggaatccatgaaatgcatgggtttggatctgacccatggggtgttctggtccggacatcctaagcacacaccccagcttagtgtgtgagtctgtgatactgtctctcatgtgcttgaaccccagagtgtgtgcatagtctatgctaagttagtgactggttaggtgtaattcaggaactgacagctgttacttgcttttgttcttgggcagtgaaactctgagagacctggaatctctcattcagcagaatgtggacttggcttgttcatcggtgagaaactgattattaaaatagttgataggctttgcttaagagtgttcagcaaagaatgatggtactaacataaaaaatggaaatgccatgggaatttagatataatactgttttatacacctgaagcaaaagctttctgctaactaggggacaattcattattttttggtgtatcgtctactgtcaggaggaggaaagcatttctcttcacaatgctcatttctgtaattgattttaaaggtgtttgttgagtgagcctgttaggcgaccccaccatggtgcttgagctcaaagagaagccacaaagaacacagtagattttccccaaaggtgtgggtcaggacagattcaactctaacttcaaagttgctgaaatctgtgtatgtcatttctcactcattggttaacttctccctgaatacagtgtgggaaatagaaaaattttagccaatttagtgcttcattgagagaaaaagacttggagtaaactagagatcagagatcaataatgagtaaactagacagcaagatttggggatgtttttgattctcttatgtgtggtccaaaagggacaagattgtataaacagtgcctagttcatataaacaacaatgtctttcagcaagggtctggctgggctgttttgtttttcttttcacatatatatatatatatatatatatatatatatatatatatatatatatatatatatatgtagagagagagagagagatggggggagagagttgtgaggttcagaattaagaaggtgcttttgatccagacctttaacactgagatcgcctgtctacctgtgataaagagaaaagagcttttgaaattggggcttgtgtttctttcaaggctgcaagtagttgatacagatgaatctaaataaaacctttctccttcatactaattggggcataaccctcagacccaggatgtgaatgtcctctcaccatttcatgtgtgtgtgtctgtgtatgtatgtgtgtacacatgcatatgtgtgttttccttcccagggtgaagacataaattaccttttttttttaaaaaaaaagaacaaggccctgcataattgatctctgatctcttaaacttaatgacttcatagtaacaaacaagcacttaacctgccttggcctgatgaatatatgttggtgtacacacagttatggcatttttgagagctctttttgaattactaggttggtgcgaaagcaattgcagttttgccactgacagtaatggcaacaactggaattactttcgcaccgacctaataaatgggacatttacttaaaaatgtctaaaattcaaaatggataaccagaattaggagaggaatccttatcctccccacccctaccaacctctctccctcccctcctcaccttctcctataattgtcattttaactatttcccctggggtggggggaaaattttttaatggtttttatatatttggatataggaaaaggagtgacaatgaaccactctttattaaataactaaaaaaagataataactgcatgcttactcagtagttgcatgtatattttgcatccaaattccaatgaccacgatatgcattatttctccaaatatacattttctagaccattcaggcaaaatgaagttttaaaaatatattttttatatttacatgtgtccattttcattcctcttactttctgcagcatccattaattagaaacatgtttacagagatgggtccctttcttagtattaaatagtagatgctactgtttgcttttttacttctgtgaataaaagatgctgtcttaagaatctgtatttttcatagtttatcatgttagattctgggaacctggtgacctgtgtttgaatctgtgaaggaatttgtaggtagaaacactctgaaatgaaaaggttcctagtcctgggcacctaaggcaggggaagaggagaggaccagtgttaccattggttttcrtttgcatatgttaatgtttgcccattttgacagtcacattgaatagatgcttgtttatcaggaatgtgagtcaggcatgtaatgcgagggcagtctggttggggcattttttgtcctccataagatctggccctgtttggtatgtggcagggagactctcgcctttgagatgaaggttgattctgttaacaggccttgattccattaatatacctagggcatcgttagcaaccactcaggattccagctttacaatattacatgatttgattttcagtggttaatatttgtattttttwaaataaaaccaaatgaacccccacaaaaacatctcactccactttttgctttgctcggcatctaaaagaattatgctccagccacttttctgtcacacatctgctgcctgtaaatggcagtgagcagcagtggatctttcattcgttaccgtggscycctgaaagcatgggtgtgctgggcctttctgccacctgctttgtcgctgctgattttgacagtgctacgtagttgctaattttggtttcaggcttttgttaccacctccctcttctcccttctcatttttagctaaggaagctttggatagatattttctatgcatattactattaaagctaagactgtctagaatttctaaacaacaacaacaacaacaaaaatctaacttaaaatttactttttgcagtattrcaaaatgaatcctaaattattggcttaatcacctgtgttaaagaagtttcaatgcagaaactagacaaaacaactaacaaaatcatcatgtcctttattatttattcttgaaattagcaatctgtagaactgatcacattttgtccgagtagacatgactgggccaattgtatagccctgaaggaaccatcattttgtgtttactaacgttttacttattgattctaagatgcacaattttcttctcatkgggacacttctgaaactgaaatgtgacttagaattgacaatatatcatggtttattggtagcattttgtgttacttagtggaacataaaataatggtgcatcataaaattaagagctcttatattggatacaatacagtatttggttggccatgttccatgtgaatatatatcatcaattagcataaaatggtatatttgggggaaatacctgactttatgttaataataatttaaagaacaaactaatcccacagctgaagtaagttaaatagctacagggatttaggaaatggtcctctccaggctgtctgttgttcatcgctgtgtgaggatgttttctggttagttgtcatgtgtgggttatgatgagcccaaaggagtgttttttatcttgaagtcttaaaaaatagaagtctgttggtcaagatctgaaagagtaaaatttaaccacagctacattttaaaataaagttaaaaattggccgggtgtgatggctcatgcctataatccctgcactttgggaggctgaggcaggaggatcacttgaggtcaggagttcaagaccagcctggccaacatggtgaaaccctgtctctactaaaaatgcaaaaattagccaagcatgatggctcatgcctgtaatccagctactgaggaggctgaggcaggagaatcacttgaacctgggaggcagaggttgcagtgagctgagatcataccacttcattccagcctgggcaacagagtgagactcagtctctaaataagtaaataaattaagtaagttaaaaatttggtaagtttccttggtaccctttgaactgaccaatgctcaaaatgtagacggcggaaagtgttttcattcaggcaaatcatacctgcatccaaggtatggaagtactttatactgtaacaacaatgccgagtgagaaggtgattgaattttcttgttttggggaccattaaactgatgaggaacatgttgatgattgcagcataaacacctctcagtctgtcttccttcagtttgctcaaggaagtacttacatcgtgatttggaaatcaatatgtttgggaaatgtcaaagctgatgcctttaaaaatgcattgaaacactatgggaatatcaaactatgaaaaagacaagattttccaatcaatatgttttccactttgaagaatacatatattttttgctgattataaagttaacagatatgcattgtcaagcattcaggaggtacagagaaatatattacacgattctcattgtgacagcattgctggcttttgatgaaaaccaatagtgacccgatgcatagccttcctatttttttctatgaatattattgcttgtgggaaggtgcatgcatcgcacatgcacatccactcctgcacatcattattacaaaaatggactgtggggcttagggtgccttgcgccccagtgtttttgaatggttgtttttaggatgttctaggtaggcacctgtggcttctgggaacaggtgggattcccagaacagggttttaacctaacattgtgcttgcctccrtttcctctcttctatttggttactttcctgaagcccagtgaccaatagtaaggaagtttcagcagacagtggtctgagtcaggcagcctttcccctctctgttttccaagcaaacttagttacattggtattctaggttaggaagccggggaaggttgtggataattttcagtccccattgtcttttaggctcccactaggttctcaataataaagaagagcaaattaaggaagactcagccatgcgctcctctcacataaagagaaggctctagcttcctacaggttatacctggggggcagactgatttcagagggaaaagatgaacaactattgcatccaaagacgtgtcgttctagggaaaagtccaggttaagttcaacgagggccagccatctcccttggtactccaggacatttaaatacttttttttttttttgctttaaaacagttgctttaacatatgcactcatagctgagtagagtccagccaaaacgacatgtctcagaagtcaagattatgtggagtttgcattagaagccttcttaagaacataaaatcctccgttttcatgcttcagaagtagagaagtacaggtttttgtctttgaatagtgccgggttctcacctcactaatatatttctcttggttttycaartatctkcttgtccacagtaacagygtccttattttccactagtaaatcttacagggtctcagtagtgactctcactgaaataagggcagaaaacaccagtgccgtggtgtggaactggagggctagggtggagggccaaggaagctggagaagccaatcagacggggagtggagtgtgctgctgtgaggccactcatgggctgggtgtccgtggctctgggcagacctctcgtgactggttcagcagagcccaggggactgggaattgaacagctaaacacagatggtcaggactgaagtgcacttgaaacaaataaaatagagcaaatagggtccattggccaacgctctgggaaggaaggaagaatagggagatcatttgacgccggcctcacgctaacagggaagccaccagtaaatgaggaataaattttgatggttaaattaccttgccttgtcagttctctccaggaccttccttgacagccaggcattttccttcagttattggcatatttgagagaaagaaggttgtttttgtaaattgtcttcattttattctgacttcctggagtcttcaaaggctctcgtggggaccactggctttctgggccctgagagcgtctgcaactaggaggtgttgtaactgtggagccaccagccaccagcctggaatttgggtgacagcagcaaccaggaaatgttttagaccaattctgagcctcagtcctgtgcacctttgagtctggtccatcgtgggtgatccaagctatgattatccactgaagacttaggttttccttgtcctttttggtatctatctgaagcacagatgctcaccacctccgcagctgtgagcagcctgcctcgctggggacaaaggagatggagaagcatctctttgtaggggagagctggataattccagcctgttagctactcacaggaacatgcagaattattggctccagggagttttggagaaagaaggtttacgttttcaaacttacagataacagttgacatcaatgcttctctttcccagaacaatctggagtttgccagaaaactctgtaaacaggagtcgtgctgtgtgtgaactgtaaactcttctctccaggcgtcgaggggacctttgctttactttgcagctgggctacatcagacgtgtgcattggaaacataaacttccttaactgggaaaagaatgcttctctgtcttcaaaatagttctgctatgtgacatttttgccatcatgaattttacatcagtgctagctctttgttttacgtgtttcatttggcaggtcacaaaggctcttggctaccacacatacgtgcatacacacacacacacacacacacacacactcataaaggattttcttttctgctttacctttaattttcagtctacttggcttgtaatgaaaggtagagccttatttttgaactatatcccaacagaatcgaatttccattttgccaagaattataaaaccctgaggttttaaaattcagtttcttttctggggatttaacatggaaggacttggagggcaaatggcccagtgattggaaaggggaaaaacaattcatttcatttaaaattattcaataaccattgccagcatttgggattctgagtgctgtttatgaagccctttcattgatataatttcatctatctctcacaaggctgtaagcaattcctatgtccatatggcagtgaggaaatggagatttgagcaggttaagggagttttcacctggaagctcttcttttttttccttctgccacagtagggtcatcagactgtcagccccagcactgggagccgagtaacacgcatgttctcattaatatccttttctcatgtttttattaaagatatatgcaagttgccgaaagacgaaggaacttgcagggatttcatattaaaatggtactatgatccaaacaccaaaagctgygcaagattctggtatggaggttgtggtggaaacgaaaacaaatttggatcacagaaagaatgtgaaaaggtttgcgctcctggtaagtgattcttccttgtgtttatggcttctgcaaataagagattcaggtcaataagtcaccttgaaaaatattagaagtgcaatgattatgatacatgtgaaaaagaagataaagtgtatcctcagataaggaagacgttcaaatacaacccatgaaatgtctttttgaattcctattttgggtttctaaaaacatattgtcccttgtcattcttcagaaatgttactaagttgctgttatttgtaaaatattgcaccaaaaatgattcctgggaagataatataatgaacaactacagataacgccaaagataaacaacccccacaaatttatcttttaaatagttttgcttcctataaataacaatgttgtcactggggccatccagtatctccattatattgtgcagttcaactggtaataaaataaacactttgaacagagcctggggtcagtgccagaatggggagagttcagttcgtataaaggcctggtagatggtgcagggcaaaagaatgggatcagatttcccagacatccctgggccccggggccccaggccaagaacgtcacagagggcctttgatggtactgagtagaaaagtgggacaggtgatggaaaccagaggctgcgggactgtgtcatgataatgacagtgcccttttgggtcagtaatgtggcttttcctctcttctctcggctcctcacctcacccyacccaccccctctctcgacgctcagtgctcgccaaacccggagtcatcagtgtgatgggaacctaagcgtggstggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttytgaagcctctaacaaatgatctagttcagaaggaagcaaaatcccttaatctatgtgcaccgttgggaccaatgccttaattaaagaatttwaaaaagttgtaatagagaatatttttggcattcctctaatgttgtgtgttttttttttktgtgtgctggagggaggggatttaattttaattttaaaatgtttaggaaatttatacaaagaaactttttaataaagtatattgaaagtttcctgggtgtgacgttcttggcagtcttgtttccatagcagcgattgtcagaatcacccctaggctggggaaactgggtttggttctggccccatggagctgtgcaacagcctttcgtttccagtggaggaggcaaaagagctttatcagccagtgtgcaaagagaccggctggagacaagcatcccccgctttgtggattcagccccacatgctccagtgctccatggccgagcggaaggtgttcctgctgttgggtcccggcagtgtttctgattttcagagtcaggctggcttctatcttttcctctgactcttggttggccctcagagcctcagcctcctcctgtcttcctctccacagtgatcctttcccagggggttgatttgcttcctctcacaatggctgagagattcagtgttgccccacgacccccaaccccttttctggagtctcaaagcacaaggtctttcatttttttgtttttcttaaagactgtttttttctctcttcagaaataatacaagaaaccaacaaatacatattcaggtggcacttgagttccacttacaaaggaaacaacttattggataaaatacatatgtcctgacaagtgctgagggtagaattacaggaatcttgggtgtcagcagaaatgttttatgtaaaatcgggatgaatttgccagttggtctattgggaaaggagagaggagtgtggccctcttcagaagcgccacttagtccccacaaggtcgccatgacctcctccccagtcctcttctatctcggcagctaccatggggtgctcaggtcagtgtgctctgagctgtgacccttggtgaccaaccctgggatcygccaggcacccaacaccagcctcttgcaggaacttgcggagcagagagctgtgggcccagctcccatagcggtgggctgagtgctccacttcccaagggatccctgcccccgccacccccattgacttgatctgctatggacctaaaatgagcatcacaatctggttttactttttgggttcctccggaagcagcccttaggactaaggatatgggtgtgagtagtttatttgggaggtgaaggaagtcactgagtggctgagaagtggggagtgagacaagcaaagggagagcactgttaagaggtgtatagtcagcgtccactgtgggtgcccagagcccaatccctcggggaaaccctgggaggtgcacctgtggcactgcacctcgtaggccagcagagggctgaaggagtttgggtagtcatacacctgtttccacgggtcactgaggcattcatgctctggtcctcttggcttgcaggcacactggcaaaggggccttctgtagtgtaagaaaatgttcttggcaaagacctgcagatactcccatgtggaacttgggggagtagtcaggcccaaggtacaggagtaggacaccaatatttgtaacatacctagatggtctgctcaaggtgtgttacaatagactggggcagggcccatcactaggagactcacttccaagggctccagaaccctctctccctttccacctcctgttgccagcatgcccatccctgccattcttggttcactctatctatgcattgcttctctgtgtgtgtcccttggctgctcaaggttgctgggacaatcacacccaccatctcacctgactcaggagaagcaggaagtgatgtaagtccaggtgagtggctggttaagctgtgtgtgctgctaacttagggtaaggcaaggtgctcaggtggtggatgggcagtttctcccatttattcccacagagcaaataaaacaaaatcctttgttacattgtctgtcctaacttagggttcagcaaaacatgatctgagctgcaggattcctgaccccttgacagctcgtggatttctcttcccaagacattcttctgccagactatgccaaggactctgtgtcctttcttgaaccctgacatgtccctgaccctcatatccactcagctctctctggggaagcctccagcctggcccgtggaaggtggcctgccaataaagaaaacctgttttggattttgtgactaagaaataaacttctattgaagtaagagactgaggtcttgggctgttctagcagctggtgtgaccgtaacgaacacagcgcacctttatccagaagcctttgtgggtcaggtgctgtactaggtgtttcacacacatcttaggtggtgccgttcagtagcggtcattgttccagttttaaagatgatgaaacagagggtcagagtggtccttttcacccagctatgttctaatggaggatctgggcaagttatggtgacccagaagccctctcagagttccaaggttggctcctgtgggacgctcactgccattctctagatgtttctggctctttctctggaagtcagatctaagccatgtgtcttttcccagaacaaagcatgccctccacatgaccctccccaagaccttccgtcactctttctcagacagcaagtctctatccttctccttcctttcattgtagtcttttccatctcttctcattatcctgagctgctctggcttaggaaagaacttggagaagctgggggctctggcacgcattgagggcttgcgcagaaggtggcctgggctgagtatggcctgcctgggctccaaggccgagtcacgaggacgtctatttgtgctcaactgtgagcacatctcaatcctttcaacagcagctttgctggatttttaaatacaagtgctttatactttcattccctcaacgattttctgcataattaaaaagaaatcacagcacttatgaatgggtgccaggctttttgtagaaagccaatgttttgaaccctcaagaaccattttaaatttctttccccatggtggttcatttttaggagatggttcgtattttcctgccaaatttccattgttgtcagatttccagctggacctagctgctcttcatgagccaggctctcagggttccacctatctgggtgtggcttccggagaagttggggactgctgacactgccaggccagggggcccagtccagaggctgccctctgccatacccctcctcggtttagtttgggtctgagctttgccgctgcctgtgcctccccttccctgggagatgaatactgatggtgagctgctgtaagagccatgggattcctggggtcttcctgctttcttggaatcatgctctccagctttgggccacccctcagcattcctgagatcccatgcagagccagttcagaaatccttttccgtggtattccctagtcttccacccaactttatggtgggtataaatctgctaaagaccaaaacaccaaagaagtagtattttggaatctagtagtcaaagcttgaaggcatttggtcatgagtgatgggaaaaggccagtgattcaagggcctctgtgcatgatggtgacaccacccaagtatcgctcaacctggaaaactgatattgttttcctgcctatgtcagatgtctctgtgaaaaccatgctgctgttgcaaaaagtcatctaagagaaggcatttgggcatctgcaaagggagctagctatgcatgtttgatttcaagagactagtaaattcccagcatttacatgaattttataagagatgttagaaacagaaatagcacaataaaaagaaattgtcagaacttgtatatctgggaaagaatatttgttttgaaagaccccatttaaaacagttacatttgataggagttgtagttgaagaagctgactggtcattcataaaccagtcttatgttgagttccccgaaagcagatcctgaccaagttttggctgcagtcatttgtttcggaaggtgtgtgggaagcacaaatgaggccactgagaagcaagacaaagaagttggcaagtcaagggatggtgcattaactaaaagcatgttacccttgagagcaactggggctcagtctccctggaaacccactgagaaagtggggagaatgctacgaggaacagaaagctggacgtttatggactgaccctcatctctctttggttggaggttgtagtagtcaccattatctagagggacaggactaataggatagacatatatatgaaagggagtttattaaggagtattgacttacacgatcacaagatgaagtcccacaataggccgtctgcaagctgaggagcaaggaagccagtctgagtcccaaaacctcaaaagtggggaagctggcagtgcagccttcagtgtgtgaccgaaggcccgagagcccctggcaaaccattggtgtaagtccaagagtccaaaagccgacgaacttggagtctgatgtatcagggcaggaagcatccagcacgggagaaagacgaaggcgggaagactcagccagtctagtccttccacgtttttctgcctgcttttttctggctgcactggcatcagattagatagtgcccaaacagactgaggtgggtctgcctctcccagtccactgactcaaatgttaatctcccttggcaacaccctcacagacacacccaggaacaatactttgtatccttcaatccggtcaagttgacactcacaggggttgacctgggggcgttacacgccagcattttgaggctgccctgcacacactgttgctagaaaagtaaagcagagaagaagagggatgygggccactgaggtggagtgctgtcagcacacctggaagcagccagcacagctgcaggggagcacagaggcgggccgaggagcaaggtataaacagcatcagcaatcagccagtttgaacatgaacctatagaaattgaagtgtctttaacatgaagttgattagagagggttgcctagatgaggatgataatagagacatattgtccactcctgattactctgatggaaagaaatgaggtgatttatggattaagcacagcttctgagctcttaaactgtagcccacggtatgcccagccctctaccagatgggggtcagcaaacttctggtaaaggaccccaccagcgtccagtggttttggggctccagcaagagccatcgagcctgtgctgtgtctgtgaatttcagtggtggctcgggctgcccaactcccttgttcctttccatttgtggaactgaacctgatttgctagccttcccattgttgctataaactactcaatatttttccaataattcaattttcttcatatgttaaccagagtaagtttctgtcccttgctgcctagagcctggacaggtacacagtctttcattcaatcacttattcaacaaacatttgctgagcacctaacatgtgtcaggtattagacaaggcactggggatgcaggggtggggtggacagcacacatgtcttcctcttgtgttccttacacggcaagggaagtaggtggcaaacacacaaaaccctcggtaaataaggacgtgtgagctgcagtggaggctgtctgatgaggtactgcatgtttaaggcaagcctttctgaagagttgatttatgagctaaaaaaaaaaaaaaaaaaaaaaacccaagagaggccagcacggtggttcacgtctgtaatcccagcaccaagggagaccgaggcaggtggatcacttaggagttcaggaccagcctagccaacatggtgaaacctctctactaaaaatacaacaacaacaacaaaattagctgggcatggtggcacatgcttgtaatcctagctagtagggaggctgaggcaggagaattgcttgaacctgggagacagaggttgcagtgagccgagatcgcaccactgcactccagcctggtaacagaacaagactctgtctcaagaaacaaaaaacaaacaacaaaaaatcccaagacagccacctttgggaagacctgaaggaagattccagatccagagagggcctggatctgagatcctgggtagagaaatgactgtgacatgtttgagaaacagcaagatggccagtgtggctggagtcaaacaaataagcggataaatttttggagttgaagtctgagagagaatggccaagtcaggccccaaaactctttcataactaacgagttgtggattgtactttaatgtgatggaaagccattgggagctttaagccgggcagtcctgggtgtgacatgtgattctttgaggaggcggggtagtcaatcaaaaattctgccatgcgtattagaacttaggatgctattgaactttgaagcggtgatatgaggaagacagttgaagttcagaggagagggtggggctaaggatatacattcagcagtttggaaatataccatattcgaagcctagatttatggtgcgatttcattgcttgagagtatagatgaagagggacagggagtcaggagaggcctgtctgtgccctggcggttagaggttgagcagagaagacaggcttggtgaaagaggctgaggaggagtgtttgtagaaataagaagagaatcagtagagacaggtgtcatgcaaggacagcgttggcagaagctgtgtcaaaatgaacagagcagtcacctgtgctgaatgctgctcatggtttagaaaacagagagcaggaaggagagagtattcttggggctgtggtatgtagt

SEQ ID NO: 12329 - DNA, 38927 bp, Homo sapiens
tggagtgcagtggtgcgatcgctgctcactgcaagctctgcctcccgggttcacgacattctcctgcctcagcctcctgagtagctaggactacaggcgtccgtcaccacgcccggctaatttttttgtatttttagtagagatggggtttcactttgttagccaggatggtctcgatctcctgacctcgtgatccgcctgcctcggcctcccaaagtgctggtattacaggcgtgagccaccacgcctggccgatttccttccttttctatggagataccactttgcttatccactcatctgtggatgcacacaggttgcttccacctcttggcttttgtgagcagtactgttatgaacgtgggtgtgcaaacatctttttgagaccttcctttccaatctttggtctctgttctcaaatggaattgctggacgctatggtagttctaattttaatttattgagaagcctctactgtttcccatagtggctgtatcattttataaccccaccagcagtgcaccagaattccaatgtctccacatccttgcaaacacttattttctgttttttttttttttttgatagtagccatcccaaagggtgagtggggacaccacgtggctttgctttgcatgtccctgataattagtgatgttgagcatttctcgtatgcttcttggccaagtgtatatcatctttggagaaatgtctgttcaagtcctttgcccttatttatttatgagacgggctcggtctattaccaggctggagtgcagtggtgcgatcatagctcatagagtgacccttcagtgctttcccacactcccctggggtccaaccttctgccgaagatgccccagctctctgcagttccctgcccaggccccaagactcctttccctgtcggaaagtttcttaggcttcctctctctggggtccccacacacctctgttcccctccagcacactggcccaggccgggccagcctgcttcaacacagtgtcaggaactcctgtggtgtccacaagcccagtgccagcgcttgcctgccgtgggacgcactgtgtgcctcaggcccctcactcgccaaataggacagttatcctctgcctcggtgtggtcacaggggtgaaatgtgcctggatttgcagggtggctgcaacagcgcctggcccataggcagtaccatgaagactcacagtgtagggcaacagacgacgcctgagcggctgaagaaggtgggctcccagggcctccctgcccaggcctgctgccacggccagaacccaggggggcaccgtgtacctcgccagtggcctcagcactgcgccttgcctccaggagtcttggcttgtttgtgtggagctggggactgggagagcagagcttgtgacctgaggccccccagcctcagggtggaggtgaccaccctggaccaaggcctgccccagttagtggctgaggacagacaggagtacgtgtggcattcctgcggccccttgctcggcacccaggcacttcctcctgcccctctgcctctggaaggccagccatggcatggccacgggggcctgccacctggcacctccccaacacaatacataaatgagtgggtgtggctgttccaagaaaactgtgtttacacacacaggtgcgccaggcctggccgtcgagccctggtttgccggcctttgttcgagaccagtggttcccaaatgtgcacctgtatcagcatcacccagagcggggtcagagtctggactcctgggccccacgcggagttgttgtcaggggcctgggctttgcatttccacaggttccaggtgctgctgctggagcggaggccacgctctgagcaccctgctctagaagaagagatgcagaaaagacaggcagggctgcagaaaaggtaggcagggctgtagggtggtccggaccaccgggcactgtcaaatggcagatgtccctccgctctgctctgggtggggctggggccggagtggattttataaacactctgggagggtcccacccagaactctcctgcgctgtgtggaaggagggccactggggagggtgtagatgggaagtgagagagaagaggggacgaggagacccctgggtggccaaggaaacacttttctgaacaatcaaaaataaaggaggggcaggcagaacgtggggacttggctggggctgcctaggttccctggactcacctcctggcactacactgcctggggagccagggggccaggagccagggagcgactggcacaccccacaccttcctaacccagcccctggtggggagcccttccttcagcagcaggcagcacagcgatggccaagtgtccctccagggggacagacgtttgcccctccacgccactcacccggggtgaggccgcagcaccctccaccttgctccaccgtggccagcttctggcctcccctcaccaagccccgggacttcacgtgaagatcacttactggccttctcccctcgcggtcctgggttctctcctcctcctggcctctgaggccagaatgctgaggctcagactagggcctttgtctctgctgacacctcgctgctgtcacgactttgtggtccctgtgccactgactgcaggacgcgcasstgagtctccttggacctgcccaggtggcccccaagcaggatgtgtccaacacaccttgcttccctctgcctggccccaggccccactctggcccctgctttctcagtaaggacatccccactccgtggctgctctggccaaagacaggagagtcaccctttctcttcggcgcgtaccyctcaagctccagcttgtgctcccagcactcccaccttgcacttccccatccccagctcctccccaccctgcccaaagccctcctgaacccattcttgtctcagtctccgcacatagcagccagagattaaaacaaaccagcccaaccctcggtggggctggtgttcacctttggggttaaattgaaagtccttgcgtggcaccacagtcactcagcgggcatcccctccctctgagtgctctcgccccactgacctgggcactgtggggccatgctcactcctgcctcgggcctcagcacctgtcccttcctggcagcctgtcccgcctggcatgctggctttgctccaatgccaacccttcggagaggccttccctggccaccctgttgtaaacagcactgcctgtctccgtgttccctgagtgttcctccaggcactgtcactgccagacgctggtatttttgtctactatggcccccaccctggctggtacactcagaaggacgggctgcgtcccctgtgcctagagaggcwtctggcacagagccagccttcaacatatattgcatgaaagattccgtccaaggacgctgtagatgtaggtggacgcagacaaaagcaaagcaggacagtggattcgtccaaagaccggcagtgtcttcaggtgaagctgcagcgtcgagtcctggtgcttgcaaggtttcagcagcagaaacctgatggggctccttgcacctgggagaaaagccactccagtgaggattattgccagtgaaggctgccctggccccagacaagttttcctagaatttatggtagcaggcgggttgttaaaggatgattcccgaaagggccagacatggtgctcacagggatgcagggtgagcatgcgtcgaagagcttccctagcccaggcagctgtgaggaccagctcagaagagaagtcctgaaacagacacttacagatgaggaatattgacatgattgtgcaaatggacmtgaaactggattttcagggggctgtgatgggctggattgtctcccttagattctaatgttgaagtcccccacaccccagtgtcttagaatgcaactgtatttggaggtagactttaaagagatggttgaattaaaatgaggccccaaattcaatctgactggtatgtctataaaaagagaaagtctggacatctggagatacatcagggatgcgtgactgctcagaggaaagaccctgtgaggcacagcaagaaggcaccatctgcttgcccaggagacaccaacctgtgacaccctgaccttagacttccacccccaagaactgtgagaggtagacctccttgcactgtaaatcactcgttctgttactgcagtcccagaaaactaacacagacctttgctgggcagaatgcctttgcttctctgcagacaagattacttttgcactattgcactgttgttatcaaaataattatatggggctgggcatggcggctcacacctgtaatcccaacacttagggaggctgaggtgggtggagtacctgaggtcaggagttcaagaccagcctggccaacatggtgaaaccccgtctctactaaaaatacaaaaaaaaaaaaagaaaaaaaaattagcctggtgtggtgtgcacctgcaatcccagctattcggggagggggctgagacaagacaattgcttgaacctgggaggcacaggttgcagtgagccaagatcttgctactgccctccaggcaacagaataataataatttttattatggaatcagtgtcaaatgctggtgccttctgggggcaacacacagtttcccaccaaagtgcatcagtgccccaggcagtcaaggtgccaggagacgaggaggccgcggatcttctgtccacctgggagcaagcctgcagcttgggaccctcctgggaccctgcacccgccagtgccctgccctcctgggctctcatgggagtgaaggagggtgggctctgtaggagttaaagaaagaggaaagaaacatgaaaagcggctcaacaaaggcaggtttattttggagaataaacctgaaagggacttctggccgattttggtcaggagccatctctcctacagactaaggatctttaagggtttaggaagtggggagcttatcgcaggctcggaatgtttctatgtgagggaaagtttattgcgggcttggaatgtctctggtcggaggggaggttatctcgaggttggcatgtttctgattggagatgttatttgtggtttacggtcgtgctgacattagctattgggctgatgtgttttgggctggatttaggcagctttttaatcaaagggaacctaaaatggcggtgtttgtccaagaaggccatactcctgctctgtcccgctccagcccttgggggcccctcgggctcttctcttggatggtgtgtgaatgggcacatgtggaggggctggtccagctctgcctgcctctggccatccaaaggagggacagcagggcctgggcagcaatgccggccttggagccccggggctgtggaggctgcttgacaggacacggagccccctctgtgctcaggtcgtggagggcctcgggcactacggtctgccaggcaccacatgtcacagctactcaaacacccagggccgccacggagggccaatggccgcaggatggctcaggacccgccccacccctgtcgctgcctttctggctgccccctagtccctggacaggcgctccccagccccaagcaggccccagccaatctcctgcccaggcaggagctccccctgccgccctcacagacctcacctcttcctacacgtttccaaggccgcgccccgccscgcaccccgccaggccccgccccgcaccccgccaggccccgccccgcaccccgccaggccccgccccgcaccccgccaggccccgccccacccgccaggccccgcgccaggccccgcctctctctccgaccctggacagtccccgggacccaccccgcccccaggtcctgcccccgcccgcctccgcggggcctcccaccctcccgggcagactccactcccgccccctccccgtgggtgcccccgccggccccgccctcccaggctgcccccggcgccccgggcctcctccgcgcagtccctgagtcccgcaggccctgcgtccccgctgcacacccccgtccactcccgtggtccccggtccggcatggcgcgcgcggtggggcccgagcggaggctgctggccgtctacaccggcggcaccattggcatgcggagtgagctcggcggtgagtccgagaccctgggcggggtaggcctctggacctggccgcgaccgggagcctcggaccctcctgcacccacgggggtcgttggggagtcaaatccgcgcctggatggggggtgcgggctgaggtcgctctcctccggttccggccaccggcgtccccacgcatggagccccgacctggacagaggagrttgcggtgggttctcgccgtcgcggtgctcccgggagcgccctgcgaccctggggccaggccccctgtgctgccgctgcgcccctgagggccagcgtcctgaagtcctggaatatggggcgggagggccccagggcattggcctgccgctcctgctctggacacagaaggcttaggaggctgccctggagaaggcttaggaggctgcgaggacccctcamctgcgacacccaggagggtgtccccgtcccctggggtcctggtcaggcagcagtggttggcacgatactggggctacctggcatctgcggggacgcacgtgttcacacccgaggtggcctcagagccctgcttcctctgcccctgtgtggacctggttgaccagagaccagcgattgcgtctggactgagtyctgcctgggtggggtcagggcctgggacaggcaccgagctctgtggtactccagcacagtgctgccagcctgggctgggcacaggaaggatggtagcttggggagcctgaggccaccgggatggggagaggacggttgcactggagcctccagaatgcctgggtgttccccaggagggcaggacactgcctggggcccccagatgggctctgctgtgatgtggggcctcccttggggccaggacagccccctcgccccgtcttgaacctgtttgcgaccctccatgggccactgcctgcctttccctcaggagccctttccactcctcctcctcccactccctgctgccctggcccctccccacactcctgcttgtgtccagcgcagctctctctcctgggacggctgggaccctctccggctctgccagagcccagggcctcccctggcatgaccagaacattctcttgtcccttgcccatctgccaaccacttccccgcccctcctatccccaccccctctcacggcctgttccctggcagctgcccctcctggccacccctttctgctgaagtggctgctcagaagccaccagcactctgtcggtgctctcagattccacccaccacactgtggccggtgcagacccctctggaggcccactctgcgcccagcccaggagacaaagcctagtggggctcgtccacgagggactcaggtccccargaacgtggctgtccaggctgccgggagcctcctctgcacttctccttctgcctgtgaatggaacaaagtcattcacagcttggcaaacgcccctgtgtgacactccactgacacagagtgacacaattcctgtgcttggccctcacaagctagagagagaggctgccattgaagggatggcatgcattaaggagctagtcccaggggcaggatctgccagggccctgtaggggctgtgggctgataacagggtctgagctgggtgtgtggatggtgtggagtttggaggcagcccagggagggcttctctgaggacacaaggcctgcaggacaaagatgggagagggccaggccaggagcagccctgcaaggtgcaggaaagaggagtggggagcccagcagggccggagcctgccagagctgcccccgagtggggacaggacctggggactctgtgtggggcctcgtccgacgcccctgacgctaccccttcaggcttggagtgtggccaactgcagtttcrttgagctcaacatgtagttcttgagtggtccgagctgcaggggcaggtggactctgtaaccccaccacacacccgtctcgcttggcccccgcgtgctcgccgcagcagcctgtgggtgcactcacacgcgtgcaccgcatttctgaaagaggctgtgaggtcctgtgtctgggtgggaaacaagagacttggaggctggaaattgggtgtggggcgtcagtcttcagacctgaagcagccttctgagatcccttggtgctctgtgcactggggtcctggcttctgctcagcagcccgtcctcgtgtggctgcgaggtcacccccagctgttgctagctgacccatgtggggcatccacttccaggaacctgcaggaatgggctsccccaacccctcgtgaggttggagcagccagactgtcaggcgtcaatgatttactccctccacactgctgacgtgggctctggccttccctggggaggtgagaggggagtggtggctttgccctagtaaagctgtttgattgtcgctgttggaacggcttctgcgcctgctggtaaacagtgacctgtgggtggaacgctgcacacctggagccctgccagagttcagggagggcagaggtgatgccagtggggacgccccttgacccatcccttctctgagttcattgaagctatcacaggtcaaggggcatagcgaatccaaacacggctgataaccccaagcccaagctggcatcagtggccacgttctgtacacccgagaaacttgaagacttcctatgtcaaactgggaaccccacctgcttgccggcctgtcccaaagtccctcctgagcccggctccttgcaggcacagcagggagggcagagatytggggccaggcagctgagagaagctccctgcccggtgaccacacgggtcccagcagtcgagagtgtcagtggagtgatgcccatggcttcttggttactgcagtggcgtctgtgcccttggcctggacctccttcctgaatgggtgctacacgttcacaagtttctaagcctaagcttgacttcgctggtgacagtggggcccattgtcttagagagcaaagcctcctttccaggtgtttggcagggggctgaggagtttccaagtcaccagcaaactcaggcacctgcctggatgggccaaggaagaggttccaggcagggctggagggttcagattctgcagcccttgaagcttttggagggccctcattgagaaaagtaatacaagttacaaaatcrtagttaggtgtgaaagccggtgtttgtttattttttatttatttttatttttttgagatggagtctcactctgtcgcccagactggagtgcagtggcgcgatctcagctcaytgcaagctctgcctcccgggttcacaccattctcctgcctcagcctcccgagtagctgggactacaggcgcccgccaccgtgcccggctgaaagctggtgtttatttaaaataacaaaagaaattgccccagctgactgggcgcggtggctcacacctgtaatcccagcactttgggaggctgaggtgggtggatcacttgagatcgggagttcaagaccagccatggacaacatggtgaaaccctgtctctactaaaaatacaaaaaaaaaattagccagatgtggtggcagatgcctgtggtcccagctactggggaggctgaggcatgagaatcgcttgaacccaggaggtggaggttgcagtgagccgagatctcgccactgcactccagcctgagtgacagagtgagaccctgtctcaaacaaacaaaaaaaactgatgccactacatacctgttagaatggctgctgacgtacaacacattgactgcggggtgagtgctggagccccagagttggaaagtggtccactcgcaggttggtaagaaaactttactggcgacagtataggtttgaaaaaggaacgtttggccagacatggtggctcaggcctgtaattccaacactttgggaggccaaggcgggtggttcacttgccttgctaacatggcgaaaccccgtctctactaaaaataaaaaattagctaggtgtggtggtgcatgcctgtaatcccggctactcgggaggctaaggcaggagaattgcttgagccsggtgggtggaggttgcagtgagtcgagatggcatcactgtactccagcctgggcaacagagtgagactctgcctcaaaaaaaaaaaaaaaaaaaaaaaaarggaagaaaggagaagaaaaagaaaaaagaaagaaattggccaggctggttttgaactcctgggctcaaatgatcttcctgcatcagcctcccaaaattctgggattacaggtgtgagccataaaaaccactgcaaaagcacatatggagtgwtttgcttgagagaagaggacaccaagagagtttagtcttgtctttggctgatttcgcctgtggtgcccacacatgcccccagcagggacagcagggcccatatccacgcctaccactctgcagcattcctggaagtttctggaagctgttcccccacatgagtcagcagcagctggaggtgaccttgcacaacgtgagcatgtcccacaaaaccaaaccagatatgccccctccacctttcccataaggcaccccagcttcacccgccgtgatgagtggagagtgactttttgtttcctgtggccactgtgccgggcggctgaacatcacagaagttcgttctgggttctggaggccgaggcctgagaggggtttccccgggctgagccaaggtgctgcagggcaccgctccgtcctgacgctctgcgggaggagccacccctgccacctccagtgtctggtggctgctgcaatccttggcttgtggccgcatcactccagtcatccaggccagcatctccaagggccgctctgccctgtcgtcatatggccttcccctccccgtgccctgtggccttccacctgtgaggaaacacgagagggcgtttagggcccacctggattgtccagggccacctcccgccccatgacccctaatatcacatccgtaaagacacttccatatgaagtgacacccacaggtaccggggattgggatgtggacatctttttaatttttatgtatttatttaattttttgagacagtctcattctgtcacccaggctggagtgcagtggtgcgatcttggctcactgcaacctccgcctgccagattcaagtgattctcccgcctcaacctcccaagtagctgggattacaggcacctgccatcatgaccagttaatttttgtattattcgtaaagacagggtttcaccatgttgaccaggctggtcttgaattccagacctcaagcaatctgacacctcggccacccaaagtgctgggattccaggcctgaggcactgcgcccggccctgggatgcggacatctaggatgctttttcaacccaccatacatgagacagggacacttggacaccggtgtggggtggaccctgagccccctggatgcccagggtctgaggttgggtccttggggttcacaaggctggtgaatccagacctttgttccggcagcccgtgtcctggctgtgctctgggcgcctcggagggcagacgggcagacaaacatgtgcgggctccgcctcccccgtctgctggctgagccctactggcggggtgattttgtcagcggctgcacctcagccggcctgcatcttccagtcctctggcaaacgtccccggggctccacaggcctttgtgtaaggccagaggaggatcacgggtgccataaaccttcacggggccaagggctggtgtcccggggctggtgacttaacaggcagagatgtggagaccagggtgagcccagcagtggagggcgatgtcagggaggggtgcggctggagggatattagagggggctgctttaacttgccaagtttggggttaatttgtgagccagtgataggcgatgggtacagctgcagagggcgaggggggaaagcaggtgaccatggctgggatctgcaggataggatggggcattgctgctgggggagggaagggagggccgggagggagctttgggacttgctggaggccctggaggggtggctgaggggtcagggctttatactgagcagctggccccagggaatgagtggtgtggccaggtctccatttaagggacagaactgagatgcagaggctgcaggaaggtggcagagytgctgggggtgggaccagcccgtctgtgcacttgctgtgtgctaggccctccaggtcggggagctggggaaggggacctgggctggaccctgagggagtcacacagtccgtgccctttgggagctcgagggccagtgagggagaatgtgggaatagcactacagcctgggcatctgggagggcttcctgggggtggtgtcccaatctgggccttgaggcacctactgggtgagaagtggggacgaggcaggacttccaggcagagcccacagtatatccacagtgaggcaaaggctgagccccgtgggccttggtggggagtgtggactaagcatttggagaaggaggtgggagcaggggcagggcctgggtggagcagctagagacctgggcagagctcctggggccgtccaggtgcgaaatgaggaatcaccacgggctccaaggcaggaagccatggcttccaaacgcgggtcagccgcctgccctctgaggggkcccaggggcagccatagcccttcctcccagcctctgactgtcataagaccggagccccatcccaccagctctggtcctgcccctcagtgagggaggaggcggccatggctgtcagcccctgaccccagcatccacctggactctgcctgcagtgcttgtgcccgggacgggcctggctgccatcctgaggacactgcccatgttccatgacgaggagcaygcccgagcccgcggcctctctgaggacaccctggtgctaccgtgagtgtgggctcctcccagtcccggacagggcatggctgctgaggggcaccgatcctgaggctgggcactgctggccaggcccacgtgagccatttgctcacycctgtctctaacatcccctcagcttacagggctttaggactgaccagcagtcgccttccaccagagcctgaacctctgagggtgccccgtgcctggtcccaccttccctccccaccctcctcccacacccccagccaggctgcttyggcaagtgtgatgagggcgccccgtctagggatcctgtatatcaggagccagctggcccaggtggccttgcccccagcatagaggtccttccatttctcagctctgggcccagctccctgatgtcccccacagctgggggtgagctgggagttgccctcgtggtggctgaccaccayagccgccacaggcgagcctcctgcaagcatcctctcctgcctgggsatggctggtcccagcccccctcttcgagctggtgtgggaagaagactgctgggagtggcccatcctgaccyacgtccttgcctctgtggggagctycaggtggaaggggggcygggccccgtacctgggatgctgagaacttgctatgtgcggagcccttggcgtaggggccccagctctgccagaggggaacagagcgggtcagggcatttagagcaggaggaggtgcagagcgggagcctgctgttccgcctcctgctgtttctgtcccgcagcccggmcagccgcaaccagaggatyctctacaccgtgctggagtgccagcccctcttcgactccagtgacatgaccatcgctgagtgggttygcsttgcccagaccatcaaggtagtggggctggggaatgctgggtggggctgtggtgtgtgggtggggctgaggtgtgtgggtggggctgtggtgtgtgggtggggctgtggagagtgggcagggctgttgggtgtgagtggggctagggagcacgggtgggaatggggagtgtgggtggggcttggagtgtgggcggggctgtggagtgtgggtggggctgtggagagtgggtgaggctgtggagtgtgggtggggctgtgggtgtggggtgggctgtgttgtgtgggcagggctgtgttttgtgggtggggctgtgttgtgagtggggctgtagggtgtgggtggggctatgagtgtgggcggggctgtgggtatgggcggggctggtggatgggcagtggccggcagaaacactctgggacgggtgaggagctgcagggtctggggtggagtcggcctgcccagcctggggcctgggagcatctgggaatggcagcttcaggaaagggcagggtccacgtgtcagagctgcgggcaaggctctgagttcctctcccccatgcaagctgggggtgggcgtatagggccaagtcgacttcccagatgaggacacaacgggaacagttgtcttagcctgtcccagttagtatctggggcgcggtgtgtggtgtgtgatgctacctcgagggccagcaagctccttgtgcgtggctggtgacctgctcactgccctctgtccgtccccgcccagttggagtcttagtggatttagtggagtcttggttggagtcttagtggaccacagcacctctcaaagactcttgtggtttacagcgacctgtgtgctccccctgcaggcagaaccaccccccgccccatcagcttttcttctcccttctcccccatcacaacacgctcccatgttaccggagctgcctcccctagtagrgggcctcctgcccgctccagtcccaattctcacctgcttcccttacgaaccccctgctcccctgagtgggaacatctaggcttccccttcccagcagcagggtggcaggcagcaccacccaggacaggaccctccatttgtrgccggcagccctcaccgggcaaggcgtgactgctttttgaggcccacgaagctgccctgcggtccttgctgcagggagcagccctgggcagcctcacaaaggccttctcggctcaggtggcccagcctgccgtcttgccgcgagtggccagcagagggcgcccttcccctccttggcctccgctcctctgcagttcccaggcctacggggcttggtcttttaatggccccccgggcaggcccaggcttcgtatggagccctgggctctcggaacggtgccctggcagccgcagcctgggccagccaccctccagggggtggtggccggaggacgtccctgcatggccagcttcactgctgcccttcggtgtcctgcccggccgcccaggtccagatccaggcaacctccaggatcacctgctggttcccggccatggctgtgccttgaccctgcaggcgtccttgtgcccaccgttgtgttcttgcctgacccgcggtctgggcttcgaggctcgtgcaccaccacagccccctgctgccatggagaggcgctctcccgcccttggggagtgtgcagaggccccttggagggactcattctcgagtgctctgaggggagcctcagcgtggtgggtgcacccgagtggcatggaagcctcggggcagggagagcgtgggagtcccaggactccacgccaggggctaatcttccagagagggacttccaggccagggtcccacgggtgcctcccctgagtcctcctctctgcatccggaccctttcccccatgctgcaacctcccccacacctgcttgcgaggggctggcctgcctgagcatgcgcccctcctgcagaggcactacgagcagtaccayggctttgtggtcatccacggcaccgacaccatggcctttgctgcctcgatgctgtccttcatgctggagaacctgcagaagactgtcatcctcactggggcccaggtaaycccaggggcccggggctcctaggaacaggggcttcctgaggccacagggcaagtcagcgctrtgggcggccgctgcgggaccccgggcttcctgctcagcccagcagctcctgaggtggctgctgcagggcccgtgctggggctcgcaaatgctcaggtcctgcccgggtgccagcaccacctgccccgcrggaggggggtcatctcctgctggtggccctgggagctgtgaggccctggagcacccagagccaggcccacctcggccctgggggtgccaggcatcccttcctctcctcccgatgcttccttgcggctgctgcccacctctccatctggcgcatcagggtggccgcgcacagagccgcaccaggaggccccggccatgtccctgcctttgtccctctctttgctccgcccactgtgggtctaggcgatgccatcctgggggccctggcacacgatttccctgcctctctcaccctaacccagcacaaatcccataagccaaggccagtagagtgttctggaaaactggatttgaggggatgtggcaggggaggttggctagaagctgactaggggtccatgttgcctgcgggtggcagtgggcacctgaaccccttgggatcctttcccacggctgaggctaaggtcttgtatgggaaaccggtacctgtgtccctttgagcttggtggcagttccagaaagctccatggaggccctcttaggaggtctgcggggagcagtccggggaggtggctcagccaccccactctgcttgcctggcgccgtctcccttgtccctccagrgtctccccagggcccactgcacacacctgttagcggtggagcagtgcctcccgccccagaactcgagaaggagggacagggctccagctggttctcctcttcccagaccttcccgagccctgggggagcagaacatcccgtggacctctctaggggatcaagggcacagttatgagcaccgcaggacccacgaacgttcacatgcrtgttgtcctcactctgatgttggcctgtgccgggacatccttatccctgttatacctgtggggaaactgaggcttacaggctaggggctcacccacagccacgtaccacgtgagggctgagccagggagcacccaggacccaggactgccaccccctgccagggctctctccctccagagcctctgactgaccacttcccggccgcctcctcctgaaaaccctggcctctgcaccgccacctgcgccctcctgggacgcgctgttcagtcaaccatagcacagtcgcccatgctagacacaggcagctgtgggaggagctgtactgtgcctggcatcccgaggcagttcctttctgtcacagcccacccacccctcacccccaccaccctccttccagcccatagttctgctggggtagcgagggagctgggcagggcagctgcggtgggaggcctgtgatgcgttctccagtatggggaccggctggcccctgctgccagcactgggctcttggacctgtagagggagctggtgggtgggttgaggccctgggtgcaggctggcatggtctgcagccacagctgttggtgggtgggttgaggccctgggtgcaggctggcatcgtctgcagggacagctgttgttggcggccttggagacagscttactgcccagctcctctgagtgccccgttcccccaaggcacccatctccaggctgcctgctgcagtccaagccygcctgtccttctctttcccacacccgcctggggctcctgggctgggcctgggggtttacctggagagatgagccagacatcccaggcttctgggcttcccaggcctcagctactcygtggcctctcccccaggtgcccatccatgccctgtggagcgacggccgtgagaacctkctgggggcactgctcatggctggccagtatgtgatcccagaggtacctgcctggtgcacgtggaggcggggcaggtggggtgggggcaggagcccagacagcagccaggaaacaaagtccccccagcccctccccagacgccactgccaatagctgggtgcactgtcttctagatcttatgttgtggatatttacattagaggtacgtatggaagttctacgttagagatacgtatggaggttctgcgttagagatgcatatggaggttctrcgttagagatacgtatggaggttctgcgttagagatgcgtatggaggttctgcgttagagatgcgtatggaggttctgcgttagagatgcgtatggaggttctgcgttagagatgcgtatggaggttctgcgttagagatgcgtatggaggttttgcgttagagatgcgtatggaggttctacgttagagatgcgtatggaggttytscgttagagatgcgtatggaggttatrcsttagagatacgtatggaggttctacgttagagatacgtatggaggttctgcgttagagatacgtatggaggttctgcgttagagatgcgtatggaggttttacgttagagatacgtatggaggttttacattagagataggtatggaagtttctataaaaacaggttgcagccagcagggctctgaagggtgtcactttccctcccccatgtctttccctgtttcctgtggcgtcccaggaaggagtgtgcaaagatctcccccaccctggggcagtggctttacccaaggctcttgagcagcttgactagagcccccacacgggctcctgagcaggggcctcagggactcccattcaccgtgggcaggggcctccagcagctgtgctcgctgcacctttgggatgagttcccagggctctgtaagaagcagggttgggggcagtgggcaggtgggaagggaaggaagtacggtaccctcctgccacccagccacttgcacgccccaggccctggggtccccaggcccctgcaggctccggttagcccacgggtaggtggcagggcaggaaagggcccgagaggggcagtacctgctcccaggaaggtctctgcctgcggtgggtggggttacagtcccacctccccctgggtctgggcacctcattgatggcagggaggaagctggagggcagatgggtcggggacagggtggccgctgctctgaactctgtcgctccgttcccgcaggtctgccttttcttccagaatcagctgtttcggggcaaccgggcaaccaaggtagacgctcggaggttcgcagctttctgctccccgaacctgctgcctctggccacagtgggtgctgacatcacaagtaagccccgcaggagcagggccaggtgcctgcccagtgctggtgctgggcgaggggctgctgcagggagctcgtggctgggactcggcagagtttgagagcaccatgcttggttctgacttgccctggcttggttctgccctgggctgtggagaagccagggctgcgtggacagggctgctgcgtggccacagaggtgggggcctcctcaggtccctgcaggctcagaggcgggaggcctggaagagaggtttggggcatctggccctcatgtgtcctgcccaaccactcgccccaggcctaggaggtccccagtgaccacctggctctgccacacctctgtgtgccgtagcctcgtccccaggagtttcagggagtctttctgtcctctggttccggcgggcagcccagccatccttgtggggctgactcgagcgatcctgtgtcctgaggcttccccctkggggggccaagcccgccccctggccctggctgtaggagcagccttggagcttgttctcagagactggtgccctgccaggcctcacctgagacgcagggccactccagtggcctgcccggaagtcactccctggcctaccgtckctccgtctggggtgtgctcctgctgagggagcccctgcttcctggactctacccggcccctgcctgytccaggtccacggccagcatggccagtcctgaccccacgccagcacccctccctgaggcagcgggagcatcccctccctcctgggagatgcatcctgcctgccctggccccctgctgtttcaaggcagcyccaaacctgccctgtgtctcatcctgactgactgaggtggggtccagccccggggaggctccagggcttggcagcactggccttcctttgggggcatttgacacctcacccggggctgggtggggctgcctgcccaggaccaaagcagctgttcctgtctgggygggtggggtggaggcgccccctcacccacactgggcttctgtccaggcctgggccatggcgggctggtgggtcaagcccacaaggtcactggacgcctggggaggcccttcctagggaatctcccggtgcggcagaggctccccactcccccattttaaggaggagcagaccctcctggagaaagggttgggctatgggctgctggggcacagcttcctggaagaatccccagacacaggcaaggaccctggggagcttcagggcctggcatgagggggccctgggaagggtctggcagggcaggggccttcctggagcatctaccagaagtcgggggacaggaggggctctgggcatgtctggctgtggggccgtcagcagaagcgggtggaggcagcgtctttggatctcaagacaaggcctgtgtgtgggagtccgggctcggtggctgacttgcttgttgccccagggcccctcagcaggacrggacagaggaaactgcctggttctacaggtgagaaacggaggcagagagaggcaggctcccacagggaggcaccgactcaagcctgtgcgctgtctcctgtcctgggctcacaccccgtcccttcttcctgctgttccctcytgtcctgggctcacaccctgtcccttcttcctgctgctccctggagcaccttctagggagtgtgaggcccagaacacatcagtgtgtctactgtgtgtgcagcacaccgggtctcaggggcttgggcaggggcccacttgctcaccgagggccagggcagccctcaaggcttcttggaggaggtggcttgtgagctggtgctggtagggtactggcttgcttgcccatgctggatgctggcactcggcccctccagcccagggagaaggagcagcaagaggtgtgggtggtgccctgcaggcccggctcccccatggggcctgattcacaccttatctggggctcaggagtggagcttctgctggtgggtggaccccgccccaacagtgcacagaggaccgtgctctggattccagggactccgccagcaccgggtgctaagcccgggcaggccacgaggctcaagacacaccggcctcaggcccagggccgtggggcagctcctgggcrcagcactaaggctggtctgggtgggaggctgccctggccccagccccccacccctgagtgtttcccacgtgcgtgtgggtgtgggaamctgatgccgggctgycgggccggttctggcacccagtgttgagaaacctcaggccttgcccagggygtggctgctggggcccctggggaggggcacaggttggcagtgtgcaccctcagcctctctgagccasctgggggtagcaatgccggcctgggcccgggtgccagctgccagcaccctgtcgagggcttgtcctgggctttttaccyactgtctgggaagtgaggggctgggctggtccgggagtcatgggcgggcttggtgctcctgtccacagtcggctcggcgccaaggggtggggggatgcgtgggaggctggaggaggccctgctggccctgtcctttccatgtgtctcaggagaccacactgtcacccccaggcaaatcctgcacccttacccttctgtgctgarccctgrccccggcccactctgctggggcccttggagcagaggagggtggagaaggggatatggctgtggggtcaggccaggcctgtcactcaccagccatgggtccttacgctgggtcaccccaaagcagagccccagagccctcctctgtgcactgggagaagccacctccctcccagacgtgacccagccaccccagctgtgccgcatccagctttgaggccgcagactacacccttcggctcctgtgctgagctcccgtatctgtagaacagggccatagcccctcttgggggtaaggggctgagcctgcaggcctcacctggccatggagccaccagcgctcctctctgcccccgggtgtggggtcacgattcccctggcctctagcaggcctgggcaggaaggactgggatcccaagggtggcatccacagactctcaggaggcgggaggtcagtgcggggtgggtgtgggccctctttgtctctgtgtagccccctctcagccataactctttgccagtggcagcggtgccccctccttycctgtgctgatgccttatctgcttgtccggctgagacacacgccctcagttaaagggcatctcacgctgccatcatgtggggctgactgatgctgtgggctctggtgggggtggaagactcactgctgggggctccgctccccmctctctcatccccagcaccccacatctccccccttcagctccaccatgccaggaaagtcctttttatcgcatgcaagctgctctagcggaagcggccggagacatgtgggtgacatctccctgtgggcaggaggaagagccctgtgcgggggtcctcctgcccaggttcctgtcccagcaccgtgccgggctctccaggcgcccaggcccttccccacccctgggcctcggttttcctgggctgggctctccagcctccagggtgtttactgccctgggcagctctgacacctcacagtgtggtgggagtccccagtgtccagccctgctctgctggaggctgccatgagtgtggagaggggcagagggaatggacctcagccttggcgctggcctctgagggtttgggggccgggcctgtggcatcagcctcccacccccacccacatggagcgggaaagtcggcagaaccctgggggctcaattgctgccagagtggcggccttcagctcgaggacaagcatgtcctctggggagcccctctgcatggacgggttcaaggggcactgaccccaaatagccatccctccccacttcacctggggcctgcacctccaccatcacccaccctgggtgtggggagggggtgatgggcacacattaggattttggggtgaactggatggaggccttctctccccagaggtgaggggtccgaaagtccatttgttcgctcattcaaccactgacccggtgggcagtgggcacagtgggtgcctggcaaggggcagaggaggctggctggttcgacgatgctgccccatgcctgtaacccagcgcagtgactgctggtggctccccagctgggcatgcctgccctcctcgcctctgcgctcgcctgacgcccccatgcggcctgcaagacacagccgggcctccatctctgcaggaccctcctgcccctcgcctggccagcggagtttccctgggcttcacccttgagactgtgttgcccattgctcggccatcggtctctcgctggccaacgagtgcctcctcccacagccccgtgcacgctgcggagcctggcacrggccggactgcgcggaagcccgggaggatttgcctgcgggagaggaggcagggcgagggggctgagccgcgaaggctcagggctctgaaaasaagggaggaggcggcctgtgcagagggccaggcactgggctggggtctcggctggcaggaggcctgaaggcaccacacaggcccttccctgtcctcagtcaacagggagctggtgcggaaggtggacgggaaggctgggctggtggtgcacagcagcatggagcaggacgtgggcctgctgcgcctctaccctgggatccctgccgccctggtagggaccgccccggccatcctgcccctgcagccctgagccccagccctctgcagctcccacggccctcaggctccctggggccctcaccagccagtgcagascccgcgtggacctgagatgtctgcagtgtggccccaccagccccaggccctgtcccctgtcctccgtcgtggtgctttccagcctctcggggagtgggcagggttggggcgcggctcacagccagaacggggtcctccatgcttttctagaggcagcgtcctcccgcagattccagctggctgggagccgcccctgctgtgctggacaagggtgtttgctctggggcctctgatggccttcttggctcctctcccacctctctgaagtgtttccacggcgttctgccacacaaagccttcgtccctacagacagggcgaccctttgggagaatgtggggggagcagccccctccaggtgccagcagccatgcacgtctgccaggagccccactgtcccgggagcagagcaggcaccagctgcccctggcttggggtccctctccttgggagggcatggggcgagtctcagtggtgctgagggcagagaccctcaccatccagcccccaccccaccgccccacaggttcgggccttcttgcagcctcccctgaagggcgtggtcatggagaccttcggttcagggaacggacccaccaagcccgacctgctgcaggagctgcgggtggccaccgagcgcggcctggtcatcgtcaactgtacccactgcctccagggggctgtgaccacagactatgmagctggcatggtagtgccgggagatcagggcctagcggggaaggggacagcctgagggcctggcagaggtgggctctgacccacccctcaygggctgggggccgtggtgagtcgcccttcctgcccacacgccccctcctcacaggccatggcgggagccggcgtcatctcaggcttcgacatgacatcggaggccgccctggccaagctatcgtatgtgctgggccagccagggctgagsctggatgtcaggaaggaggtgcgggcgctctcgggctgtgggcaaccctcggtgtgcacaagcatgtcagttggctcccaggggcatgtctggggcgatgccggaagagcctgggggccggtccagggtgtgtcctgtttgggaaggggagggatgtggctccctatagtggggaagggcagctctgggcccaggctccccacagccctcactggactcccagcccaggctccgcctgtccttgtgccttctcagactgcatggagacctgaggctcccctaactgtcgccaggaaatcctctcctgctctccactcttcctcgagggtggggttcagacacagctggccccagacccttgggttgccagcctctggggctggayggaggcttttggggcccctggagaccctgagctggtagggccagggagtggggctggccttgggaggggacccagcccgctctggcccgagggatgaagcacacacggccgaggctcaggccaagggcaacccctgactgtgcccgggtagcccgaccctccaggctgtcctgggctgcccatccagccctggcagagccacttcacctctgttctctccaccagctgctgaccaaggaccttcggggggagatgacgccaccctcggtggaagagcgccggccctcactgcagggcaacacgctgggcggtggggtctcctggctcctcagtctgagcggcagccaggtaatgscgtgggacacgggcctgagtggcagstggggrctgtgcaccctcttggtcaccctgggatgcaccaggcaggcacgagcccctgtagccatcactcgagcccaaacagttaggcacacccgggttctggggcccaggaggagggtttggggtctgcagcaaggaaggtttgcagggtctataaggcaggaggcaggaagggccaggcggtgggcacacagcagggaggccttctgactggcggcgctgccttagtgcggggctgcctcgggagctgcctgtccagaagaagggcgggtgagtgggggcggtgcttgctctgggctctcccaggctctgagcaccaggggttccaggtgaggaacccggaggtgagggccagcctttgagcacgtcccctgcacaactgaggtgcccagacctaggaaggggggctttcgaggcctggggtctgcagggggatggggcctccctggaccccgcaacatgcccccttggctgctgggccaaacatccaggcctgacatggggcctggcaggccagacagccttgctccccactgtgtggggtcctgccccggcctcagtgcctcggtttccccctacagggatggacctgtcttgtgagccatgtgctggaactgccacttgctggggcgggtgatgggcagatggaaaggactggcgtgcatggcctgttattagggtggctgcatagggcctgaatgctgtagggaggcaggccagaggcagcagccttgtcaccaggccacgttgtacccgctgggtgtggtggcacctgtggggcctctgccaggaccgctgggtgtggtggcccctgtggggcctctgccaggaccgcggccttttggcrtcttggggagctcctggtgcccggtgctgggggcaggtggctcttctgggaaggtgcagccgtgggaacagggccttccttccaggggaggggtctggctctgcttcccacgctctccttatgtgggtgaccattccgtcccgacggcggtgggagcagacgggggagtctgggagggtgggtagcaggtactggccacacacccgttggggacagggctggatggtggtctcgtggcctggccttagctccaggggaaggggtcctaggtgggcctggatggggtggggtggtgaggctcaaccccaggccttccgatgtggcagctcaggttccttctcacccacgccctgggatctgcgggcccttgtgtgggggctggcaggggtcatacagcaccggggactgccagttccaccagatgccaaagggaggcgtgggtcccagggtgccgccttccccacctaggaggcagatgccctgcggaatgccctggtgcccagcctggcctgtgctgctgcccacgccggtgacgtggaggcgctgcaggcgcttgtggagctggtgagcctcccccaccctgggggcccagccccagccacgcctggcctgggggctctgaaccctgtaggcaggacggcctttcatccacccactgaccacactaagcccttgtcagccagactgggcagcaggactgtcctgccagcttgtcaggtctcactgaggctttgagggtgggcgcaggggctgtgctgggccctaccctcagagggaccccaccctccccatggcctacctggccccgcctgggtctccctcaggggtcgcatgtccttgtgttactccagggcagtgacctgggcctggtggactttaacggccaaaccccactgcacgcggccgcccggggaggccacacagaggcagtcaccatgctgctgcagagaggtgtggacgtgaacacccgggacacggatggcttcagcccgctgctgctggccgtgcggggcaggtaatggrgctagggctgcacagagctgccttggacaggtgggcgcagagaggctgtgggctcctgcactcaaacagcctcccggggctgggctgggagaggtggaggacacctgcttcctaaaggctgcccccgcagcccggggcccagtaagaccccggcccagagttcctagaaaacaaaaatgttgtggacaaagctgggaggacacggtgcatctctgtgcacctgtgggtatggggggctggggtggaggtggggcagaaggtcctggcccagcagccagacgcggtcaataaaaagcaggctacgtggcagcagatctggggctgtgacaggcaactcgggccctggaggacaggcccagcctgtgcgtgtgggggtcccctgccccaccaagcaagccctggctggtgtctcttcccaaagtccagagcagcagcagagacggagtgtgtgcctgtgcccctgcgtggggggcggggccagcactggtgggatctgcgtcccgtctccccttcctactctttattgccccagcctgggaaggccaacgacctgtctgctggtgccgctgcccggacccatgggctgctcagagatcccagggcccctggggattcctccctgtgggtgggaggacttggcctgcaggaccctgggttcttttcggggagggagtgctcaggagtcccatggagagaaggccggggtgtctgagcctggggtcatgtgaccctgacgtgttcagttgtgggttcccctccccagcggtgaagcggtgagccctggggtggggtgtggcaccttttgtgaagtgggtgactggggtagaaggttctttccagcctcctgtgatcattgacagggtgctcaaaagaataggagagaacagggtggtggacaggagggggcggggctgtgagggtccccccgagcagggctggggtgatccggactggagcttctagactgggcgtccttgggtgtgggtgggtggcgcggagacgagctcacacagtcccgccccctcgtctcctcctgactcacaggaccaggctcacagcacgcccccaaccggtctcccagcctcgctccgctgccaggctccctgaggccgcctgcctggccctgctgtgcctgagtggggtatggggaggccactgcctcatacctattcccaggctccctaaatggggtgatgggrggatctgtggtgctttgcaggggtgggggcacggccagcgattatggcacagtctttaggtcaccctgtacaatgggctgtgtggcctccggcctcgggcctttgtgcctctgctcctccttgctagagccccgaccccacccccacagactccactgtccgggtgccctgcccccactcctacccaagggcagtcggccggattgattcagtgtcccctgcgcctggctgaggaggtcaycacggggtgtgatcagcgtttgggtgtgcagtggggccggtcagctcatgtaaggctgtcctctgaaatgggctgtcccyttggaatgggttggggagactgccctgggaggagctattctgctagcaccaactaatgccctcccctgggtgctgggtgcggggctgccacagagttgaccccaccccttgcagamctcagctgccctaagaaggagtactggacaaatggaggtggtgggatcccgggatgatgtcacatgggcctaggcagaggatggggggatgggcccttgtctgaggctagggctgtggggtcttgggccggccggtcccygtccctgtgcacaggacatgagctctgctggctcctgagtgaggtgcagcggggctgggctggcsagggcagaaggtcagcatgctcattctcacacaggcatccgggtgtcattgggttgctscgggaagccggggcctccctgtccacccaggagctggaggaagcagggacggagctgtgcaggtgagtgcagctagagcacctgctcttccagggatgtgggggacacagcttggggaagcgaagccagacctgctgggagggacaagtgagtcagggtgtgggggctttcagaggcgaggcccgctgacctcagtgtgcaccaacctggctgatgggaagaggtgtctaccctggaccatgtcatggggcaggggaaggagttgttctcagctgagcraacagtccagcaagggtgtctctgtgtgcacatgtgtgcatgtgtgtatgcatgtgtgtgggtgcrtgtgtgtgtgtgtggtgggcttgaggaggggtatgggaattggttgtcgggtgtgagaggggctggggtgtggactggggggtggctggggctgcatttggggaggttggggcaggtggggcacagaggagctgaagcccctggcaggtgacaggtctcgtgagctctgttctccccagcgtggttcctgtcctgggataaactgacctaggccccgcctccacctgctggccgcatggcaccagtggccagtgtgccttccgatctcatgctgccgagtgaccaccgaggcaggctcaggccttctgacatcatgttgttgttggggagactgaggcgcagggaggccttcggcgagggtgtcggttgtgggtggaggtgggccagggatgcagggatcctcctctgtccgccacagccagaatcgctgccccccaccccatgccttgtgcctggtgacttggcgctgcctcctgtgcccagcctgggctgcccgaggccaggacgactccragggacccaaaaaggagagtcggaggcaggagacctgggccgggtgcaggtggtggctggggtgggggtgctgtgagtggyggggtctgtgcgcctgtaagtccagagtcccaggcttggggagtgggtgatggcgggggctcggctcactggctgggagggggtgggtgcaggcgcctgcccagcaggaggaggactagcagctctggcttctcctctgggaccggcccacaacccctggtcttgcttttgaagggacttcyggggtgacttggtcaagatttgcactccagacaggccttgctggctccattgacagatggggaaactgaggcagtagtcaggtcctgtgggagctgggaccagaaccctggtccaggactctgcttggaagtggcctggccagcctgagctgctggctggacttgagcccctcggctaggccttcctaggggccggtgtgtgtgtggggcttggcctcttggagcaggtccaggaggggccagtgaggccatccagcagattcgctgcagagattacccagtgccactgcagggctgctgctgtttcctgggtaggcgcagagtccctaagggccctccagaggagggggcagccccttcctcaccaggccacttcccccagcccctgcacaccatgggtgggtggagccttccctgccrgrtccccacctggcctgctcctggcctccccaggtggcgagtgagttcttcccaggagggtggcagggtgaggaggagctggtgagggcctggcaggtgctccccactccagggcaggtgggcccagacccctgtcccagccaggacccccccatgcagtctgccggggtccagggccaaccgttatcctgggttgcctcctgtgtccccctctctgaaccactgggctgcctcaaactttccttccacctttgcggaccccgccccgggaagagcggtgtgttgtgtaacacgaaactggcgtgggctgctcggcaggtgggcgtgcatatgtgtgtgcaaaggcgcatgtgctcatgtgtgtgtgcacatatgctcgtgtgtgtgtgcatgtgtaggtgtgtgcttgtgtgctcctgtgtgtgtacatgtatgctgctgtgtatgctgctgtgtgtgcatgtgtgttcatgtatgtttgcgcatgtgtacccgacttgagtcgcagtcccacccactgggtgaaaccaggctccaggctgcccgatggcccccagtgactcctgccccaggaccaggtcgctgctgggtcagctgtttggggctggctttgtaagakcgtccaggccacctgggggacaggcacgtgggcagatggacaggtgcccagcaggccccaacaactcctcctctgcccccacccccaggctggcatacagggccgacctcgaaggcctgcaggtgtggtggcaggcaggggctgacctggggcagccgggctatgacgggcacagcgccctgcacgtcgtgagtgcccccaccccctgcaccctctccaaaggctgccacctccaggaaggacacctggacaattcaccagctcactgctctgcccctccccgctctgcccctcccccaaatgcctggccctccccatgcaggacccgcacagactgggtccccttcccggggctctgagtggtgggggtgacgagagtggaggagctgctggggccctgtgtgtgtgggctggggacaggggagggcatcctggggatggggatccttgggccaggctgctagtcagtggccccaaggcagcccctccccactgcttccccataggcagaggcagccgggaacctggcagtggtggcctttctacagagcctggagggtgcggttggtgcccaggccccatgcccagtaagtccccaccccaggcggggctgacaccccccagtgagcttctagtgcagggctggatcctggctcgggggggcgtaatcaaggggaacagaaccggaggaggctgagatgggtcccagccagtttagggtctgcagagcccctcctggggatgtccagggtggaacacagtttagaggtgaggagaaggagaaaggagcagtcagggagggcttcctgaaggaactgaccagacttgagcactgagggcccagccagggctcagcatccccttacccacccctgcccctgcgccctgccccaccgggaccccctaggctgggtgcttccgcttgtctcccwggccagttcccagctgacacccccattcccacttggttgtgtggccctcccatagtctcaagctgggtttgctcaggctcttgggctgtgccgtacagacggggtgcctgggcttgtctctctgccctgccttcrcactctacctgggtgtccttctcaggagccctcatgttttcaggaagtgctgcctggtgtctaacctgaaggcgtcctgctgcagtataagccattccttcctcccatgacctgctggaggggtctcaggcatgaccccactgctggggctgcttcccagcctgctctcatgtaaagcctgaaggcctttgttgggcaggacggcaataaagtctctgacatcccctcaccaggtctgtacagcctggctctgagaggctctgtctgggtccgggactgtggatgtgtgtggggagtcaggcccaggctctgtggggtctctgcgggggtcacttggcccatccttccgggggcagctgtgcgtgtgagctgggcagggtggggtgcatggaggtgacttggccaagtggtcctttcccagctgccmctcccccttcctgccaccctgcctttgcccaggctggtccctcctccagacaccctctgcccatctccttacctcctgcgccttcattctggagcttgaagtcccctcccccaggcagccctccaacccctggatgagcatgctgcccctgcttaactctttagtcctcacagtcccgtcccagttgctgtctggttttctgtcaccccagtatcgctgcacccggcccccctctcaggccagggccacaccagggctccatagggctgcggaagcctgtgagtgtcaagggggcttcacactctggtggtgagcccctggggaccattccagcccctgctctgcctgaagctcctgatgcagcctccaccgtgagccaggccaccctgtaagggaagaggtgagctgtgcctgcctggttgcacagcctgggcaggtgggcgggtggggcgggccctgctgctgcccggtgggggtggtgctccaaggccaagggcagcctcgtgccttctttcagctggggctgaaatcgggggtgtggacccctggcccccatcatgtgtgcatgcactggcctgggatggccagggactccctgctgctgcccccagcccctgaccccttcttgctgggtgtgaggagcatgggggctgcctccctccaggcctctctacctgcccaggtgacggttccttttgtccctctgtttggctggcctctggactggagccccaggagggcaaaagcatgaccccagagctggcccttggcacctgggcataccccaggctcctcagcctggttcccaagcctggctggtactgccgctggcatccttgctgtcctcaccccgacacaggtgtgcctgggccttgcacaacaaggtgacgccatgcgagcgtggcagggccggggaagcctttgctcctcaccctggtgaggcccatgaggggctgcaggtggagggagggtggcaccgggccccagagccaggagcccctgctgtccccggatggccgagacccttggagggccttgggagaggcggtggggcatctggacaaatgcctggtgcaggtgagaaggggtgggactacctccggcatccctgggctgagcccacctggtctccccggttgctcctgcacayggcagtgcccacctgcttccctcagctcctgaggggctgggcagagcctgttgctcacgccaccccactcagtgctgctccgggttgtgaaagctgcaggtggctcacgttagcccacatggcagcaccctcccagagcaggtgccaacctgccagtgtagacacaccgactgatgccgggggtgagtgtcctgtagtgtagaaacgcccactcatcctgcttgtcccgcagagagcatttgtcaagctggcctttctccaactgggtcactgatggagttcggcagagacggcttgggggccacgggctgggcagatggggagagctcctcacaaggctgggcagccagacccccattgtcagtcccctccaaaccctcgtgggatgtagggccctaccacagggagccccgggactgggccagtgtctcaggaggctgtgaagagtcataggcttgagtctgggagctttctcgggggccgttttgtgccccttggggagaggccagaggggccctgggtaaggggactcctctagaatcacccagaagtggcaggaggtgcagggccactgctcggggctccctgggctctgagctgggcagtgacctggccccaaggcctctggctctctggcgtgcagtgggaacagccgggacagacaggcttggagcgttcgtgtcctgcgccgcgttggtgtgtttcgtccccactgtgcctgtaggagggcaccgggtccccgtctatcctacttcatggctgaggaagctaaggcacagagtggccccgtcctgcgcccagggctctgcgttggcacagggcagagctgggctgtgaatcagggccgccttgtctcttgctgtggtgtgaggctgtgggagactcaggaatgaggcacagccaggtgcccagtgcccgtgggacccgcctccccacagtggggtggcgccgctcacacctggtaatttcacgctgggggaggccttggttcctatagcccatctcgaatcacctggatcccagggctatctctggggaacatctcctctccatcacgactactgtctttttcaccagcattttctatcctaaaatcagactcctcagctgagggccctccaggaccgcccttccccagctggaggtaaccagatttctcgtgtatgctaggaagttccccttctggtcacacctcaatatttcctgctgctggtgggaactgcaggtgcttgtacttgtcaccttctccccgtcctctctcgtcagttcccttggatgctggacacgggagccacctgggcgaggggagcccatccaagtggctgtgcgtcgggaagagtctgcccaggactgggctagaccagagcttagaattaaggagtggtggccaggcttggtggctcacacctgcaatcccagcactttgggaggccgaggcgggtggatagcttgagcctaggagtttgagaacagccaacatggcgaaactctgtctcttaaaaaataaataaaaacattagccaggtgtggtggtttgtgtctgtggtcccagctacttgggaggctgaggtgggagaatcgcttgaactgggaagatggaggttgcagcgagccaagatcgcaccactgcactccagcctgggcaacacagcaagactaggtctcaaaaaaaaagaaaaaaaaaaagaaaagaagagaggtgggttcttcttgcccatgcagttgtgttgggggaggagctcccaagctcctgttcttgatctcaagctcccctatgcccacttccatccccacccccatgccgcagcccctcggactccacacccaggcactgagacccacagatgcagcgatggcaaggcctgtcatcccttctctaccaccaagagctgtgcaatccccagaagtcactgtccctccctgagcctcagtttccccaactgcaaaatgaaaataacaaaacctttctgattccctttccagggtggctgcggtggttgagccacacgcggcccatgtggaaatgtctggggggtccctcagatctggtggctgtgttctggtctggggctcaccttggctcctgagcacttggctcctggctggctgggcgggtggtgggatggcgtgtcaccgccctgcactggaatgaatggtcaccaccctgctgcccaaccccatacagacacactaatggctccagacttggggcaagtgctgaagggggctctagggtatttcctagagcctgagccctcccctcagctgccatgttctgctgaagcagagtccctgggaggcgccactggtcaggcctggacacctccaggtgactaagtgggtaggaccggcagggccagctgcgccaggacgttcggggctgggctgtgagtggggggagcgaggctcaggcccttgctgcgtgagggggtagggcgtccctccccccgcgtgggaaatgaggaggcaggtacggggctacccctgtgggctgcggggtgggggttcagggtctgagaagcagaaacctccctccctccagtttcactttctctttacccctccccttccccctcccacgaagttccctttgaagtgagaggggctggggtgggtgtgtccagcccagcccccacacccaccggagagctagcgcggccctgggctcctgtcgggcgctggtcctcacctgttccggccaccctgggcctcgacccggccaaggtggagccccgggccctccgtgcgcccgagcacccccggcccagacgagacggttcgggcgtggcccggcggggacccagaacccgggaggccaggtgcgcccaggccaggcgctggaggctggggcgccggatggggcggggcggccgctgagtcagggccacccccgcgcgggcgcgcggagcaggtccccgggccgtggaggatcagtcgcgggacctatgggcccgggagccgccccgcccggaaaaaccggtcgggccagcgcggcgcgggcacattccggcgccgggaagggcggctgcgccgcataaaaggcgccgccgcgctggccaccgccgctcggagctcagccgccctgccacgcggggcccgcgggacgaggggacgccggggccagcgaggacgcggcggggctgggcttggcggctgggatcccccagcgccaggcgagggcgtctaaggcgtccggtacggcgtcggggccgggtggctgcagcagggcagggggtgcgcgaccagcggggatctgggcgcaggggccggtccccgggatccgcaggcgacgcgggcggtcccaagggcgtcgggggctcctctctccgcagctcggcgaaccgacggtgttggggactcgcgcgctgggtccagtggttcttaacagttcaacagttctgtagcgcaattgtgaaatgtttaggaccactagacccggcgggcgcggcgacagcgacggagcgtcccacgcgcggcctggagtcagagtcacagtcaggggtgcgccggcgaccaatccaggggagcccacggaccggctccgcgctccaggtcggccgccccatgcgccgcgccccgcagtccccagggcctggctggctccacctgctgccagggaagaccctcggccggagagccaagtgctgctgggaggtggccgggcgtggccgggctgtgctgtgggaaccgctgggtgggggcgcgctgggttgcccacgctcctggcgcgctgccggcctggagacgccgccgccgccctcttgcaccccgagggcccgcacctcgaaactccgtggaattcccagcgaggaactggcggtgggcccgtagggttgaggagcgctccttgccctgggcttcctgggagctgcccatcaggctgccggcagccgcaccctgctgggcggccgatggttcccgctgccggctccccggagcgtctccactcactgaggccttagggagcgctgcgcggctcctacgagtgcgcgctaaactcgtgaaggacctcgaggcacaggaactgggggtggggaggaagtttgcagactacacccaggtagaggagaagcggcgcccatgatgacaggtgccttcgccggagcctccctggaacctcgtggtagctagcgcccacaggagaggtgtgcgcgtcaatctgcgtgtgaagccccgggcggccctgggagggactcagcaaagggtcgaatctgtccccacctccagccaggggccggggtcttctgcctggtgctgcctggcctgctgtgtcctctggggtggagggtccccctccagtccccacctcctcacccagtgtttagagagctgcggggagtcctgggagatgggtcagacaggcctgggtttgaggcctgctagggtggccttgggccagtcacctgccctctctgagcccgacctgcacacatagggggttgatgtgaggagacaggaggtgactgtggagggctgttccagaagagggccagcagcaggacagcaaggtcccctggccacccaggtggggggagtggagttcccgggagagcatccaccactggccagtgcctcc

SEQ ID NO: 12330 - DNA, 201990 bp, Homo sapiens
  misc_feature (1)...(201990): n = A,T,C or G, or insertion/deletion polymorphism (see Tables 1-2)
ttaggagggctttggagaatggtttgctcatggtggcttttaaaatacactgagggttgccaggctgaatgggatccctgcggggctggtgacctggttctaggctggtgctcagcagagctgcctcctggtgggttagtggacttgttaaacatagttgcctctcctattccctgttcttgggggatgaagaagaaagtcttgtactctatcccttcccattctaaaattggggtaacggaggcccaagagagtaataatataagaaataagagccaacacagatcactttatgttaacttgtctacaaatgtcaaggggaggaacatcatggcatagtggcaagaaagatatagttttagatcctggtttttgccagtctgaaactgtgtgaccttgtgtaagtaagtaagcctgagactcagtttccttatttgtaaaatactgatgatgatgcctattatacagcattgttgtaaggagtagaaataatggatgtaaagtacctggatgagtgctggcatccagtgggtacctgataagtggtctgtatttatttatttatttatttatttttgagatggagtctcactctgtagccaaggctggggtgcaatggcacgatcttggctcactgcaacttctgcctcctgggttcaagtgattctcctgccttagcctcctgagtagctgggattaccggcatgcaccactacgcccagtgtgtttttgtattttcggtagagacagggttttgccatgttggccaggctggtctcgaactcctcacctcaggtgatctgcacctgcctcggcctcccaaagcgctgggattacaggcatgagccaccgtgccctgccttctttcctttttttgagatagggtctcactctgtcacccaggctggactgcagtggtgcaatctcggctcattgcaacctctgcctcccgggctcaagtgatcctcccaccttagccccccaagtagctgagaccacagggatccaccattatgcctggctaatttttgtattgttttgtagatggggtttagccatattgcccaggctggtctcaaactcctgagctcaagtgatccgcctgcctcggcctcctaaagtgctgggattacaggcatgagccaccatgcccagctgtaaaatttttccttttagagaacagggtcttgctgggtttgccagactggagtgcagtggctattcataggcaatgaccgtggcatactatagcctggaactcctgggctaaggtgatcctcctgcttcagcctcctgagttgctgggactacaggcacccagcagataaacaatgttttgtaatcatgcctgacagtaagaattttccaacggctagttaaaaatacagattccctggccaggtgtggtggctcacgcctgttatcccagcagtttgggaggccgaggtgggcacagatcacttgaggtcaggagttcaataccagcctggacaacatggagaaaccccatctctactaaaaatacaaaaattagccaggcatggtggcgggcacctgtaatcctggctactagggcagcagaatcacttgaacctgggaggtagaggttgcagtgagccgagatcgggccactgtactccagcctgggtgacagaacaagactttgcctaaaaaaaaaaaaaaaaatacagattcccaggcttcaccctctacagtctatggaaaggcatgggaatctatattataacaagccattgagtttctttttctttttctttttttgagacagagtcttgctctgtcacctaggctggagtgcaatggcgtgatctcagttcactgcaacctccgcctcctgggttcaagttattcttctgcctcagcctcctgagtagctgggattataggcgtgtgccgccacccccaactaatttttgtattttttagtagagacagggtttcaccatgttggtcaggctggtctcagactcctgacctcatgatctgcccaccttggcctcccaaagtgctgggattataggtgtgagctggcactgggtggcttctatgaggaagttttggaatgcatccaggagccctccactccaggttcttggtttattagccttttggtcctctatttatctagccctctgttcagtaaagctttaggtttgtttgaaggagacatgattagaaggtcaaatattgtatattctcaaggcgaatgtgtcctgaactttgcatagtagaatttattcctgaaaagttgtttgcagatggaatttgttttgtgcgtgagagaacaggcatatacagaataccttagtttgctatttaatttaaatcaatattatctgagtgactgttatttgctgaggatacaatgataaacaagatgcagaccccatcttcaagggtcttagagtccagcgaggaaggtggtcaaataaacaggcaattacaaaattgtggttagataaggttaagcacagggagctatggtggatggaggaggaagtgcacccaactcagtgttggggcatcttggaatttctaggtgaagtgacatgtgatggagaaacctatagactggaatatagtctcaaatccattgcaaagggaatgatccttccccaacttatcttcgtggaaaaataaactttctttctttcttttttttttttttttttattgagatggagtcttgctctgttgcccaggctggagtgcagtggtgcgatctcggcttactgcaacctccgcctcccaggttcatgccattctcctgcctcagcctcccgagtagctgggactgcaggtacctgccactgcgcctggctaattttttctacttttagtagacgggatttcactgtgttagctaggatggtctccatctcctgaccttgtgatctgcccacctcggcctcccaaagtgctgggattacaggcgtgagccaccgcgcccagccgaaaaataaactttcacatcatgttacccctggatacatttttgtggccatgcatctgcacgaatattcaatccctgctacaggcaagacactgagtgggaygttgcagggctaccaaggtgaggaggtcccaacccctgtcctcaaggagttgatgtaacacctacccaggattaatttcatttctctcagaggtcattaatccagtgtgatctgtttatggctgaagaggtagtttattattcaggtcttcactccctttcctgaaaaggctgtttattttgtttcatcactgtgcagtggcgaaatccagttccaaccaatacttaagctgggcatacattttacccaggagaaaactgaagggcgtgcaggagttcacagagctgtttgctgacccaagccatgaatctgtggagacctgggtcggtcttcagggttagtagggtctgtagggtctgtgaggatccgaggcagcctgcagacctactatcatcttctttttcttttttataattggcaatcatccttggctacccagtagcatcttttttttttttttttgagatagagtttcactcttgttgcccaggctggagtgccatggcgcgatctctgctcactgcaacctctgcctcctgggttcaaacgattcccctgcctcagcctcccgagtagctgggattacaggcatgcgccactacacccagctcattttgtatttttagtagagacagggtttttccatgttggtcaggtggtcttgaactcccgacctcaggtgatccgcccaccttagcctcccaaagtgctgggattataggcgtgagccactgtgcccagccccctggtagcatcttaaatcaagctttccttccctctgggtatcatggacatgaacaccttttatgtctctgcctcaagaggggaggaggcacagaggaacaaaaatccttgtgaattatgataattacatagtgtttaaatgaagggtggcaaggtgtgtaagtccataggtaaggtttcttttttctttttcttttcttttttttgagatggagtctcactctgtcacccaggctggagtgcagtggtgcaatcttggctcactgcaacctccgtctcccgggttcaagcgattctcctgccctcagcctctggagtagctgagattacaggcacgccatcacgcccagctaacttttgtatttttagtagagatgggttttcaccatgttggccaagctggtctcgcactcctgacctcaagtgatctgcctgccccggcctcctgaagtgctggggttacaggtgtggtgtgagccaccacgcccagcctcttcttttttttttttttttttttgagacaggttttcacgttattccccaggttggagtgcagtgttgccatcttggtttactgcagcctaggttcaagccatccttgtatcggcctcccaggtagcttagtctacagctgtgtgccaccacacccggctaatttttgtagaaactgggtttcaccccgttgcccaggctggtttcgaactcttgagcttaagtgatctagtcaccttggcctccggaagtgctgggattacaggcgtgagccatcgtgcggcctggcaaagtttctttatcctcagtgcttgtctgggtgtgttgtctggtgggaaccacttagaccctgtaagtgaatgtgtattcccatcttgtagatggtaacctgaggcccaacgggtgtctggaggtagtgttggacacctcgtggtctgcatcttgctgcacacagaatccagcctagactcattatcctggcctttgaagtctcccccagtatgaatcccccagcctcccattcctgtttctccgaaggccaagctcgaagcatctgctgcctcgtttctgccaagttggccccacctcctgagacacttctcccctctactggcctggtgaaactcaacacatccttcaaagcccagctcaggtgtcacctctctcctggttggaattaacctcttcctccttagcactctctggtttggccctttctcttgcggcttctcctgggcaagtggcatagcctccctgatcctagtgtcttcctctgtgcatgggcacaggagtaatatctgctgtgatctttaactcctgtcagttcattgacctctttaacaacgtgatgaaagcttccagaagagctaatgtatgtggagtcccacgatgtgtcaggctaggtgtttaggactttactaactactgtctcgtttaatcgcgaatgcagtggacctctctctccacacgtcctagtacgatctttatttcacacgggaggagaggagggtgggtggggtcggccagagaggagaaatgcgtctccagagttcacagggctggtactaccagcagagccccgtccaccatatgccacagctggggttctaatccctggactggcttgtactgggctctctgcctccctggccggcgctcgggggctgggggacagaacacaatgtacagcgtgccttctacaatttcggggttcacgcacccccaagcccacccagggccaggtcaaacgcgccttcgccgggttgctgtctacaatcaggcttggctgcgctctcagtaggggtctcggtcaacctctgcccacccgaacccggcgccgtggacctggtgtgaggctggggagcccgtcctgaggggtgccggctcgaggcgctagagccacggagcctggtcccgggctccaagtcccaggaatgtgggagggctgggcggaggggcgggcgaggcgggagcgcttcctctgcccgcgggaggggatccgcggccggctcggagggggcgggggcagcggcgggcggcggcgaggggctgcggagctccgcagccgccgggccggccggggcgggaggaagcgatgaatattcagagggggaggggaagggagggggccgagcgctcgccgcggctccctgcagccccagccgcatgacgcgcggaggaggcagcgggagcagccgcgggagccgggaccgggtagccgcgcgctgggggtgggcgccgctcgctccgccccgcgaagcccctgcgcgctcagggacgcggcccccccgcggcagccgcgctaggctccggcgtgtggccgcggccgccgccgccgctgccatgtctccggggaagcccggggcgggcggagcggggacgaggcggaccggctggcggaggaggaggcgaaggagacggcaggaggcggcgacgacggtgcccgggctcgggcgcacggcggggcccgattcgcgcgtccggggcacgttccagggcgcgcggggcatgaagccggcggcgcgggaggcgcggctgcctccgcgctcgcccgggctgcgctgggcgctgccgctgctgctgctgctgctgcgcctgggccaggtaagcgccgggtgggctcgggcggggggcaggaggctggggcgggactggcattgactgcacctgcccgagcgtacccccccggggggttccggggaagggggcgggggtccggatccccggatccccggaaggcgacttgcggggaccccggccggcctckcacgccggcgatcgatcccttttccggctgcccaggatcgggggagagaggcgggatccgggtgccgcggtgcccgagcctcccggggaaagcctccgcgcgggctccaggccgtccctggcccggctcttcccggcgctgggcacatctggcgggcacgggcccggcttcctagccggaggcggccggagggggcgtgtttgcggaggtctggggacgcagagccgggcggcctggctgagcctttgccgacagacctccgacccggcctgcaggggcccgaggggcggcgggggcgacagggcagggccaggcgctgggcagtggggccctgggcgaggcgcgggactccgggccgagggccctgttcctggggaaagttcccaggccggggaaaaggtggccgcacgctggcttttctcaaggcagccggccctcttggcgtcgtgcttgatttcatgggtgtttaatwygtgctttgtgggcgctggctccccctccccaccccaccctcaccctcttttctggcttcacttttcagataatgctgtccctggcgttttggtgaccgacctttccccttcctggcatttccataggggctgaggcagagcagytgaaggggcattcccatttcacagatggggaactgagggagagaagtgaaakagcggagcacccagcccgtgccatgggagctgagccagcgggcacgtcctcttagcctctggagcctgttggggtttgaacccgcaggggaagcggtctagggctgccttgctgtgcgtttctgcaaatgaccatcttgcttgttttatacagacaccatctctgaggaaatgagttattggctggggatggaacctggtttcagggaaaacttctccagcgcgaatacaggagagagcagaagcatcaccctggggcagcaatgccgcctagcaggctgtaggagaagggggctggggcctgggggctgcgtgaccctcggcacccaagggtctctcctcgcagtttccccagcaggttctgcacaggctctcctgggggccagaaggcaatgtgacctcctgcagagaacctgggagtagatgtcaggagactggctccagggccgggccacagggctggacttgctcttcaggcttctctaccctcagttaaccgcatctgtagaatgagtatagcaccctctgcccaatggaattgtttgaggggcttccactggccaatgtctaaaagaactttgtaaatattaagggtttccacatgggattctcattattaaggtacagtgcctgtgggggctgtcttctccctgtccatgtaaggaaattcagggaagcagtgtctgaagttaaaaaagccttgtatttgaagatttcttgtatcaaaagtttatgctaaaacaaaaaccacaaaaaacagaaaacccccaaacttaaagcttcatttatttttaaatgtataatatatgtaattttttttttgcttcagcaaaaaaattttaaattatatatatataaaatttatttatttttgctccagccatagtggttgctagctgtgttctcaatcagcaaaaagtttcttgggtaaatttattgcttgctcaatccttccttgtatttcattagcatattgccactctacacttgtcctgtatttagatatttccttcctctatggtttgttctgtagaacctcaaaaggactctcttatttcttttttttttggacacattatgaaataggaagtctaaaaggctcccagaagaagcatcttcaaaatccacattcagcagttcattttgataatggatatttcagggaatcagtgcatttttgagctggaccagactttcaagayagctgaaacccctcagagctcttagatgaggatattgatgtccagagaagacagggagcaggctgaggtcacccagcaaggtattagagaagacaagatgggaacctgggtcacckgcctgggcctcatattttcaaagtgctatttttttttttcccgtgttttcactttgatcttacttttaatgatagggacgtatcactgtgtcttctcaaaatggtgggtgtgaatggaatttttcaaagttgaatcaatttgagatatttctgaagtttgtttaggaaacaagtatgtgactaccttcctaagagctgactggttttttgaggcctggattgtgtgtgtatgtgcttatgtgtgtgttataaaatggaatcaactataccaggttaaacaaatggacaagtcatggaaaagacacagctctgtttggacattaataagggcgggtgtggaagctggaaagctgagatgccggaaggctcagtgcttagtaggcccggaaaagcaatttttgaactggcatctcattccccttttctaagacaggaaggacggtcagagatgattccaacatgaggactttgctagttgcagtgtctgactcctcccattctcatagcagttttgcacagtagttttggtttgtgtgtatgttttaggcaatgtgacaaagcagttttcctcctgcctccttgagaaatttaatcctgacaggttctttaagaaatcagcttgatgtgggctgattttaaaagaataaatgaaaaaaaaaagctggtgactgatagctgttttattggtcttgtagtgttttggttttgttttatcttcactttcttgtttcctggtgaataataactgggtttattatctctcatggctaatccttaagcctgattccttacctgttccatccagagtacaaagtatattttgactcctctttaaactgcttgttagattctcatatgagtgactttaaatatttttgttttgcttcaggacaacgggaaaaccaaacgattatgttttgtttgcagacagtttacgaaaacagcaaattggtttatggttagaccgtgactttgagctgacttcaagttgggccccacgataaagataaccatggaatacccaagctttcctaagcagagaggatcctggcttccaaatgagcaattttggtcagcaaaggggttatttagctcctaaaagtaatttttgcttgaggttggggctgaggcagagtggctgaacaaccgtaggcctgggtgtagccagaggatcatcagtaattacttctcagttcattcacttcttgggctagggaattattttgagtgcaggataagaggcaattttctgtgtgtttcccttctaatataatgccactgatgatattataattaataggtaacattatgcatgacaggcactgtgtgctaagggttttaatgcattatytcatttggccatttcagaaataccaagaggtaggtgctgttcttgtttatttgtttgttttttttttttgatagggagtcccactctgtcacccaggctggagtgcaatggtgcaatcttggctcaccgcaacctccacctcctgggttcaagtgattctcttacctcagcctcccgagtagctgggattacaggcgtatgccgccatacctggctactttttgtatttttagtagagatggggtttcaccatgttggccaggctggtcttgaactcctgaccgtaggtgatctgcctgccttggcctcacaaagtgcagggattataggcgtgagccactgtgcccggcctttttttttttttgagatgaagtctagctctgttgccaggctggagtacggtggtgtgatcttggttcactgcaacctccgcctcctgggttccagggattctcctgcctcagcctcccaagtacctgggattacaggcacgtgccgccatgcccagttaatttttggatttttattagagacagggtttcagcatgttggccaggatggtcttgatctcctgacctcatgatctgcccacctcggcctcccaaagtgttgggattacaggcgtgagccaccgtgcccggcctgtttttgtttttaagagacagggtcttgctttgtcacccaggctggagtgcagtggtacaaacgtaattcactgcaatctcaacctcctgggctcaagggctcctctcgttttagcctctcaagtatctgggactaaaggcgtgtgctaccattcctggctaatttttttttttaatagagatggtgtctcgctatgttgcccagtctggtcttgaacctctgggctcaagtgatctgcccaccttggctccccaaagtgttgggattacaggcatgaaccactgcacccagccatgtttttattttatctgagagaaaactgaggttcagaacttaactgtrtacttctggaatcttcacagagaaataaaaaaaaagaaaaataatttactatagattcattaactactacgtggcggagccagggctgatgtctccactgccccaatttaccatcctgtgctgtaaaaagtcatggagaaggttttctgtgtgcagctaagagaggaggtggcagacatttatttatttatttatttatttatttatttatttatttatttatwgagacgaagtctcactctgttgcctgggctggagtgctgtggcacgatctcggctcactgcaacctccatctcccgggttcaagcgattctcctgcctcagcctgctgagtagctgggattacagacgtgcgctaccatgcgcagctaatttttgtatttttagtagagatgaggtttcgccatgttgaccaggctggtcttgaactcccaacctcaggtgatccgcccacctcggcctcccaaagtgctgggattacaggcctgagccaccgcacctggcccagacattttttagacagtcttgctgtgttgcccaggctggactcgaactcctgggtccagttgacatccctcttcatccttccaagtagccaggactgcagggacatgctacctttattttgggttctttgtgtcctaaaccctgtatgatctgctccatttgtaacacagagaacccaggtgccctctttcctgcttatatttctttggggcctcagtttacaaggcaagtctgcctttgtggagatagactggggtctgggatggaaagacctgggtttgggtctttgctctgccactgcataaactcagcaagtcacttaacctctgtgacttctcatttccttatctggaaaatgggactaacacttcctgcttcactgggtggttgagaggatcaaataagatagaaaaggaattgctacgtaacacctaaagcaaggcccaactgctagttgtggctgctgctgttacttggagagaagaaatgaggccccagatcattagttcatatgacaattttttctttttttaagacggagtctcactctgttgcttaggctggagtgcagtggcgtgatctccacttactgcaacctccgcctcccgggttcaagcaattctactgccttagtctcctgagtagctgggactacaggcacgctccgtcatgtctggctagtttttgtattttagttgagacggggtttcaccacattggccaggctggtctttaactcctgacctcaggtgatccacctgccttggcctcccaaagtgctgggattacagtctgagccaccacgcctggcccatatgacaaatatttatgaagtgttttccacagagtagtatggaataactctgggtgtgtgcaagatgaactgagctcagtcacaatacttttttttcccctaatgttaagaattattggctgggcagggtgactcattcctttaatctcagcactttggaaggcagaggtgggaggatcaggtgagcccaggagtttgagaccagcctggatgacaaagtgagaccttgtctatacaaaaaattagctgggcatggtggtgtggacctgtggtcccacctacttgagaggctgagttgggaggatggcttgagccctgggaggttgaagctgcggtgaaccttgatagcgccactgcactccaacccaggcaacagagtgagaccctgtctcaaaaagaaaaaaaataaaaaataatttattttagggggtcttagtaaagaaagacccccaaaagtccatgattttataggtcgaatgaggtgaaaagtggtatcatgataaataaatttgtttaaatatcataaaaagttggtctaaagaaaaacattgggtaaataattatgtgagtatgatgtggttatgaccaaattgtaaagatgatcagtttcttaagtctgggggacaggcactgagcagaggccgtggtggggaacaggagcctgtcttcatggctcttactggccactgggcaagactcagatagyaccaaccaaccagtcacagttgtgatgtaggatgtgactgtgaatgacatccctgctgccygcttcagagaaagggctgccacttgccagagaaggaatggtgataatgagggacagccagtccctaagtggagatccctgaaagtggtgaatatcttagaccagagaagcccagagcagtttttttaccaccttgtatggctggttttccagtggctttactggtgccccctcggaggacaggggctgtaggaagtttgttattacttccttattagtgacagctgcagtcatcctattgtctcagaatttccctggcatgtaaatggtaggataaggggtggtggtaagcagatggggggcattttgaaaacgaggcagtgtcagctcccacagaaggtctaattttaaacatgcaaataattttcagttccacttttccttcttcctgttagagggaagytgtcccctgttgccatttctgaaacttgggcggacaatgtcgttattgtgttacaaacgatttgcgtctccagggcaggagttgggtgatatttttctgggagcctgtgccagggcgtagcccagtgttatctcatggtttctgagtgaatgagtgagtgagtattaaaacttcatatcaacatggagcctataacacagtggttctgaatctttcttgggggggaaaagaagagatacaagacccctagagagtatagagagtatgtaaaagggaagaatccttccccaaaagggaatgcacatatttacaatattgtatccaatttcagaaggtttttttaaaatttttaattttattgttttttttttgagacacggtctcagtttgtaccccagcgtggagtgcagtggcatgatcttggatctcggctcactgcagcctctgcctcctgacctcaggtgatccacccacctcggcctcccacagtgctgggattacaggtgtgagccaccatgcctgaccatgactagtgttttgatgtgtggatttactacaatttatttgaccattctcctatcaatggacactttagttgttttagtacacctccctgtcccgtcacaaatcatactttgtaatgtttctggtggatatttcttgtaaccttcacaagtttatctgtagagtaaatttctagtttcaggattactggattggaagatgcatgcatttaaaagtgtgattgctgttgtcaggttgtcctccaaaagtgtcccctcagtttgtacctgtatccataggtttggagagtgtctgtttctccataccgtctcatctgaaatgaaaatttttacatgtttgctagtctgaaaggtgaaaaattgtatcttgttttttttttttttttttttttttttgagacggagtcttgctctgttgcccaggctggagtgcagtggcgctgggctcactgcaagctccgcctcccaggttcatgccattctcctgcctcagcctcccgagtagctgggactacaggcgcccgccaccaagcccagctaattttttgtatttttagtagagacgaggtttcaccgtgttagccaggatggtctcgatctcctgaccttgtgatccgcccgcctcggcctcccaaagtgctgggattacaggtgtgagccaccgcgcctggccgtatcttgttatttttatttatatctttaattttgagttagttgagttttttggtcatttgcctctgcttcttcttctttttttgttttctttttttttttgagacagagttttgctcttgttgttcaggctggagtgcaatggcgtgatcttggctcactgcaacctccacctcccaggttcaagtgattctcctgcctcagctttctgagtagctgggattacaggcgtgtgccaccacgcccagctaattttttgtatttttagtagagatgggacttgttccttaggaaccatgttggccaggctggtcttgaactcctgatctcaggtgacccacctgcctcggcctcccaaagtgctgagattacaggcgtgagccactgtgccaggccccattttttgttttttggttaactccctgttcattaaaaaaaaaaaatctrtatctatagatagatagatatagatataatctttgttatcaatttgtataagctctttggaaattagtccttcgattgtcatttgtattgcaaacacattccccctcccccatgccaattattttagatgtagcacttgttccttaggaactcagagataaataagaccctagggtggtgaagagagcatagaatttggaacaagactcctttgttggagtcttggctctaccacctcattagctgtgtgatcttgggcaggtatcttgacctttctgatccttgctcttcatattccaaaaatgctaataataggagtacctctgacacagggtagttggagaagctaagtgtgatcatattatgctaaaattccttgtaaatggctatggaaacataaacacagcattttataaaataccacgaggtattccatttactgaagagttacatcagaagagtatttctgattgtgccactgcactccagcctgggcgacagactgagattccatctcaaaaaacaaacaaacaaaaaactagccagtcatttataagaatgagttacagctataggtgcaggcggtaaatactctccaagatatctaaataaattaaaaggctatgtagagaacaatgtatatataatgttacctttaaagtgacaaaaaaaggtgaatatagatacttgtgtatcagaagagagaggtattccatttactgaagagttagggcaaagaccataatattgtaattatcaataattatgaattgtcaaaattatgtcatgaaacctctttttttcttttttttgagggggagtcttgctctgtcacccaggctggattgcartggtgtgatcctggttcactgcaacctttgcctctgaggttcaagtgattcttctgcctcagcctgggattacaagcatgcgccaccatgcctggctaatttttgtagttttagtagtgacagggtttcatcatgttggccaggctggtctggaactgctgacctcaagtgatctgcctgccttggcctcccaaagtgttgggatttttttttttttttttttggagacggagtctcacccagtcacccaggctggagttcagtggcgcaatcttggctcactgcaagctccacctcccgggttcacgccgttctcctgcctcagcctggctgggactataggcgcccgccactatgcctggctaatttttttgtatttttagtagagacagggtttcattgtgttagccaggatggtctcaatctcctgacctcatgatccgcccgcctcagcctcccaaagtgctgggattacaggcatgagccaccgtgaccggcggaaagtgttgggattacaggtgtgagccaccgcgcccggccccatgaaacctcttatattgggtttgagattaaatccacaatggattgtgtgtattatatatacacacacagacacacgcaaatgtattaaaatgtataatatgaagcagtggaacttccctgatagcacaatttaaatatttcctttttgacaaacgtgcatagttaaataaattaagtgaccaccaggtgtgactgaagagtggccagtgtctattcctagccccgaaggagcacagggatattgactgtgtcccttaaaaaaaacaaaacaaaacgtagggctttctttgtattggtttgaacatttctctttatcttgtgacctggccaactctggctatggctgcctcctgtctctcggtacattttctgtggcggtcaagaggagttattttaagccaccaatgggaaagtttaaagacataatccttggctgtaattgcgggagacgggaggctgagagtctgtgctgacttgccacctgtttccacggcagcaaggtgattgtgcatttcctgctgctggctgaggggccagcaaattttcatgtcgttgtgtcatggggaagttttcctgtctcaatgagagcacaccgtgcttgtggtcttgttcctgtgaccaggacatggagaactatggggagattgttctgggtgtgaagggaaattgctggccagtgcttagtgcacgggctttggagtcagagccaacttctccacctcctacctgtgtgaccttgggcctatccttctaatgcttggagtctcttctgtcctcatctgtatgatggggataacaagaatacctactttataggattgctgtggaggattaaatggatctgcatgacaaatgcttagcatgaaaaaawccctcaacagatattggctgctattttattatcttattgtgctgagacactggcataatttacaattcaaaaattaaatttttttaatcttatactgtagtttacaaggccctttcacatatatgagcttgttcaatcctcacagcgtccttgagtttgtcattgttattgccatttaaaaaggtatgactcagagtggctgtaattgacttgtccaattcaggtttcatctgtcttttgcagaataataatcatgtacgttcatagtataggccacctctttttttttttgttttttaagacatagtctcgccctgtcacccaggctggagtgcagtggtgcgatctcagctcactgtaacctccgccttctgggttcaagcgattcttgtgcctcagcctcctgagtagctggcattacaggagcccgcccaccatgcctagctaatttttgtatttttagtagagacagggtttcaccatgttggccaggctggtctggaactcctgaccttgtgatctgcctgccttggcctcccaaagtgctggaattacaggtgtgagtcaccgcgcccaagtataggccacttttaagaattactcagagttagcttataagaggcgaatcagtggagtcctccagtttggttcacacataattattaggttgaaccatataaagttactgtttttggtcctgtgaatattagtatttatatatggttccaatctgatatgttccagaaaatacacacttaagtaaagtttggaaaaccaaatcatagacttacatactgtaaggcggtgtatttgaaactgggatgtaaaatcaatttagtgagttatgacctgcattaaaaaaatggtagaatatcagagtttgctggtaagtattgtaaaaataccagagtttgctggtgagtattgtccatttcagttatatatgtgcgcacgtgtgtgtggtgtgtatgtgtgtatactaaattgcatataaaatgaatttcttatcatgggttcacctgttgccagaaaacactggaagtcactgttccagggaatggaatggtggaagatgcctggtgggggatggaggtggattctgtttccagacacagtaaaaaaaaccagtataaagtccccaattatgcattgtcagtgtctctatgtgtagctggaaaccattcctgcagcaggtaagcaggaagaaccaaattgtcgagaggcacttcaggaagggaagtgggccgactgaaagctttggaggcctgcctttaagtagctgcttttctggaaacttcagggtgaccagcctagtgaacaagctatgggtcagcgttgtgtgttcctttggtaaatggatttggtagagagctaacactactgcatttgtagtttatttgtttgtttgttttctttttgagacgagtctcactctgtcacccaggctggagtgcagtgttgcgatctcggctccctgcagcctccacctcctgggtttaagtgatcctcctgcctcagcctcctgagaagctgggattacagatgtgcaccaccacacccagctagtttttgtatttttagtagagacggggtttcatcatgttggccaggctggtgttgaactcccgacctcaagtgatcctcccatcttggcctcccaaagtgctggggctatagggctgagtcaccgtacccagcctgcgtctgtagtttaaatgataacttaatgaccaccatccagtagctgaggctctaagagggaggtctgaatagtgggtgactcagctcagccctgcctgacctctagctctaggctgtgctgtctctaggctccggcactgatttgcatgggcctgaatgaaccttctggagattgttagcccaactggctgaaggatcctgatccccaggttaatttgattcccatcaaacagttcatttttttttttttttgagaggcagtctcgctctgttgcccaggctggagtgcggtggtgggatcttggcccactgcaagctctgcctcccgggttcaagcagttctcctgcctctgcctcctgggttcaagcagttctcctgcctcagcctcctgagtagctgggactatatgtgcaggccgccacacccggctagttttttgtattttagtagagacggggtttcaccatgttttccaggctggtcgtgaactcttgagctccggcaatccacccgctgcagtctcccaaagtgctgggattacagttgtgagccactgtgcctggcctttttttttttttaatataaaaaaattgaaaatacagataaaaggaaacaaaattacctgtaatctccactcatccaggttaactcctggtacctttttgatgcgatttctttgtctttttaaatgcatgttctgtctatttatactacaataggataacctcctacatgtgctttgtaacttacatcttttaatttttaacagttgaggtgggccgggcaccgtggctcatacctgtaatctcagcaccttgggaggccaaggcaggcggattgcctgagctcaggagttagagaccaccctgagcaacatggtgaaaccctgtctctactaaaatacaaaaaattagtggtggtgcacgcttgtggtcccagctgtttgggaggctgaggcatgagcatcacttgagccctggaggtggaggttgcttgagtcctggaggcggagtgagccaagattgcgccactgcacttcagcttgggctgyagggtgagattctgtctcaaaaaaataaataaataaataaataaaataaaaaaacaattgaggtggatgtctccctaggggtaccccaggaagccacaggataaaaagcaggcatcttgctggagggtctctgttgctcagtagaaattattttgtaatgttttttgaaaaccacaaacatggacatattatggactrgataccacatttgcatcaggatttttttttcaaccagtacagtacataacaaagaaatctctaccctgcagaccctctgggggtgtgagagcgctccttgctattctcagggtcaatgtatggcaatctgtgaaggactgacaatatattgcaaacgtttccccctgccagtaaatattcttcttttgtataactgttagctgttgcatccattccattatgtggaggtaccttaatttatctaataagtcctgtgattagtcttatagtttgttttcaaaattttttttgtcacgataggccctattcagttgactttgtgatcagctctgaacatataatctggtgattgccttaagataaattgaataataaaagtaacaatagtagctaccatcggttgaatatttatcatcaactgttgtgagcacgttgtacatattaactcatttaatcctatgacgtaggtatagggaaggaaactgaggctcagaacctctgccagctagttgtgggcttcctttgaggcacaggggagctgaatgggagggtctacataggacagggcgtgtctgagtccaggaaggacagctggacttgggccagtctcacaggtgggaaggctgtctttctgtgaggatgggtgacttgttgacctttgatcctcagagccctgatgcagcaggagtgaaatgattcccagagccacagaaaacaagagtatctttgtcttggattttagatcctggagctatcaggtggtaagaaggctgtctgacccagattaagtgatgtcatggtatcatgttggggtgtgggccttcctgttgtaaattatttgggatttcatagagatcgaagtcatgtgtggatgacatgacttcaggatgtcccattagaagaggaacgtgggggtcaggcgtggtggctcacgccagtagtcccagcactttgggaggctgaggcgggcggatcacgaggtcaggagttcaggaccagcctgaccaacatggtgaaaccctgtctctactaaaaatacaaaaattaacagggtgtggtggcacatgcctgtaatcccagctactcgggaggctgaggcaggagaagtgcttgagcccgggaggcacaggttgtggtgacctgagattgtgccattgcacttcagcctgggcaacaagaatgaaactccatctccaaaaaaaaaaaaggctgggtgcggtggcttacgcctgtaatcccagcactatgggaggccaaggcgggtggatcacaaggtcaggagatcgagaccatcctggctaacacggtgaaaccccatctctactaaaaatacaaaaaaaattagctgggcatggtggtgggtgcatgtagtcccagctactcgggaggctgaggcaggagaatggcgtgaacccgggaggcggagcttgcagtgagccaagatcgcaccactgcactccagcctgggggacagagcgagactctgtctcaaaaaaaaaaaaaaaaaaaaaagaggaacttgggaaagagcatgggctttggtgtcagcagaagcatgtgtccagttccatgctcttcccttatagctgtgtgaccctgctatctgcacagggacttgagcctctcagaatctgttactgcatctggaaaatggaaatctggaaatgtcactgcatctgtagcaayaaccaggccattttgttactaggtttaagtgagggaaggcatgtaaggcactcagtccagatcatggcacttagtaggcctgagcacatttgctcccacctcagtgacctccttgttaacacgacatctcctgactttggggctgcagagtgatgcagagcactggccagtgttgccatgcacccagggtgcagggagacctgtcttgcaggtgttcaaacaacttttgtcagcctcagtgtcagggacttttgttgcgtagagcagtcaccraatcctatggtgagaagagaaatcgttggagatgggggtgcaggggtggaagctcttatttcagaagacctgttgtgaggtaagactcagaccctcagcttctatccggccacagagtttgggaccagcctttcgatgtcttttggaagatgcacatggaatgcttagcctttgctcttccctggaacctggcttaggctttgcacctatcccaccatgtggttggggtgagtgaggacaacttcttttcctccagaacatggtttctccatctcagccctattgacattttgggctggataactcgctgttttgggaggctgtcctgtgtgccccgtaggatgtcctgcagcctccctggcctctgcctgctaggagccagtagcgccccctcccccacagacaaaaatgtctccagatattggcagatgtcccctaaagggcaaactacccttgctgtaggtaatacttgctttgaagtactggtgtggatggcctatgccctggcagtcttactaggtgggactggctgtcctctcattctcatgggawtggcctcatgctggtagctgacttcctccccgtgagaccgtaggtctaaactaacaaggtttacacatgtgacaaacatccaggttgccagggctcaaaagagggttcacatcgactcccttctcattcactgagtcctttttcrggagctttggccgagtttgtgctgcgtctgggcatctaggtgtcgagttcttccctagtgttttcagcctcggcttcctcctctgtaaaatgggagtaactgatacttttcctgtctgggtgggaaaggaaccccgtgctaatgtgattgatggtgtggtgctaagctctgctgcaagggatgtgaagttgagggaaaggtttaccatttattaggagctttgagaccaagttccttccacacaagagatatgccctgtcaaagggagatcccattgcaaagagattcactgccaagttccccctcccactagctccctggagcaattttcagcttttagagtgtttagaggcctcagggtgtaaagcgagagagagaatgccttccagccagcgagagagaatgccttccagccggtgacattgagaatagcaggaaagaggcagaagaagaaactgacttgaagggtgatgccagccaggggtgagtggagtgaggtaggatttgctttctgaaaactgggatgtgcacacaacctatcaagaatacttcactttgtgaggcccaaaaacagctcctagcacagtgtagagcagacttggtcagaacttcaatccttgayttttttttttttttaacccgaatttcatgaggtttttctgagacatccactggactgtcatataccgtgtgctgggctctcattttatccttacaattattatgttcattttaaagacctcatgttagctagatcagtagggtgactacagtttacagtaatctactgtatatttcaaaatagctagaagagaacaatttggttctagcataaagaaaagacaaatatttaaggtgatacatatcccaagtacattgatttgatctttacaaattgtgtgaatgtattaaattaccacatgtgctccaaaactgtgttcttgaaaaaattatcacgcccattttagagatgaggcacagagaggtggagggacttgcccagatccaggtatgtggctctcctgtaatckcgcttctattgctttgtgatcagcagcaacttagtagctttcaaagcttcaattttcttgtgtgccaaatggggctaataaataccttagaggattgtgatcaagattccgtgaaaaaatgtatgcagtgcccccggcaaggtgcctggcatacagaaagtgctctgtacgcaccagctgctgtcattattattgtttcaactaccagtgatcataaaggatgcctgctttgatgagcttttccaggaatatggactggtctgccctgatctacttgaataatctgtctcaggccctattcggtaaatacatgtaggaggtgcagctgccagggaagggagggatgttacctggagaggacagagtctgaagttcaggaaatacagcaagagccttcctcagggatgaaacatgtgatcttatggtctgactagcctcaagccagctgagctcattgccrtgcaacttggtagttaatgattgctagtaagaagtttaaaaggatcatcccctcaaagaatgtcagagttggaaaagaccttagggacattaggctaggaaagacaatgtcctagtgagtgactgcttgggccctgtatagaagggattctcagatcacttgggatgtcctggctcagcaggaggctaaggtgggatcaattagtgatgtctgccatggccacaagagaggcaaggagtggcacatgtgctgtttatttgctgtctttggctgcagctgaggacactgaggcccaagacttgcttgcttactggacgatcacccaagtcattaaaccacaaaaatctcttttggaaggaatctgttaagaatgtctgattataagagttgcacctttgagcaagtattttttgcttgatagtcttcagtgaggaggaactgtcttcaaagagcacattctgtcttttggcaattctcccaattagaacttagaccactgaggtagaaaggccttagaagcccctttaagtgggctcttctcaactggggctgcacctgagaagcttttggaaaataccagttggaggctccctccccagaccagtggattctggatatctgggtgtatggacacctcttgcccccattggtgttttattttccaagctcctcatgtgttgttaatatgtagccagggttgagaaccactgagaccaaaactctttggaaacagagacccagaaagggagaacatgattgtctatgggtatgtagggctagtggcacaaggagaaggaaaactaggggggaaaaggcctttatcaaatgccacccatatgctagtctcttttactttcatgccgagattcttctttttttttttgagtcagagtctcgctctgtcacccaggctggagtgcagtggtgcgatctcggctcactgcaacctccgccttctgggctcaagtgattctcttgcctcagcctcctgagtatctgggagtacaggcttgtgccaccacagctggctaaattttttgtatttttagtagagatggggtttcaccatgttggccaggctggtcttgccctcctcacctcagctgatctgcctgccttggcctcccaaagtgctggtatgcctggcccttttttttttttttttttgagatagggtcgtgttctgttgcccaggctggagtgcagtggtgtgatcacagctcattgcagcctcaacttcctgggctcaagcgatcctcctaccttacctgcctgagtagctgggactacagatgtgtgccacctctcctgggtaattttaaaattttttttttgtagagatgggggtctcactatgttgccacagctggcctccaagtcctgggctcaarcgatcctcccgtcttggcctcccaaagtgctaagattataggtgcaagccacctctcctggcttgcttctttcccgtaaattgaggtgtgttattccactgcttaaaagcctacatggcttcatatcgctsttagtataaacccaaacagtggtctgcaagactctgaaccttagatyaggatgatcagacccctccctcccctccaccctccgacctcatcctggctacccactccctgttcacagactrcagtcacctggctctagtacaacagacacttgaacctaccccgcccctctccctcagggcctggtactatcctcctcgctccttcttatcactcaggcccctctatcccatcatcctccttcatttcctcccatccttatcacctactcatttctgtctgtctccccacctcttggattatgagttcaggggagtgggaccccctatgtctgatttccttatgtgtaggacagagcgtgcctcaaaagcatgcttgcttggtgaatgaattgaaagaaccaccctgacatggagctggtattatccacaggttacaatggactggacctcctcttccagtcccatataatttttttttttttttttttttttaaattttgagacagagtctcactctgtcgcccaggctcgagtacagtggtgatcttggtttactgcaacctctgcctcccaggttcaagcaattctcggtcctcagcctccccagtagttgggactacaggcatgtgccattacacctagctagtttttgtgttttcgtagaaacaaggtttcaccatgtttgccaggctggtcttgaactcctggacttaagtgatctgcctgccttggcatcccaaagtggtgagattacaggcatgagccattgtacctggccccatatcacttcttattatctcataatattcttaccttttgcagtgacagccccaaagtgtgtgtgtgtgtgtgtgtgtgtgtgtgtgtgtgtgtgtgtgtttggggtggggatcataataatcctgcaggtggggtttagctctggtgaaaagagcacagatcctttgatttgggtttgaatcccagcacttcctcttactaagctgtgtgatcttgggacattactaacctctgtgaggttcagtttttcttggctgcaaaatgtaagcacaatactaataagtaactgacagatgctgtgcttctgccagacactgtacccagtgctttgtgtgtattggctgagtgaatcctcatgacaccctaatgaggtaggtctcttctcttcttgctttcattttacaggagaggaaaatgagatgcagagaagctaagcaaccagcctgaggccacacagccaatcagttgagagtcagagttcaagcctaggctgcttgctgccagagtcagagtgttaggtaggactttatgaaatcatgcccacaggccccggaacaggtagtggtgcagacacttggtaaaccgtagttacccctcccactttgacatttactctcctggtgacatttaagttttctgactgttttgttgttcaagttggtgacaaaagtaccaatttcctgcctgctcacttccaaacacagcttctgttgatgagaactaagggagtacaacttttcaggccgggggtgtgcatggtgttttgggccttggtgctcaggaagtgtgggcactcccttaaattttttaaatgggcaaatgagtgcattttcctatttaaatttttttttttttttttttgagacagagtctcgctctgtcacccaggctggagtgcggtggcgccatctcagctcactgcaacctctgcttcccgggttcaagtgattcttgtgcctcagcctcccgagtagctgggattacaggaggctgccgccacacctggctagtttttgtgtttttagtagagatggggtttcaccatgttggccaggatggtctggaactcctgacctcaactgatctgcccacctcggcctcccaaaatgctgggattacaggcatgagccaccatgcctagcctcactcccttaaatttttaaaatgggtaaatgagtgcattttcccatttgaaacattttctgcttcaaatccttattgagcactttgtgctaggcattgtgactatgatcagtataaaaaccccaagaaaacaaaaaaacaaaaacagtaattcactgtcctgtcacccccaactcatcaatcctttgcttttccataactggttacctgggtgcttttcttcgttgtgattattttttattggaaatgcagatttgtgactgtgatgggcctgaggtcaggtcaccttgctgaggcgagtttcctgggcggctttgccctgttttgataaacagaagaatgagcagctggagctgcatttcaagtggctgctttagttgaggcaggcaggcctcagtgtttatgtgacaccgagcagcttcaaaatgagcttggtcatttaaaaaaatttattttttcctagttaggtaacagtggtataacaacattaaaagaaatgtagaaactagagaaaggaaaaaaaaaagccctttatcccccccatcacaaaactattataatttcaaaatagttacaagtacaatgtattccaagtggcttcttatttaagataattatattcacagagcagggaccgtttcaggtcctttaatgctgaaaggctaaataaagagaactttttattttttccatgttaatacatggatgatattaaccatgatgtttaatagctacagaatactgcatgaaatggakgtactataattcatttagcctttttcgtatttagagatttaagcagtagccaatttttcaccattacaagtggtgcaaggaccaatatcttcatgaatacagcattttctgtaaagcagaaattctttcttcaggattaatttccagatatctttytggtattagacacataccacttgcctaataacgttccaaaaggaattcattgtttacattgctattagaacataygagattgcctgtttcattaygtccgtcccagcactgggtattatcattaaaaaaaaaagattttaaatttatttattgagttatttacttgagacagagttttgcttgtctcccaggctggagtgctgtggcacgatcttggttcactgcaacgtccgcctcccaggttcaagcgattctcctgcctcagccttccaaatagctgggattataggcacccaccaccatgcccagctaatttttgtatttgtagtaaagatggggtttcatcatgatggccaggctggtctcgaactcctgaccacagatgatccacccaccttggctcctcaaagtgttgggattacaggcgtgagccaccgtgcccagccaatattttaaatttaatgtttacatttgcacacatgccaattgggcwtcatggtggctgcctcacaccactttttgtccgtgtgtgagactcacatakaggctgttttctgtgatccttttttaaaaaataattacatttttttaatgctcagggaaaatgtcaaataattgtttatgttttgtactgaaatctgcactggtctgatggtacccagaaaaactcttaactgtagccagaaaccagctgagcctagttgtatgcaacctgactgcaaaggtcatcaggtgctctcattttatttttagagctatattttagctctaacgtgattgttgggtgaacacttgcagaatgaaatatgactgacacctaccagctgtctayacattcctggttatatcttaggaaggcagtgtgtgctagcaccttgggaagagaatgttgagttcaaatcctagttttgccccttgcaccaataccttgatcagattcctcccctgcgtcctccctaccctttcttcaacttcacaccttagtttctttacttgtaaattgggttgatagtgggctgctgtcagaattaaggacatcgttttgtcaaggattttgcatacrggaagtcatggtgacagctgttgttactgttgtcctgaggagtggggacaggagaggaggaaaacaggctggtccaggtgtctttccttaaaggaggctccagcttagttggggagatagatgggctggtcagagtttcaagtcataggcagtgcaggcctcaaaggaacagccaggacttgagacaagaatcaggccaagtgagtaactgttgctgctgtggcagtgaatgttagcagcccaggcctgcaggggggaagactcatttggggtacagtgagaggtcttgctgggcaaatgcagggtgtttgcggcaaggtaggctggggctggacttggaggatgcctgcgtgatttagattctatcttgtagagaatgaggtatcatggaaggattttcttttcatgttgtaaatattaatcattttattgttttgtatttttgatggcaatataaaaataccagctttgttgagatataatttacatacagtaaaattcatccatttagaaagtatacagttcaaagctgggcgcagtggctcatgcctgtaatctcagcactttgggaggctgaggtgggtggatcacttgaggtcaggagttcaagatcagcatggccaacatgatgaaaccccgtctctactaaaaatacaaaaattagccaggcatggtggtgggtgcctctaatcccacctgcttgcgaggctgaggctggagaatcacttgaacctgggaggtggaggttgcagtgagcagagatcatgccactgcactccagcctggacgacagagtgagactctatcttaaaaaaaaaaaaagcatacagttcagttgtttttagtatattcagaattgtgcaaccatcactgctgtctagttccagaatattttcgttactcacaaaagaaaccccatgcccacgagtgctcactcctgatttctccctcccccacctcctggcaaccaccaatttgctttctgtttctgtgaatttacctgttctatgtatttcatgtgagtagaatcatacactgtgtgtccttttgattctggctatttcgcctagcatagtgttttcaaggtccatccatgttggagcaggtatcactgctttgttctttttttatggctgaatgatatttcatcacagagagataccatgttttgtttatccttttatgagctgatggtcgtttgggtcatttctactttttggctattgtgagtgacactgctatgaacgtttgtctaccagtgtttgtgtggccacgggttttcaatgtgggaggattttgaactggggagtggtgtttggagcctttgggtggggtgggctgtgaggagcctgtgtgtgtgtctgcccttactgggctgggtttagggcaagcttcatgtgcttcctttcttttaagggactctctgagacagggttattatcccctttttgcagatgagggcactcaggctcagtgaggttaaataagctgcatggctagacaatggcagatagcagccctgtccggctcttagccagcttgcagccacctgcccctgctgggccaggcgattgcagtggtcttggctgggaggggcccagaggctgtgtggtgctggagagaggcagcaggctggacctggttgggcaaggctgagtggttgtgggataagaggagatgtttcagagcagcacccacagaaccgctgtgatgggagaaacaagacttcgagttaggagagtgggttggactcttggtgcagcctatgtgaccttgggctgatcttgtctcttttgagcatcactttcctcatctggaacctggggctcttgtggcttcctgcctctctcaagggtgattcgggaggaagagtgggagagagagagagagagggagaggatggaggcgagagaggtggagtgggaaaggagggcagaatctgctagaacctgcagagctcataatctaggggcggggagggacatgcagcaggtgcaggcaggtgtgggaggaagtagcctggtcatctggatggacatccctgcccattcagagaagctctgaaccctgcaaaagctcccacgtggaggccagtgagctggttataatccagagactgtcagtttttcctagtacatatttgracytgagcctttgtttctgcaaagagtctggtactgactcacacagtgtcagcagcccccttccatcccctggcacacccctccctcattcctactgagcattaccttaaaaccagtgaggtctttctgggtcttaaaggtcacccagtgtccttgcctatctgggcctgtctctgttcaagtggcaaggcggaccatcccctttatcactgacttgcagcttgcctgggttttgtaaaaagcttgtcattgccagttagaaaataaagacagaaacctcccctttggcattggtatcgtgatgacttgctcttgttctgactctattttgctggcttgttatgagtcagtcatttttttttaatgaaatgaatacctttgtcttaatatgaagctaggcatatatgataaaggttagatgatttttcaaatatgaaatcagaattctacccatactcccaaattagagagcagtctgatgtgttcccctttactgtgaccagtggcttcataggggacctagttatgagtcctgtttcttttttttttctttttttattttgagactgagtctcgctttrtctcccaggctggagtgcagtggcgcaatctckgctcactgcaagctccgcctcccgggttcacgccattctcctgcctcagcctcccgagtagctgggactacaggtgcctgccaccacgccyggctaattttttgtattttttttttttttagtagagatgggttttcaccatgttagccaggttggtctcgatctcctgacgtcgtgatccgcccacctcggcctcccaaagtgctgggattacaggcatgagccaccacacggggccaggcctttttcttttcttttttttttcctcactgtgtcacccagactgtagtgcagtggcacaatcttggtgcaacctccgtctcccaggttcaagcgattcttgtgcctcagcctcctgagtagctgggattacaagcatgtgccaccacacctggctaatttttctatttttagcagagatggggttttgccatgctggccagggtgatcttgaactccagacctcaagtgatctgcccgcctcccagaatgctgggattacaggtgtgagccactgcacccggctgaggcctttttcttctgtgcgttcctgctgtcttccctccaggcagcagcaagctggtaggagctgtacttgtgagttgacatcatgatgtacagtcactggtcacttataaaactgggcaggcccagagcaggaagggtcattgagggtcatctaatgcaaaccgtttactttagagatgttgaaaccaaggcgcagagaggggaagtgacttgcccaagaccacacagctaatatcactgtgagcccaggttcctggctccagttcctggttctttctgcccccttcttcccgacactaaagatacagtggtgagcacacagggtattcagtaacgtatctatttttgacctgtttttaatggaggctgaattgggcttttagggttgagttctgacacgtgccaggtgatctgctggagggaaatctgttacttctggggaagagttgaaggtgtcttctgaactctggaatctgttttgaggggaggctgagcccatgcgtggacccttaggctgagcccatgcctgcttcagatgttccacacctttcaccacaatttatttatttatttattttttgagacggagtctcgctctgtggcccaggctggagtgcagtggcgtgatcttggctcactgcaacctccgcctcctgggtttaagcaattctctgcctcatcctcccgagtagcagggattacaggcatgtgccaccacgcccagctaatttttgtatttttagtagagacggggtttcaccatcttggccaggctggtcttgaacttctgacctcgtgatccaactgcctcggcctcccaaagtgctgggattacaggcgtgagccaccatgcctggcctatttatttattttttatttttttgagttgaagttttgctcttgttgcccaggctggagtgcaatggtgtggtcttggctcactgcaacctccgcctcccaggttcaagcgattctcctgcctcagtctcccaagtagctgagattacaggcatgcgccaccacgcccggctaatttttgtatttttcatagaggtggggtttcaccatgttggccaggctgatctagaactcctgatctcaggtgatccacccacctcagcttcccaaagtgctaggattacagtcgtgagccaccatgcctggccacaccccggtttattgcatttgcttctaatagagaaatcaacccagtaaacaaatgaattattgttagcaaaactggggggtgggttgggaaaggaaagtagttccttctataataaaacttgctgatatttcgttgaaagtcattgtcttactcatccttgtataagataagtcacacaatgagtggtatcagggttgcagggtttccccctgtgaggacacratgggatgaaccgtgtgtgggatggtctgttaaagaaaaacaagaagccatgtgttggaaacaacctaagtattgagcggtggaggattgctgaaattgtggactactatgcagtcattaccaacgcactgaaaaaatgttccatgatatggcaggatgtttatgctataagaaatttaaagacgcgagcttcaaagtaaagtataaacctaatttggtcaaacaggctgggcgcagtggctcacgactgtaatcctagcactttgggaggccgaggcaggtgggtcgttggaggtcaggagttcgagaccatcctggccagtatggcgagaccccatctctactaaaaatacaaaaactagctgggtatggtggctcatgcctgtaatcccagctactcaggggtctgaggcagaaggatcacttgaacctgggaggcggagggtgtagcgagccgagattgtgccactgcactccagcctgggcaatagagcgagactctgtctcaaaaaaaaaatattggttaaagaaacaaacgttagacttgaagccgtgctttatatggatatgtggtgcactataatgtggtgcttaaaaagcaacttaggcagacctgggccaagtctgggctctgccacgtaactgctatgtgcccctgggcaagtcactggatctttcccagttcaggcttctcagctgttaagtgggactagtaccttatctctttgggttgttgtgagaattaaatgagctatctgggctttcagagaaagggcttcatgtgccgtggctctgatcagaccaaacaagttatctactgctctaagccatcaaggccccccatgcctgttggatactgttgagttatttgggttggcatgtagtgcagcgtttctggacatacatactctggggactccccatcccaaatttcttacagtctctccagtgtgccacacgctttcttgccactaggtccttgcatgtgatggagtaactcttgtacctctgtctccctaaatagacggggttctccaaggacatygtgccacagggcctggtaacccagtaggtgctcagtaatttatttatttatttattttttttgagacagagtctagctctgtcgcccaggctggagtagagtggcgttatcacggctcactgcaacctcccactcccagcttcaagcagtcctcctgcctcagcctcctgagtagctgggattacaggcgggtgccaccacgcccggcttattttttatatttttagtagagatagggtttcgccatgttggccaggctggtctcaaactcctgacctcaagtgatccgcccgtctcagcctcccaaagtgctgggattacagggtgaaccactgcgcggcccattaggtgctcagtaatttgttgaatgaattgaagacatgggacttgarttaggcttttattattattattattttttgagacggagtctcactctgtcacccagtctgggagtgcagtggcgtgatcttggcgcactgcaacctccgcctcctgggttcaagtgattctcctgtcttagcttcttgagtagctgggattacaggcatgccaccacgcccaggtaatttttgtatttttagtagagatgaggtttcatcatgttggccaggctggtctcgaactcctgacctcaggtgatccacctgccttggcctcctaaagtgctggaaatataggtgtgagccaccatgcctggcctattattattattattattattattttggagatagggtttttctgtgtggctcaggctggacttgaattcctgagcccaagtcatccttccgcttcagccaattgagtagctgggattacaggtgcactgtccstcccagcaagttgggtctttaaataaagagtggggtttggtgagcagggtgggtgcactgttctaggaggtgggcaggacagaggtcagtggtggtccctactgcctattcagggaccagggcccctgggcaaaggcagagataacattggcacaatctgcctttcagctttcattgtcatgcgggagtcaccatgctttgtaagacatttaatctataagacttgattagttttgctacctttcatagcttggggctgtgtatgcctgtttgtaagagagatccatccagatcaagcctgtgcagcaataatgtatgtgcacaaggcctcttgtgttgtgctgatggtaagataggagctggacttggaggcaggaggtggcctgggttctgtttctggacttaccacttactagacgggtactcttgagtggagtcacttaagaaagtaatgccgatcaggggctcagagtgtcccaagtgttttctcttgccttattctcattaaacagaagtacagctcagaatatgatgggccagtcttatgtgattggtgttaataaggcagtagagagttgggggtactctggcagaccatgagaacctgccctgtttgaaggagaatgctgcctcctcttcctccttttaaaattcacacatatgatgctcactaagtgtctggcacccttttttctttttctttttggggcagagtcttgctctgttgcccaggctggagtgcagtagcacaaacacacctcacttactgcagcctcaaactccctggctttaagtgatcctcccacctcagccttccaagtatctgggaccacaggcacatgtcaccacacctggctaattaaaaacatttttttgtagaaatgaggtcttaccaggtcgcccaggctgatcgtgaactcctgggctcaggtgatcctcctgtcttggcctcccaaagtgctgacattataggtgtgagccactgtgccccgcctcagtttttaaaaatacttgcttaaggagagagcactgaaggaagatttagatctgctctgttgaagtgacagagtacggtggtttccatttatgcgtattttgtagttcggatggcttcttgtggggagtcctgtgagttcacacttgggggcatggtgtgggggacctgtgaagtgggtgttctggggtgagtgcgatgctagtcactgtcccagttttcttctcatttctttttttgtgagtgcttggctagtggcagccttgcagatcagctagttttgacccacatcctccctctaagtggtgctcattgaattgagccacagccccaaggtcatgttttcaaggttggcatttgggaggccttgtcagaaggtcttataccatattccagtcacccaragtgctgcccgccatgcctgttcgttcagcaggatttccctgagcacctgctctgtgccaagccctatgctaagcaccaagggagtaaatatggagggcagtgtccccagagtccaggaactcgtgatctagtcggggaggagaggggtacctactctgtcttttacacagcaagtgtaacctctgaagaatgatgttccaggaggcaagagcaaccctggcggactggtggagctgggaagggaaagatgcttctggaggggccttgggagaagagtcctccagggtgagccccttgagagaggtttcagagctctcatccatcttcatatcctggcacttagcccaggcactaaaatttgcatatttttgatggcaattaaaaaaatactagctttactgagatataattcacatacagtaaaattcacccatttaaaaagtatacagttcaaggttaggcacggtagctcatgcctgtaatcccagcactttgggaggctgaggcaggtggatcacctgaggtcaggagcttgagaccaacctggccaacatcgtgaaaccccatctctactaaaaatacaaaaattaaccgggtgtggtggtgtgtgcctgtaatcgtagctacttgggaggtggagacaggagaatttcttgaaccgggtgggggaagttgcagtgggctgagattgtgccactgcactccagcctggrcaacagagtgagactctgtgtcaaaaaaaaaaaaaaaaaaaggttccattcaagatgtcaagccccacgggactgagggtaacatgagggtaacagacaggtgatgttaaattccatttgggctcatgttcacccccaggccccttattttctttcaaacacatggaatgggcatttagaactaggaagatcatgaatctggtggctgtgtagatgccataccaggtatggaccacaggcttggagcgcagcagcatacaggggtcagaggtcaaggccagtggtctatcagaacccagttcctgcaggagccagtgccggtactaggtagactcagatgactgaatggtcctcgggatctgarggccagtgggggagatgaggcctggcctcccggaagtgctcagtaaacatttgttaatcatttcctgcctagggaagctctgtggtatgctcaggagaatcttgcttctcrtgggggaatgggtggttgtcatttgggtggcctgactgccagcctgcttgctggctctctgggagttggggtggtggcatcaacctgcagaggcggggcagtggggcagctcacggctgtgtgggtaagtaagcagtgagcacagtgagggagctgttgccaggagcctcttggcttagtgagccaagcagaaccatgtgatgcaccctgtgggcggccacctggggactcaggacatgcacccagatccctcctcccctacccacttcaaagaaagtgctgccctcccagtggtgatgaagaccttccgctggccccagcctctgggatctggcctttacttgggtattcatgtggccctgggrgttggctttgctgaagttgggcagagcaggtgggttctggaatgtgcaggggcaaccagagtgtccatctgtttgggtgaagccagctgtttaggtctgaaggatctgtttgatttttagaaacatgatgtgttccagagttagtaggtggtggtgatggagggtattggcgtgaagagtgtggatgctcttcgttcctttgctgttttgggactatctctctatggggtagtggcccctttccttgttaggatcatttagaaccccctgggatcatgagaatgaatgtgggtctatccttccttctgtgtgaggaaaaggggaggtattgtggttaagcaagtttggagaactctggcctgaacaaaatcaaacagatgtctttcttgcaggacttagaagaaacttaaatctgttggtaactctttaagagggaaggggatataaaacccttgttttccctagatttttgttttactctatagctgtctctttttagaagcatctcatgagactaatgtttttaggaacctgctgtaggaaattcatttattcaaaaaatatttgttgagcatctgttatgtgctagtgactgctccaggtgcttgggatacagcagtgaccacctccaaccaagatcccgctttcaagaacttccattctagcagaagtgatgaactcatttttatggagcacctactgtgtattaggcatgtgagttatcacacattatctgctttacccctcacaacagcctggtgaggtagatggactattttattttattttattttatgacagtgtttcactcttgttacccaggctggagtacagtggcgcaatctcggctcactgcaacctccagcctccaccaggttcaagcgattctcctgcctcagcctctcgagtagctgggattacaggcatgcgccaccatgcccggctaatttttttgtagtttttagtacaaatggggtttcaccatgttggctaggctggtctcgagctcctgacctcaggtgatctgcctkccttggcctcccaaagtggtgggattacaggtgtgagccactgtcccaggccagatggaccattttaaagattaggtaactgagctctaggggtcaagagacttggccactttggcagctgcattgtcgtttttggattatgtcatcaaattgcaaggggaggtggtgaaataaggaatttctgcaacagaaattggagtctgcggtggggatgctgcaggccttagctgctgtatcactgtgtccgtttatgaaggcccgatggagaagaggctctgaatcaggccgggaaagaggtatttctctggaacaactggtttgtttctgtgttatgggcaccgagaagcgtgtggctcatcatgttttcctttggctttggttactaagcacctgagagctagatttgtggcccatcttgacacttctgcaggatgggaccatatggcatgcatttctatgtgctgatcttaccccaacctcccgccctccatcccgctttattattttctctatactcatttttgccttgcctggttctcttgtttgttttattcttttgtgttatttgtattattctaaaccaccacatatacttggtgggatggagctgggtatagttaaattttaaaaataatggtgagggccaggtgtggtggtttatgcctgtaatcccagcactttgggaggctgaggcaggtggatcacttgaggtcaggagttcaagaccagtgtggccagcatggtgaaattagccgagtatggtagcgtgcacctgtaatcccagctactcgggaggctgaggcaggagaatcccttgaacctggtggaggtcggaggttgcagtgagccaagatcatgccactgcactccagcctgggcaacagagtgagactctgtctcaaaaaaaaaaaaaaaaaaaaaagaaataatactaatgatgagatgacttgcataagatcccccagctactctgtggggaagtcgggctccaagccagctctcctggccccaccctctttccaacatactcagtgcctttctggattaggatccactgcaaggttcctttgcagtgggagccaggtctgtttggcttttgcagccattgtgttatgggttccagtggaagctgggctggctggattggaggtgttgaggggcttggattgacctaagtgtcacctgtggctcaagcaaggctctggactgtggattccttcttggtgagggctgttcagcctcacccaggagagaacccatacctctgcttcttgcttgtgaggcatcaggtttcaagcaggggtcagaccagatgagcactgttatgttcttcacagctgcttcccactcgttatcctcatagtagcccagggtagaaaaggagaggatgagtgggtggtattgatgaagaaacggagacctacagaggtgaaatgacttcacccaccaggtgatggctgagtctgcaacccaacaaaaaactctggcttgctggcatttctcaggccagacagttccaatgtgaacccacggtaccttctgcgggagaaaaggtggcatgggaagcaggaagagcctaggatttgggagttggatgccatggacttgagtcctggccactactatgtgcatatggggaagtcacttttctgagcctcagccgcctcatctttaaaatgtgggccctaatttctgccctgccagcctcacaggatggtcatgagaaactgaatgagaagatgaacatggaagccttttgtctggcattaaccacatgtgcctgtgtgctgggttctgtctgcattgtgctaatgatggtggtgatggtattaatagtaataatagtgaacatttaaggaacactgcctcctataatagtcaccatggtaaactttacatacattatcttaatgaatgcagaaaacaagcagatgagcagggaccgtctattattttcccatttatttttgtttatttttaattttttttttgtagagacagggtctcatgttgtggcccaggtcttgagctcctgggctcaagcaatcctcccacctcggttccccaaagtgccaggatcacaggtgtgagttacctcacctggctgtattttcccatttttacaagtggaaacagggggttcaaaaaagtttatgtaatttgcttaaggttgtagagatgttacatagtggagtccagatttgatcccaagtaggtgaccctactgtggtatcactgctatcagattggaaacagcagaagtctaggacctttttggtttggttgatgacatctgtgcacatcattctggtaggtaggggccatctgggggcaggaagttgggtgtgggtaggggttggccctggagaggcaatagaagctggggcttggctggataacaagcctggcacactgagtttgtctctgaggtttagtttctcacctgtaagatgatgatataataatgtgcctcatgggattaaagaaaataagagatgcctagatacttatacattgctataaaaatgtctgtgttataagagtgacatggcattccacaaaatgcagtgtagatgtaaattagttggaatggtgacctcacccctgctaggtagcactggcttatgtcccacctgagagtagtagcatctgagggctagccacactgaacaagccacacacctgacctcagcatcctcttctgtgaggggaatgctctctgctcttctacctgcatgcaccgtgtttgtggaagtgctctgtgtaggacagggaaagcaccttgcagagagcaagggcccactggctgcagagagcctggtgggtgatggaccagagataagggtgagggacagtttagagtgtcacagtttctcatagagctttgggcagtgacaccagtattagtctcaggaccatcattgactcctggttagtttttctgttttcaaaacactttatcagctgtaaagcacttaaaaatgtaaattagttcctgcaaaaacaaaatgcacaaaaaatgatggctctgccaggctgggttgggagatgaatgtgtatgcatgtgtgaatggattcatttctgatgataaaaatactttatgcttatttatgtgaaacttggaaaayagaggaaaagtataaaattgaaactaaaagtcatccataatccttytaagtagctttatcatttaatgttttagtatatttccttcctgtttttttttttttccttaattctgggtgtatgcaaaggattttgtaaccctttacattctggaaactgttcaacatgacttcttttttttttctttcaaccaatttgtggagagtccattttgcaaagccttagcacagtgccaagcacaagctacacacccgggatgctgctgaatgcagatgagagcatgccarctctgctgaagttgggggctgggggcagtggatggctgtgagtggtgtgaagcyccgggccacagtgaagaccctggaatggctgagagactgggattccaggagaccgaggtttgaggggaggcttttcattgtttgattagctctttttttcttaccacatgtaagtcatcataatacttaaaaaattgctgtaaaaagcagctaattaaaaatataaatacagtctttttggagactagaaacagtcacaagagaagcagtttcagtgagaaccagatcctttgtcagtgtcagcgagggggaggggcgtcggggcccagccagcaaatccttccctccgaactgggggtgcggaatgtggcactccctttagttagacttgatgagctttggatttgagtaagtgacagccccttttatttcctgctttgttctctcccaggtaccagttgaccacagttttcattcatgcaaatggaagctgacagctgcccagggagggttagatacctgggaggatagagcagaggccctccttctccccgacccctcgcctctgcaggctggtggggaggggggcaggggagtcsagttaccctctctccacgctttcttcttgtgtatgtgtgcgtgtacgtgcgtgtgtgtgttgtgtgtgtgtgtcttgggggatggagaacccctctcaggagggcctgtggaaaggctggggtaagtggagtgagcccgtgggtcctgcccttccaggctgccaagagtttaagttgctgcctcccggtctctgtgcccttttcctgcctgtggaaggccctctctctgtttaggaacgtggatgtggcaggggctgggcgggcacttggcctttataacaacagaagaggattttcagtgacgaggaagcatcccgcccttctggttccctgtcttccacctggccccactgcgacagcctctccaggcctctgacttcactagaatctgcccctccaccccaccttcccccgaaccccacctcctttctctgagcctgagaggagttaattgtgttagagtgcactgagaaacctccaggaaggggccctagtccctgtgttgcctgttcagcaatcacatttgctcacgtctagaaagtacaatataatgactcaggttaaggggtgaaaaaatgtggtggacattttgccagggtactgtgttaactgttccaaggtatcaccctgtgtgagactcaggaacattcagtgttttggtttcccccctattgtactgaatgccggcagctttccccttctaattatttatcttaataatttgaggaaagttgatttgctttttaaaaactggcatccaagcgtaccctatcgcactgcacacagctgagagattaaggcagttctttagaattcctagtccgtgttgtgtacacagcgataggctggggtagtggttctgggtgcaactggggacaggcgaggaaccataaatttggcaggaaagatttgtgttggtaccctgttatatttgctttgcatcacatattgtttaaaaagagcgatattttcgttaaaggaaaaggaactgtgtatttgagataagaagtagaataaaatgaaatgaatagttgggtttcgtcctgtggccttcaaaatggcgttatttctgagatccctgtttctatgctgttccagtatttatacggaacttataaaatacaaagtataggcatgtcccgagatcctggcgaggctgtaatttatagtgttgttctttttcttttgttttacagagctgagtttggtgaaacttcaggaggttttagctagtggcgatccaaagacattaaatattgctttgtgggtacgwctccaccttgygtcttacttggtgactgttcagtggtaggcaaatgtcagaacccagtatgcaaatgtggaagtggacagatttgagtcagttatctcagctggtgttatgaaatacrgaaatttttggcgttggtggtggagggcgttggcataggaggcgtgaatgctctttgtttcttgctgttatgggagtatctcttgattgccccatcatcttgtttggtgtggccccgtttccttctagaagttgagttccctgggcttgtgagaacccttgtacatctgcctccattaaactcacatttggagatctcgtaaatgaacscagtgcagtccgggggcagagtgaaggctcagactgcagccggacatggctcagttaccctaggtgggttagcagctgagcaggtactggtctcaaaaccctctgaagcgaagctgcctgtcgattccacagttgccagcttccagcatggagcttctggaagtatcacggactgagttgggtcccaatgctggatgtccctactcttcctcctgcccctcccacgtttggatgggcaaatgcactaagaacagcccgtgggcaagtgaatgaaaccaaaaagcagcaagggatttggacagtccacctcagagtatctgactttattttgaggggcatgtgtcagagttgggtgaagaaagagattctcagatggagatagagaaagatccccaaaagggcaggctggctaccagtgatttatttttatttttcttacttttttaagagaatgcagggcattttactcttctgtggtaggagagtagactggccacagcccagcccagaacccttaacaaaaggttaagctgctgggcatggtggctcacgcctgtaatctcagcactttgggaggcagagatgggtggatcacctgaggtcaggagtttgagaccagcctgtccaacatggtgaaaccctgtctctactaaaaatacaaaaattagccgggcgtgttggcatgtgcctgtaatcccagctactggggaggctgaggcaggagaatcgcttgaacccaggaggcggwggttgcagtgagccaagatcacgccattgcactccagcctgggcggcaagagcaagactccgtccctaaaataaataaataaataaataaataaataaataawtaaataaataaaataaaataaataaaaaaagaggttaaggtttatacgcaggccatttctaatagatgttatggaagccccaggktttggggcatcagggttggaaaggaagccaaaaatgggtgtgtccaaaggacagatgcattgagaatgggttgtaaaatttcagccattgtgtagattaaccagcacggcaccctgcccctcagccattgtgtagattaaggagcactgcaccctgcccctcctcccccaagcatgcagcacctgagaaagaaatctgacaaagatgctttaatatgagtctagcgctttgagcctttcattgtcatctccagtgcaattgtctgtgggttttgttttgttttgttttgttttttcatttttattggactttgctttgccttttaagggaaactctggatgatatacttcattatttcacttgtcagatggttagtaatatggtattgccattcctgacctaaggcagcaagtgattccttctggcaaactctttaagaaacatgggcatggagcctggctgcctgagttcaaacccctgctctgctgcttaccagttgggtgaccttggtcaagttacttaatctccgtgcctcaatttcctactctgtaaaatggagataataatagaacctgtgtcattacattattgtgggaattaaatgtgttagtctacgaagaggggtgcctcaggcccatggtaaattttatgtaagtgttggttgtatataagatgatgaagtccgggcgcggtggctcatgcctgtaaatcctagcactttgggaggccgaggcaggcagatcacctgaggtcaggagttcgagaccagcctggccaacatggagaaaccccgtctctactaaaaatacaaaattagccaggcctggtggtgcatgcctgtaatcccagttactcaggaggctgaggcaggagaatcgcttgaacctgggaggcagaggttgcagcgagccgagatcgtgccattgcattccagcctgagtaacacgagcaaaactccatctcaagaaaaaaaaaaaaaattaagatgatgaagatgcagcgtggggccatgagaagagtcctggtctggtgagtttggaaacctggcttctggcctgtttctaacactgtatgtccttgggccagaccctttcccctggggtgctgatttcacacctgtaaaatgaagaagtttgacttgcacagtgcttttcttagactgtggtaaggggtggatgtgggggtagtgccaagaccaagtgaaagaggcttctggacctccatccttgcttcagccagagcagcgtgggttcatttcatttttggattttggtttgtgggaagaaagggttctcttgccggtgtgtgtgtttctgataaacaaagaagtgtggaagtggctgaatgagatgacccaaggactctttctgggaagatgcaggaggaagtaggtgagctgaggggaagctggtggggataggcctggtggggcctggggagaaggatttgaaggctcaagtcacacggtgcaggatgggactcaatatagggtgggatagggcggtgggtaaaagccgttacaattttgtccaaatggtatgggctgatttacttattagggaggtacaaatggcttcrtgttataaagtgtcaagatccttatttggataaggcaaccagagtgtagacgagagagtaagagtaagaaaacaaggagaaaaatgagtgtcttaaggatgtagaaatttagtttgctggaagtctctgcagcctgaacaaaacagctgttaggtttgccagaacttaaaccagagggtgcctgccagtggttcatattcttgctacctcttcctcctcttgtcttgtttttcctttccattctaataatcacgatgagtttccctgacatgcacgccccttcattcatttgtatgatcacttagagatgaggagctgccttgccaggtagaaaaaccattctcaggatgaatctttggctttctgaatcagagttttctttgggttttagaacttcattcttattaaagtgggaatttaccggccgggtgcggtggctcatgcctgtaatcccagcactttgggaggccaaggcaggccaatcgtgaggtcaggagttcgagaccaccctagccaatatggtgaaaccccgtctctactaaaaatacaaaaattagctgggtgtggtggtgcgcgcctgtagtcccagctacttgtgaggctgaggtaggagaatcacttgaacctggaaggcaaagattgcagtgagccgagatcacaccattgtactccagcctaggcgacagagtgagactcggactcaaaaataaataaataaataaataaataaataaattggaatttaatatctcttatcatttcttcaattccagtttttattagatccacaacttttttggtcaaaaccagaattttgattatgtgtgccatcctaggctacctcaccatccaaaaatcctcttggaaaaccccacgcttatcaggaaaaggagatggaagtgaaaaaataaaaatatatataaaaaaaggaaaacctagtgttagcaccccttatscagcaggccccccacctggacccccacctgtattcacattcctcccacacttacagtcagtggcttcattaatctctaaggttccatgttctgctccccaaatagactgtttgctcattgaagacaggcaccacacttacattttttttctttctttctttttgttttgagatggagtctcactctgacgaccaggctggagtgcaatggcgtgatctttgcttatttcaacctccgcctcctgtgttcaaggaattctcctgtctcagcctcccgagtagctgggactacagacgcatgccaccacagccggctaatttttgtatttttactacaggcagggtttcaccatattggtcgggctggtctcgaactcctgacctcaagtgatccacctgccttgcccttccaaagtgcwgggattacaggcgtgagccactgtgcctggtcttatatttcttttctatttttctaccctgatcaaccttttcttttctatctctctcactgtttctacgatcaaagtagtggagtcagtttccttgcatctgtcccaagcagccgttgctaatgggaatgagtgtcaggcactgtacatcagccctgttttgaaactctgtgcctgctgcctcattgactagctggagagtgttgaacatttggttgtagaatgtatgtggattgctgagtttcacgcatgagctgtgttgtcatttcattcattctgagtggcatctgcgccagggctacctggagtttttccagctccccaggcctagcaaaggcagggatcctgtctcattcagctgcatttcttgagctgtgcttagaaggcctgccacacagtagggaatcaggaacagtcgcgtttacagagctctcgggtgatagaagggaaagtaaaggtatattaaatttcttctaggcttgctgcctaatcccctaaggggccttctcatttctttcagcagtgccatctggcaggcctgagagtatatgggaataagtggggtgctggatcttgtgggcaggctatgggatctgggaaaggggttagcacctgggcctggagggacctggaatctaggggggscatacatctaagctaaatgtggctgtggcttgcaaactcagaggcctttcgggcagcctggtgaaatgataaatgggcagttgctgtttattctcagtcctagagattaaaaagaggtgcccccattggaaactggaggttacatgttctacccaaagggagcagctgccagtcggcttcttgcgatgtgaaagtacagccccagaaaacccaggttaagtgatgtcccctaatttttaaaagttggcaaccaattcaactataaaatcatgcctgctggcctctgagcagtaggcagggctggtgtatgccggaggccaccaggggacataacacctgccatagggtcagaataggtgggtgttagtcaccatccagatggtcagataccggaattgccacagaaatgaacatgacatgcagagcaggcagagcaggtgccaaaagttggtatcaaggaggcgaaggtcaagttctttgcccaccagaaagccttctgttccttgtctccttcccttcctgcacctccaaggactctccactgctccctacagcttaagtccaaatttccctgtctggcattcaaggtcttccataccttccttacaagtgccctttaggcgctctaaatggcgcgtcagctcctatgtgtggcctcagcttagcagtccagtgttccctccccctgaatccctccagactgcccaggctgcatctgcctcagacagccgggtgttcccaagacatgctgcactttcttccctctctgatttgctcatgctgctcctcttcctggaatgctcatccccccaattatggaaatcccactccccactcatccttcaaaaggctctggacaaaaggcacattctccctgaagtcggctaccctcccgactctgtaaatttggaataaatcacatctttcagcttctatagcactcaccctgcatctccaccacagcccttatgacatagctgttgagaaaggtctgtcttccttggtagatgatgaggtcattgtggaaggttcgagtcttacttactgtgtccacagcatttggctcagggcaacagtcaacagaggcttagtgacttagacacttgatggtagagtatggaaaactgattctcatgaggaaggtgcttaaggtctttggtaagcctgggaaaggggcagttggctggaacagagggtgtgagaggagcaggtaaagctggatccagctctctttcagcccaaggcaatacctaaaaccctatctctgacttggaaaggcagtatcctgctgtcttcctgctgtggccatgagcctcactggggcttgacttgaatgttaggactttttttttttttttgagacggagtttcgctcttattgcccaggctggagtgcaatggtgcgatcttggctcaccgcaacctctgcctcccaagtagctgggattacaggcgcccgccaccatgcccagctaatttttgtatttttagtagacatagggtttcactgtgttagccaggatggtctccatctcctgaccttgtgatccgcctgccttagcctcccaaagtgctgggattacaggtgtgagccaccgtgcctggccatgagtaggttctttagtggtgatttgtgagattttggtgcacccatcacctgagcagtatacactgaacccaatttgtggccttttatccctcacctgcttcccaccctttccctctgagtccccgaagtccactgtgtcattcttaatgcctttgcatgagagggaaggctttttaaagggcccttttcaaggtttgaaataaggctccatgacaatggcctgatttggatgggtcttggaatacccttttttttttttttttttttttttttgagacggcgtctcgctttgttgcccaggctggattgcagtggcgcgatctcagctcactgcaagctctgcctcccaggttcacgccattctcctgcctcagcctccagggtagctgggactgcaagcacctgccaccgcgcccagctaatttttttttgtatttttaatagagatggggtttcaccgtgttagccaggatggtcttgatctcctgaccttgtcatccgcatgcctcggcctcccaaagtgctgggattacaggcrtgagccaccgcgcccggcccggaatacccttaaaatatagccagaaagggctgaggatgggtaagaacccaggatatagagtcttcccataaaagggagggccatcatgcaagatgaacaacttggtcctgatatggatggggctagaatctccgtattgttgctaataaggtggaactgaatcccctccctgttccccaacacaataaaacttcagtgtcgtctgggtgcagtgactcacgcctgtaatcccagcactttgggaggctgaggcaggtggatcacctgaggtcaggagttcgagaccagcccggccagtgtgatgaaaccctgtctctactaaaaatacaaaaaattagctgggcatggtggcacatgcctgtagttccagctgctcaggaggctgaggcgggagaattgtttgaacctggcaggtggaggtgcagtgagcagagatcatgccactgcactctggcctgggcaacagagygagactctgtctccaaaaaaaaaaaaaaaaaaaaaaaaaaaaaaaaatcttcagtgcagggcctgtctgctctccagggaaggctgcagtattgtcaggtttgtttctttttccccacaaaactgcttcggagagctcttaggtcccaagtttgcctgcatccagggtccagatgcttccagggtccagatgcttccagggtccaggcagtgagtggaagtgaaggaggctcctctagtgaaagaaaaaggcatccagtgttaatagtatttcttcccagttgcatggggcttgcatattagagataaaggaaacatcttwgctactactgagccataagtggtctcacctttcttgaaacataaggccgtcttggtttgttgttctgttttgtgcttttcacagaggcatggacactgaaagacgtttctctgacagtggagatataggactgaagagtgacatggcttgcagagcactacctgtccccctaatccacactgtcctctctcctcatgggcagcctgagaatgtggacccaaggtagcccatcatgcagttcttcatgaaatctggaaatcttggcatttcatgggaaatctcatcactgctaaagtaggcttagatttgttttaaaaccttgtgtgggctgggtgcagggcattttactcttctgtggtaggagagtagactggccacagcccagcccagaatccttaacaaaaggttaagctgctgggcgtggtggctcacacctgtaatcccagcactttgggaggctgaggtgggtggctcacctgaggtcaggagtttgagaccagcctggccaacgtggtgaaaccccgtctctactaaaaatacaaaaattagccaggtgtggtggcgggcacccataatcccagctacttaggaggctgaggcaggagaattgcttgaacccaggaggcagaggttgcagtaagcagagattgtgccactgcactccagcctgggcaacaagagtgaaactccgtctcaaaagcaaacaaacaaacaaaaaaccttgtgtgggtgaatcaaacacgtctgcaagcctgattcagcctgtagcccaccagtttgcagcctttgtttagatccgtagtggagaaagaggttaaagctacaagttaggacccctgaaaatgaaagatggtttggaagtgaatctgaagtaaattgtcactgtatggtttcagaccgttttctggtagtatgtgctgtgtgacacaggttgtccctgtgttgtgcagtggttttgagcacaacattggccctaggcctgcagtgtggggtgcaggccctctgctgagggctgcagatgctgccgggagtgcagtggatgaggtcctgcccgcacagcctcattcggcgttgatacccatgcctggaggatgtgggctcatcttcttgggtcaggtgagcctcttacacctgtgttcattgcttagctcttttgatgtcattgcatattggttcaattacttttcccttttcagagccatgaataataactatgattttgctagagggaaaaaatgaaatgatcaaggtaatgcatttacatgttacataaaattcatatcatacagaaaggcagaaggaaaacagggagaattacttgttcccttttctctcttcccctcccarttcctttaacaggaagaatgtctcactagtcatgtgatctacagcaaatcctttaacctcttcaaacccgcatctcttatatgttacaggacagtaataaaacttaactcatattattgttattttttatttaatgtggattaagttagttggtatgaaattctccaaatcctatgcatatataaagggtgctcatagagcttttttcttcttttttgtatatccaggatttctttagcggtcttttgtaattatagtaaaagcactgaggttagatttatgggttttttttgaggaggatagactgaatccctttcccgcctcaaggctatagtgggtcggcacagtttgtgtttgctaaacatatctttagctgcgtaagagaaagaaggaaaatagtaaagatgaacagtactgttttctacttgaagttctagttggcccccmctcccttccatgtaggaaccttagcttgctttccacaccctcccaccactggactcacaaaggcccctgatgagtgcctccggtaagacagggggaaatttttatcttaattagaaaaaggcttagtatcttgattgtatgttctctggagccagtgatagagatagtataagaaattctggacattcaaatgtaaaacagattaatttgtaggaatgttggatttttatctggacagatgttttgtcttttatggagttggttgggattaagaagtgggggcagggtcatgttggtattttatttttgctttgggcttatgttacttaggattaactttagctgtgtataacaacagcaacaaatcagatttatagtcagttaacggaggcttaagtgatgtaaagttttatttctctctcacatagaaattagttagaggtagtagtttagggctcttagagsscccaggctgtcatattctacctgcttacacatggctttcaggatctaggtcacctcacagtccatgatggctgctggggctccatcccccttgtctgagtcatatgttggcagaaggaggaaaggcacagatcaagaggaggcctttcagctgggcgcggtgggtcacctgaggtcaggagttcgagaccagcctggccagcatggcgaaacaccatctctactagaaatacaaaatttagccgggcatggtggtgtgtgcctgtaatcccagctactaggggagctgaggcwggaggatcgcttgaacctgggaggtggaggttgcagtgagccgagattgtgccactgcactgcagcctgggcaacagagcgagactctgtctcaaaaataaataaataaataaataaaataataaagaggaggcctttcctgctgcatcagctctctctgagcagcgttcctgggaagttccatggaacacttctgcttatctcattggtcataactcagtcagatgcacacactgagctgcaagggaggctgagaagtatagtctcttagtcccagatacaatatgtataaaattcagaacaagggtccttttactaaggaggaggaagagactggatgttatggatatgggcagcaagcagtgttttcaaagtactgaaacagattgtagaactttgtaaactggctgcctttctactcctctgctcacctctaaccaaagagccacctaattgttctgcatggtgaccattrcctgttagattcttggtgaatagattcctagcctcatcttttkttatttttatttttttaataaatggtagaatgaggatgcaggaaacttggaaaagcagagtcaaagttcaactagcacaggagcagaaggtaaattctgttggcttatagaatgagcccagaccctggtgtcagaagacctgggtcagttctggtctgtcctctcctgggactcagtaaagtctcttggctctctgagctttccacatcagtaagatggggaatgacaacccttatgggactgcagtgaggcttagccaagttggtgctgtggaaggccctactggattccaaagcatgatacrgatgatgaatactttatgtggctgaggtgcttccagcaggcacgtgggaagcatccatgtaagattggggtcatgcaaaatggggtgggatcacatcgcgggatgaagcacttggatgcaaaggcctgtgtggtccagcctgagtctggctcaacacacagggtyggatcctggctgcgctccttactgctgtatgtacagatttggctcagagggaatgcaggattggcaacatgcatctagtctttcttgtggtctcctggtgcctctcatggtgtgcttattcttattctgctacggagagtgtgacttaagcatgtaatttgcatatagcgtggctcctgaatgcaagccactaacccattattttacttagtaagttccagtgttggggcttgggggatggtgtgtcctttgccagtgaatgcttatgttggtacatttcaagggttattttgcttatgcaccctccccacccccgtcaacgttagagcttagcatcatatgaaaggcagtgtccctgtgactgtatcatagggttgatgaggatgaaatgaagtaactgcaggcagtgtccagcccagtgcccagtgctctgtccaggctcagtgagtgacctttgctgctgctgctgctactgcgtccagctggctacatggggctggtggcagagggtgactcagttctcagtgtgtcttttcctgccccctgccaggttgcttcccctagcctagttccctttttttgtgaaatgctcatccctcagctctggacttcaatgtactgttggtttcaaaaccttatgaaacacaacatcaatgggggaagggagaagagagaagctgagaagcctaacccaactctgacagctgagcggctacagaggacttctcagttgggcttcaatacttcttaagaactttcaagttaggcctcagatgtgattttgtttgctgactttctctttgctaccttggcttctatttagttaacaaatctaggccgggtgcggtggctcacgcctataatcccagcactttgggaggtggaggcagaggtgggtggatcgcctgaggtcaggagttcaagaccagcctgaccaacaaggagaaaccccatctctactaaaaatacagaattagtcgggcgtggtggcacatgcctgtaatcccagctactcgggaggctgaagcaggagaattgcttgaatctgggaggcggaggttgcagtgagccaagatcatgccattgcactccatcctgggcaacaagagcaaaactccatctcaaaaaacaaaacaaaaacaacaaaaaaccccaaatctaattcattcattcagcgtgcacaatttattcaacacagtttgttccaaacactggggatatgccccaaacagaccaagttccctgtttcatggagcttacgtttggtggaagagagacaaatatagaaacaaaagtgtaggctgggtgcagtggctcacgcctgtaatcttagcactttgggaagccgaggtggggagatcacttgagcccagaagttcaagatyggcttgggcaacatagtgagactccgtctctattaaaaaaaaaaaaacaagtctaacatcaggtagacttcagggctgtgaaagaagtgacatagggtaagggaatacagcgtgttgaggggatgggtgctattttccaaggaaagcccctcctggtggggggccataggaaacagctggtgcaaaggcctggaagactcactggcatctttctggaatarcaaggatcagcttggtgggaagtggaatgagctgggggtggagtggggtggggtggattttggagtctgagcttgagatacctgcttggagatgctgagcagtctgcaggaaccaggagcccggagctgagggaggacatgaaggctggaattgtaagtttgagagaaatcagctttttgaagctgtgggacggggtaagatcaccgtcatgtgagaggatgggactggccaggtggtgcatgtgtccaggctcagcggatgttcctgggatacaagtacctgttcatcttgttgacatctaatctgtatctgcgcatagtgaccaaggataagccactgagctgctccaaacgtgtgctatgggatggattaactgtgtgggtgtggaaatccctcagaatgatgagacagggagcagtggagaggaagacagtcgatcattgatcggtgagcctgtacttgagatctggcctggatagttgtgatggtaggtggtacccacaatgatggcccttcaggggatttgaagattgtgaaggaggaccaagaggagctgtttggaccacctgtgatccaaggcrggaactaggaagacacctaccggaagtctttgtggatcttttgggattggattggattagcagatacagarcgtttgacctatagtaaccagctgactgttcagcaaacgcttcacttcctaaaaggcttcttctttccaaggcaaactggggcatgtgaggaacaggaacttacaagagcttctagtctgaactccaggtgctgacactgttaacagttgctgagtggagtccttctcacttgggtggaaagtaacctgtaaacttggcccaagtctcccttttcctgtcctttggcccatgctgttctggtgctagatgttggctctggcctttgcactgaccatctcctcgagatggcacgtggggaggatgtgctgtgttgagaagaacttggctggataggcaaagacttgagctagaaaaagaacaagtggttattcatttggtgcttccctttaaccagggcctttttttttcttttattttaaaggaaacctttaagaaaggagggctctcaggcctttcttagaatttaggtctcagttttacatcatgggattctgtttttcttgggtttccattagaagattaaataacatagtggctatgaaagcatactatagatactaggaactgttgctttgattgtgttaaaggatacctctattccccaggtcctttattgattcatcttatttttatttgtataataaatcattagaatagtgcctggtgctctattgcactcacktgcatatactgtataaagctttgtacatattacttgtttagtcctcacagcagccctaggaggtaggtactattattttgctcattttgcaggcaagaaaacaggcacagacagttaaataaggtcacccaactaacaagcagtagagctaggatttgaactgggggagcctggctccatgttctaggttcttcaccattatactccaaggcctgtcggttttcccatcaatctctactgaagaacaatggcgatggccatactggtaattgttgtgctttatatgctgtgcactgtgttgtgtatttcagatgcacgaatgagaatcttcatccccgcaagatattaagagcccgttttacagaggaggaaatgaaggctcagagaattgagtaacttgcttgaagtccaaagctgaggagtggagccagaattcaaactcgagtttgtctggcttccgaatcstgctatttcctcagcacagtggccgtcctccaaggctgtcacatgttccttccctggtgattcacggcacctggctacctccttttagactcactttgtggcccatggcacccagttgtgtcatgacaggacagtggctcccatttctccgggcctgactgtgaggccacatgagccaccccagggaggccagcagagtcagagcttggctttgaaagctgttaatcgacctgagcccctccatgtcccttgctccattttaagcctagggctttcctaaagcaccgcagatctccttttcttgtgagaagagattaggcagatgtatacatacacggtaatgtgcaagtgtctagtttcttgtcagcatcgggatgagctgtttgtagtgaagagcctgggcctggtgagcccccgggatgatgggtggggaccatctgtgctctcctggaaaggaaattgtggtttctttcttttcttttttctttcttcttcttttttttttttttttttttttttagyttatgggaaagggagacttgtgtctcaattgagtctttgtggcgttgtattacagagagtcacagaaaatgttctatgtaaatgactatgtgctctgattagagcctcaatgggcaccattgtgtcatattgctattattggcgattgcaggatactaaatgatattctcatcaggctgaaaaacttcagtgttagcagtgaaactcggggttaattatactgctctgaattagagcatggaattaagttgtagggagagtaagcctattgctttcttccccctctgtcttcctcttcaagattcttgctgggggtttgatcagaatagtttttaacccatgttctatatctgtactactggcattttgttctccatgagttactaccccatttggggttgggaaacacaggaccaatttataggacagtgggagaaggggagacatggtctacttaatagtgcattcttctcagtcaatagctgggtaaaaaatagcatgaagattgaagtcttaggggaatgctggactctctagaggggcctctttaatttagctcttgtctcttctgcctttgaattctcatctcttctgatcctgactcacctctttgaagaaatgacacactgacctacatcttggctgaaacagatagaagagtctatctctgttctgccccttcttggcattcccagcacagcctccaagggagtctgtcccagagctgaggcaggccctctcgggttgcatgccattgacttctcagctttgttttaactgcagagtttccagtgctctgctcttcttgaattgctcctgattgtcaccttcttgcattcctttctctcatttctttttctgtaaatttcatgtcactggtatcaggtttaaagtcgtattttttaaatccctttcaatgttacgtgggttgtaaatgtaattgttaatattatttaaaaatttttgaaaagtgatttttagtggtggccttatcatatctacatattattactccmccattttgggatgtttaggtcgaatcctggttttttcttcttttgctgttgtaagtcatgtatattggcaattagcctaggagagattcctagaaatgagttcactgagaatatgagcttaagagaaagtgaggatttaaagccagatctgtctgccttcaaatccagcgctctttmtactgatgtgagttctcctgtcttttttacctatcagaattctagaactctcccagagaaaccaggcagatactgctccacaccggtgagctgcttctcacctgggtagtctagggtggtttgctccagaattgtatttctgctttttctttttttaacttggcagtggttaaccattccctggagcagcaccaggtaagtcagcttgtatcagagtcatctgctttacctgacatgagcacacgttgtcatatatttgcacatgcagatatcatatgttaaacaatatcacattgttgaagaaaattacactggaaagcgtaaaatatagtttggatgccatattgagtgtaacttaatccacccgattcagaacttttgtagagtgcctcggagttcctatttggaaatatcagttagcagttttagtcagtagagtaacatattttctatatttatgatatatcaaagagactttctgaagcagaaccctgattgactcaagagtcttttccaaattctgtattctctcagaaccaggatttaataggaggtgggtggggggtggtccttggtcaaactggggaaaagcctcataatgagattgccaaagcgcttacagcatttgaaggctcagagagatgccgtggtcaggaagcttgtttgagtctgtctggaagccagtaagtcccacagaatacctactgataatcctgtggaataagcagcatatggaatgttgctgagctagaattaaagtccacacacggccaggcgcggtggctcacgcttgtaatcccagcattttgggaggccgaggtgggcggatcacttgagtccaggagttcgagaccagcctggccaacatggtgaaacctcatctctaataaaaatacataaaattaggtgggcgtggtgatgggcatctgtaatcccagctactcaggaggctgaggcaggagaatcgcttgaacccaggaggcagaggttgcagtgagccaggattgtgccattgcactccagcctgggcaacaagagcaaaactctgcctcaaaaaaaaagaaaaaaatatattccacacacctagtttttcagccctatacaggctgaccccatacctgccatctccttttcacttcctgttctttctggcctccgtgagtccacgtgtgcccttgtctctgcttgctgtgcctttctctttcctccacgttgctaaattccgtccatttttcaaggctcagttcagatcatycttctttgctttatcattttacatactgtgtatggtttggcctcttggtctgctgctctctgtgtctgttgtatggagcgcttttctatctggtattacggttatttgtgtgcatgtcttttgattcatctacttgaagacaagagctggtcttgggctgccattcctgcagtgtaggctctcacattgccttgcacgtagtaagtgctcagtaaatgcttggtgaacaagtgttcatggcgtaacttaatacttccagtggtgagagttcctgtcaagagtgttggcagtgaagttgttccccttggcaatttctatgctgatctcgggttactgcatgagacacagaatctgcgtttccctcccttcagcatcactggggaggacagccttactttggagttttttttctgatcagttacatgatggtttcatctttaagactactgataacaggcagctctgcctatggagtagccattcttttttttttgagatggagtctcgctctgtcacccaggctggagtgcagtggcatgatctcagctcactgcaacctccgcctcccggattcaagtgaatcttctgcctcagcttcctgagtagctgggtctacaggcgcacgccaccatgcctggctaatttttgtatttttagtagagacggggtttcaccatattagccaggcagtagacctgcagatctcatatcatcgccactgtggtgcaatgccctcccaaagtgctgggattacagacataagccatggtgcccggtggagtagccattctttatccctttactttcctaataaacttgctatcactttactctaaaaaaaaaaaaaaaaagactgaccaggtgtggtgactcatgcctgtaatcccagcactttgggaggctgaggcaagtggatcacttgaggtcaggagttcgagaccagcctggccaacatggtgaaacccccgtctctactaaaaatacaaaaattagctgggtgtggtggcgggtgcctgtagtcccagctacttgggaggctgaggcaggagaatcacctgaacctgggaggcagaggttgcagtgagctgagatcataccactgcactccagcctgggtgacagagcgagagtctgtctcaaaaaaaaaaaaaaaagaaaaagactattggtaacaaccctcatttttttgagcacttgctatgctgctaactgctttatgcacactatttctttaatccttaacactatttctttaatccttatatctacccatgagatagggttttgttattcaggcagtggcaaaacctgcggcttagagaggttaaaaaaaaaaaacaacaaactgcctcaaacaaagtcatatagtaaatggcagtgctggagattaaatttaggtctgtcttgttctgcagtccatataccatataactttgccaaatacaacactatggtgtgtgtgtgtgtgtgtgtgtgtgtgtgtgtgtgtatgcacatgtgtggcctttattgaacactgtggtgtgtgtgtatgcacgtgtgtggcctttattgacttattgaattgatcctgaatcttccctactcctttcctgtctcttttctctttctgaataacatcatttctttttctctactggacatggtctctgtgggtttcacccctcacccctcttatttttgaagttttattgaggcactggttgaggctttagggctcccactgttaagtttgacagtaataggtaagtgtccccccagtctcccttttgccctttctttttttttttttgagacagagttttgctattgtcatccaggctggggtgcagtagtgtgatcttggctcactgcagcctcgcttcccgggttcaagcgattcttctgcctcagcctccccattagctgggaatacaggcgcacaccaccatgcccagctaatttttgcatttttattagagacgtggtttcaccatgttgggcaggctggtcttgaactcctgacctcaagtgatctgcccgctgcagcttcccagagtgctgggataacaggcgtgagccacaccgcctggccgcttttgccttttcttgacattgccaatgcatcctgtccccgagcgtctctgagttttaagtctcagatttgttttctttggagacaaactgcaggtaggtgttacttctcaccgaagttcccagatagcacaggctttgctaaacaacacagcaccaggaactccatcatagagaccgcaggatgctgtgtgcgcgcacatgcgtgtgcacctagtgagatgtaaacatttacctggagtaaaagaaattctttccccagagcccaaatttggctagtctccttatgtacacagctttgacagggattccatatgttttgctcatctttgcttttttgcagcctccacaaatttattttccgtaccactgccactaaacagagttgtttctaaagtgcagatctggttgtgccattccaccgtcaaaaattattttttggctccttgttgccttcagggtgataggacaggtgactgctcacctctccagcttctcttactttctttcttcttcttcttcttcttttttttttttttttgagacggagtctttccaggctggagtgcgatggtgcagtctcggcttactgcaacctccgcctcctgggttcaagcaattctgctgcctcagcctcctaagtagctgggattacaggcacctgtcaccatgcccggctaatttttgtaattttagtagagatggaatttcaccatattggccaggccggtctcaaactcttgacctcaagtgatctgcccgcctcggcctcccaaaatgttgagattacaggcgtgagccaccatgcccctcttacattcttttcttctgttcactacagccgtggagagctccgggttgtcctgcacatgtgcactgccctctcttttatggaccttttaggctggctgcaccctccgtctgtgtcaccctcctgctcctcctccacctggctagttcctgttggccacttttggaaattcatgccagtccagtccaccctgagtacatcctckttctgtgtcactgagctcactatgctgggttttatctatgtctccctcgcaactagatcattcacgtcttgaagttaggcatcatgcgttcttcatttctgtacctcccaactcaatgcttagcacccagcaggggctcaagactgtgtgtggaatgaaggattcgtgtgaaaatgcagggagatggaaggctgagcgtttctgttccttgaccattcccgggtttgactaataactctcatacacactgctactcattgaaggcctactgtgtgcatgcattccatgtgtgctatacagtttatttattgttaacccacgtagaattcccagacacatagcgttactacaaacttcatcacaaaaataaagaaaccagggccctgtttctctttgtttctcagatgagaagtctcaccagagttgactgtggcttctgagcattatgaggcacatgtaggatttaaagctgaaaggctttatccctgagactcagggaaatatgacaatcttttattttgttttaattaatattttttgagtcagcgtcttgctttgtcacccaggctggagtgcagtggtgcaatcatggctcgctgcagcctcaacctcctgggttctagcgatcctcccaccttagcctcctgagtagatgggaccacaggcacgtgccaccatgcctggctaatttttgtactttttgtagagatggggttttgctgtggtctcaaattcctgagctcaagcaattggcctgactcagcctcccaaagtgttgggattacaggtatgagctaccgcacccagcctgacaattttttaaacagaattttaggtgcttgggccctggaaggttcccagttgtccaactcttgaggtggggggtgggtggggggtggagagagagagagagaggaaggcttttccttctcaaatagtttgcatttacacgaaggccacggtgtacttgtttattgaatcaataaagatacaatctctttgaatagttcagaatctgatatccctgttagactgagttcaccttttgtgaaggacacaggactgctggatagggtgttgcagcaatgaggagttatgttataaggggtctcttcagtgtctttttggtcatatgaattttatttgcccagtagaacatgactgatgaggctctgaatagtcaaagaaaacatctctcttatgttctgctcatgaatagaacactctgtgtcctgaattgttgctccactggggccagcacgtggtgtatttttctaatgtttgaaccaatgggctttttcattttggggcaatcaaggtaaagattttctggtgctcctgtgtgacagggaaagcatgtcttgtattttctctctctttcccttctgtcttttgagtttggaaaattatattttgagttacatgactaattacatgagtaattttagcaaatttactagaaattgatgttctgccaatgattggaaatcccttcctcccctccactcttctaaaccaaaacagtgctgtgtcctgaagctagaggggtgagtattcagtattggagtacagcggtttagaacattggagacatttacaaggataaatctatggccctgggttctgactttcttttgcctgtgtgtgtgtgtaggggtgtgtgtgtgtgtgtgtgtgtgtgtgagagagagagagagagaaagagagtaagagagagcgagctgggtttggggctgggaaggaagaatgattgattaggaagctgttgtgcagagtagaacaggacttcctgaaatgtaagacccaaagaaacatagatagccatattttccagtcctggaatcagactcaagtctgataaaaggttttcttttgatttgtgattctgataatatgaaaagtcttacaaaagtatagaattgtagctggtaggctgctttatgagaaagaaaataaactcccacagagtgggcattgacctgggagatctggagcctggtgcaagtgcagaccatggttttcacaatctttgatcactttccttttgtgttgaactttctcttttagctccatatttataaatggggtcatatttagccagatattttatttttatttttatttttaaagagaggcaggatcttgctgtgttgcccaggctggagtgcagtgccatgatcatagctcactgcagcttcgaacagggcacaagccatcctcccatttcagcttcctgagtagctgggattacaggcaggagccacatttcctggcttctagttgggtttttttgtttctggaagaacagaaccatactcctcaggccaggaagacctaggtagagcaagaccagcaacctcttggctagagggctgtgggagctgagcatcagtgagtgaggggaaagcagtggttttttgtcttgagaagaagttcagcgctcagttaaccagaacaagtgccacctgtataagacagcagacggtcaaagcagaagagggaaggaaatggttgaataattctttttttccttttgttccttctctgccctgagtctcccccacccccaaagagatatctcaaaatgtcaaggtccagtgaaatggacggtgggatccttgaggaggggtctgtggggtgggggtctctgaaggggctaagccatggtgggctaatggctctgtttaccgagtgcatgccctatgcctggcattgtgcttctttctcgaaaccatcctacaggtggaggaagcgggggtttaaagggagccagcagccagcgactctctatcttacagcttctaattggctttgaaaccacacaggctgctgctggaggaacctttgacatcctcagtgtgcagccctctcccctccctctgaagggaggcatactccttcactgttgctttgacactctaggatgttccaaaactaggtggtcagcttactcagaaggctctgggcatttttcctcctgcaggagggactgcgcacatgcgaaagacatgaggaagctctgatgctcagggctgtgggggctttggccttggcccgcacagccttctctggtatagtgaggtctccttttgggtttttcacttgtgtttgttttgaggcgtatgtgcttcatatggttgaactcattcctcgcccagctggacatagagttgactgcctcagtgggtcccacctcgggggtgggaaatgtaacctcatgagggccactgtatggttgggcagattcacagctgctctgaggtcaggcctggcaggtggcgagggcctaagaggaattggatcaccctggaacctagctggggctaggatggttgttgcatgtgattttcagcaggactctaagggatctccaaagctggttggctggctagygaggttgggcgagggaataactcatttgcttaacttttcatatgtaacaactgggttttgggtttcacaagagacaaggtaggcaggcaggctcaggtggttctgtataccccatttcatacatgagaaaatggagacttgtttcagatcgtaaggtagttggaccgcagctactcttccaagactggtattcgttcctctactctgttaaagccagagagaggatgcaggccaagtcaagtgaccaaagctaaaggggaaggaagggctggctggacttagcagtgaccacagacagagttgaagccttcacggttggcgttggycttgttcactgctgtgtgccaagctgctgacagcatctggctatcgcaggttcgtaataagtgtttgctgagtgaatgaaagaatattggtgttggggatgatctctttttcacttgctcagcaccttccagaattttgttcttctctttgccactcccttttttctcctccctgggtaacacctcttattgcaggagtaggatcaggttttgagtagcacctttggggtacccattcagttcctcttttcccccgtaattatgggatttgggattgccctttgggagaattaggtaactttaggttctgtatgttaatttgaggcctggattttgaacttccttctgatgcagatagaccttggaagggagtccttacttagaacctctttattttatctcctcactgggagagtagatcccagacaggttttgggaaccacctggtgtccccaagcgagcagaggcagagttgggcttgaatctcctccttcattgcagtgctttctctgccctgatcccattgggtgaccctggactatgaatatggattatgagtgggccctgagagtgatcagagacatccttcaagattgaagctgctttggttcctgccacatggaactgagtgggagaatgtctcaattcaggatggtgggagtgtctctttgtccaagtaataaatggaaaccgtttgctcccgacttttgcagatatcaagggcttgtctttccagagtttggttttcttcccttctctccgcctcccttttctctgcccgcctgtggttttgagcccctcatggctatctgggcagtgatgggtggaagggagctggtgcagtattcgagtagagaagttctgctgcagtgagtgtggggcaagtttcccagacccttgttgggtcagggcaggtggttgtggcccagttgtttggccttctgcaggctgcacccctgccctgctgcctgccagtggggtgagggcctggccacctggtacttaacaagtttggttctacatgtgttcccgtgagtggaggacaaaatgaaaatacctcctgatcgtgttcaaccattagttgaacaaccatttgaaatggttattgcaaccatttcagagttttcttctgtttgtgatgtcatctgtgccttataaggggtgacttgctaccttatggagcacctaggttgaggcccgggttgagcacagttccatacgttagctcatttatttattttgagacaggatctcacttctgtggcccagggtggagtgcagtggtgcaatcacagatcactgtagccttgacttcccaggctcaggtgattctcccacctgagcctcccgagtagctgggactacagctgtgtaccactatgtctggctaattttttgtatttttagtagagatggggttttgccatgttgcccatgctrgtcttgaactcccggcctcaagagatcctcttgtctccaaatcgcttcgcagaagtgctgggattacaggtatgagccaccatgcccagccaagttagttcatttaatcttcacagtggtacaatgggctaatatctctgtcttataggtaaggaaatggagactaagagctctttgccaagggttgctgtcatccatttattcatcaacaggtagttattaggtatctactctgtgctgggccctggcctgaacttggctttggtggatgagactgacaagttctctgttctcacagagctgagagtctggggataaagatcccttattatggtttcttttgtggtgttgtggggagagggtgatgattagggtttgggtactggagagagaattaggattttagctcattttactcaaatgctttatattgcaccatgttactacattttcccctgtgcttcccccctaccctatgtggattattacagtttacttgtgtgtaaacttaggctcagagaggctgggtaacttatcccagcttgcacaaaagaggacctgaatttgagcagaccgtaggttgaattctgtccttctatgctgcctttctatgaataatatgtttacatatatatatatatatatatatatatatatatatatatatatatatttttttttttttttttgagatagagtcttgttctgtcacccaggctggagcgcaatggtgtgatctcagctcactgcaacctctgcctcctgggtttaagtgattctcttgcctcagcctcctgagtagctgggattacaggtgcgcaccaccacgcctggctaatttttgtatttttactagagatggggtttcaccatgttggccaggctggtcttgaactcctgacctcaggtgatccacctgcctcggcctcccaaagcactgggattacagcatgagccacagtgccaggccttacataaaaattgtttaaaaagcagtttgcagaagaattatcaatccttttgttaacattttggtgaactcttgaacacattttttaaaaagttgagagttgctaacaagtaaagtgaagtcctgtgcctgttgtaatttggactgaggagtgtgagttgtcttggtctaaaggtcagagtgagggtctctgcctgctgcaggggtctcccggttagggttagggtgaaaagctttttaaaataaacctctcaaatttgttgtcaacattaacctatggtaattttttttttttttcttttttttgagacagggtcttactctgttgcccaggctggagtgcagtggtgggatctcagctcactgcaacctctgcctcccggttcaagcgatcttcctgcctcagccccccaagtagctgggacgacaggcgcgtgccaccatgcctggctaatttttgcacttttttggtagagacagggttttgccatgtcacccaggctaatctctggtaatttttaaactctgctcaaagttttagaaaacataagtctggaaattccaagttgagccactggtgacttgtgagcatgagtatggcatgggattgggggtggggtggggctgacgtggcctggggcagatgccgggtggttctgtttggaaacagaagttccactgcacatgcagccttcacgtcttgtgggggcttttgtgggggctgtgtacttcccagtttggttattagtaactttatttggttctggtcattaacggcttttgggggcgttttgggggcctgtttgaggcccctgaacatgcatttttcagttgtcgttgtccatgttattaaaaggatatgttggagggggttgcagtttagtctgctgctgtttcgaatccttttctttgatagtgtttgccttcctcccaccaaatgctgcactgagagtctctggtacctgggtccctccttcccttgcctttgcttgggaggtcagtgccttcatccaggacatctttgggcatacaggtaatcccaagcagctctgctcagttgttgataccccttctcacagaacctgatctgcctcagctctccttgcctcctaagtggcagtgccccgctgctgggaagactcctctctctgctggatgcttcttcaggcctgctgctgcacagcttacggccatgatgactgctgcagtgcagaaggcatttcagttggctgtttgtttttcatgcattttgtgtttgtagtgtgctggccacgggagcactctaaacacattatgggccgggcgcagtggctccggcctgtaatctcagcactttgggaggctgaggcgggcagatcacttgagcccaggagttcgacaccagcctggccaacacggcgaaaccccgtctctactaaaaatacaaaaattaaccgggtgtgatggcgcgtgcctgtattcccagctactagggaggctgaggcaggagaatctcctgaacctgggaggcagggactgcagtgagccaagattgtgccactgcactccagcctgggtgacagagcgagactccatctcaagaataaaaataaaaacaaaaataaacataaaaataaacactttatgtacacaatctcacatcactttcacagtcttggaaggcagatatttctgttatcctcattttacagctgaygcctatctaaggcttgtataaaagtcagtcactgtccaggctcacacagccaatgctggagggctgtgtggcacccagagagcacagttgctgcttggaataaaccttcacttatagtccggagcagggtggttctaaagctcccttagctttcccactagtaagcttccaggttctggtacagtttctcagcctcggcactactgacgtttggagtctgatgagtctttgttgtgagcgctgtcctgtgcattgcaggatgttaggagcatacttggcctctatccactagatgccagtagcacccccctcccaactctgcccagttgtgacagccaaaatgtctgcagacattgccagatgtcccctgggggacaaaatcttgcctaattgagaaccaccgagtcatggcaaccatttcaaaccctaagccaggatgtacgtggagatggagaaaggtacaacatttagaattggtactgttggctgggcacggtggctcacacctgtaatcccagcactttgggaggccaagacgggcagatcacctgaggtcaggagttcgagaccagcctggccaatgcggtgaaaccccgtctctactaaaacaaaacaaaacaaaacaaaacaaaacaaaacaaaacaaaacaaaacaagtcgggtgtggtggcgcacttttgtaattccatgtactcgggaggctgaggcaggagaatcgcttgaacctgggaggtggagattgcagtgagccgagatcgcgccattgcactccagcctgggcgacaatagtgaaactctgtctcaaaaaaaaaaaaaaaaaaaagaattggtactatcttagaaaacctggagcaccctgctgctttaactgcagccctctgtgtgggcagacagattgacagtgggcttaatgtggggtaacctttcatcatgaaaattaaattacactgcaggccttttgtagccctcctatatgaaaccctcttaaaatattttctttttgcaatggaagcttgggggaaaaatcatagtcttagatttattgaagttttgtggataaaagcactttttattaaaaagaaccaggtgaaaactagaagggcctcttttgagtctgctgacagacacgtggagaatatatagtcagcggaacattcctgtgctttccgtaaagctgtggatgaacctgcctttcaggtttcgtagcctcttcagtcagatggtttgagaatgcgtgttttgtggtgtatgcacacagactgtatgagtttgtttttttacacatgactagtaaacctgtcacattttgtcaaatgtgattttctttctttattaaaatagattttatttttagagtagttctaggttcacagcaaaattgagcagaaggtgcagagatatcccatatacccctggcccccacatatgcacggcctcccccgttagcaacacccccaccagagtggaacaatcaatgaacgtacattgacatatcactatcacacaaagtccatagtttctgttagaattcatgcatagcattctacattctgtgggtttggacaaggtatgatgacatgtaactgtgatttcctcaattcaatatgtatagttcctgttcacacatttcttcacacatttgttcctcagtgctcaaatgcctgctgtattccaggctgtatttgaagcccctgagcctttatttggagagttcattgaacattagagcatgcagtttgctgagatgtcttgtacttagaaaatccaatttataaaaaacctcaaatagaacagtaaatttagggaattttttttttctgatgataaaattagataactctgttgcatggattctgtaaaacacagctccctcctgttacgccatgaattgggttcaatttacaacacccctttaggcatactttttcagcaacacatgtctgagccgaggtgcactgtgcctctttctgtagcaggcagcttttagggggtgtcctagtggtcttatgttttatacatctcatgggagtggctggtttctaggaaatagctcacttgccagttttggtaaccctaacagagctgttttgccaaggcgtctggtgaatatttctgtcttccagtcaggactaatatagtacttttcagaggtgatagccagttaactgatgactttttttttttttttttttttttttttttgagatggaatctcgctctgccacccaggctggagtgcaatgatgcgatcttggcttactgcaacctctgcctcccggattcaagcgattctcctgccttgcctcctgagtagctgggattacaggtgcgcaccaccacgcctggctaatttttgtatttttggtaaagtcagggttttgccatgctgctcaggctggtgtcgaactcctgggcccaagtgatctgctcacctcggcctgccgaagtgctggcattacaggcgtgagccattgcacctggccgtgttttctgttttttatttagaggaagtcacttgatcatgcttttccccccacccatggcataggaaaatgattcttttgctgattgtgctgattaaatgtgatgtggaaaaacctactcctggtgttcagagaggttttccaggtcacagtggggtgggtctcatctggacatcagaatcattatgttaatgataactaagagcagttgactgcttactataagccagccactgacctcagggcattgcataactggcttcctttactcttcacatcagccctgtgggcttgggagtgagacctctacctagtttttaaacaaattacataaactttttggggctcagctccctcatctgaaaatcagaaaatgatacttctctggcattttgagcatgagttcaggagtcagacttcctgggtttgaattctagcttcttctatgactttgagcaaattactttaactttgctaagcctcaggtttctcgtgttgcataggcagatgatagtcatatctgaatgtaacgagaatcaaatgcaacctgggacacagtgaacacttggtgaacgttagtgccttggtaacagtgatgatagtgacaataaagatcgatgatgatgatgatggcgatggtgcttaacccagtatgaaggtgaagtgtctaagcttcttgagggcagagttttgtcttcttctgcactttctttctagtgtctagaattgcctgtaggtttacccctggatcccgtcaggatggggctaaatttagaatttttggaaagatgtgagctagcccgtctacagtgacatccagctcagtgtgtatgtttggtctgtgaacatagtagaggcatgattcaactgtgagtttgtgctgggagcatagatggatgcttttcaggctcttgaaatgtgcaagtgtggttcccttgcagcaggcattgcctctccctcgttaatcaagatcttttccttgccaggacttcaggagatcctggacatcctctggagcccaggggtggcctcacccgctccttgctttagcctggaatgcaggccctcaacattccagccttgggttagtgccagagctgtgaaagcagggcaggcatttccaccttgcttgacaaaggcttttgctctctgggtggttgggggtgcctctgaagccaggcgagaccagagatctcatgggtttgtgtttcttcattgatacttttaaggggagcaacttaatcagtgggaaaccagatctcaaaggatgggacagataaacscagggtacagagaagagcttgggggagtgtcaagcttatttgcccaaaagggctgaccctaccttaccgccattaatacatgtccttcatgcatccctgggtaacagggaagtagtaccaaaaatcttacagtgcaataaacacttggcagaaatggagaaactagtaatggctgagcagctgtgccctctccaccacctcactatgcagtacgtgggccaccagccgctaggggcctggcagccacagagatgagggaagcatgctgaggaccctggtgtggagttggaggggtcatgtcctctgaaaggtggccaccactcatcgccagcccttactgtcatgtgagaatgtggctctgtgtttccagatattgtttttttttttcccctccaacagaagcaggaaatataaaaaatttatataatatatataaaatatattatatataaatatataaatatataaaaataaatatatattatatatataaaaatatataaatatatataaaaatatataaatatattatatataatatattaaatatattatatataatatatttatataatatatataatatattatataaatatataaatatataaaaatatataaaatatataaatatataatatatattatatattaatatattatatattatatataaatatataaaaatataatatatataaaatatatataaaaatatatgatatataatatatataaatatatatgtataaaatatatattatatattatatactatatattatatataatatataaaaaatatatataaaatatatatataacttcacggaaactctgaaggagaggtcaaatataatattatatattttatatatataatttatatatatataaaactatatatatatatttttgagagacagtcttgctgtgttgcccaggctggagtgcagtggtgtgatcttggctcattgcaacctctgcctcccaggttcaagcgcttctcctgcctcagcctcccaagcagctgggattacaggtgtgtgccaccatgcctggataatttttgtacttttagtagaggcagggtttcaccatgttggccaggctggtgtcgaactcctgacctcatgatccgcccaccttgacctcccaaagggctgggattacaggcatgagccaccgtgcctggccaggaaattatatttttatgagaaatattctgttgtttaaattctggcacctcgttcttttttttttttttttttgagacgaagtttcactcttgtcgcccagtctggagtgcagtggcatgatctcagctcactgcagcctctgccttctaggttcaagtagttctcctggctcagcctcccgagtagctgggattacaggtgcctgccaccacgcctggctaatttttgtatatttagttgagatgggggtttcaccatgttggccaggctggtcttgaacacctgacctcaggtgatttgcccgccttggcctcccaaagtgctgggattacaggcgtgagccatggcgcccggccctagttcacaaaatatatatggccaaacaaaacatgtctggggctagacttggacagggggccccattgtgcaacctcttatatagcaaattagagtttaccaggaagtttctgcccttcaggccctctgctctcacagaaactctatgaaggagaggtcatcttgtctatgtttgtaagaagtcacattgagagaaatgacatcttagctcctcttatgtgccaagtagtttgtctgcgttatcttcttagattggctccatctctcaggtgaggaaacagacttggaaaggtgaagtgacttgcccacctagttagaagcacatcatcttctgattcctgtctcatttcatttcaccgcttgtttgccctctctgtggtcttgcccacggacttgtagtccctgatgtacgccaggcctctcacagtgtggcccccgggattcccttttatgaaaaaaagttgagcatgagctgtaagttagagtaggttttaattctgtcctaccacggagtctgttttatatgagaacaagttatttaactcctctgagtgttaatttcctcatttttttcctttctttcttttttttttttttaaagggccagtccccattctcacagggtgtttggaaggagtaactgaaggggggtatataaagccgctggcagccaggcatggtggctcacgcctgtaatcccagcactttgggagcctgaggcaggcagattgcttgagtctaggagttcaagaccagcctgggcaaacatggtgaaaccctgtctctataaaacatgcaaaaattagccaggcatagtggtgcatgcttgtaatcccagctacttgggtggctaaggtgagaggattacttgagccagggaggttgagactgcaatgagctgtgattgcgccactgcactccagtttgggtgatgcagtgagatcccatctctaaataaaaaaaaaataaataawgcccctagcatggtgcctggcacatggtaggccctcaaaagatgaccctccaaagtggccaggactcaccatgcattcagggaatatggattcttttggtggcagcaggctgcatttttgcctggctgaatgcctgcaagcatgggaacttttgatgcaacagtaatccttggggtctgaaaggccccaaatctcccgccagatctctgaggttaacatccagtcaaccttttgcttttcattcttggcctctttcctcctcacctccaccagtgtgacagtcatatcctctctatgtttctggtaagttctggccttgagggctggtcttatgactgacaagtgaagagcagtgccaccctctactccacattctcagaagcgtctctaggttccatactttaaggcaggctagcttccaaggcatactgacagacatccctgtgcagtcctgggggcacgagggtcccattccaccctggggcttcagggtcaggtgaggaaggtagatccctgaagttgggtccagaaaaggccactgggctagcctgtctctcgttctggtcactgacctcaggatccagcaggacgctgctagcttgcttggctcagctctgcgagtgctgggagcaataagcagtgctgaaaacgcgatgcatttcaacccaaagcactctgatccctttccaggctttgggagaatgttttttccagctcggttacttgctggcatgcataggtcaatatacaaggtgttctcagagaagccggagctgaatgttgacttttgtgctccctggggtgtgttctggggaggaagtgggttttcaggttgtggtgcgtgtaggatgtggtctgggatgattagtatcacacactgtggataaagttaacacgcattgtggagcttttttcctcttttgtacttttgggcgaaggtgcctcaaaagcagctttgtttatcaaggaggtgcccttgattctgtatgcatttttaacatctgaatagaagttagacgcacacataattgctttacttgatgcagtaaatacgtttcagccagataatccataagaccctagttcagatcctgactttgatccctcttagttgtgtgagctctcaccagtttacttgacctcactctctgagcgtcagattcctgagtgtaaaataggtacaaaaactcagattgttgtaaggtttcagtgagttgttgcgtgtaaagcatttagtatacagttcttgtcacaatgtttagtaatggcagctattatcttaactattagagcggcagtttggcgtggcactaataatgatgatggtgacagtttcactgagtgcttactacctcagctattcttccaagtactttgcatcacttagctcatttaaccctcacaataaagcgataaggtaggtgctgttctaatctctgttttacagatgctaaaactcggcagccaggtgtggtggctcatgcccgtaatcccagcactttgggaggccgaggtaggcggatcatctgaggtcaggagttcgagactagcctggccaaaatggtgaaaccccgtctctactaaaatacaaaagaattagctgggtgtagtggtgcatgcctataatcccagctactcaggagacagaggcaggagaatcgcttgamtccgggaggaggaggttgcagtgagccgagattgtgctatagcactccattctgggcgacaagagcgaaactctgtctcaaaacaaaacaaaacaaaactcaggcacagagaggttaagtaacttgcccaaggtaacccagctcataaatatgaaaagagcagggactttagagtcagaagacctgggtggcacgcttgcatgccgtgtcctggtggtgtggcctaccgcagagtgactgactctgattgccttcccaactgtaaaatggtgctaatgatacagaccgccccccattgcctggtgtggtgcgcggctgtgagtgcttaataataggtgcttaggcatcatttgctaattaactgactgtgttaggttattaggaagttccagtgggctaataaaagctctgggtaaacgttagttgttcttttaaatgtcctgaggtgcttatgattggagtttaaacagcacacctgtttttcagatttcggaaccacttaagagaggcacagtgtaaagaaggtggagatgagaatatcacctttactcctgatacagtcttggagaatgcagcttagttgtggggcagcattagctttctgatatgaagctgagattaggtggatgtaccaggccagtcacgggcagccttgggtacccagaggccttctcacgtgggtcgaggcaggtggtggaggtggtggcagcggtagcccccataatacttctaggtggaagaacagaccacctgagtgagagaaatcactcctgagccctgggggagaactgtgtggaggggcagatgggagcctggagttttgagggaaaaaaaactttccttttggaagccagacgtagggaagaagcatattgatcacaatgactattaaagaaagctccccaacaccccagcaaaacacccacaaaacaagaaactacttctgccaatggttctagccagttttcttcaccacagttcatgactgcttcatccttttaggtgatcacacccaaaacttttgggtcttcctgcctttttttttttttcttttgagaccaagtcttgctctgtcacccaggctggagtgcaatggcacgatctcggctcgctgcagcctccgcctcccgggttcaagtgattctcctgcctcagcctcccgagtagctgggattacaggcatgtgccaccatgcctggctaatttttgtatttttagtagagataggctttcaccatgttgaccaggctggtcttcaactactggcctcaagtgacccacctgcctctgactcccaaagtgctaggattacaggcatgagctaccacacccagcctttttttaaaacaaaaccaaaaccaaaagagacagggtctctggtgtgcagtggtgtgatcatagctcactgcaccttgacctcttgggctcaagcaatcctcctgcctccacctcctgaatagctgggactacagatgtgtaccatcacactcatctaattaaaacaattttttttttggtagagatgggatctcgctatgttgcccaggttggtcttgagaactcctggcctcaagcgatcctcctgccttggcctgctaaagtgctaggattacgggtgtgagccactttacccagccttgggtcttccttgactcctgactctcaaacctcatattcagtccatctgccagtctgtgggttcaatcttcaaagcaaacccagaaccttactacttctcacctctccccagccaccgctctggtccaagccaccatcgtctctcacctggattagtgcggggctctcttcctggtctccccacttctgcccttgtccctcttcagtctatttctatgaggccaccagaattatcttttttaaaaactgaagtcagatcatgttgctcctctgctcaaagccccgcagtgattccctggcacgccgaggggaaaaggcaagatcctcccaaaggcctgtacgatctgcccccggcagctccctggcctcttcattttgtgcctcctctgccccctctgcagagccacactggccctggtagtttctagaacacgtcacgttcatgcctgcctctgggctttgcatgggccttcttcccaggcacaacgtggggctctccccacttcttccaccctacagagaggccggccctgatcagctgttttataatagctcctcccgatcagtactcctgatcgctccctactgtgctgtgccttttttttttttttttttttttttttgaggcagagtctcactctgtccattgcccaggctgtagagcaatggcgtgatctcagctcactgcaacctctgcctcccgggttcaagcaattctcctgcctcagcctcccgagtagctagaacacaggtgcccgccaccacatccggctaattttttgtatttttagtagaggtggggtttcatcatgttggccaggctggtctggaactcctgacctcaggtgatccacctgccttggcctcccaaagtgctgggattacaggcgtgagccactgcgcctggctgctctgctttttacccatagctctggctctaatatatgacactgcccctccctgaattagaatggaggctacagggggatgctggtctgttagttgactgatgcatcttcagcacttaagacagtgtctggcacagagtaggaacagaatatggtcctgtaacaaatactgaaggttgtgctctgtgcacctgggatagagcaggagcaagacacatcattcctgccctcacagggttatggtctcctaggtgacaaggtagtgcacacttccatagstcttactctgggacaagtactgtgccaaatgcttcctcccagccgcctgatgaggtagctactgttagttatcaagtctgatttacaggtgaggcaaagaaaggataagtaattgacccaaggtcacacctagcaggtggtgaagctgagccatgggtcttggcttcaagaatctgtgctcttacccaccatacctgctgctgccggattcaaacccgaattgcattaaggaatcatcataacctgtttgattgaagctataagggaactttgagcatggtgaatggggcgctctatggaaaaggggttctgggaagcctctgtggaagggaggttttgttaagtgaactcccctggtaaacggagtgattggcccccaattagcttgctgttcggattaactgtartacatcacactttcgaaagtgaagatatgcctattttttcccctctaggtctataaagtagatttttgccattagtaaaatttaaagtgattgggggctatggttactgagaattcaagaggtagattgacgaaataatatttgaatgcaattttattttttgaaaaatgttttcgagatgtcctgtttttagccaggaagcaaactccaggaaaactctcttttccattaaagtgtggatggtgtactgtaaacaaagactagctctcttgagctgccacgtttctataacttatagaaacagaagctgttttttttttctaaagatccaaactcatgttgccacacaaacaacaaaataaaccagtgtgttccaaaaacaagcatttgctctacccacacgcacagttggaaagatgcaggtttgattgaagaagtcggaagccagtgaggtaatggcagattcttttaggggctcctgttaattttagtaagcttggaagaagcttctaggttgtttagtgtttctattagaaccatcacctcaacgaatttgttattgtagagattgattaggggatctgcttcctttgagcagccaggatcccccagctccagcttctagcctgcttttcttcctcatctctactctttcagaataatgcatggctttcaagtcctgtgtgataggtggcttcttagcgggcctctgaaggggctgagatttgttcctggggctgagactttgttcctttgagggtgcagaggctgctacctgctcaggctgcccccaaattgctcttgtgtgcagtgtgctgcttggggaccagtcctggctctgccaccatggcggacactactggcttcctcttaatctcaatctcttcttctcctttctttcttttttttggagacggagttttgctcttgttgcccaggctggagtgcaatggcgctatcaatcgttcaagcgattcttctgcctcagcctcccaagtagctgggattacaggcatgtaccaccacacctggctaattttgtatttttagtagagacaggatttcactatgttggccagtctgatctcgaactcctgacctcaggtgatccgcctacctcggcctcccaaaatgctgggattacaggcatgagccactgtgcctggccctcttctcctttctaacacaagcctgcttctcagtttcacgcacacataggagtggccacctgaccctgtgttggcaaatgattgcaggctgttgtcaccggtggggctcctggaaaagccctctatgggggattgactctggcatgactggggtgtggatgctgtgctcagaggtgctgcagtaatggttctgctgctgctgatagtaacacaggcagtgctgtgtcatgcacagtaatcctgtaagggagatactatcatgatctctgttcggtggatgaggaaacagtctgaggaaaggcacctgacctgttcaggccacacactaagtacagagctgggatcctggcaccagcatttgctctcaccacctctctgttatgtacctctcacacaggtgcgagtcccaccccagaggggccttgagaggctgcaagtgtcctgggtgggctgcctgcttcaggaggacttattattggggaaaaatacccccmctacttattactaagggccgaatgctttatgttcacacaacaactccatgttgtgtgactttggacatgttccttaactttctttatcttggtcttctcatctctgtaaaattgggatcataatggcaccaacttatagttttttttttttttttwtttcttttgagtcaggatctcaccctgttgcccagactggagtgcagtggtgtgatcttggctcagcccttgggctcaaacgatccccccacctcagcctcctgagtagctaggactacagacatacaccaccatgcctggctaattttttttttttttggtgggttttgctatgtttcccaggctggtttctaactcctggactcaagtgatctgcctgcctcggcctcacaaagtgctgggactacaggcatgaactaccatgcccggccaaacttctaggtttcttaaaaaagtgcctggcaggccaggcgcggtggctcatgcctgtaatcccagcactttgggaggccgaggcgggcggatcatgaggtcaggagatcgagaccatcctggctaaaacggtgaaaccccgtctctactaaaaatacaaataattagctgggcgtagtggcgggcgcctgtagtaccagctacttgggaggctgaggcaggagaatggcgtgaacccaggaggcggagcttgcagtgagctgagatcatgccactgcactccagcctgggcgacagagygagactccatctcaaaaaaaaaaccaaaaaaaacagtgcttgttgttcttttgttgttattgttaaaggatcattatctcattatcaacaacattggcaggtaattgagcaactgtttgtctccttgtcaatgtggagatagaaaattgcctacgaggttggacaaggtgctggagcagcgtcaaggaagagagatcgaacaagaagactgctttgcccttggacagctttgtttctgaagcactttctcatattctcccatttaatcatcccctccctgccaacttttccaacaggtgcatacttaggtagagctattctttatcagcctggggctaagatttgttcctgggcaggttatctttgtctctgcctggatagaggcaggggcagtagagttgtcatgcattccagactactagctatgcagaagcaggagcaaggtaagagcagatttgtatgaatgagggtgtcagggaatatcttagatgtccatttagttgttaaaaaagagaactgatgcctatatttcaaaacccaactttgatctggatgcagtggctcatgcctgtaatcccagcactttgggaggccgaggtgggtggatcacctgaggtcgggagtttgagaccagcctggccaatgtggtgaaaccttgtctctattaaaaatataaaaattagctgggcgtggtggcacacgtctgtaatcccagctacttgggaggctgaggcaggagaatcgcttgaatttgggaggtggaggttgcagtgagctgagattgcaccaatgcactccaggctgggcaacagagcaagactccatctcaaaaacaacaacaacaagaacaacaagaacaaaagaaaaaacccctaactttggagaggttatctcctgaaaaggagggttttggtctctttctcgcactgctctaaaatagtgactggcacatagtaggtagtcagtaaatatttgttgaatgaatgaatgaatgaaaggtaattggccttccctgctcagttctcattaaaaattctggttttcacatatatgggcagtgtcccaacaggctgctggggggtggccgtttgtgatggcctcaccagtctttcccagagagggaagtgcacatttttargctacttttgctctgactgatacacttggctgcctaacaaaaagccagagaagaactaagatttttagcatcattcaaaatgcttgccattccttttgctttgtgaaatcatgagctagttattttgagttcacataaaggtcagaacttgatctggggaaggaggttccccttggtttatgtgaggggaactttttcgcccttctgtttattttatccaaaggcttctgtttttctcccaagctaaaatctggcatttgttgtagaaagttctcagcttatgtgtgtgtgtgtgtgtgtgtgtgtgtttttaaaaagagctcatattttggctttagttttgattctcagtgattttttttttctgcctgagagttgattttctgcttcttcaaagtccagctctcaagtgggtgcctaaagttgtttcgttttagaggtgacttaatcattttttaggcctttaagtgctgctcccagcttgtgtttccttctgtttttagtttttatgtggggcagggtctccaaagtacacgggctcttttccccacccctctaccctcattttaactgtgcatcaaatgggtcctgtttcttcttcatgtataattttgtgagtcagggaaggtggtgaaggcccttgaaccctggctttgtcatggcccttccttaaggacctgaaggtctcttctcctaagggctaggttggttcagaaagtgagaagggctggaccttttgtggggagaggatacagcagggtccraacagctgggctgayaccgggcagcagcccagcagcagtcggagctgcagggtcagctcaccatgggctgaacttgggcattgcctgtttaggcagagtctgcccgagcctttcctgctccctgagaatcctcagcatgttttcctgctgagcaaggagtgaggaatgaagcccactacgaagcccgagctgcaaatgtatttatttatttatttatttagagacagagtcttactctgtcgcccaggctagagtgcagtggtgagatctcagttcactgcaaccaccgcctcctgggttcaagcaattctcctgcctcagcctcctgagtagctgggattacaggcgcccaccacgggcccgagaactgagtctcgcccatctaatttttgtatttttagtagagacagggttttgccatgttggtcaggatggtctcgaactcctgacctcaggtgattcacccaccttgaccttccaaagtgctaggattacaggcgtgagccactgcgcccggctctgagctgcaaatttaatagggaaactgaaggaagaggttctccacagcaccagtggggctgagacctgttttcctcaactacctttttttttttttttttttttttttttgagacagagcttcactcttgttgcccaggctggagtgcaatggtgcgatctcatcttactgcaacctcttcttcccaggttcaaacgattctcctgcctcagcctcccgagtagctgggactacaggcatgcaccaccatgcctggctaattttgtatttttagtggaaaagcggtttctccatgttggtcaggctggtctcgaactcccgacctcaggtgatctgcctgcctctgcctcccaaagtgatgggattacagatgtgagtcactgcgcctggccaactgctttggtttctgagtcctccctcctctaagcccgctcagtgtgtgtcattcctgggaggcggtggctctcccaggaccccatgccgaaatctgccttcttcttgtcttcattcccccacctggggtacccctcagtgttttcccattacacagattcacgtttacatgttctagaaacatctgtaagtctttttcctgtttgtaaattgtatatcctctgttagattaaaaaacttttaaaagtaagtgtctttctctgtggtgacctatttgtgtggcatagtataggttacaaagcccttttcatgcattgttttacttataagtaatgtttatagatgataccgaggtagaccctatggggtgcttactatgccaggtctgttctaagaatgttatacacattaccttactaacccaccccaaccatccattgtgttattgtcacccctgttacagggtggagagaagaaggcagagagaagtggaatgacactcctgaggctaggcatttgccaagtgaggtctgggatttgaacccaggcagctgaacttcagaatcctggtgtttaaccactataccatgctggccttcatgttattgagcaggataaggaattgtcactcttgacttgtttttgaaacatgaaaacccttctcttaaattcaaaagtaatacatagctgggcacggtggtgtgcacctgtagtcccagctacttaggaggctggggaagaggatagtttgagtccagaaatttgagactgcagtgagctctatagtcatgccactgcactctagcctgggtggcagagtgagaccctgtcaaaacaaagcaataacaaaaaaaaccaaagtaatgcgtattgcagcaagtacttaaataatgtagatgcataaaagcaaaaagtgagaatccccactcctcctccagtgctctgagatagactgaagtaactcttcagggatgagtgtaaacacaagggatgtcctcgaagactttccacttggaaagcttgtgtattttatacattaagtatcataaatatgtagttaccctaatgggtccccgccattgctctgcaggcagtgggctgaggttcaggagttaagtcagccccagggcacagggtggtgcaacagaagagcctgagtcgaatccagatctcccctctccactgtgactgtttcctgggaaactagtcaggggctggttttataggaattatccagtcgtattattattattattattattattattattattattattattattgagactgagtctcgctgtgtcgcccaggctggagtgcggtggtgccatcttggctcactgcaacctccgcctcccaggttcaagcaattctcctgcctcagcctcccaagtagctaggattacaggcttgagccactatgtccaactaatttttttatttgtagtagagatggtgtttcaccatgttggccaggctcatctggaactcctgacctcaggtgatccgcctgcctcggcctcccaaagtgctgggattacaggcgtgagccaccgcccccagccttccagtcgtattcttgacaaatggttttccatgaagttgtggacaccttccagggtcacaattaaatggttaaatgagtcacgattaaataatgattgtgggtacctcccagagtttcaatgaaaaagggaattaactttggacacagacagaataatgcaaatcttcagttttggtttagaaaatctgaaacctgcagtggggaatacagaaaagaaggaagtagaaggagtctgtccccaaccccgccccttccttttttctctcctctggagagagaagggattaggaggcctcctggaaaggagtccctttcctgtgatcaaactcaccccttccctccaccagagcaattacagagcctccggcctggaaccttcctcaccggcctggaggagacaccattctgcggacaatggggggaaggaaaggaaagcaatgccgctgccaatggtgcggatgacttcctcaatgccagacttgcttgcactttcaaagtccctcctcggaggtcccctggtaggacctggagataggatgtgctttcactctttacagactattgtccaggaaagaaagtttcagactttcttaggcagggaagggccctctgactgtgaatttatttggaaatttgaaagagaagagagtcttatcctaggaagtgttctttttctttccccctggatttgacaggccaggcaacagcaattatccaaaccactgctctgcaccaagaggcaaaccacaggaaaaagaaacccgaacaagcaaggagaatagaagttccccaaagcatgccttcttgtttttctcagaggacagtcttttcattcatgttttacagattggtccaacaagtgcagttcttctagtctcctatctagataagcaggatattagaaggaataggagaggcctgcaaaaagctatgatagggtggaaataggataggagaaactgaaaaaaggggaggcgtgcgctccaacacctccatagcccttggggacgggcttagtttctaatgagaatacagaaggcccatgtctcaataggccccgaaaaatattaatccagcccaatatgaacagtctgctaattatatgactgggcctgcttaggagatcagggcaatattacattcagagtactcagtttaggaagatgacacagtgtaatacatacagatttccatcatttcttttattcctcatttggagaggcaacagggctgagatagacatgttagcgatggctagattgattgatttattgactgaatgaatggcctgctttaggcagcgggaacactgaatgaacattttaaaatcagctggtataggtcaggaactgtgcaggttgctgggaatgggtagatgaaaagacattgctatggtttggctgtgtccccacctaaatttcaccttgaattgtaatccccatgtttcaagggtgggaccaggtggagataattgaatgggggggtggtttctcccatactattctggtggtagtgaataagtctcacgagagctgatggttttataaatgggagttcccctgcacaagccctcttgcctgccaccatgtaagatgtgactttgcgcctccttccccttccaccgtgattgtgaggcctcgccagccatgtggaactgtgagtcaattaagcctctttcctttataaattacccagtctcaggtatgtcttcatttgcagcatgagaacagactaatacagacatggaccttggctgtagggagtttgcactgtagtgacggcaagagctcacgtgatccattttaagatagaagagcgagctcaggcagaggaacacagagccaggatggtccatgcacggaatctggccctgcccttactttctccaggagcatgggctgggtccctctcctccctaatcctcactttgctcatgtgtgaaatgtagatcaagtaagttctacactcagaggtctcttgtgaagattaaatgagaaaaggcatggaaactgcctttgcacacagcctggtatatcctgatgtctgctgatactcttatttttatgttccttgacattccaaatctgccccagggagaattccaggacagctctggagaggaagtgatctttgaatccaaccttgaaatcaccctaggagatgcaaagaaggtgacaccagttaagaataagatgtgtacccattttcaaatgttcttttttttttttttcagatggagtctcgctctgatgcctaggctggagtgcagtggggtgatctcggctaattgcaacctccgcctcccgggataaagcgattctcctgcctcagcctcccgagtagctgggattacaggcgcctgccaccatgcccagctaatttttgtgtttttagtagagatgggatttcaccatgttggccagactggtcttgaactcctgacctcaagaatccacctgccttggcctcccaaagtgctgagattacaggcatgaggcactgcacctggcccaaatcttctcagttctaaatggctgtgataaaaactacattgacaatttttttttttttttttttttggagatggagtctcgctctggtgcccaggctgaagtgcaatggcgcaatcttggctcactgcaagctccgcctcctgggttcacgccattctcctgcctcagcctcccgagtagatggggctacaggcgcctgccaccacccccggctaattttttttgtatttttagtagagacggggtttcaccatgttagccaggatggtcttgatctcctgacctcgtgatccgcccacctcagcctcccaaagtgctgggattacaggcctctgcgcctggccttgcatkgacaattaatttgtttatggaaagccagttatccaatgatggtgaacaaatgcaacttgactgtataatacttattttggttttggaccaaagtcaccattaaatatgccaagttcttgttcaaggaaacagctaatgtcgtggacttgcatctcatttgtagttggttctccctgaaaagtcagtggtgtgggagaaatgatacttagtcaaaatcatcagtgaaaatcattgcttggatcatcccaaaatataatgaacaaaagtgatatttatctgccacattgagaaacattcaccatatctcaataagctctcctcagccagttggtccttttgtggttgaaaaaagtgccatatctttggttgggcatccaataaaatayggtatttaggggctacctgtatggaaaatccatatccttaaaggttagctcaccaggaggatgttgagaaatggcacagggggctgggcgcggtggctcatgcctgtaatcccagcattttggggaggctgaggtgggtggatcacttgaggtcacgagttcgagaccagcctggccaacatggtgaaagcccatgtctactaaaaatataaaaattagccaggtgtggtggtgggcgcctgtaatcccagctactagggaggctgggcaggagaactgctggaacscaggaggcggaggttgcagtgagctgagattgcaccactgcattccagcctgggtgacaggcaagactctgtctccaaaaaaaaaaaaaaaaaaaggcacacaggaattgggttgggactcagtagatcagtagatttagatctcccagcttagtctcatctccatagtgtgggtggagtagtactcacactatttaaattatttttatttcactacctgaatcccctcagcaagtatagtttaattcacctgagtaatacgcttatgcgaggggatttctccatgggccttttgtttttgctcctgctggtgatctgattttaaatgtgaacgtgccattgctaagagtttttgttctatgtattattctgtgtggaaaatttcttaaatgggattattgaagtatacttcattatttatcttctggcaatttatcaacaacagcaaatatcattcattattgtttggaggacagaactatttttatattctttaattaaaaatggctttgacattttcaaattcagagggaagttgataatttagtgctgtatgataggacctttagttggtctgaatgtcacataattgtacaaattgctgttaaagtatattattacttattttctgagaggtagagggacttggttatcctgggattgcataattattggttcactagaactacagatgagtgaaaagaagggttagatactctctagttcacttttcttccagtgcagggaacattctatggggttccgaacagatataataagctcataataacagtggccattgattgaactctttctatcaaacaatgtgaaaaacattagtagaggtgatatcttagtctgcttttgctgctgtaacagaatacctgagactgagtaattttttttttttgagatggagtctcactcttctgcccaggctggagtgcagtggcgctatcttggctcactgcaccctccgcctcccgggttcacgccattctcctgtgtcagcctcccgagtagctgggactacaggctcctgccaccacgcccggctaattttttgtatttttagtagagacggggtttcaccgtgttagccaggatggtctcgacctcgtgatcctcccgcctcggcctcccaaagtgctgggattacaggtgtgagccaccgcacccagcctttttttttttttttttttttgagatggagtctcgctctgttgtgcaggctggagtgcagtggcgccatcttggctcactgcaacctccacctcccgggttcaagcaattctcctgcctcagcctctccagtagctgggactacagatgcatcacgcccagctaatttttgtattttcagtagagacggggtttcaccatgttgtccaggatggtctcgatctcttgacctcatgatctacctgcctcagcctcccaaagtgctgggattacaggtgtgagctaccaygcctggccattttttttttttttttttttttgagacagagtctcactctgtcacccaggctggagtgcagtggcatgatcttggctcactgcaacctccgtctcccgggttcaagcggttcttctgcttcagccttttgagtacttgggattacaggcacctgccatcatgcctggctaatttttgtatttttgtacagacggggtttcaccatgttggccaggctggtcttgagctcctgacctcaggtgatccactcacctcatcctcccaaactgctgggattacaggtgtaagccactgtgcccagccccaagactgagtaaggggtgagcagaaattcactggttcacagttctggaggctgggaagtctcgtatcaaggtgccagcatctggccagggccttcttgctgtgctatcccatggcagaagtacagaagggcaaagaaagagggctgaacttgcccttttataatggcaccaaccccacccatgagggtggagtcctaatggcctaatcagctctctgagatcccatctgttaatactgttacaatggcaaytaaatttcaacatgagttttggaggggacagacattcaaaccatggcaggtggcaagaagtatcaaactactagatccttgggattgtgctttgtactggggtgtattttttccaacaatcctaaaaatcatttgaatagagatagcaatatatatcttacccatttggaaatgcacagagattcaggagtgttcacatagaaacagaagatcattggcttttgtccattcccaacgccagtgatctgtttttcttgactctttttgatctgtgtttctgaatgtgttgatatactgcgctactggtgtgcaggatgattttaaatgttgcacagatgaacattaatagtcatctattttaatatgtattaggaaaaagcccataaaacaatgaagcccattaaaaccccatggtttcttggatagtattacatagggtgaagctaattttatttcagtaaaaaatatgcaggtcaatttaaataaaaaaatagataatagtataaatgkcttgtggctacagtaaaaatgatgatggtacttgaatgtccaaattaatttaagtgatatatgtgttcatagataccatttcattttaacgtggttctgctggtcagaacagtcttacgatgggggtggtctccaggcttcaccttgtgcccactggctctgtttggttcctctgggctcacacacagggagctacgtatgtctctctcatttcctttggtatgttctctgggttaaatgtccccagctrtctgatctgttccctgcgggccttggccattcctgtcctggcctttactggcagtctctattctaaaatgtgggcatcccacatgaggtccagcttctcctgagatcccyggaggtgcagctgctgtgatggtgaccttgtttagcagatgctccctgcagtccaaactcccacccatcgtcctgccctttgatccatttcccatgaactgcttacctcagttttctcatctgtaagatggagagataactgtaagtgcttagcacagtgtttactagcacagactactgctattactgtcaagtcacttttcctttgctgccaataggtcattttctgtttatggcttcttcagtatgaactgatcaactgtaacttgaaaatttccagacttaggacttttggactcatagtgaaaggatcctttcccaattcccttgatcggtttttcctttaaaaaaaaaaaagatatttgacatcttttcactttcaagttcagtttctcttctcctttttttctgggtgatggtttattatttaaaaaatttctatgtatatgtgatttaaaagtaaacccacgtagctgaaaatgtctcataggtttttcttgcattttcagttgacccattcactttgcaaatctttagagtattatatttaagacagcttgcagctgttttcttatatatattttacatgacaaaattatatttaaaacatattaaactttaaaaaaccatagtttataatttataagccatgtagcatatttctrtttttgagacaggatcttactctgtcacccaggctggagtgcagtggctcgatcatggctcactgcagccttgacctcctgggctcaagtaatcctcctgcctcagcctcccaagtagttgggactacaggcacatgccaccatgcccagctaatttttatattttttgtagagatggggtttcaccacgttgctcaggctgtaatttttaaaaactaaaaaaagaaaaaaaagtgtttacaggactttaaattgagaaacttaaatatctttacatattctgtgttcctaatttatttttgcagcagtaattatttcagctgtctttagtattgacatgttggaacctcggattaatttgtgcatggatatatttagagccttttacttgacaagaatcatgtatatcatgactgaatttgtaatttcccagcatgagacccaaattaatagacagtatttagattctaggcaacgatgcattatataaaccagcatcatttagggagtggcaaagactctctccccaccagttctgtgaacttgggcaaggtgtgtaatctttctgagccttaatctaattagaccctttctcctgtaacccagagggggtgttagtaaagttggtgtgaaaaaagtcaattattgtactgatgcaatttgggtgaaactgtgaagttcagtgttcacatgatggttgtggagacactgaaccttaatccttaggccagggattcaaagttttttttgactctcatgttgaacgttgtctaaagtgcagtgtgccctagtttttaggtaattctgagaattctaaggcccttgctggaataattaatgagaatatgagatttcagcaaattagggccaggagtcagtgctctcagcatggaagaatctcacctccaaaaattttatgtgggttttacacattaagcaagcataggtgaggtgcagtgaaggggaagtgatggctgtcagtcgtttggccaggttcctttgcatacaggggagctagtgggtgtataccagctgagacagctgaaggaggagaacatgaagaatagttggaaactattgaacctccaagatttttctgtctttgttaacaactagcagttacatgctagcattatttatttatttatttagttagttagttagttcttgagatggagtctcactctgtcacccacgctggagtgcagtggcatgatctcagctcactrcaacctctgcctcctgggttcaggtgattttcctgcctcagcctcctgagtagctgggattacaggggcccgctaccacgcccagctaatttttgtattttgagcatgttggccaggctggtcttgaactcctgaccttgtgatccccctgcctcggcctcccaragtgctgggattacaggtgtgagccactgtgcctggccttatttatttatttttgagacagggtctcactctatcacccaggctggagtgcagtggtgcagtcatagctcactgcagcttggaactcttgggctgaagtgattcttcttccttagcctccccagtagctaggactatagtgccaccatgcctggctaatttaaattttttttktgtgtgtgtgtgtggtggagatgggttctcactgtgttgctcaggctggtcttgaactcttgggcttaagcgatcttcccatcttggcctcccagagtgctgcgattacaggcgtgggccaccacacctgtcctgtgctaggctcttaacgtccttcccagatgttatgtcccttcccttggtggctgctgctttctgccacattttaccttgccgttccgcaccttctaccatgtctccttttccagcctcattccctgagatgtagccggagttccagttcagccaacctgcccgttgttttctctcctggarctgggtgtttgagyctcctgcatggagtgttcttccttcccagctaaagtcctggtcatcccatttccatctgaaaggcccccttgttcatgaagcctctcatggtccttccccctaccccagccaggtatactttctctcctcttggaattaycctataggaagaacatggtggcttgacctgggttccagtctcacccatctgtttacctggggagtgatcttgagtgggtcaatttatgttctcagtgccttacaaaatggggcagaggatacctaacccccaggagctggtgtggctggggtaccttacacagggcctgactgtagtagcttctctccaagcattggtgtcttacctcttctgtttctctaatggtgttttgcacattcattgttgtattagagtttgtttttttgtcttaccttgttttaataaattataatcttatgggagatgacactgtcttttctttgtttcrtatataaaaagtgttttgctgatatacgtagaatcaagttggtctggagttactctggataagggatgaaatcagggagctcttgtgttcaaaggggccttcttcccttttttggttctttctcctcattttttagcttccatttttacttcctttagtattgagaaagtaccaggctcacttcaaagagttgacttcaaagctcccaccagctcagamatacttgcsactgaagcctgtaggaattggcatcaatggaagaccctgtggcggttgcatttaagattttttttgggacttctatttttataattcttttaaatggtaaaggrggagggttacaaaatatctgcgcctttaagatatcaaacataagccagtgaagttccaaaaaaaaaaaaaaagatgtcttagagaaatgaaaaggattttacaattggtagaaaagaacaactcttttttctttttctttttctttttttgtttttgagatggagtttcgctcttgttgtacaggctggagtgcaatggcgccatctcagctcacygcaacctccacctccccagttcaagtgattctcctgcctcagcctcccgagtagctgggattacaggcacgggccactatgcccggctaattttgtattttagtagagacggggtttctccatgttggtcaggctggtcttgaactcccgacctcaggtgatccacctggcttggcctcccaaagtggtaggattataggcatgaaccactgtgcctggccaagtcttttttctttaaaaaaaaaaaggttacttttactgttttgtcctagttacaagatcttaggacagaaataaagccttaacttgtatgtaacattttccaagatggctaagtggagttgcaggttacatagcagaaaacagaggcttgggcctgttgagacctcacacccagttcttcttggagctgtgggtgtgggctgaaagagaagacagggagattaaagaccagtgatttccctccatggaccctttgatgctcttgtttgttgactttttgaggcttggagtgaccgactcttccaggaatgagaaatggaatccctcccagttttgatggtcgtcccaggacatatttcctgaaggcctactctgtgtctcagcaccattccaggactccccccgacagccttacggagcgtgctacagtcttcctgatccaatatcctgccacctgcccactcattcaccctcggccctaccccatgcctttgcacgaatctttccagcctgagcagcctgagatgggtctttttccctgctccgaaatcctgacctcataatggctcatgaatccctattcaaccttcaagacctggttcaagggttaaatcctttaaggagacttctcctgatttttccccagctggttgctttgttctccagcgatttgtaaccttgtgaacaaatattctactcattttattctactggaatgatctatttacacttatctccctgcaaattgtatcctgcccttcaatggctaagtgaatggcataaacagatgctataggaattgagactaagttggagctgggtgatcagggaaggttttaaggaagagatctgggacaaatagctaaagatggattcagtgttttttttttctttttctttttttttttttgaggcggagtcttgctctgtttcccaggctggagtgcaatggtgcgatctyggctcactgcaacctctgccgcccagattcaagcaattttcctgcctcagcctcccaggtagctgggatgacaggagcccaccaccacgcttggctaattttgtgtttttagtagagacaggttttcaccatgttggccaggctggtcttgaactcctgacctcaggtgatccacccaccatggcctcccaaagggctgagattacaggcatgagccaccgtgcccggcctgatggattcagtttatgtgcaaaatttaagaggatgggtttcggcagttcaggttgttaggagacaagggtggaaaggtgtcctggagccctacagagatgggcttcaagtgccagccaaggtgtttgaccatttttagaagaggaatgagatgattaaagtggaacttttaggaagagtaggagtgagcgggatggatttaaaaggcggagtgagaggcatcaggaaggctgggtaggagagcattgctacagtctaggagggaggtggcaggggtgtagaccagggatcacaaagcaatggcttgccatctgcttctgtatacccagagagctaagaatggtttgtaccttattaaatggttgaaaaaatcaaaagaatatatgctgtgatatgtggaaattctgtgaaattcaaatgtcagtgtctgtaaatagttttttttttttttttttttttttgtggaacacagccatacttttcatttatgcattgtttgtggttgctttcacacaatcatgccagccctgagtagttgctgcagagaccatatggcctgcaaagactaaaatatgtacttatgtactatctggctctttccagaaaaaatcagcagaccccaggtgtagaccaaccagggtgaatgagtgtatgactggaaatgcaaagacgggcaggatcaagggacagtttagagcaggggtgtccaatcttttggtttccytgggccacactggaagaagaattgtcttgggccccacataaaatacaccaacactaacaatagctgatgagctaaaaaaaaaaaaatcacaaaaaatctcaaaatgttttaagaaagtttatgaatttgtgttggtctgcattcaaagccatggtgggctgcatgcgggccatgggttggccaagcttggtttagaggcggaygcagtacgggagagttttcccttctcttctgatgtaactccatgtcttggtggcggtgttctagatgtaggcatctttaggcaggggagtgtgcgtggaagggtgaaagggttgtgccttcatgacgctcgtgtgtgtgtgtgtgtttgtgtgtgtgagtgatgctgagctagtcttagagtaaatgcagacactggatggtagcgagttcagtgcagtttttatggagggacagcttgctgcctgctgatgaagccggacaagactgggtagtgaagtcaaaggcccacacctaactctgaggctcttgggggcaactgtgttgtgcagagaaggtaggagggcagaggaagaggaggagcggcccctgggagaatgccttctacccagctgcagcttctcaagggtgtgtttgcgtctgacctaaggtgttggagctctttgtttctggctgtgttcaggctttcccccgcttgcctttaggggaagctgatgactgctttagcgtaaagagagggccaggaggtcaacttccctacagtcccgtgcctgcttctgggttggggctggggagagtgctgcccactgaactctctaaatgttaaaagatacaaagaggaagcacagagtgaaaagggagaccccagaggacagcagaacatcccgaagcatatcccccatcagagaagaggcatgattttcacctggcttgcaggtgcaggatgggcatctcagatgctgtgagtctgagggcagatgcccatcagtccaggacagttcctggggacaaaagcctcttctcacctttagagaaattaagtcwtattggtagaaaatattttagagaggttctggtctaagcctctcattttgcagatgagaaacyacccaaggcccaagatggatggatttatcaaagccggttggtrctggaacttggatttaatttcaggtcttttattattactatggaacaaatcttaactttttcaagtgcataccatgtgcccggctatgtgctggatgtagatgctttatctgcaggtttaatcttcactacaactatgggaagtagctattgtctctcttttgcaagtgtgaagagtgaggcttagaaaggccaacttgcctgtgatcgggtaactcaagagggaaattggatcagagtccatctgagactgactccagagccaatgttcttagccaataggggcacataaaactgttctgagtggcttcctagctcctgtttccagtgtccaatccattctcggtttctgttcattcatcagatgtgcactgagtacctgcaagaagtcagaagggtgttgggttggtgaggacagattgtataccatcttggctttggccgagccaaacagaatgccaaagatcggcaaagatagggaatgattgttcttggcctcagctccacgctcccctcctctgtaaaactgcccctgacaccccggcaggattgaattcctccacctttaagctcccagagtacctcagctctgtctttagcacttcacactgtgtcatgcctccccttgggccctaaggccaagagcatgtgccatttatttttgtattcctacttctatagcccagtgcatattgggggcactcaggaattgttgagcgaataaaagaatgaatgaatacagacccagattgtcaatgattctcaaaccttattttacaaaagaatcacttgaaaagctggttaaagatcaaaactcctgagccctactcctggtgattgactcctaggtttggggtgggaccccagaatctgaatttcccggaagcgcccaggtgtttctgatgcgggtggtctgcaaaccacacttgcagcaaccctggcacaggtgcccagccttctggaataaagacaggaactaagcattaaaaatagcacgccattcatttgcttgtgccgagccgccaagtgccccctcctgcyggcgacaggtccggatgtgggccagttctcagcccagggaaaatgaacagtgtcttctccrtggtgcccagaacagtctgagtcagtggaatgtgctggccagtcaggcagaagggaacttccacttcttttttaaaaccttggtggaaactgtgctggcaaggcaaacagggaggagaggaagctccatgtggggcttgggcttggcggacgacttggggctggccggactttgggtggccgccgaggaccattgctaaatatgcccctttcgtcctgaaatagtcacttccccggctggcttttgtgttggtcggtcgccacaaatgtgtggctgttgttcaaggaggcctcctgggatataaaaagagagaatggggccaggctgcggccagggctgtgtaggaagacaggagagctgccttttctcctgtcccaccacggactcattgtaagattcagagggagtggcttctgggccctgggtttacttttccatctgtaaaatgggtggggggaaggggcagcatcataaagcttctttcttctcctgaaagggatgttttaaggcccatgtcaagattgaacacagggctctgttgttgggctgatgctactgatgaagtctcaggaagctcgaagtttgtagttaactctttcagggtagatgtggtgaatagtctcttggtattgtgttgatggtggcccactagaacagaaggtcccagagggcaagggcttggtctttcttcttcctctctgtatccccactgtttagaactgggctgggtgcagagtagtctccataaatgtttatggggccaatatctccaaatattggcacctactaagcgtcagtcccatctctcttttgtcttcttcacaggtttaacttgctgtttgagaagaggcgatatgaggagcagggcatttttggaggaagaaactttacctctgttttcaacgtttcatccagtttctcttctttttacttatttggagacatggtcttactttgttgtccaggctggaggctgaagtgcagtggcacaattatagctcactgcagcctcaaaacacctggcctcaagtgatcctcctgctttagcctcctgagtagctgggaccacaggcttacaccaccatacctggcaaattttttttttttttttttttggagaggcagagtcttgctccgttgtccaggctggagtgcagtggtgtagtcatggctcgctgcagcctctgtctcctgggcttaagccattctcctgcctcaccctttgagcctccttaattttttatttatttattttttttttgtagagacagggtctcattatgttgtccagcctgatatkgctatttttttttttttaatggcgatgtagtaatcttgctttgttgcccaggctgttctggaactcctggcttcaggtgtgtgccactgtgcctggcccagttgctctttacatggtggaatatcagaggttaaagacttggtaaaaattcatgcggtgcaataaaccatgtattacataataggggtgacacttgttaacttctcccaggctcagtttcctcatgtgtaaaataggtgaatagtatctaccctccaggagttgtacaaggctcatgtatacatagtgtatgtgaatgtgctgtatgggtgcaaggggttgcagaagtgataatgtgtgtaaacagatggtgtggttggctcattggaggggtggaggccctaagtgggatgacctctgaggtttactcttcctagagtagttggaaagcaattcagcctcagtggtaagctctcagctcttctagggcaggtccctcttccaccaccctgtgtctgcaagcattttggtattaagttgtttttctaaggctgggtgcggtggctcacgcctgtaatcccagcacttttggaggccgaggtgggtggatcacctgagatcaggagttcgagaccagcctgaccaacatggtgaaaccatatctctactaaaaataaaaaattagctgagcgtggtggtgtgcgcctgtaatcccagccagctacttgggaggctgaggctggagaatcgcttgaacccgggaggcgaaggttgcagtgagctgacatcatgtcattgcactccagcctgggcaacaagagtgaaactctgtctcaaataaaaaatattatttttctaaaaagctcttattttattgtgaaacacttaaattagcaaatctcaggcttgctgaataaggcttcccaggcaaaccacatcccacatgtgcaaatgtctggtgacacagtgcttcatttttttccactagtacttactactacctgacattatagtgtaagtttacttgtctatttgtgtatggtctgcctctcctatgagaatgtgagctgcatgaggtcaggacattgttttgttcactcatgaattcccagcacccaggacagtgtctggcatgtagtgagtacccagtaaatatttgtggaatgaatgaatgaatacttaagtgggtgggaagttcttggaccttagtctagacccatggttctcaaagagtggtcctgggactcttggggattcctgagatccttttagggatctgtgaggtctgtgaggtcaaagtatttttataataatagtaaactatttgtcctttcactctcattccctcatgtatgcaaatctcagtgaactgatattttccaaataaccaatgcataaggccacaaagccatgcagggtaaaaagagctatgaacaaaagttttctagagaagaatttggaggaaagagagtttattctagtgaacagatcgcaaactgggagatgctgcgttggtgtaaaatgaaggtgcattccagagagcaaagagagaatctagttttttgttgttgttgttgttttgttttttaaattttgagatggagtcttgctctgtttcccaggctggagtgcagtggagtggcgtgatcttggcttattgcaacctctgcctccgggttcaagcgattctcctgcttcagcatcccgagtagctgggactacaggcacttgccaccacgcccacacaccctactaatttttgtatttttagcagagacggggttttaccatgctggccaggcttgtctcgaactcctgacctcaagtgatctacccgcctcagcctcccaaagtgctgggattacaggcatggcagaatctaggtttttatagcaaaatttctggcccatgtccccaatcaggtttgattatgcaaatgaagggggcgggtcaaacttgcttagttctgattggctgacacagctgagttctgattggtgatacagctgagccctgattggttgatacagctgagctctgattggctgaagcagacgagctctgactgcttggttcatgtgagctctgaaagtcccaagtcaaaagggtgtggggttttgggaaactcggagtacgtagtgtgacctctagtcagcaaatggccacttggctgtattttaaatttaggtacactttgctgcttggggtccatcttgaggggattgcctttttyaggttcatgtttgttcacagagccattcaaagtgcagtggatacattataaattgtacaattatttgtaattaaaaaaagaacaacagcaaaaaacccaaagtgcartggatgcaaagaccaatggattttcatgtaacagaatatgaaaagttcaccgacacagtttcacattccacgatgcagagaagtttttaataactgccatccacatgttgagttttggtgtaacagcaaagaaaaatatccacaactactgaaaaggctgagaaaatactccctttctcaactgcatgtttttgtgtgagtccagaatttctttacattattgtaacagagtgaacgcagaagcaaatatgagaatccagctgtttcttactaagcagacattaaagagatttgcaaatatctaaaataatgctatctctctcacttttttttttttgtattggaaacatcattttccatacaatgtcatttatgttaacaggtgacagatttatttatttttattttttatttttttgaaacggagtttcactgtgtcacccagccacccaggctggagtgcaatggtacaatcttggctcactgcaamctccgcctcccgggttcaaaggattctcctgcctcagcctcctgagtagctgggattacaggcacccgccaccacacttggctaatttttgtatttttagtagagacggggtttcaccatgttggccaggctggtctcgaactcctgacctcaggtgatccacccgtctcagcctcccaaagtgctgggattgcgggctgggattgcgggcatgagccaccatgcycaacaacagatttattataagcaaaagctctttggggtcctcaataattttaagagcataaaggagaccaaaaagtttaagatgtgctggtcaagacagagccctgtggactatggaagggattgaagccattctgtggatcctataggcttcttttctaagcgaatgattagtgtttattcagtarccctatgtcaggtggtttctgtatgaatgagaggtttgcctttccagctgcggcggggctttgggcaagttgctgtctctgtgctccttcgtttgctcatgtgttaaaaactggcccaggggtctgggggtggggtggtaagaaaatgggttgagtctccttcatctctaacattttcatgtttaattcttggaacctccacttgttagctctgttcactcctctgaaagagattggtgagaattgaaacagtgaaagaagattttagagaaaaggtgacatgtaaagctgaacaagggttgcctgtgaggcaggcaaaaaggacatttattatatttaaaaaaaattttttttttgagacggagtctctgtcgcccaggctggagtgcagtggcatgatctcggctcattgcaacctctgcctcccggttcagcgattctcctgcctcagcttcccgagtagctgggattataggcacacaccaccatgcctggttgatttttgtagttttagtagagacggggtttcaccatgttgaccaggctggtctggaactcctggcctcaggtgatccactcgcttcggcctcccaaagtgttgggattacaggcgtgagccaccgtgcccagcccagaaaggacatttatatgtggggaccactgcatcttgcagatgggtaaactgaggtagcgacaggtgaaggctcagttacattcatcctgggtcccagactgtctccaacctgtagcctgaagctttgtttccttcctccctagcccaggatgacagcagtgaccttccatgggatcttttcctgggatttattgagccactgaggtcattggcctcaggccacctgcgtctctcgactgaccagttattcttcaaggaagacactgtgtgtgtgtgtgttttagttgctcttctataacttccgggtgctcttctcagagcagcagtgctttaaaaaatgtctgtgtgtgtatttccccactttgagccatgaaatatgttcagtctgttttttttctagtccaaagtatttccatatcattgtgcacctgaggaaatgcatactttgatagaaaatggacaaaaaagttgtattggtagaattaaatgaactaatgcatgtcaagcactgagcactttgactcaatagtamtaataataataataacacaatgtatcattatgatagtgttatatctctttagcaatcttgatagttgacttgtataattcacagtacagaagcttattctaaaactaaaatgctttggttctcctgtgtgccaggaacagcagtaaactttatgtcctaagattagtatggttggaaatgcatgtggcagtggttcccaaacactggtgtgyagatggaacacagcccgtgaagttttcagcggtccttgttaaaaagagataaaggaaagagataaaggataaagtgctgagattctcgtgaagctaaatgaagctaaataaacatccttcaatgagaatatgtccttcctatagtttttggaggaaaatatttccttttgtgagacaaaagtgttagtaggtggtaagtactttttatttagcatagtacaaagttgtggccctctgtcaacccttcacattttggtgtgtgtaatgtttgaaactgcattggtctgtaaaatcccaaacccaggtagataaaaccaagaagtgacagggctggaagggatcttaggaattagttcataaagaacttcaggctcagagaagrcatgtgagttgcctaaggtcacacagcaaatctgaagcaaatcagggctagaaacccatagacgatggtcatgagcactggttttgagtcatccatttgaacacacctgtgttcagattctacctctgttacttatgagctgatttcttacctgtgaaagtgggatacctacccaaggggttcacgggaggatttaataagatgatttggattaggaaaaactgacaaatttccccttccttcttctccctgccttcccctcacctgttaataaatagatccttgtgaaaggtcagtgagcagcatcagccagaagggctttgttttcagcaaggtccctgcatgtatgattacaatcctaagtaatatcagctgttgcttgcgttggtttctcagctctctcttggtgatctctctctttagctgttgaatgagttcaaagatctgggaagagctttgaaacccctctagcagcatttctgtctccagtcccagcacaggtctttggaggatgagataaaaagggttttgcccagggtcaaatgctgtgtacacgcttggtcactcttccctttcttgagatgacatgtccccttcttggagacccaagatgattgacaacaataacattcctttacaacrttttcttctcatctagagcactgggaggctgccttttaacagagatatcacagagtagcaagcatgcagacattctcatgacatcctggcagatatcaagaccaaagaacatcccatgttccctcttgaaggcttgtaataactgccataaattrtcttgtgggaatggagtggccctggcctaagctgtgctgtaccggactctcctggtgacagttttagtggctgcatatgtttgcagaagaaggaagcgtggtaacttggcaaacagctccaaacgctcctggcttgctgccacaggattgtccttgagacttgggcacagtgatgtgtgaaaaatgcccacctttgctcttggtgtccagtgggccttctatgggccctctatagaggtcatcacctggggattcctgactctggccaggtcctgaggtctttccatgttactctccatgttacttgagtaacataagagcttcttatggctcttatgttctgcaggacggatgaactaggtacccaggacaggtctgtttgtgcacaaggctgtctccttctccccctccttggtttytctactgaggctttgttgtgcttggctcagggtgatgttagcaaatgcactctccaccctgctgtgccacattaaggaaacgcatgttgtattggcttctgccaagtcagctcacatgctttgttttagtgactctgtgaagagctcatcatctattatttattcaggtaacacacttctatctcctaatttcggtgctactcccatttttcatccccggttagcgtgctgtgcggccaggagggctgcctgttgtctttaagaaccactttgaacatttttgctttggttatttattcataccaacatgttgttgttaaatgacgtgaaataaaaccccattttaaaaagaaattgtaaaaggaagctatgtcctgtgtggaaatcatgacaagcccagaaacatgttacaaaaacattaaccaggagcggtggctcacgcctataatcccagaactttgggaggccaaggtgggcagatcacttgagaccaagagtttgagactagcccggggaacatggtgaagcccatctcaactaaaaatacgaaaactatccaggcataatggtgcaggcctgtgattccagctactcaggaggctgaggcaggaaaattgcttgaacccgggaggcagaggttacagtgagccgatattgtgccactgtactctagcctgggcaacggagcgagactccatctcaaaaaaaaaaaaaaaacaaaaaaaccccacacacaacaaaaaataaatattgcctgtacctatcacctgaggagcccattgttaatggttgtgtgtctttttagtcttttaaaaaatgtgttaaaaaatgtagttgtcataatgtccgtatataaatttttaagtggagttgatagatttcatttgaagggctgctgtgtcataaatgtaaaatgcttagcaaggtgcttggcacctggagctgttcacagtaaatggaaggaatttttatggagggtgtaaggtagagtgggctcctgagccagactgccctgttccaggcctggctctgctatatctggctgctagagcctcgagccagccattgaagtgcagtgccttcatttccccacctgtaaaatgggggtaattatcatataccccaaagtgctgtcataaggatttaatgaaatatcccatgtaagatccttagagcactgctgccggatggtcatctcatagtaggtattggttgttattattcaggaaaatgttggaaaacacatttttaaacaaagctggtgttcagtcccctccctccccccaaccaaggaaactctctttaattcccagtctgctgtgattcagtgctggcctgggagcagccctcgagggcagacacagcacttgtcccctacccagcacagcacctgcctgtgcatccttagctgatgaatgaggctcacagccccaggcgccctgcatccttcccttctttctggtaccctcttttgtctcctccaaacacttgctactcaggcttcagggaggaagtaggaagtaggaggtggtttctccctcccagacccccagctcacactggtcttgaagggcgtggcatctgacagagcccggtggctggttttcacgtgtctcctgaagccacccctaaggagaaggcttcgatgtcatcttctggtcagagccgagcacagtggtcctcttcagagacagatccrtgcagcaggatggcacctctgttgtcctcccagactagcagtaggtacacgtgggcttcgcaggctgttttctgccctggaatgctgctgttttttagacccagcatacctcagtgtcagagaaggctggtttgtttgaaacggtcagaatgtcataaataccttatgat[450 bp omitted]cgaggaggaaggcggggcaatgttaggagcctctgtgccttggagctgcaggcgagttgtctggtcttgggtgattcccttcctatgtttgcatctcaattttccctcttgtaaaatggagctgagagcatcccttatatcacaggaatgtcattaggattacttaaggtgttggaatgtttcctggcctaggggaagagctcagtagaagcttgctattgccctaatatcattactatcccagatatgcattttcttgttatttccctgttaggcgttaagtgtgtgaaagtgtgtgtgtatatttaaaaggtcaaagtaaaattctttagaaccttagggcaggatagctcttgtttagttaggggtgtttggtgactgctggagaagtcacctacccagctgatcttacaattactgtctgcttaaaggcagctcttgacttggccttctctaggggaaaaacatgtagtttatgcaacttttcttttccctttctgctctggatttgaccttttgttccttcaggtgattgaaaaaattcgraaagtcacctgtttcctcagaattgctttaagacaagactaagtgaaccaacaagaatgaagtcagctttttggaaatacctcccaagaggccttgctctttatgcaggactgttatttcaaaggatggtgtcccctccccaaccataagaacgatccaaacctgttttctggggcccagagtttgctgaggataggmctgggctgaagctttcattgctggtctgtggggtagaggtaagcctcccctgtgaagctggtaggttacatgctttggcaacatgaattgttatttctggagtcccctgggtgctgtttagaaatgcaggtaggtggctgggtgcggtggctcatgcctgtaatcccagcattttgggaggccaaggcaggcagattacttgagctcaggagttcgagaccagcctgggcaatatagtgaaaccccaactctacaaaaatacaaaaattagccagggatggtggtgcatgcctgtaatcccagctactcagtaggctgaggcaaaagaattgcttgaacctgggaggcgggggttgcagtgagccgacatcgcgccactgcactccagcctgggccacagagcaagatttcatctcaaaaaaaaaaaaaaaaaaaaaaagaaaaagaawaaaagaaatgcaggtaggtgcttctagctactgctgtgggatagcaaggtagttaccaaactgataagggtagcatcttacttactgctgaaaaattcagtgtcttttttctttttttttgagacagagtcttgctctgttgcccaggctggagtgcagtggcgagatcttggctcactgcaacttctgcctcttgggctcaagatattctcttgcttcagcctcccaaggagctgggattataggcactcgctaccacacccggctaatttttgtatttttagtagagacagggtttcaccatgttggctaggctggtctcaaactcctgacctcaggtgatccacccacctcagcctcccaaagtgctgggattacaggcgtgaactactgcgccgggcttgagtttgactttttgaaaatattccacctataagtgaagttgtgcagtgtttgtctttatgtgtttagcatatttcactcagcataatgtcctccaggctctgatgggcacttggcttgtttccatgtcttggctattgtgaatagtgccgcaatgaacatgggcaaattgccgtgttgagttaaggaagctcttttccagtctgagtttgcaaatagcttttcatatatgagcgttgaatattatcaaatgcttttctgcattcactgagatgactttatgtatttaaaaaaatctgatggcctatattttctatttctaaactactcgtgtattcctggtataaatcaactcagtgtgttactctcgtttttatacatagctggattcgttttcactaatattttgtttgagatttttgcctcagtgatcatgtatgtgattgctctgtaacttttcattcacattttgtccttgtctgtcctggtatcaaagttatattggcttcatagaatgagggaaatgtttatccttctaaaaatatttagtagagtggtctaagatgagagtgtaagtgagtaaactttctcaatcaaatattttgtgatatgtttcaggaatttcattacatgtttggttcaatttttaaagcatttctttttattatttaaaacttttagcattggtgaccatccatgtgctgcttttattgccagcttaacttgtttttatgacatcttcaggaagaaaacctctgctgtctatttaatggagatgaattgttaaacttttaccatttgcaactayacgtctctatgagtcagacttttattgatcgtgtacaactaaatgaaacccggaaatgaaggaaatgtaacaagcgattttatgtattttttgtttgctcaaattgcctttataaaatagattgatactctataataagcaaatgttgtgaatttggaattttcaaattgaggcttactaataatgttawctattttatccgagtttatttgggtttcttataaaatgtaatttctcaagaagattttgctgccctaaaaaaaaaaaaaagaaaaagaaaaagacaaaaagggaagccactggttgctaatggctcctgcggctctgacgatcctcgatgaagtgttctttgattaagtgtcaagatgagtggtgcagacctttgacagacacatgattgtggttggagaaagcccagcattaactgctgaccttgccatctgtgagcaggtgttgaatgagctcagttccctcccagcccttctttttccctggtgggtcattggctcctgagtargatagatgcatgcaatagaagagctgttaatagcatttactctttcttaatccttattaatcccattcatatttcagtgtctgaaacttggcaggatgtcaagaagccacagtgcaagtagggaaattgaacagcaaggaccaagtacaatgttcccctgatatttaatttgctaaaacatgtaagaagaagaaagttcttacattgttaggtcccaaagagagtgccacyaagcaaccttgccaaaaccaccttgctggagcttcttattatctttttttagcgaatggcaataaagtcattttgtcaagctaaccaagtaccataatgagatctttgtggcataaattaaccgagtggggaaataactttgacaggggttgatgtccgaaatgaagtgttgtttgtctgatgtcaagcctgtggggaatttgaaccttgcactctttcctgataagacattaacctctgcatgggcttgctggcccaaccttttgattaactggacctattttcttgtagatctaatacaaggatttggagaaccccagtaaaatgctggagggacttagactctgatctctattgggatgtgtcaaattggagatttggtgggcttttctgccgtgtttactgcgatgggtgtgtgtatttgaagtctgtatgtggcctttaaggatgtgtttggggcgcagaagttctgggtaacagagaggctctcaaacgttagattttggattagactttgggtcaacttcagggtagcaagaggatggatacccgagaacatgttttctccgacttcctggcccctgtcttctaagttctgggtagtgatgggtctttggaggggcagccctttctgccatgtgaatctttgcccagccctgagggggtgagggctggccaagggagccgggccatggtcggagagaaggctgaggctccttgagaagcatttggagtttgagtcagttgtgtcttttaaaaaaattacccattttggacttgcctgtggaagcaattagagagatcacaggaccgtttctgattcccaattctgtccagtgtctattcagaaaaatagaaaacagtcaactggaacaggggattatttgagcacacacagagtcctgttgtctcagcagcgtgccctcagacaatttgccttttagtgaagtttaagcccatgaaaggaaataaaaagtgttttattagatggcaaagaaagatggactggacttatgagactttgagaatttttgctttttctttgttaatgcaaactttggaagagagcaactctttctgtaatgcaatttatttgtacaatgtggtagttattgttaatagctaataatgatcttcaactgggtaaaataccattgtgtgtttgagagggagagagagagagaagggtaggaggagagggagaatatcttttgttcaaagccaaatgttgctacttctgaagacgagtgcaccttatgggtatagccagctataatgtttatcaaacatatactttttttttttttttttgagatggagtttttgctctgtcacccaggctggagtgcagtggcatgatctcagctcactgcaacctccacctcccaggttcaagtgatttctcctgcctcagcctccctcgtagctgggattgcaggtgcacgccaccacacccagctaatttttgtatttttagtagagacagggttttgccatgttggccaggctggtcttgaactcctgacctcaggtgatccacccacctcggcctctgaaagtgctgggattataggcatgagccaccatgccctgcctcaagcatctattttgtgcaagagcttgcagaagttctttcctgcyacagccgtggttggccacattgctcccccatgaatatgtggaaactgacacttcaggagaattggtggctcacccatggcattcagctagtgggttatggggcagagactcaaactcagccctgactcccacagcattgttctttttctgtaaattgctgacttactcagttgatcacagttcattgccgtttacagaatttgtctgcacccattgtgccttttaagtgtcgattttctttcctgaaagcacacaaagcaaagcacggctctgcagtgtgacccaccgtgtgctgtgtggacagatgatgctggtcagcaggcaggaaaacgatctgcyaggcgctgggggtggggcagaggattgttcttcctgaccttggtatgaaaaccgtrtggagttcttagtgaggaaaatcactcttagcccaaattcctgcgaaggccgatgggattgtttttaagatttgttggattgctggatttgttgaagggagaactggaagaagctatcagaagtttacagggcatcggagggagacactccctttggccactttctccgccaaaactatcctggttttagcccaacagtttcccacgcccgcccccacccccacaaccttgtttgtttaaagaccattaaagaacgtcttcaatttattctggattgagttttcctcaaaccaaaccacccctcagttcaccccccagagctgttsaggcccttcctgggggcttgtggctgtggctgcctcagatcagagcagaccctgggctgcatcatccttccacattgtctctctaaagtacctgaagccagtagttctcaaactttggagagggttttgagtcacctcgagagctgataagaacagaggcccagattgaagttgaatagtgctgggcctttgtttttaccaagttccctggatggttctgctacctcctagcctgtgagaactactcctttgtgatttcttgccattgaaattttttctcaccttcttcttggcttgagtgctcttctgggttccttccggctgtccaaatcaaatttaattttcacacccagaccttgtccctgctctcatccttcagcccaccctcctgttccccattcagcyagaccccctgccagtcagttcaagtgctaggcatggggtatcgagtctcaggccggtccacagacattccagcacctggtggtaagaggtgagtgctgcgtggacccactgaggaaggctctggctgtgctgggggaggggagtttatgctcrtcctcatagaaggataagcaggaattaagtgggcaaaggagggagtgaggaagctctcactttctaggtagtaggaccagcatgaaccaaggtaggggatgacaacatggctcattcagggaatttgaggtatgttgatacatggaaaaatgtacctgaaatgtgagtcctgcttttgtgactcaccctttcctttacataagcattgatttacatctgttgttttttaagatagkgtgtatgttgaaaagttcagaacaagatcaagtggagacataaaatggtaagatgtgaaaagttgttcttgccagattaaatggttccacctgaagaaaattttttttttttttgagatggagtctcactttgttgcatgggctggagtgtagtggcgtgatctcagctcactgcaacctccgcctcccgggttcaagcaattctcctgcctcagcctcccgagtagctgggactacaggtatacactgccaagcccggctaagtttttgtattttagtagagacggggtttcaccgtgttgccccaggctagtctcaaactcctgagctcaggcaatccccagcctcagccccccaaagtgctaggattacaggcatgagccaccgcacccggcctgaatttttttttgttttgtttatttatttcttggttttgctggcctttaagcaacccaagactagggggctttcactccgtccttagagagctcaaagggcctgacttaggggacacagtcagtgaaggggatgaatgaatgagtttcagatccaggtgttctggataagtcactttacctttctgggcctttttcctcaactccaaacagaggatgtcggtatagacaatccctaggatcttgtcccctttatgactgatcacacagttccactgcttgcccttgaggctttggtgtccrcgcatgcctattcagtctgacccacaagaggccaggccagctctgttccaggysctgaaaatcccattaaaactccactcactagcctgttccctgggggtgctgaatcagcatttaatggggaaggccacgagctaggctctggtgggtaggaagtgtgtgacttctcttacctcaacagtttctactgtaactagcgggataaggtaaatctatggaaatgcaaggcttatgccgaggctcacagagtgggccaggctgcataagtcctggacaccacagggcctgctttgagaaggcagctgtggtcccacagccttgaccaccaggcaccatcctctgttgccagtggacccacatttcaaatcattttatctcttaaataacctgtattcatttgttccttcccatgtcttatccaccaaaaatctccaattggaaattcagacaaggattgagaccctgtgttcttaaattgggttgattgaaatctagaaacaatgatagtaataacagagttatcttctctcgaacatctgcctcctgcctgatgttatttcgcttaattctctcaagggcttgaggagagtcctgccataatccttcctttcagaggggaagatcgaaatttagctcagatctcaagctagtaatcatcagaaccaggatatagaatcaggactagaccacatggtccctgctctgagctgctgcgggtccatccctgtggctctgtccagggtaaatggatgattcaggggaagggtcagcaaactatagcccatgggccaaatgcagccactgcttgtttttgggtggcccaagagccaagaatagtttccacatttttaaatgggtggagaaaacaaaatctacaaagaataatgtttcatgacacatgaaaattatgtaaaatatacatttaacgcttgtaartaaagttctgttggaactcagctacagtcgttagtttacatatcatcgatggctggtttcgcagtacaagggcacagtttaaagcctgccaggcctaaaatgtttactgtctggcctattacagaagacgtttgctgacccctgatttagggcattcatgaggcttgatgagatgttgaaaatcagctgtctcctcccgycactctcttctgattgtgggtaggctctggtgcaccagctctccagtgatctcctatctgatgctcagagttctttttccattgcatggatgtcaaataaaagtgtctgctttgtggcatttctggcttgagagtacctgcccaatgtgatttgccaaggtgccattttatcaaaagtcttaggatgactggatgggtttgccttgaatttgttttgcctttgctgatggttgtatttaggttatcattgaaagaggattgcagaacagcggcagtttcctgtgctgtctggattgaagttgaataatgccctaacttttaattgaaagggactgttgtaggcgggagactgtctaagagctgacctgtcaccaccacctgagatgtctgagcccacccttggactttcttggcacgtggggaagagggggcctgggtcctgggctcccacctaaactcagcagaccccactggcaggtgtgtgttgtgggggtgatggaggctttttggagggcattgagctccttgggtggaggtggggtggctgccttgggggctcagtgcagctctggccatgatggacagaaggagacaagaatgtagcttcttgttctgagaacttcagcccaagttcctcctttcatgcagcagaatccaagacactgacttgcccctctctgctgttgaggcttctgtgttgcagagataccttctggccctgctttatcctagtgaggcagctcacctctcccgtgtttcactgctcgaactctccttcccaaggctgtgctagtggtagtgatgacaataatagctactatttattgtgtgcccctcgtatgctaagtgcttcacgtagattatataatttaatacttgtcacaacagtcttatgaggtaaatactgtatatatatttaaaaagactatttttagagcagttttaggttcacagcaaaatgtagaggaagtttcacagagatatcccaagcaccccttgccattttctcttagttatgaaaatgatcaaatgggctgggtgtggtcccagcactttgggaggccaaggcgggtggatcaccggaggtcaggagtttgagaccagcctagccaacatggtgaaaccctgtctctactaaatacaaaaaattagctgggtgtagtggcacatgcctataatcccagctatttgggaggctgaggcaggagaattgtttgaacctgggaggtggaggttgcagtgagccgagattgcgccattgcactacagcctaggcaacaagagcaaaactctgtctcaaaaagaaaaaaaaaaaaaaaaagatcaaatagacttccaagtgcccatgtctcaggttcagtactgatcagcattttaccctcctttgcttcagctccctcctgtcattgctcattgctgagagtgggtaaggggctttctcaggttcctgtagctggtaggatcccgctgtcctcaaagttcctgcactcagtggctgacggtgccaggtgactcccccttttggggtccatgacatttgctgctgtttctaaagcccctactgtgtgctgctaatcccctcaccaagcttgcagagcggatggtaactgacaggtgaaaaaatgcaagaagttaggtcacgggtccggggacatcctgctaataggtggtggtgccaggcttcaaactcaggcctgacttcaagtcccgcagcttctctgccccaccctgtctctgtcctcctcacctctgtagtgtggtgggactcggtggggtggtcgtttgactgtgggaacttctgtttgcaaagccttggaaggacccaggtgactgcagatagttccgtgagaagcatctgggactgttgacctcactgctgatcttccttgtgagcctgtgatagggctaacccttggctttctggccagagtgtagacagagacccgattagcattttgtggtcagtcagaggcagtttgtgaacctggaacttggaagctggtttcctcctctgggagggatgtggagcctggggagccaggaaggcatggactgaatatacacccagctgggcagtggggaagggaggattccgtggggagctagccctgaacacagcaagcatttggtaaatggtgcctgttagctgtttttatccgtattctaaggtggacgagcggcgcaggagagaactggtaggattaatggagtggtttcattattcagatttaagtgcatgcagccagaagtcttcaactgaagaattgaaactctctgctcttttttgggggtcatggtggcagtgtgaggggctggttcatgagtgaggagaaaaggtagtggcaggcagaatggtacattttatattcatattgtgcacattattcacacctgacatgggccagaaatcctctcctaagagagacacttggaaagtaaacagtttgttaatcatttcaacccgtggactttggttgcagggtgcattttgatcaagggttacaaacaccaatgtcttcagggacatttggggacataaataaagggaatggacaaaaagatggaaaagcatactgcctctcagtctttcgcatgctcatgtttgatagagaaaatcaacatcgtgggggcagtgttgcttggcaactgccatttgtcctcagcgttggggtgacattactagggaatggctgtgaactccaagcacttccccccgggaagcgaggctgacactcagatccaattcatgtctttaatgtggccaaatgagaaagccagatgtatttctgagaagccaaaaaacaagatttaaaaaatgctatctccctaatttttttttttgagacagagttttgctcttgttgcccaggctggaggacagtggtgcgatcttggctcactgcaacctctgcctcccaggttcaagcgattctcctgcgtcagcctcccgagtagctaggattacaggccaccatgcccagctaatttttgtatatatatttttttcagtagagacggggtttcaccatgttacaggccaggctggtcttgaactcccttgaactcaggtgatccacctgcctcagcctctaaaagtgctgggattacaagtgtgagccactgcacctggcttctatctccctaatttttaaatacttaagattttaagaaacatcacaggtcaagcaatgcatggcagtgggctagattcagacaggggagcctcaatttaggacccccagatttatcatacaaggtggaggaagggttcagatagggacttggggattgccaactctgaccctctcttcagatgaagagattagccctgtggaggagtccaggatttgtattttagtcttggtactgggtgttctgggttgagttgctagaccattctgggacaagttgctagaccattctgggacttactttcttcctccataaagtcaaagggtaggtagatcacacatttttaaagtgtgctccttgaggtgtgtcaggggttccataagcatttgctttcagttttattaaaagcagcctgtactctcaaatttgagtatatttgaaattgtaatgagagcagttgctcaggatggagtgtggtggctcatgcctgccccacactttggaaacctgaggtggaggaaaccttcaggccaggagtttgagaccagccagggaagtatagggagaccccatttctacaaaaaacaaaaatattagctgggtatagtgggacacatgtgtagtttgaactactcggaaggctgaggctgggggatcgcttgagcccaggagtttaaggctgcagtgagctatgattgtgccattgtactctggcctgggccacagagtgagatcctgtctcaaaaaaacaaaaaacaaaacaaaaacaaattaaaaaacaaaacaaaccaaaaaaaccaaccaacacatttgcccaaatagtgaatcacatcaaattttaaaattcgctggaaactatctgcttcttaatttgattatacatcaattatgttcaaagtaaaaaacaaggtaatttgaaacagctgcttttatccaggtgtatacacggtgtatacatacacagatatgtatgaaatgtggaactctatacccgtatgtatggagttcctcmtaagagtctttttgagaaaatagttccattgctaaaaatacccaatggaaacttctggcctgggatttccaagttcaccctcggctgtgcrtctcaaagtccacacagcctcaccaaaatagcccttctgggtacttttttctgtgtgttcttggaggaggccatcgtgcctccagctccctaaggcggaagatgagccagcggggatctttgcagggtggttggttctcgttccttccaccgaagccttccatggcatttttgggacctggaattgtgaattattctgcctcttccccacagtccctgatgacagcatgaagttcagagagtttatttgcagatgaggcagggaagccggcctgttctcatcttgctgtgcctgatgccttgtgcttggggcactgttcactgtgctgcctgctggcctgcttgtctctgccttttggaygggagataggccaccccacagtgccacacctgccttcagggaagcttttgggtgttccttgtctggcttctgggttcagtgggagggcccacccagcctgtcattttaatgatttaccttagaggagccagttttatagggagttgttggataatcttcacaaggcagataaatgggagagcaggaagaatgatggcctttcagagttgaaatctgtgctgctccaaatcccataaactgctatttgattttaaacattgcttgaagcggttcacattttggttaattacgtcagtgggtaaaaataactattgtcatatggtgtgtgggcttggctttagaaggataaagagtctattgttacccattgtgctattcagtcacttattacccatccttaaaagcccaacgtggataacagaaaacctggagagctttgtcacttgctgaaatccaagctgccctgtgaatttatccccaaacactgctccttttgagaaacttgtacaagctgccttaattyagtcaattcaaatgggttgatgggggctgttcccaaggcccaggacaggcaggggtttgtgacctgcagccctggaactgcctttgggtttcatggtctcagttgagacctgcccagggttgaaccagcttagtgctccctgggggtggttaagttcaaggacttcagggtccgattgaccttgggctgaatcttgacctggggctgtaagatgctcggtcaggaccttaacttttccaaggctcggtgtctacatctggaaaatggggataaacacagttcctccctgctgggattattgtaaggcttgaatgagatgataaatacaacatctgacttgcgactggacggtagcaaagggtttagttaatattataataagtagaatggaacagcattagattctcacacagggtcactatgttgttttctcccattctacccctgcatattaccctgaagcacccccaagcctctccctccccatccctcaagcccctccctccccatcccccaagctcaccaggtcctggcgcacccagatctttcactgcttttcttgcctgtgagctcttggggagtcaggaccaccttaagcaccctctgcatctttggcacctaacctggggcctggggccctgcagggccacaattagcagcatggacaacagcatggacggagagggtctcagagcctggagagctcctaggggctggagcagtcacaggaagtcaccaagtgaattgaagggtggtggctttggaggttcagtgaggcaagaagaaggctgttaggctgggaattaaggaaccttgtgttgttcgagtctcaggacaactcagatatggggtctgtattgcaaatgcccctgcgtcattttacaactgatgaaaacaatggctccacgagaccctcaagtgccagagctcatgagtgacagtggaagttgaactaaccttttaaccaccctagtccacacctgtcaggctgacgggctttcagtggtgatgtgttgggagctctgtgccgcagatctctgtgtgctcctgagactctgcccgcctgtctctaccctgctgtgcccactaggaggaggctgacctttatgttctacaccagtgggtgcccttggtctccagcttccagtgggccagtctggcgagagaccctagctggagatgaggggaggtagccttggcctctctccttgcccttcctcrctgctgctaccccaggattcttgcccatcccttactggttttccttaaccccaccctcacccttgaaaacagactctttaaaactctcctcactcaccctcattgagtgtgtcatctgctccagctaggatattggctaataccgcatgtttcagaaagaaaaattcgcagttctatttatttttttactgtggattgaagggagaggcaaccaggtatatggatgaaggagtagggcctggctgtcaccactggtgttcacaaaaggctcccgtttaagtcctcttatattccaaatgaggggttataggtcgagtcagggcgttgctctaacagaagcaaaaccaaaaatacacggccgtagatacaaccctgttctggtacttcctaattttgtgtgtacatgtgtgcacctggagcttcaagaaatgaaaatggaaatggcctgagtgtttctcagccctaggatgaggctgtttctgtgatttagggctggaggttatgaagacttggtttacaatatgcacagtacagaagcggggaagtcaaggtgtgctgggcaaggaaacatctttatgtgacccacaaagagtgaagcagagggaagaaccagaagttattctggtttgcagactgggagacaggtttaatgacacagtcatgtcagagagaggggaagaggagaatacgtagggggtctgttttgatgtgtawgtacatgtaggattttcatgtagaggagttggggaaaattttagaagttttaggtgtaaatgcagctggtaagatccttatgacttagtttctttyttttcttcttttcttttctttctttctttctttyttyttttttttttttttttaagacagagtctcactctgttgcccaggctggagtgcagtggcgcgatctcagctcactgcaacctccgtctccccagttcaagcaattctcctgcctcagcctcccagagtgctgggattacaggtgcatgcaaccacacctggctaatttttgtatttttagtagagttggggtttcaccatgttggccaggctggtctggaactcctgacctcaggtgatccacctgccttggcctcacaaagtgctgggattacaagtgtgagccactgctcccggccttagtttttgagtgggaagaatctagtgttcagagtggaccactgatgtcatagctgcaggtttggctgaattgggatggtgcagaaagccgtgttaaccatttctttttctctgaggcctggaggaggakccttgtgactggaaccacagttgggactggcagtggtttttcctgctggcaaggaaaaaaaaaaagagaaaagaaagagttcgacttatcagcacaaagaaaggaggatgtgaaactagaaccatctctagggcagttctagcaatgaacaaggctggaaggctcaccggcgaggggtttcccctcaggaaaggggacagagaagcttccacctcctgggtagcattgggtgttcctgggcacatctgggtgactaacgggttttctgccacacaactggggtatatagggaagtctttggccagaactgtgggccgtactgcattcttcccgtgtctgtcactgctgagtcgtgagcttgatctcttttcttagtgtttgctccttttgtccagctatgggggccagcagaagctttgggtcatctgtaccagtgactttgctgtgaagatgtaagggagagtggttgaggtcaagatctgggttctggttcttgtgcctcctctctggctgtgtgtccttcaacaagctgcttactgtctctgggcctcygtgccctctgcaactgggttgttggtctatttaaatacttggagaaaaaagctgggcatggtggctcatgcctgtaatcccagcactttgggaagccaaggtgggaggattgcttgagcccaggagcttctgaccaatctgggcaacaaagtgagatgctgtccccatacagaaataaaaaaattagctgggcatggtggtgcatgcctgtagtcccagctacttgggaggcttaggtgagaggatcgcttgagcatgtgggatcaaggatgcagtgagctgtgattgcaccactgcactccagcctgtgacagagtgagaccttgtctcttaagaaaaaagttattcaaaaaatactttggaaaacaatgctggggagagtatgagcttcagattgcacattggtttctatcaggaggatctgagcctcggtggtgttacctgtaaaatggggataaaaatacctcacagggttgcagtgaagatgtaaggatgatgatgatgacaacagcagctcaaatagatcatttaacttaattctcgccaaagcaaggcagrtacaaagatcatcctgttggcagatacagacagggagggacagagaggttaattaagcaagctacctgcccgcagttacatggccagmagcagtggcactgaacgacttccttcaggcggtctgagtccaggtctcagctcttagccatcactccatggttctgtgctgagacaagggatgtagaaagcccagcacagtgtctgttacatagtaggtgcttagtaagttagacttcctttttatcctcagaatgcgtttgcaagtatagcctcccacagtgcttttactttaatctttccccttactgggcaaaaaaatgtttgctgccctgtgcgacttgcctagctattgacttctcttttttctgcctctctcctatgatccatcctagactgtggattgaggctcagcctagattaaagggcaggggctggaggaggaagatgagctgaaaaagggtaggcctgaggcgcgaaggagttgatggtagggtggaaggtgggaatgggaagtttgagaattggaggacctgggggcaagactttccccctctgggctcgttctttccttcctgtgccgtttattgagtgcctactgggtccaccattctaggcatggggcacagacaagatctctgttctcatggagcacacagtgtggttggaggagtcagtgatggacagagagtgaggggtgttggtttccatggctgctcggagaaggacttgctgaggaggtggcgttttgggcaggccatgaaaaggtctgggcagagtgtgtttgtgggagggaataaatatgtaaaggctctaggggagaatcagtttcgagaatgtgagggggcagtgagaccagaggggctagtgggctgtggctgagtttgaattttattctaagtgtcatggaaagtaggaggacggttttttccaccagggtcctttttgattattttattcttcgtgacgatcctacttaaaaaaaaaaatcttattcaccaaaaaggtgtgtttgtgaaacaatagagtgtacaaccttgaatcactttagatttttaaagtatagggaaacaattatggatcacaatgaatatccttgagggctgctcccctccccagctgacactgtcagctaaacctttaaggcctcttgtgtgtcaagcattaattcttcccaaagctgcttgacatgtgattaaaaatttttactgccacctactgatggaaagaagaagatgaatttttgtacaatgaaaatcccaaacacagtggatttctggtttccactgtgctgtcaggactgggaaatgggtctggggaaggggtgtgctgggcttggtatcccccccacccaaccccctttttttggccctgacaatctggtctctgcttctgtgtccttctgcttcagctcatcgcacagtgggtggagggaggtgctgacctggggagttgctccggggagagggctggaggtggggggatgtgtctggggagaaacactgggcactgggagtcagcagccgccagcccccacataacccagttaatcctttgtaattgaccccgaggttgcaatgattccctgtgtttaatgtcccaagacggcctaaccctgaccagcagacctttgcttaatgtgcttcttaccaccccacccccattattaaatcctcaactgctttatttctgatttgcattttccatggctgaatgaatctgctgacttccgttttctttttctgtttcagatcytgtgcgcaggtggcagtgagtacccttttcctctctattcttgtgttgttcgctactgccccctaatggacacacagcaacattaacagcaatgtgaaatgctaatttattaaaacctgctcggtttccaatttttctttttctttttcttttctttttttttgagttggagcctcgctctgtagcccaggctggagtgcagtggtgccatctcggctcactgcaacctccgcctcccgggttcaagtgattctcctgcctcagcctagcaagtagctgggattacaggcacgtgccaccatgtccggctaattttttgtatttttagtagagacggggcttccccatgttggtcttgaactcctgacctcaggtgatccgcccgccttggcctcccaaagcgctgggattacaggcgcgagccaccacgcccggccccaatttttctttagaagtaggagtgagggtggaaacaacaaatgaaagaaaaaattttaattaattgtgcaatcatgatgaaaatttatattttctgtaatttttttctagcctcatctgtgggcgatttaacttagttgaaattrtaatacattatttgtatattgtttatgtgctgttatcctttaagtattttcttgtgttgctacattgcccttttgttgctacattgctacatttaaagaatggggtggaagatcgtcataacctttggaaaatgagacctggactcccgcatgttttgctttcatgcacagggctgagtcccaactgctgacagtgctggttcattccctggtaataaaatgagaaaaataaggatatgactagaagttttttaaggaagcttaaatatattcagttgaaagcaccatccatccctggattatgtccttactaattttttggtcataaaacatttctataagaattgaaggccgggcctggtggctcatgcctgtaatcccagcactttgggaggctgaggcaggtggatcacctgaattcaggagttcgagaccagcttggccaacatggtgaaacaccatctgtactaaaaataccaaaaaaattagccaggtgtggtggcatgcacctgtaatcccagctacttgggaggytgaggcaggagaatcgcttgagcctgagaggtggaggctgcagtgagccgagatcactccattgcactccagcctgggcaacaagagtgaaactccatctcaaaaaaaaaaaaaaaaaaaaaaattaaaaataatagtagttggtagtttttaaaaaaatgtaccttttaggaaaaaaaaaaaaaccatggtttttgtttctccccaaaatttgggaactttttttttcctgattggtaaaatctcagtttgtgagataaaataattagattgtactcatggaagcatatatgggcagatcttgctgaaatcttctaataaagcaaatctcaattaataatggtaattagagcctgtgcaaacaatgggaagagtactgccgttggtttttcttcctgttaattagtttaataaataaactggtgggtaccttgtacaggcttgaatcactgctgcagaagaacacttctattcaaacatctaccgtaggtagtagaattgcgggaaacagaaatcatgagctattttaactgaaaggatttaccctgggaagtgagagtttacagagtcattggaagggccgctgtattagtttgccagggctgctgtaataagatcaaggtcttgggggttaggacttcaacatatgaatttgggggtggcrgagcacaagtcagctcataacagctggggaggaggctttaggcctggccctgagaaattactcccagactaaggctgcagaactgaccccctagagagtcaccaccttggtcatagacagcaagcagaragggaggaatcaggaagtccctgctgtagttgctggatccagcggtgaatgttctgagctgtgatcctgggatcaggaagctgcagccactgccacagtgttggttctagagccaggcagcatgagatccagtcatcgcatccacactacagctataagaaggaggaagggcagaaggttgtgctccaccctttaaggacacttgctagaagtcagacagaacgtctggtcacactctgtttgacagaagttagtcacatgcaacatctagctgcatgggaggctgggaaatgtggtctttgttcccaacagctatgcatatacagggccaaaaatctccaggagtatgatgaagggaaaatgggggaatggagtttgggggtcaagagtggtctctgctgcacctccctgaacagagactctaggagactagtaatgaattcaagataaagcagccagtgtggccaaggttctccttcagtgcctgagctcttggccataggagctcacgcctcctctcctttcctgtgaatgactgtgtgcagtgtaagcatggagcttctgcactctcgtggccaggtactctccatgtggccagaaatggcagtttctgaggggctcatgttgtaggtgatgatacaaagaagagaaagagagggatcagtttttccaagtgtgsatttcatttcagtgtaaatattktgtgaggtggggcatccctgtctcctggagaartatatttttaatctaattgtttactttctttgcatagcccctagtccaattcctgacccttcagtagcaactgttgccacaggggaaaatggcataacgcagatcagcagtacagcagaatcctttcataaacagaatggaactggaacacctcaggtggaaacaaacaccagtgaggatggtgaaagctctggagccaacgatagtttaagaacacctgaacaaggatctaatgggactgatggggcatctcaaaaaactcccagtagcactggtaagcataggcttttctgccagtcatgtttcttaaaggaaatcggtagaatttataaatgtcatgttttccaaatactgttcttcttttaattacctaagaaaatcttttwaaaaatttttataaagatagtaatgcatattcattatataaaacatagacaagaaaagaataacaagtaaatcattaactggagataaccattgatcacttgatatacgagttttataattttaagatatatgcatgcctgtgtgcatatgtatatacatatatatgttttattttgttttacaaatatcaaggtcatcctttacatgtagcttctcaccaatatattacaaatattcttccctgttagtatatacatttctacaggacagttttaatacctgcctggcattctattttctaaatcagggttggcagataataatggtccttgggccaaatatagatcactttctgtttttgtaagtaaagttttattgagtctgcctatggctgctttcatgctagaattgagtagtggcaatggagaatttgtggcttgtaaagcctgaaatatttattctgtggcccttacagaaaaacattgctgatacctgggttagataattgattctaaaactgtggttcagagatctctaggggtctcctagattctttcaaggtatttctgggtattgttttcataatactactaacatgttatttggcttctttactctcattktatcatgagtgtacrgtggagtcttgcagattctatatgatttgggatgacactgtcactcttacagctaatggaatgtatgctttcatattgtttaaaaaactttatcttttttatttctaatacagtatggtaaatattaatcaatataacccatataaacaaaaattctccgggagccttaataatttttaagaagttaaaagggccctgagaccacagtgtttaagaattacttgtctaaaagcattgtaaattatttaactgctcccctgttgttgggaaggtagattatttatttataatttttcataaaaaacattgtgatacaatagttttgttagttctagaagtattgataaaatcacatacacagttaaaataagtcattgaattatttctagggtaatatgagaaacttttagaaattcctaaggggctgggcacagtggctcatgcctgtaatcacagcactttgggaggctaaggtgggtgatcacctgaggtcaggagttcaaggccagcctggccaacatggcaaaaccccgtctctgttaaaaatacaaaaattagccgggtgtggtcatgcatgcctgtaatcccagctactcgggaggctgaggcaggagaattgcttgaacccaggaggcagaggttgcagtgagtggagatggtgccactgcactcccgacagagtgagactctgtctcaaaaaaaaaaaaaaaaaaaaaaaaaaaaagaaaaattcctagcaagcttatgttaattattgttacaaaaatttgggcttagaggttgggaccataccagatggtcttcccagaaatcactggacaggcttactgttgaagggcatttccagaggaagccaatctacaatgattggaataagaacctacttcttcaaatatacagacatcaacacagagtcacaaggatcaagaataatcagggaaacgtgatattaccagagaaacaaaataaagtgcaagtggttgaccataaagagatgggagatgtatgaactgtctgacagagaattcaaaatacatgttttaaggaagcctagcaaactttaagaaaatacagataaagaattcaaagaaatgaggaaaacaataagtgactagattgagatatttaacagagaagcaaacagaaattctgaagctaaaaaatactttgaacaaaatgaaaaatgtaatagagagcaccaagagtagaactgatcaagtagaagaaataatccttgaacttgaagacagattatttgaaaatatacagaggaggaaaaataaaaaagtggataaaaaggaatgaagaatgcctataggatttatgcaacagcatcaaaagacgtggtatttgaattggagttcatctaggggaagagaaagataaagaggtagaaagcttatttaaagaaatagtagcagaaaactctccaaacctggagaaagatataaatatccaggtacaggaaggacaaatgactccaatcagagtcaattcaaacaagactactccagaacataatcacactgtcaaacatcacagacaatggggatttggaaagcaaaaagagaaaagaagcaaataacatgtaagggagctccacttcagctagcagcagacttctcagcagaaacttacaggccaggagagagtgggatgatatattcaccatgctgagggaaaacaacctgccaaccaagattrctatacccagcagaactggccatcaaaaatgaaggcaagataaaagactttaccagagaaacaaaagctgagggagttcatcaccactagacatgtcttataagaaatgctaaagagagtttttaagctgaaagaaaaggacactagtgattaattgaaaacatatgaaaggataagactagtaaaataaatacacagtcaaattcagaatacatgaatactgtaatggtcatacatatctttaatatgaaagttaaaagataatacttaaaaaataataactacaataacttgcaggggggatatgcaatataaaaagatgtaaatggtgacataaacaattcataatatgagtggggaatggactagaagtgtagaggtcaatttgtgtgtgtgatcaaagttgtcatcagcataaaataacctgttataactataagattctttttataagcctcatggtaaccacaaagaagaacctttagtagatacacaaaaaataaaaagcaaggaatcaaaacatactactagagaatatcacttaacctcaaaggaagatagtaagagaggacggaaggaacaaagagtctataaaacaaccaaatggcagtagtaagttcttacctatcaataataaccttgaaagtaaagggtttaaattctccaatcaaaagacatagagtgcgtgaatgggttaaaaaaaaaaaccgatctcaatagtatgctgtctacaagagactcacctcacctgcaaggacatgcctagactgaaagtgaagggatggaaaaagatactccatgctaatggaaatctaaagagtggcaggagtagctatacttatgtcagataaaatagactttaagttcaaaacttttaatggagacaacaaacatcattttataatgataaagggatcaattcatcaagaggtcttaacaattataaatatatatgcacccagcattggaatgcctaaatatataaagcaaatattaatggatctgaatggacagattgactgcaatgcattcatagtagaggacttccaccaccttacttccagcaatggacaatgatccagacaggaaatcaataaggaagcatcagacttaaactacagtttagaccaaatggatgtatcagacatatacagaacattccatccaacagctgtagaatacacacttttcaactgcacctggaacattctccaggtagatcatatgttagaccacaaaacaagtsttaacagatttaagaagtgtgaaatcatatcaagtatcttttctgatgatggcatcaaactagaaataaataacaggaggaacttaagaaaattcacagatatatggaaattaaacaacatgctcctgaataactaatgggttgatgatgaaattaaaagggaaactaaaaaatatcttgagacaaacatcacttcttaagcaattttgttaacatatttctttttcttctttaaaatggtgccataacctccttcatgaaattgctgtgagacataaattagaaaatgcttgtacagcccctggtataggatctgtccccaggtcacttacagcaggtccccagcaggggtcatgctgatcttgccatctcccacagtaactattgttaattgttttgtcacaaatgcccctgaacaatcaatgggtcagtgaagaaattaaaagggacatttaaaaatttcttgaagcaaatgaaaatggaaacacaatatactaaagcctatgggatacaccaaaagcagcccttccaagaaagttgacagcaataaactcctacatcaaaaaagaaagctccctgggcacagtggctcgtgcctgtaatcccagaactttgggaggccgagatgggcggatcacttgaggtcaggagttcgagaccagcctggccaacatggtgaaaccccgtctctactaaaaatacaaaaattagctgggtgtagtgacacacacctgtaatcccagctactaggaaggctgaggcaggagaattgcttgaacccagagggcagagattgcagtgagccgagatcgcaccactgcactccagcctgggcaacagagcaagattctgtctcaaaaaaaaaaaaaaaaaaaaaaaaaaaaaaaaagcaagctcatacctccagcctgggttttgagagcctgtctgaaaaaaacaaaacaaaaccctcaagtaaayaacctaatgtagcacgttaaggaactagaaaaataagaacaaactaatcttcaaattagtaaaaggaacaaaataataaaggtcaaagctgaaataaatgaaataggcactagaaaaacaatagaaaagatcaataaactaagttgtttttttgaaaacaaagaacattgacaaagctttagctagactaagaaaaaagagacgctactcaaataagaaaatcagaaatgagacattataaactgataccacagaaatacaaaggaacaattatgaacaattatatgccaacaaattggataacctagaagaaatggataaattccttgccatataccatttactatgattgaattatgaagaaatagaaaatctgaataatccaataatgagttaggagattgaatcagtaatagaccatctcccatttctatttattactgttgttattctaagagacagtgactccctctgtcacccaggctggagtacagtggtgtgatcatagatcactgtaagttgaactcctgggctgaaatgatccttctgccttagcctctcaagtagctgtggctattggtgtgcaccactacatccagctaacttttaaaatttttttgtagagatggggtctcactgtgttgcccaggctgctcttgaactcccagcctcaagtgacccccaccaccttggcctcccgaagtgctgagattacaggtgtgagccacccagtcctctgccaaacctttaaagaagatctaatgacagttcttctcaattgcttccaaaaattgaggaggagagaatacttccaaactcatttaacaagagcagtattaccttgatacgaaaaccagacaaggatacaacccaaaacactataggccaagatgcaaaaatctttaaccaaatactagcaaacctaatttaacagcatattaaagagatcattcaccatgatcaactgggattcttcctagaaatacaaaaagggttcaacctgtgcaaaacaataaatgtgctacaccatattaacagaatggaggacagaaaccatacaatcatttcagtagatgcagaaaaaacatttgaccaaaaaatattgttaactgtgctttcttttctgaacttaagaacttgcttttccaaaaccttmccagaatccctgtatgaatcaacaaaatttagttcttaacacatttctccttctttaaaatggtgacattagctgggcatgatggtgtgtgcctttaatcccagctacttgggaggctgaggcaggagaatcgcctgaacccgggaggcagaggttgcagtgagccgagatcacgccactacactccagtctgggtgacgagcaagacttcgtctcaaaaaaaaaaaaaaaaaaaaaagaaataatggtgccatacctttctcatgaagttgttgtgaggcataaatgagaacatacttgtacagcatctgggacatggacggcctctcaaaaggagtgctgctgttcttgctacctgcaccactgtaactgatgttgtttcatcatcctcgtcaccatcattgttattgattgtaaatggaagcacagtggtcatcttccaaatatgccactctgactctgtgaacttgtcactttataaagaggaaattcaagcttggaggggccttctggcatgacgtttattgaattgtggggcacaagatrcttccctgcttgttccattttcctttctcttgtttattctcctgccttatttatttattttttcttttgagacagagtcttgctctgttgcccaggctggagtgcagtggtgtgatcttggttcactgcaaactctgcctcctgggttcaagtgattctcctgcctcagcttcccgagtagctgggatcacaggtggctgccaccatgcscaattaatttttgtatttttggtagagacggggtttcaccatgttggccaggctggtgtcgaactcctgacctcaagtgatctgatctgcctgcctcagcctcccaaagtgctgggattacaggcatgagccagtgtgcctrgcttcctgcagtttttttattgattggatgaatgtttgtatatcccatgagccagatgaggcacactgtccatgcacatagcaagatggtaacacttacaccatctttactcttttgggattagtcccaagctccttgagaatgactgccgtatcacctgggttttactcttcggtttctggttgttactcctcagtcttcagctcaattaggatgcatccatttggtagttttacagttagtaaccctgatggcttccactggtttacgatcttgtacatctaagatgatgaaactaaggttcagagaggtgagatgactttgagtaaaattgcatggtgagcaactagcagaattggaccctgaaaccagatttctaatgtccaaatcttgtcccttgtttatcatatcatggtggttcaataataattcttcgtgtttagtgtggtgtactagagctatcaacagagaaacttgagactgagaggtttgaagggactaattctaggtcacacagctaatggatggagcaggtctttaatcccagatctgggttccaagaccagtccttttctctttacgctgctctgyccctgctatctktatgtcagaaaaccactgagcttccttctagatgtcagggtttggcaaaaaagttatcatgtgcttctgcgtcatgcagcgttttctgagaatggggagagggactcattttgcatctttgatctctcttttttattttgagatggagtctcggtcttgtcgcccaggctggagtgcagtggcgcgatcttggctcactgcaacctccacctcccgggttcaagtgattctactgcctcagcctcccgagtagctaggattacaggtgactgccaccacacccagctaatttttttttgttttttttgtttttttagtagaggtggggtttcaccatgttggccagggtggtcttgaactcctgacctcaggtgatccacccgccttgacctcctaaagtttggtctctttttgtatcagcttctatacagacttaaccccatttttaagtcacagccagcatggtcaacttctgtcagttttgcttctgttccaaaggcttctgttttactaacatacacacatacatgtatgcatatggatttaaataaattctggtgcagggaagtctaggaggcaaagagagataaaactctgtgattggaaagtcacttctggaaactagacatatagagcagacctcactcttacatttctttttgaagtgcaataattttttttttttttttaacaatatagggcccagtcctgtgtttgacattaaagctgtttccatcagtccaaccaatgtgatcttaacttggaaaagtaatgacacagctgcttctgagtacaagtatgtagtaaagcataagatggaaaatgagaagacaattactgttgtgcatcaaccatggtgtaacatcacaggcttacgtccagcgacttcatatgtattctccatcactccaggaataggcartgagacttggggagatcccagagtcataaaagtcatcacaggtaagatgactggctcccagggatgatgacaaaccatttcttattatggtgtattctagggccttgtccgttcaagttgcctgttggaaagagaatggttttcataaactagaagaggagaaaaggtgctatgttgtttcaagcctgggatttctggtggccacatcattcagtattaaggccctatgtgttttgggaagttctaactacttctgtttggtttttaaaatcttttgttattgttggttaacacctacctttctgttaagactcaggagtagagacttccttaaaaacgcgtgtcttcatggtaattaccagccttttaagctcccaggaaattgatgctgtgtttatattcccaggagtttctgttgggcaggaaagtttggtgtattttataggggagtgtgtgtttcaaatgaaataagagtttgatgatatttaaattttaattcagatttgacagtttagattttgatttatcttagatgtcaataccgaagccatctattatagctgcaaacttagctttttttttaagctgaaaagaaccaaacattttaaaaaacaggtggagaaacttttttaaggtgaggagaaccaaaaattgaagaaagaggtcctctgttagttttctgatctagggggctggggagtgtgatctcaggggctggagtcggccatgggcgcctgagctcttggagcccacggctggaggtgaacgaggtccagcgtggagcagcaaatatgaaaccagtggcttccgacattttaagtcaggaaactatttctttaaacaaaaccttgcccaggagcccaaaaagtaaaaataaaaaactggagagaaaagagccaaagaaatgggagtcacgggcaccctgacaaaactcctggagctcctcagagcactattttaggggggaamacctgccataaaggtttgctctgttacattgtgaaagagagggaaaggagagcacagagagatgacagaagagaagagaatgagagaaaagagcatagaacttggaaatggtcatgaggacaaggtgaccccgagggggtggctgtgggaaaggggatgcggaggtgcaggaagcaccggtagaggggctgagtgtccttatctagcttaaagccctgagcacagggctgcatgggagcaggtccatcagctgctgcgtattgagcacggcacatgtgcctctctgtccttaatgttattttgtcctcacagtaaccctgggggctgcagcagaagacactgtaatgtggagaagttaagtttcttccggtgtctcagagttactgagtatcaagtggtggggctggaacccggagtctaactctagaccactgtggtgcagtgatgttcataacagctatccacagtcaccgagctrggaatttattggttctgcattacttaataaaacaaaaagacgcatgactgacctgatttagaactctttgcatgagagacatgtgctgtgaagaatcatcttaccgtttcggagctggacrgtgccttagaatcatctaggccgatgtctttaccttcaggcccctgcagccctcaggaggggttttgctctatctgcagcactacctgtgcttttctgtacatgaagctgcagccctgggttctcctgtccccactgctaccaggagtgtgtgttcttgagcaagcccccctgcctctctgggtcttcgtgttcttattggaaaagtgaggggagtgcatgtcattttgggtgaagtggtttgacttatgtcaccatcaaccaaataacgcgatgggaggaaggtccaggatatagtggagatggaacgtcttctgaaaaatccccttggtgctgggatattgaatgtgctgcttacttgaaatgtcttggtaatttaaaatgatattatttgcattatcttgaattgagacctttagattagtaaacagtcactttatttgaggctttgttcctgatatctaaaacacatacaattaaatgctaccatttaaaagggacagtttagaagagtgtccagtcactattggggttaatcttggagaacagtgtggatcctaaacaatttcagttttaaggtttttttcttctcttccgtgttattattttctcccccagccctgctgtgaaatgatggaaatgcattgggctctgatagaaaggaagtatttttagtgagtcacattgggacatcagtgacctcagtcattctttctttttttcttttaaaacccgctcccagcactgaaccccagtcattcttaatgaaggtgactgcatatatcttgttccattaatgcatgttgtatttttaaaatagarccgatcccagtttctgatctccgtgttgccctcacgggtgtgaggaaggctgctctctcctggagcaatggcaatggcacygcctcctgccgggttcttcttgaaagcattggaagccatgaggagttgactcaagactcaagacttcaggtcaatatctcgggcctgaagccaggggttcaatacaacatcaacccgtatcttctacmatcaaataagacaaagggagaccccttgggcacagaaggtggcttgggtgagttacaaagggtaccttcygtctcccttactggttcttactttcagtaactaaatgttctaaaaaataaattgctcttccatgtgtatggagatttagaatttataaagggcttttcctccacattttagtttgatcccccacctgcatgaggaaggaaggaaacgtgttctgattttacaggggaacacaytggggctgagaacagcaataggaattgaaactttttagagtctggcacccaggaaagttagaggcccctttagctttctatctaacagctgtgtcaacccaagttgggccttcagaggaacttatcacgtctgctggttgatgttggcgttgtcatttgcaggtttcatagcatttgcagaggatccccaggataactccatgaggaggacaggcacttaatctgcattttatacttaagaaaacagagctacagagtgggtgtcaggatccttgcttgcgagtgacagaaaccagactttggatagctcagacagaaggaacaatttattggctcatgtggattttcctgctagcgggaggccttagagaaagagatgaggcaattctcatccctccctcttgcttctttctgttcatcagcttcattctcagagcagctccctctgcacacttaaggagcccagctgctccygtttcacaccctgcagctgccycaccagccagctgccccaccaaccagggtctggtccagggaaacgtgtcttgagtggggtctgattagcaaagtctgcttcacagagctgtccctggaaatccatgctgggacaggagaagataacaacccaaagaagggagaatgacctgaaataagcagagtttgaaagagaagcaccagatatctgtggtgctactggaataacagtacaaatggagatggagctatcaggcctttttatggggctgcctctctctctggaggaggaagggagcagatattgatggagcaccaactgtggccactgtctgatggccatctgatgggrttggggctccgaaggaaaatgggggatgtgtccctcttgtggttgatgtctttttgtctcctgtgcttgaaacagatrccagcaatacagagagaagccgggcagggagccccaccgcccctgtgcatgatgagtccctcgtgggacctgtggacccatcctccggccagcagtcccragacacggaagtcctgcttgtcgggttagagcctggcacccgatacaatgccaccgtttattcccaagcagcgaatggcacagaaggacagccccaggccatagagttcaggacaagtaggttgaactttgtaaaatggtggcagccagagtttcctagcacaatgttctgtctcctgtgattctgattctgagtgatttcttgcataacagctagttttgatgtcagagggagcttcctggaggagattttggacagagcagatctgctcagtttcttcttaactccatgggcagtgcacatctctcattaagtgaaatcaaatacatggagcagcccctgtgtgcgggcaccaggcactgcctcacgccatctttcacagctttgcgtggtggctgatgagacaaactggcatcatactttcctcttaaaaacaaataatcattgcttgtttttcctttgctttgagttaagaaagttatgaaagtgagtttcattttttcacccgccttgtaattcataccgatctttctgttgaaatgcttgttgacatgcacattgctgcttcctcgctataatttatcagcactttcactctgtaagttcaccaatatttggaggctttggtgaaaagagcgggaggtgaacacatttgggaatacttagaggtagttactggccaggctgtgttacttgtacagggctagaagttttggcaagacattggtgagaagccattctgtaaggaatgacagtttttcctggtatccatgttgaaggagggtccatttgtgtccttccttccctttgtacttgttttgctaatgtgggagtgggtggggaggatgcggccgtaggacaggctgcctgacctcatggggcctgcagtgacctggcaggagtggcaggtgggaggctctcgggtgaggagggcttggattccagagggtgggttagttggaggaggaggaaggggctcctatgtgggtgcggttggcagtggtggggtgtcctgcacatggtaagcttgcgtgagagagtgaaaggggctgaaatctggtctgtgtgccctgcatcaagccatgcacccagggctgggtccagccaggggaaggtccctttgactgatttgctaaaaggacttgtagatttgtgtgggcctggggtccctgctttttaaagcagtttgagcaaaagcaaagtagtagtgattacatctcaggctcttggtggtgtgaattcacacacatcctgctttgggttgaactgtcttcatgcttggtaaataatcattatagtagcctttccctctctataaggggcgagtgtgtgtgtatagataagtcttagtcagtttgggctgctgtaacaaatggccatgcactagatggcgtaaacaatgaacatttatttctcagggttctggaggctggaagtctgagactggggtgcagcatgcctgggctccgggtgaaacaccctcttcctcttccaggttgcagactccctgggtcttcacgtggttgaaggggtgagggcgtggtttctctccagcctttttgataagggcactaataccattcaggagggaggtaattcatgatctaattacctcccaaaagccccgcctcctaaaagcatcacatcaggggttacaatttcaacataggaattttatggggacagaaacattcagtctgttgcaacacacacacacacacacacacacacacacacacacacacacatacagataaacaaacacacatttccacccaccccagagcaccctgcacttttcaagtgactagttaggtggggcagggttaaggagaccatcagaggacattgttgaggcacccaagacacgacagaaagccacctctagggctgaagggctagaggaggacagggtgtttctggagcccagtgagagctggggcagtggtggacacagctgtgtcaggacaggaggcccagagcaggaggygatggaggaaggcactgactcctttctcctgtggcccttcaggggcctgcccattggctcatagtggaacccggtcacagcccatgtggcaagaccccccatgatgccttgcacaaggtcagcctcctgggcccagagcaggtgagggaagggcagtggatatgtcgggaggrtggagtgggcaggtggtgaataactggcactcgggttatcttttcttgaggttaggattgctctccagttttataggtgaggaagctgagctcaagtggttttcctgtggcccacctgggtgtcatagcagagtgagccctggaayccaggcctgcctcrtcctgacttctgtgatctcgggcgatcacatagatcgcagtgttcgctcttgcatcatgtgtgtttgacaacttttctgggtgcccctggccctagggtaagacatgcatagagtccaagtcatcatttaggtcaaatctctaaagtcaacttacaaaaaggaacaaagaataaccctgcaggtgccattggccaggttgtttcttcaccgcccaatgatgcctgactttggctgggaccgtcatgctttcctagccacggttgatggtgcagaggaggaaggaacactcccccaggagagtttgctgggcttgacagcatgccctgatgacctctccctccctctgccttggccgttctggttattttgaactcctcttgtgttctcacagatgctattcaggtttttgacrtcaccgctgtgaacatcagtgccacaagcctgaccctgatctggaaagtcagcgataacgagtcgtcatctaactatacctacaagatacatgtggcgggggagacagattcttccaatctcaacgtcagtgagcctcrcgctgtcatccccggactccgctccagcaccttctacaacatcacagtgtgtcctgtcctaggtgacatcgagggcacgccgggcttcctccaagtgcrcacccgtgagttcatgcctggctctcaccaccctttcctgctgtcctgctccgtgccaggcccagacacaggatgcatgatgtagtaatggtgactgttggctgaccacacgccaagcttcgtgtgacatgctttccttgcactggcacattgtatgctcacaayagccctgtgatgtggttggaagtagccttattttatagataggaagccaaggctgagagagktgctagacaggtatcacagctggaaagtggcagaggtgagattaagcctctggtatttctcacctggagcctgcgcttgtaactctctttccagtgtggaggagacctagagtgaattgatacagggagacaaaaatgacctggtattcatatccccttgtgtcttgggtgctgacattataacgaatcactggcacagctgtatctcatctttgtttgtttaaatgtcccttaaaaataagattttatgcagcaaataaaaagctttaggtttcaaagaaggtccgataatgtaaaataaaacagtaatggtgcactagtagtacagtggtataatattgattatatactattaaacaatagtagtgacaccagcactgcattttgcactgtgccatgagatttatagacactgtagtggcctccgaggtaggtattggggtccccttttacagatgaggaaatgacaccctgatggctgaacagtttgcccaaagccacagagctagtgagtagcagagcaggacttgaactcaggggtgtgtggctctggacccaggcttatcccacaagaatgtccattccttcgcaggaagcacaccttagcattcttatagatgtattttggactggatctttgggaaaatgaaatatgcttgcatttctttaccttttactcttttactatttattagttaggattaggttcagccacgaataacaccaccaaaaacaacaacaacaaaacccaagtatccrtggcttaaacaagacaggggtttatttctctctcctgtaacagaagcccagtgctaggcaggatggggatgatagaggttatccaaggctcagttgtatgaaacagaaactgtgagctattttaaccaaaagggacttatcctgggaattgaggttttgcagaatcattggaagagctggtgtattagtttgctagggctaccagaacaagtaccaaaggctgtgtggcttgaacagaaatatactttctcatagttctggaggctgaaggtcaaagattaaggcaacggcaggtgtggtttcttctgaggcctccctcttggcttatagatgactgtcttctccctcacatggttgtccttagtctgcgtgtgcctatgccctcatctccctttataaggacaccagtcttgctggattagggcctaccttcatgacctcacattaacttaattacctctttgaagaccctgtctccaaagacagccacattctgaggtcttgggggttaggacataaacatacacatttgggggtgagggagcacaagtcagctcataacagttgaggagcaggctttaggcctcgccccaagaaatgactcctggactaagtctgcagaactgaccccctggagagtcaccaccttggtcacagacagcagagggaggaatcaggaagtctctgctgtagttgcgggatccaggggtstatgttctgagctgtgatcctgggatcaggaagctgcagccaccgctgaggttttggttctagagccaggcagcgtgagctccagtcattgcatccacactacaggtataagaaggaggaagggcagaaggttgtgccccacccttaaaggacacttcctagaagtcacccagtacctctgctcatgcttcgttgagcaaaacttaktcacattgcaacatctagctccatgggagctgggaaatgtggtctttgtttccaacaggtatgcacacacagggctaaaaatctgggtgggtatgatgaagggaaaatgggggaatggattttgggggtcaagactggtctctctctgctgtccctccctgaacagaggctctgggaggctagtaatgcattcgagataaagcagccagtgtggccaaggttctcctccagagcctgagcccttgaccacaggagctcacgcctcctctcatttcctgtgaatgattgtgtgcaatgtaagcacagagcttctgcactctcatgatmaagtgctctctccatggccagaaacagcagtttctgaggggctcatgttgtaggtgatgatacaaagaagacagagagagggatcaggtgtcctaagtgtacatttcatctcagtattttctgaggtggggcatccctgtctcctggagaagtatatttttaatctagttgtttactttctttgcatagcccctgttccagtttctgacttccgagtgacagtggtcagcacgacggagatcggcttrgcatggagcagccatgatgcagaatcatttcagatgcatatcacacaggagggagctggcaattctcgggtagaaataaccaccaaccaaagtattatcattggtggcttgttccctggaaccaagtattgctttgaaatagttccaaaaggaccaaatgggactgaaggggcatctcggacagtttgcaatagaactggtaagcaaataggcttttctgttaaaccatcatgtttcttaaaggaaatcagtataattaataaacataatgtttccaaatattgtttttsttttaattatctaagaaaaaactttaaaaattttcataacactaatgcttatttattatatgaaatacagacaagtaagtagaaaaaacttacatggaaaccatcaagcagagataatcacttttgatgtatgacattttacaatttttaaacatatacatatagatacacaaatatatgtgtgagtatacatatatttaatacatatatatttaatatttaatacacacacacacacacacacayatatatatatatatatatwtttttttttttttttttttttttgagacagtcttaccctgtcacccaggctggagtgcagtggcatgatcttggctcactgcaacctccatctcctgggttcaagtgaagcgattcttgtgcctcagcctcctgagtaattggaattacaggtgtgcaccaccatgcctggctaatttttatagttttagtagagacagggtttcgccatattggccaggctggtcttgatctcctgatctcaaatgatctgcccacctcagcctcccaaagtgcttggattacaggtgtgcgccactgcacccagcccacaaatatatatttatttctttcacaaacattgaggccatctgtacatgtggttttgtaatctgccttttccccaacttgccaattaattatgaatattctttcctcttaataaaatatttctacaggatgatttgaacacctgcctggaattccatcatctgaaacagagttggcagataagaatggcccctatgccaaatttggctcattgtctgtttttgtaaataaagttttattggatcacagccatgttcatttgcttatgtactgtctatggctactttggtgctagaattgagtagtggcagcagagaacgtgtggcttgtgaagcctgagatatttattttctggccattacagagaatgtttgctgacctctgggctagatcagtggttttcaaattgtggtccagggctctctagggatccctaggttctttcaaggggtctccaaggtagtattatcataacaatactaaaatgttatttggctttttcattctcattctcttttggagttttccaactttgatccgatatgggatgacattgtctctcaggtctaatggaatatatgctgtggattcttacattttaaaaatttcttcattttaaatccctgatatagtaaatattaataaatataacctatgtaaatacaaattctctgagagccttaataacttttaagatggtaaagaagtcctgagagcaaaaagtttaagaacctctggtcaagatgtgttagaaattaactactgtgctgtgttgggcaggtggactgttcacagtctttcctaaacaacactgtgatgagatactttgttagttctagaaggctaattgaaattgataaaatcattttatagtcagctacggtggcctgcacccatcgtcccagctacttgagaggctgcggcaggaggattgcttggcccaacagttgcagactagcaccagcctgggagaccctgtctcaaaaaaaaatttttttttatagaaacagtttaaattattaaattrtttctaggcctacaggagaaacttctgggaaatcctagagagtaatgttcattattgttgttttaaaattttgaaataattgttttttggaaaggttgaaaaacatacagtcttccttgatctaagattcaagatagttgaaatcttttatacagagggtagaataaagatatacctaatgtaaatgatgagttaatgggtgcagcacaccaacatggcacatgtatacatatgtaacaaacctgcacgttgtgcacatgtaccctagaacttaaagtrtaataaaaacatatatatatatataaaagaaatgggacagattccttgaaacacacatgaaatgagttacgcttttgagattctccttgaagaagcttcttcaactgtgctggttgggttaagcaccgatagtcactcagaggatctgcttctgaaataagggatctactaaaatgcatccctcagatgaaatgcagtattccctttgcaaatctgcatttcagactgttgacatgacgtcttaacgtcaacatgtttcttctgtcttttaaggatgtggataatggtaagaggatcaccactgagggagatgcatgatgttgtgctacttgctattgcccagaacttactgtaacaataatataatatgctgggggtctgcgaagtgctgagtgctctcatactgcattttacatttttaacacaacttcatggagcaggtattattatcatttctgtcttacagagtaagaaatgggggctctgcaaacttaagtaactggcccagagtgacaaggtggcaaactgacctgtgtctgctgtctaagaccaagtgcttaaccaccatgtagattgacactttgatgtggtacagcagtaaagtttagtattagtgaggagagggcatctcttttactatagtttattgtgaatattctttcctcttaatatcagtatttctacagggtaattttaacacctgcctggaattgcattgtctcaaaggacccgtttcattcaatggtcccattgaatgaaagtcaagaaggcttgctataagatctaaactcttaggggggttacctttctattatcaaataacctttattgttattggaaaaagtcagcttaacagcattaaaagcaatttcaaaaaaaggaaacgaataccatatgatccagtaattccagtcctatgtatatctccaaaagaattgaaaacaggcccctggacagttatttgtacatcagtgttcatagtagtagcattgttcacagtagccaaaggtggacccaagatcccatcaacaaatgaatggatagataaaatgtggttcatccatacaacaaaatactattcagccataagaaagaaagaaattctgatttatggtacaacatggatggatcttgaggacattatgctaagtgaagccagacacagaaggacaaatactggatgattccacttacatgagtacctagattaggcaacttaatattctacagaaattagaatagaggttaccaggggctgttcagaggagggagtgggcattattgtttaatggctacagtttatgctggggataatgacagtgttttgggtacaggtagtggtgatagttacacaacattgtgaatattgatgataccgaattgtacactgacaaatggttaagatgataaatattatggtatgtatgttttaccacaataaaaatgaaaaggaacaaatatctctatttttctaacccaactgaattccttttctctctgtgtccacagtcatacattttgcttgtatactgtaattattatacaaatacttttattttgtatttgaatttctttttactcagtctataccacaactttcccctatagttagcatggccttcatatttttagtggctaaagagtatttcatcatgcagccagatcacagtgcccacagccctccccatgttattgaatatttaggttgtttctaggtttttatgtttatagacaaaggctgcctttcatgggcttttgtctgtggaatccctttgacatcaggaatctgctggtaggaaacaaaggctcctcccagtggcttctctgtaaggagaatccacttaaaattaaaaaaaaaattaattttggagtagatagtacgtaaacatgrcacaattttttttgttttttggacaaggtgtttgcagtgaaagcatttcccttttttgtcccctacctgcccatttcctctccctggaggtgacgtttgttgccaggtaaagagagacagggttgaaagccgcggtagaaaataggcccagcctccgcggttacttccgggcctctatgtaggcatccctggtgcaggtggctgagtgggcagcgggagatgatcggaggatgggctcctgtgggagattccatttctgactctgctctgaaggtgcagggtgtgcctgttttcttcccttcctcatccgtcctcaaatgctgcaacttagtaaaggtcagctctccatttcagttttcctctttggtatgtaaggctgtgtcacgggaagatgtttccttctgagtgactgatttaaaaaacacaacaaaacaaaaaaacctctttattgagatataatatacataccgaaaagggatgtatcctcagcacatagcttcatgaacttttacaaactgaacacatcttgttaccagcacccatataaaaaaactgaatgtgatttccacttcagatgaccccttgaagggctttttttttttttttttttttgagatggagtttcgctcttgttgcccaggctggagtgcgatggcgcgatcttggctcactgcaacctctgccttccgggttcaagtgattctcctgcctcagcctcccaagtagctgggactacaggcatgcaccaccacgcccggctaattttgtactttttttgatagagacggggtttctccatgctggtcaggctggtctcaaactcccgacttcaggtgatccgcctgccttggctgcccaaagtgctgggattacaggcgtgatccaccgcgcctggcctttttttttttttttttttttttgagacaaaccctcattctgtcgcccaggctggagtgcagtggtgtgatatcggctcactgcaacctctgccttctgggttcaagcgactcttgtgccccagcctcccgagtagctgggattacaggcgtgtaccaccacacccaactaatttttgtatttttagtagagatgggttttcaccatgttggccaggctagtctcgaacctctgacctcaagtgatccatctcggcttcccaaaatgttgggattacaggcatgagccattgcacccagcctaagggctcatttttaagacaacaacaaaaaactggagaactggtaagataaactgggaagttcatgtgcgtcacagaagagctgaaattcttgagagcactgagtgtgtgcatttctcagctcgattttggagtgtgccttttgtgaactcattagaaagcgtaatggcaaaagagcaggtcctctcgacagcacttggagaggaagctgggcgtcatgatagtaacagttttcccttctccttcctttcttctgagcagttcccagtgcagtgtttgacatccacgtggtctacgtcaccaccacggagatgtggctggactggaagagccctgacggtgcttccgagtatgtctaccatttagtcatagagtccaagcatggctctaaccacacaagcacgtatgacaaagcgattactctccagggcctgattccgggcaccttatataacatcaccatctctccagaagtggaccacgtctggggggaccccaactccactgcacagtacacacgtaagtctcttaggatgcccytctaaggaacagcctctctaactgtctcttggaggaggcactggttaaatgatggccagtgtgcttctgggatccaggttgactctgaaactgctgaagttgaaaacattggtctcagcaatggttctgctgtcaccatggggcactgttcttcaagctatgtgaacttagaattgtcattagaaggaagaaatgattccttgggaatggtgactgaaatggttctagtcattccttgagaatacagagtagagaagggtcaccttgtcatgttggtattggaagatactgcccagatgaggagcttcgcctgcaacagttagggaggtgttttgcgaayatttgaattaaatacatggtaaagatgttagtttgtaatatgtttttagtatatttttctccatctattagatttaaaaaacagattagaaattaaatgttaaaaatatrtttgaaataaacttgaagtattaaaagaagcctaaattaaacttcttttgagacttaatctgtataattattttcttgatgtgtttttgggaagttttccatcttttgagccagcaaatactagttttattcattctttctaaaacgagccaggctatttttggatatagtaaatagtcctggaattctacttaatctgtgcttttacatgaattgccttttttttaaaatcaagggcccagcaatgtgtccaacattgatgtaagtaccaacaccacagcagcaactttaagttggcagaactttgatgacgcctctcccacgtactcctactgccttcttattgagaaggctggaaattccagcaacgcaacacaagtagtcacggacattggaattactgacgctacagtcactgaattaatacctggctcatcatacacagtggagatctttgcacaagtaggggatgggatcaagtcactggaacctggccggaagtcattctgtacaggtgagtgtagccccarctgcctcttggactcctccctgagtggtgctgaccttgcaggtcagtcctcccaagtctgtagtttgtctggttttgtgtgatgtgcagtgatggacattgagctttccgaggcatcctgttagcttatcggtgctgtctcgatgccctcatcatttctgcattcaataaatatttattgagcatataccatatgccagtcaagtccttgccttcttggaacttttcgaaggaggaagtgggatgtttacctagagtgctcaggaaaggcctcaatgacaaggtgacttttgagcaaagatctgaatgaagggaaggagccagccatgtggatatcagggcatgagaacattacaggcagaggcctgtgcagaggggcctgtgcagcatcaccactgtatctggaggctggaggaagagcaggaggcaagggtgggaggagtggacccgcaggaacaggaggatataggtgggaggtgaggcctgagtggggctgagccaggatgtggatgatatctggcattggtttgtcttttgtgctggagaagatgaaaagtttattgaaatgatgcccagcctttgcatccttcttgatcctcacctatctcacaactgaaaatgtgtgataaagagaagagccctctgtgtaattgaggatgctttcagggcagcccaggaaaggctttgcagacagtggtgggcacttctgctcacagtgctgactgtggcacctttatcactcagcacccgtgcactactcattttctgcccttctcgctcctacctcttccctttttagcccaggccattcagatatgttcaggctgatttggaagtgatggtctcatgggatcagcctccctggtagtataggagctccagccttgatggcctctggcttttcagtggtgagtggggtggccacagaaatccctgcagctttgggtcacttctgctccatcccacctggtctagacacccatctttgatatttgggtgcctttcattgctgatatttatcttagctatagttatttgtagcctatagcaagagaaaaactgtatctgagcatttatgactgggtgtgggtggaacaggagctgtaaaagtgggtgcagtgttcaggttacctttccaggccctgggtggcaaatgtgggtgttgcactaggtgccttggtagagcttctcctgctctaaaattctgtgacattcaattaatgataatactgtcctccagttgtaatatggagttttctatttacatcagtttgatgttagtcctcagtaaaaatctaatggccctcagatagagacaaataacactctattttgaagatgaggaaactgatgcatcatcaatggatgatgcagtatgttatgtgagtagagagtgtcttgaacttagacttagaaaacctgggatctagttttggcttcaccacctgccatgtcatcatcagccaattacttaacctctctgagcctctgtggatttatctgcagatgggacagtataggcctcacctgtctcagaagtatcatcaagagggccttggctgggctggtggctcacacctgtaatcccagcactttgggaggccaaggtgggtggatcaggaggtcaaaagatcgagaccatcctggctaacatggtgaaaccccatgtctactaaaaatacaaaaatcaactgggtatggtggtgcatgcctgtagtcccagcgacttgggaggctgacacaggagaattgtttgaacccgggaggtggacgttgcggtgagctgagattgcgccattgcactccagcctggtcgacagagcgagactccgtctcaaaaaaaaaagggggtcctcatgatgagatggtgcaagtgaggaggttgctacttctcacaggatgatacagctgactctcatggagccctggtctcttccaggcgtctttcttggtgcctgacatcattgttcaatttactcttcaaagagtcctgcagctgaggctcagagcagttgggtgactgacccaagctcacacagtttggtgttgcccaatttagggtcagcccctgcctcttccaccacatcacccacccaccttctcatccccaggattctgctactccctatttccatgtttgcaaaggcaaaagtcccggaatctcatgctgtgctgtacttgctttgcagatcctgcgtccatggcctccttcgactgcgaagtggtccccaaagagccagccctggttctcaaatggacctgccctcctggcgccaatgcaggctttgagctggaggtcagcagtggagcctggaacaatgcgacccacctggagagctgctcctctgagartggcactgagtatagaacggaagtcacgtatttgaatttttctacctcgtacaacatcagcatcaccactgtgtcctgtggaaagatggcagcccccacccggaacacctgcactactggcatcacaggtgggctacaaggcaggggctggtcagttggcactgtgatcactcctggagcggctgacccacagtgggtctgcacgtgtggactagaaatctgtttttgtttttttatttcccctaaaatatttgcttttactgacatagactggtttctcattctatagaaatcaatctaaaaaagcagagtaagaggggctcattttttacattctaaaagattccttttctttacagcataactcattgcctcattgccatgttttcttttatatttttttgagatggagtcttgctcttgtcacccaggctggaatgcagtgacgcaatctcagctcactgcaacctctgcttcctgggttcaagtgattttggtgcctcagcctcctgagtagctgggactacagacacatgtcaccacgcctggctaatttttgtatttagagatggggtttcaccatgttggccaggctggtcttgaactcctgacctcaagtgatccacccgccttggcctcctaaagtgttgggattacccacgtgagccactgcgcctggtcgtcttttarcccacatctgttggtggcttactgtgtgctatggtgagggatactatggtgagtaggggcgacagggcccctggagcataggactgagaagagcattgagagggagaggatttccaggtctggtggtgggtgagctagcatgctgctgccarttttgcagcaaggacctggggatggaccttctctggccagctacagggtatagagctggtgggaaatgcaggagcctgtgctagcagttgaccattaacatgggaaygccacctcccagcgggcactgctgccgcatacttgcgaggttgctgaagcttgtagttyagagcaggaccatcccactagatgtgcaatgtgagcctcaggtataatttaaagttttctagaagccacactgaaaaaaaagtgaaaaggaatagcygaaattggtattaatagcattttacttaacttagtatattaaaagtattatttcaacatgtaatttctgtgaagtattaatgagttattttatgtcttcttttgtactaagtctttgatatctagtctgtattgtgtgcttgtagcayatctgaatgcaaactggtcacctctcaggggcttggcagcygcatgtggctagagggctgctgtatcagcacaggtttagacaattatgttgtggttgttttggagttcagatttctgtctccttgaatcttgaatatatataataatgagaacaggctgggcgtggtggcttatgcctgtaatcccagcactttgggaggctgaggtgggaggattgcttgagccaggagtttgaaaccagcctgggcaacatagcgagatcccatctcatttattttttaaaaatatataaaaaaaatgggaataacccaaactgtatgtgtgagatgaatttaggtagagagagagagtgtgtggagtggatcatctttaattcagtgtgttctttcttttgtgttagttcagagagtggctccataccctggcttggaaagggggggtgtgcacaatcatggaggccatccatggagggtcctgtgggggcttttctggtttctgggaagaggatctgttgggtttctctaggtggtatttgagaccaactctgggaaaaatgtggggactgtttatgaagaacacagagaagtgctgtgcccaggtctcagcagaaagtgtgttctctcccacctcatctgtgattcttctccttggacatttgctccgtctttgctctcagctgaccagctgatcctggggccaagccaagtccatgtggtgtcattgtgcagctcccaaggccacaccttagagttccaccacagtctctttctcactctccttcttccaccccagatctcaggataatgaacccggctcatcttgagtcatatgggactgggggagaggacaagggcaggttagcttcctcatgcaaggatactagcttcttactctaatgatggtttcttttactgtgcaaaaccttttcagtttgatttaatcttgcttgtcaatttttgcttttgttgctgtgctttttgtgtggtatccaagcaaccattgtaaatactatgtcaagaagctcttccccaatgtgtttttttttttttttaaacaaattttacagtgtacagctttaggtctaatgtttaaggcttgaatctattcagagtttatttttgtgtctggtgtaagatagaggtccagttttattattttgctcacggatacacagttttcccagcaccatttgttgaagaggctgtcttttccccattgtgtcttcttgacatccttgttgaagataagttgactgtatatgtgagagtttaattctgggctcagtattctgttctatgggttgatgtctgtctttatgcctttaatatactgttttaattactgtagctttgaataaatatatcttgaaatcaggaagtgtgaggcctccagctttattctttctcaacgctactttggctattcctggtctttgattgttccatgtgaactttaggattttttttttatattctgtaaaaattgccattgggattttgatggagcattgaatttatagatcgctttgagtagtgtcaagtcttccaacaatgtgaagtcttccaatccatgagcatgggatgtctttgcatgtatttgtgtatttgtatcttctttattttatcgatgttttgtggttttcactctacaagtctttcatctccttgattgtattctaattatatttcaatcaatctgttaaaaaataaaataaaagcatgtactgttcaaaacaacaatagcaaaaccaaacaaggctgctgggtgcctgccctggggatttggctggatgccctgaaggggtcattgtgagctaggtgggtttcccaggatctgctgtctctgctcctcaccagtttccttccctgccttttgcttctggatttgctgttttgcacgagcccagcatgtagcttccagagtaagatcttgaggaggttgctgaagcatgttctctacctaatgtgttgctttggttttcaatattgggtgatcatgttttgttttgttttgttttagatccccctcctccagatggatcccctaatattacatctgtcagtcacaattcagtaaaggtcaagttcagtggatttgaagccagccacggacccatcaaagcctatgctgtcattctcaccaccggggaaggtaaggagaggcctccgtgggttaaacagcccatgagtgatgcagtgaccagagctttctctgtgcccactgaggcatgtgagtaatgcagacacacgcctgtcttctcactgcagccyatgctgtgtactcagacagagaaggagggtgaggtatttgcctgatggttgacaaactttctggaaagggccagattgccaatattttaagctttgcaggtggtatagagtctgttgcaagcattygactctgccattgtagtgtgcaagcagtcacagaagatacagaaggaatgagtgggaccattcccactagatgttatttaccatggcaggtggatttggtttgtggcccataacttgctgatctgtgatctaggtttttcttctcttttacctcactgggccttttaggtggtagaatattagttttaaccaactctgtctctctctctcactctacacacgtacacacatgccatcctcagaggatgactttcctttgaaagaaaatagaaaaagatttgcatttgctagtgggaatttgcagagtatctccttagctgagagaagaggtggattaaaagctgcttttccttaaagggctctgttacattcttttgtggtaggaaaggaatcattcgagagtctcttcggtagctgtgtttgagtgcttgcataaggcctagatttaaaagcccaagttttgttgggggggttccctcctccccctcccctcctccccctcccctatcatcatcgtcccattgtcctccaccctcccctctcctcctcctccccttctccccttctccccttctccttcccttccccttccctctttctttcttttagagacaagatctcaccatgttgcccaggctggtcttgaactcctggactcaagtaatcctcccaccttggccttccaaagtgctgggactagactacaggcatgagcctctgtgcctggtctgggagattctttatgcatgaataatgcagtgtttcctctgcccactctctcctactgtggtgctgtcctcatgtccttgaggaggatagagaccaaacacactgtcggggttagggatctgggaggatagaaatttgctggtgccataacctgtggcaaaatttcaaaaagtgaggttgaaatctctatcttttaattttgggtctgtttccagctcttagtcattttgctgtgatgcttgtcagcaagtcccattgaggaaggccatgttgcatagcagccagactgaccagtgctggcctgtgattagatgaaaccttgggctctgagcccgatgccctggattgggaacccaactctacctcataggcagtgtgaccttgtgcctggtcctgttagccttttgtaccttcgttttcttgtctgtaaaatggagacaataagcttatgtgatgggattcatggggatgaagtgagttactgtaggtgaaacccttagaattcaatgtaagtcaaacctggcacagagagatacttgagagatggttgctgatcactatcacccaacatcaccaccatgtagatatgcaggagaagaaatctctctgccatcactttcttatgattctccttctgtgtacctttcttagctggtcacccttctgcagatgtcctgaaatacacgtatgasgatttcaaaaagggagcctcagatacttatgtgacatacctcataagaacagaagaaaagggacgttctcagagcttgtctgaagttttgaaatatgaaattgacgttgggaatgagtcaaccacacttggttattacaatgggaagctggaacctctgggctcctaccggtaatgtcttctggttcttactctttgggggctgagcctcatgagcataaagctctacatgcctgcggtcagacacgtctcagggacctctttttgctctttgttatcccacagggcttgtgtggctggcttcaccaacattaccttccaccctcaaaacaaggggctcattgatggggytgagagctatgtgtccttcagtcgytactcagatgctgtttccttgccccaggatccaggtagggagaagacaacagtcctggcactggttcagtggcattttgctccacgtgtccatagaaggccagctgtgtacatgcctccctcagaccttcaggagggttggtgtgcccagctctcccctcccagaggttgagatgtcactgggtcaccgggcttactgggcttcctcctccgaggtcccacagcctggaccccacactctcccttctctaagtgccagttgttcttccaatctgcaaagattattgactccccttatctatgtgtggtcacttgtgggcccatatgccaggtgcacagtttgacacattgcattgaatccttaaatagtagaatcagaggaagccacataaattgtcttgttcaatcctctgtttatttttcttcataattttaattatgtttattgatttgtttattttattttatgttttttttttttttttttcagacagagtcttgctctgtcacccaggctggagtgcagtggcacgatatctgctcactgcaacctctgccttctgggttcaagcaattcttctgcctcagcctcctgagtagctgggattacaggtgcctgctaccatgcccagctaatttttgtatttttagtggcgacggggttttgctctgttggccaggctggtctcgaactcctgacctcaggtgatctgcccacctcggcttcccaaagtgctgggattataggcgtgagccaccatgtccagcctatttattttatttttgagacggagtgttgctctgttgcccaggagtacagtggcatgatcatagctcactgtaactttgaattcctgggctcaagggatcctcctgcctcagcctcccaggtgggaccacagttgcttaccaccatgcctggctaattttttgtagagatggggtcttgctatgttgcccaggctggtcctgaactcctggcctcaagcctccttccaccttcttccaaagctctggggttacaggtgtgagccactgtgctctgcctgctttttggaagtgagacttttaaggcctagagaggggaagtaacttgtccagggttacacgatggctttagaggcaggcctgaaattctggtcttggacccttgttaagtgcttctaccctttatcacatagacctaagtgatacaggagcttcagggatccaagaggggtgcatcccctaccttcaagccagaggctaatggactggctggtttgttagtttgtctgcttttctttcctagttggtggttgttgggcgcaggaaagaatgcctgccccagaagcaaagtttagggagtccccacatccttccccggtaaacaaatgggtttcctgtcacctgagcatggatgctgctgtaggtacctctgctcatatgtgggtgctagtctcaaaatgtcagaggtggcaggaaaaatatctgaaaatccagcccagttccctaaatttgcagttgaggagacagacctggagaggaacagtaactttctcaagaccatccaggtagtagtggattgggaacaggaacctggcttctgcatgcatagactagttttaggtccaaagctatttaactcccttgtgtgtgtgtgcgcctgtgtgtgtgtgtgcatgcatgtgtgtgtatggtatacacactttaactctctggtgttagggtcccaggccagtttttagcacattgtgtggtctgcatgaacacctcttgaagtgtctcccatttggacttttctcaggtgtcatctgtggagcggtttttggctgtatctttggtgccctggttattgtgactgtgggaggcttcatcttctggagaaagaagaggtgatattgcttatgctaataataatactctggtatttaaggaagctttctattaaggaacatttcaaactttgacagattcagaaggaatgatatgatgagcgccatgttcccttcacccatagtgttctgcatttggccagtcctakttcctctgcgcccccagctgggcgatgttaatgtgctcccagctgtcacatcaggccactgatagacgccacagtgtgggatgctactttcaaatgatatgttcttgtttacaagtcagtttcatagtattatgatgttaagagatttcatttcagaggtagctaagtttgaacaccagctctgtctttgaccagctgtttaggaagcttagccttaatgtcctcatctatgataggaggataatcattgtgcctaacttgtgaagctgaggaggattgaataaataaggcacttctcagtgtcttgtgccttgtatgctattactattattttatctgtacaactaccctgtgaggtcattaaatggtaaaagtagcagccctgttttgagtgctcaccgtgtgcctgcatctgtgctttctgtgaattatcgcatgcatgaggctctgcgaggcaggtccagtaagtcccttccaaggatgcagaagctgagtcaggaagtgtggaaatagaacttgaacctggtccttgcacttcatggcacgccctcttgtctgtgtagtgtgtgaagcctgtgtgtgttagttgggatttctttgctgtaaggtgctgccaaccagggaatctccatcctgccttaggggtcttcatgcggcccaggccggttccttgtgctgccaccctgccctgttggagtgacaggcagagctcatgctccagcttttaggttaggttctgtttttttttttttgagatggagtctggctctgtcccccaggctggagtacagtggcatgatctcagctcactgcaacctctgcctcctggttcaagtgattctgctgcctcagcctcttgagtagctgggattacaggcaccgccaccacacccagctaatttttgtatttttagtagagacggagtttcaccatgttggccaggctggtctcgaactcctgacctcaagggatctgcccgcctcagcctcctgaagtgttgggatcacaggcgtgagcccctgtgcctggccagattaggttctgattttggrgggggaaatggatcagtcagtggctggataaaacagttttattgtttcttgttaaaaataagagtaatacatgcttatggcaaaaaatatagaaaagaagagcaaaaataaataggaaatctgcaatcgcagaacccacacaaaactactcttaacattttgatgtgaccaaactcacacacaaatgtgtgcacacacatggaatcatgttacatgttagaatcaagcctgctttattcagcttagacattgttggcagcttcatttcatcacaattttttttttttttgagacagagtttcgttcttgttgtccaggctggagtgcaatggcgtggtcttggctcactgcaacctctgcctcctgggttcaagcgattctcctgcctcagcctcccaagtagctgggattacaggtgcccgccaccatgcctggctattttttttgtatttttagtagagatggagttttgccatgttggctggtcttaaactcctgacctcaggtgatccacccgcctcggcctcttaaagtgctgggattacaggcatcagccaccgtgcctggctcatttcatcatcattttaagtggctacagagtattcaactgtatgacagtaccatgatctagttaaccaatttcctaggtgtttccaagttttttttcttggccacagttacttatccttgtgcctaaatctttgggcacattcacgattatttccttaggctaaattccaagctaggcaagtgctgggtcagtgggtatgcgtgctttcagttttgatacatactgccaaattaccttccagaaagtttttcttaaataccaatgcagagttgagtcaacagtgcaggagtgtrcagatgcctcaccaacttgccagttccggatctgatatgttttttggtttattgcattcatttatcagaaaagctttctcaaaaacaaagtatgaaataacaagtcttgctttacattaaagtaatgccactgctatatatttgcaaggaagttcttaaaagtgacttggatatgatttttttcattcttttagatagtacaaaagaaaataacttcacaaatttgtaattagcatttgcagcttgggtcattaagtttagtattagggggcaggatttggtgtcagckgtgaactaatgcctgaggaaaaggtgtaacacctttatttcatagatgacatcaactccagatacacaagggaaaagcacaggaaggaatccttttttgtctaatgggtctcttttctcttaaaacaggaaagatgcaaagaataatgaagtgtccttttctcaaattaagtaagtctctcaaattatgagctttattttaaatcctccaatctgttcggtgactatctataaataatttttgatggaacttgctgtcatttttcctgattgrcacattttgaccatgaccatctggaagtttttgctagctctgttttctgcaaggaatctatgttttattagtctcctgaagytggcttccttgtcatgttctactcttctaccaataaatacggatttcttgattaaaaaaacgtcaaataggttatcaagatccaggggagagaagaacttacttaaagtcacaaaaccaattagttacaaagtagggtctagaaatcagatttcctgaatcatattktagtgttttgtgaataatagtactctgaccccctcttgccaaattatrccctgggttttgttgttttgggaagattgtttactrtcatttctagagtatgaatgagtctttctaattgcatattttttctttccctttctatcrtgaagacctaaaaagtgagtaatctctttattttttttaataacttgtacttttctattgaatatggacttcactgaatgtaaaaaatcctgataagttttgttttcttagatctaagttaatcagagtggagaattttgaggcctacttcaagaagcagcaagctgactccaactgtgggttcgcagaggaatacgaagtatgttgctgtaaatactgtttttaattgtgtcaggttccaacccaagctgggatcygaggggagttggtggatgggtggcaggtagctgaaagaacactcgagggactgtaggcagttgggacatggctttattctctctcctacagagtcagcagtgcagttatattactcacagacaatagtggctcaaagccaggtatgaactcacacaaacaggttacattaaatggctatataacgcaaggggttgttgcgctccaaaccctttgcgtcatactgtcctggatgtctacctyggactactcctgactgaagcacagccactttccttagaaattggcttgtttttcctgaaagttagaaaactgttaacagaaactaggaattcaagtcagggaactgttagccacaatacttaggaagctatatgagctggaaagaaaccaaatgggcatgtagaggtctggggcttgatggcagtgtggcctaggatggcttgtgaggctcacttctgaagccctgcacaaggamtttcttggccagtgtctgcctttcagttccccatgctgtgctccaaccagcccaggaaccagccctgctcagagtgaccatgcacactcgtcctcctgtgctgccctgtccagcatctctgcctttgctctcttgaaatcctgctcagcactcagcacagtgcacatgctgcttcctccatgggcattctgggatcccattaggaggacttgagttctgtgtgctcagactgccttgtttcccctgttgcttgttaccaatattcagcatttctttaattctgcctttttgtaatgttagttttttctgtgtacagtacacctctcctccaggttgcaactgcttgaaggcaagggttatcctttttcctatattctaacctttgtattagttctctaggctgccataaaaaagcaccacaaactgggaggctgaaaacaacagaaatttactgtctagaggccacaagtcccaaattaaggtgtgggcagggtcacactcccttctaaacctctgggcagcgcccttccttgcctccgcagcttctgggagccccaggcgtcccttggttttgtggcagcaacactctgatgtctgcctctgtgttcacatggccatctcccctcatgtgtctatgtctctttgtctcttttcctcctataaggacactagtcatatgggattcagggcccactctaatctagtatgatctcattttaatttgtttacatttgtaaagagccttttttttttatactttaagttctaggatacatgagcacaacatgcaggtttgttacatatgtgtacatgtgccatgttggtgtgctgcacccattaactcatcatttacattaggtatatctcctaatgctatccctccccccaccccatgacaggccccggtgtgtgatgttcccctccctgtgtccaagtgttctcattgttcaattcccacctatgagtaagaacatgcggtgtttggttttctgtccttgcgatcgtttgctgagaatgatggtttccagcttcatccatgtccctacaaaggacctgaactcatccttttatggctgcatagtattccatggtgaatgtgtgccacatttttcttagtccagtctatcattgatgkgcatttcrgttggttccaagtctttgctattgtgaatagtgctgcaataaacatacatgtgcatgtgtctttatagcagcatgatttataatcctttgggtatatacccagtaatgggatggctgggtcaaatggtatttctagtttcatatccttgaggaatcaccacattgtcttccacaatggttgaactagtttacagtcccaacaacagtgtaaaagtgttgctatttctccacatcctctccagcacctgttgtttcctgactttttaatgattgccattctaactggtgtgagatgctatctcattgtggttttgatttgcatttctctgatggccagtgatgatgagcattttttcatgtgtcttttggctgcataaatgtcttcttttgagaagtgtctgttcatatccttcgcccactttttgatggggttgtttgattttttcttgtaaatttgtttaagttctttgtagtttctggatattagccctttgtcagatgggtagattgcaaaaattttctcccattctgtaggttgcctgttcactctgatggtagtttcttttgctgtgcagaagctctttagtttaattagatcccatttgtcaattttgtcttttgttgccattgcttttggtgttttagacgtaaagtccttgcccatgcctatgtcctgaatagtattgcctaggttttcttctagggtttttatggttttaggtctgacatttaagtctttaatccatcttgaattaatttttgtcagtttcagctttctacatatggctagccagttttcccagcaccatttattaaattgggaatcctttccccattgcttgtttttgtcaggtttgtcaaagatcagatggttgtagatgtgtggtattatttctgagggctctgttctgttccattggtctatatctctgttttggtaccagtgccatgctcttttggttactgtagccttgtagtatagtttgacgtcagctagcatgatgcttccagctttgttcttttggcttaggattgtcttggcagtgcaggcttgtaaagagcctatttctaaataagatcccactcataggtattgggggtgagaaatccaacatatctttttggggcacagtttaacccatatcacctctacatttccactttgttcttttgctaccaaaacaccacgggtttggtctaggtcctgctcctcacctttacagaaagccaatcactgagatgacaaatattgccggggaagaaagctttaatcgggtgctgcagccaaggagatgggagctgaatctcaaatccatctcgctgactgactaaaaccaggggtttatacagcaggaaagaaatgtaacaatgtgtaagaaaacaggaactaggggctgggcatggtggctcacgcctgtaatcccagcactttgggaggccaaggtgggtggatcacgaggtcaggagatcgagaccatcctggctaacatggtgaaaccccgtctctactaaaaatacaaaaaattagccaggcgtggtggtgggcgtctgtagtcccagctactcgggaggctgaggcaggagaccgcgccactgcactccagcctgggygacagagcgagactctgtctcaaaaaaaaaaaaaaaaaaaaaaaaaagaaaacaggaagtagggaggggcaaggaggcatctggtgcagtgatctgactagtttcagttctttgttactccctgaaggycctttcctgagaaaggaactcagataaaacaaatacaagtttcaggctttaatagcagaagggtaaatttctatgtttattcaaaaacaacttgtctatgggactgttgggctggtttcactgtcatatgctatgctaaatatgaataatatttgaagactaaataaatgaacacctcatttgttttgttttcaggatctgaagcttgttggaattagtcaacctaaatatgcagcagaactggctgagaatagaggaaagaatcgctataataatgttctgccctgtaagttattttatctacagcatcttctctgtgttccatcagtggccatcacatctctaagtgtagaggggagggaatcagtgatcctaagtaaccacttccacaaccattcattagtcacctacttccacaaccatccattattcacctactatgtgctaagcactatatttaggtgcattctcttaaatcctcacaacagccttatgaagtaggtagtagaatatttgttttgcagatgaggaaaatgcacagagtggttaggtgatctttccaaggttacacaggtagtgacgggaaaactcggctttgtactaggtctgtctgtctcagtaagggaaaaggccagagtctgtgttcttaacccctctgtctcacaactatttatttcarttctataattctggaatgaaagtgagcagagggagacggggagtcacactctctgtgtccagacacatgggctgagtgaattccacagctaagtatgacttatatttagctcatttcctgtttttgagaattaacaatgtctgcatcttagtcaacaggattacagcaaattgagtttaaaataagaattatttattacatcaaaccattagatgaaatgtaaataattctccattgaaagttccttgtaatctctcttttgggtggggattagggcacagagaggagcataagcagattgtagccatgttctgatggagctgaaattgatagactttgcagataatttttacatcaggacgtcatcatctttattcgaagccgtgtttttcattcctggactaaaacattaagttctttttaaattcagcattttctagttcttgggttctttctctccatttatttccttgtacttgacaaggartattggcccatgttctgagggaaatgcttttaaaactaggctgggggtattgcccttgtaagggtaatttgggattattggcccctttttgtgaatgtctgtggagattctcagatctggagtgggagctgggaagtgggtgtttgggtattgttcttattgggaagcctttaggctgagactcaggtcagtactagacttagcattgttatgttattttgtccagaggagggtgaggtagtacaatcagagacrgggaaactgaggtggtgctgcttctggctcakcctgacacttgcagttctaaggttattatttcatctcttaagttgggcaagtttgtgtgtatgcttttgagatgacaataatatttataaaacataattctgtgttttagaccctcctactcatagtagtcttatacattcaatttatacttgaacttggtactctgtttttataacaacttgtttatatgagaatagaggcagagtagaatggttaacctagggacctaccccgtcctagtggaaggggcactagatttgaattttgactgcccctcaccagatatatgaacttggagaagtcacttaatctctgtaaccctcagtttcctcatctgtgaaacagggcagtggcttgtagggtggttttgaggagtaaataaaattgtttagcatattccctcatggtagacacctgaggatgctaatagtaacaggttcattttatgtgagaaggcatctggtgtggttaagatcttgggtcctggtgtcaggctgcaggttcaaatcctggccctgccactcattagctctgctctggtgatcatgtgacttctctgtgccacggtcatatagagtgaccatgaggattaaatgaggtggtctatatgaaatgccacactgtgcatcttcaaagacacaagtcccagttttgccattttgaatttcatttttttttctgttttgtgtccaactttactaaaacatttgcttataatggggaccttttttcttttaatgtcacagatgatatttcccgtgtcaaactttcggtccagacccattcaacggatgactacatcaatgccaactacatgcctgtaagttgggggacggtctcacagcactggactgtttcgatgaaatcttcagtgtgctttgcttctttctgtttctttgaggttgactatgtgctgtttcccatttttagggctaccactccaagaaagattttattgccacacaaggacctttaccgaacactttgaaagatttttggcgtatggtttgggagaaaaatgtatatgccatcattatgttgactaaatgtgttgaacagggaagagtaagtatcttttttagtttttaaaatttaaaattacattaattgctttttattgtggcagaagggtatcttaaaaaccatttgtttctttaaaaaaactcaaacattagcactttattcttataaacttgttttctgtctttttttccccrtaagagaaatgtttaaaaacattctttaaacaattctattttgtcattatcttttttttggacaaatatcagtgtcttctgtttattacgttgctgctggagttagtaaatagcaaaatctcccaggcctagtgcaagatgctgttcacggtgtggctctgttcttcattggccccatgaacacggacaagcccatcatgtctctaagcaaccggtgtcttcatctgtgagatgagggttttcatcagctccatgattttcaaatttaggttgagcactgaacccctcctgcctccaccccaggtttttttttttttttttttgagacagggtctcctctgtcagccagcctggagtgcagtggtgcgatcatggctcactacagctttgaattcctgggctccctcccacttcagcctcctgtgtagctgggactacaggcgtgcaccacatgcctggataattttttttatttttagtggaggcaaggtctcactgtgttgcccaggctggtgtcaaactcctgacctcaagtgatcctgcttccttggcctcccaaagtgttgggattacaggcgtgagccatcacacctggcctggaaccatttctttaagcaaaatctcagacttatccctggataagcctcagcagcctcctctctcctgcaacgtcctgaaatccctcttctgcttccatcaaagataagattttttttttttagatggagtctcactctgtcgccaggctggagtgccgtggtgtgatcttggcttttgcaacctccgactccctggttcaagcgattctcctgcctcagcctcccaagtagctgggattacaggcaggcgccaccatgcccagctactttttgtatttttagtagagacagggtttcactatgttggccaggatggtctcaatctcctgaccttgtggtccacctgccttggcctcccaaagtgctggattgcagatgtgagccaccgcccctggccaatattttttatagtaataaaattctgcatttccatgaattgatgtgaagagaactgaaaaacacatgctaatctaaaaaaatgctgtgccttaggaatgggacttaatgttgctttatgagttgtttttaagtgtaggttcattgcttgaggaataggattcgattccttaagccagtggatctcaaactttagcatccatcagcatcaccaggagggtggttctaccctcagagtttctaattcggaattgcgtttctgccagtttctgggtgatyctactgctgtggcaccagggtgcacacttggagtggtactgtccccaggatagtgggagcccttcaggcatcatttcttttattgttctttaattcatggtaagctagcagatgtttatccagcccctggtatatgtaagatcctgtgctaggggctgaggatggaggagggaaagataacagagcagtaagagatgacgcccatcctcatgttgcttgtgatagagggtgggctccttaccctcttgttgaatcaggagaataggctgtaatagaaataaaagcgtttttaaaatgaatgctgataggctgggtgcagtggctyacagctgtaatcccagcactttggaaggccatggtgggcagaccacctgaggtcaggagtttgagaccagcctggccaacatggcgaaacccatctctactaaaaacacaaaaattagccaggcgtggtggtgcatgcctgtaatcccagctacttgggaggctgaggcaggagaatggcctgaacccaggaggcggaggttgcagtgagccaagattgcaccactgcactccagcctaggcaacagagcaagactctgtctcaaaacaaaacaaaacaaaaaaagaagaatgcaaataagctttttaatactgttgagcccagggccttatacatgaaacattcttataaatctatctgttagacaaacaaaaatgacataattacattaatggagaacatgaagatgaatttaaatggtcttttgttcatctaaaatcaagattgaagttagtcttagtgaccctgggtgaatggggaagggagtgtattttctgcactagattctccatatatgttattttttttctgtaacaaccctgtgaggtattatgatttcatagatgaggtaactgaggcttggggagtttaagaacttgcccacaaggtaggaacaaaaatatacctggtaagaggctgagctgggaatcaactccatgtcagtgtgtatccagatcctgggttgtttctttggaacctgggtctttaaagaaatacagatcccgcagccagagtcagaatctctggaggtagaacccaggcatctctttttaaacaaaacaaggccaggcacagaggctcaggcatgtaatctcagcactttgggaggccaaggtgagaggatcacttgaggccaggagttcaagaacagcctgggcaacatagtgagacccccatctctacaaaaatacaaaatagctgggtgtggtggcacgtctctgtagtccaaactcctctggaagctgaggtgggaggatcacttgagcctgagaggttgaggctgcagtgagccgtgatcgtgccattgtaccccagcttgtatgacagagtgagactgtctcaaacaaacacacaaacaaaaaacagaaaacaaaacccaaaacaactcaaacttctcaggtgagtcagataatcaattagctttgaaaactaccagcagtagagcacaccttagaatactgagtgtgtgtgcgtgtgtgtgtatgtggggggtgtgtgtgtgtgtgtgtatgtggggggtgtgtgtgtctgtgtgtgtgtgtgtgtgtgtgtgtgtgtgtgtgtgtgtgtagtcatttgccaaatgggtattcagatattcttggagagcaggtgtttcctggttatttctgttcacatctgcccaccaactttatagaaatcaaagaccccagaatgatttaatttgattttctttattggtgtgtgtatttgtattgcaaccgatgtatatctgaaagccttgggaaaaagtcctcatttcttccagctgtctggggttatgggagaagatgaggtcagtgaacagttgtggtggctactctaggggcaaagggagctggatggggactgtgtcctaggtcaagggacagctgctgctctgctctaaatcaattttcatgctgaaagcagggcctrttgtaggcagatctgatttttaaagagaaaataagtctggatttttatgagaaattttaagagttggcaagaattgtaaattaaaaaaagaaaaaacaattccaacaggtgctgtggtgtgcccatagacccagctacttgggaggctgaggcatgaggattgcttgagtgcaggaattggaggtggtagtgtgctatgatctcatttgtgaatagccaccacactccagcctgggcagcatagtgagaccctgtctctataaaataaaataaaaaaattcgaagggtcaaacaaaacccaactagaaggtctgattccatctctgatgccagttttcaatagccagtctcccttgtgaggttttagtgatggcagatggcatgatctgagtcttcttataaaaatgcaattttgttctagaccaaatgtgaggagtattggccctccaagcaggctcaggactatggagacataactgtggcaatgacatcagaaattgttcttccggaatggaccatcagagatttcacagtgaaaaatgtaagtaagaagtcaggatcagttgagctcatgtaattaccatatgttaatttgggggtgatatgttttaggttgatattaactaatatgttttcctatgcagtgagaaatgttttgctkctttcctttcagaacagaacaatccatatgcatgtatactccaaggcaaccccttgacttttctgggaaatttactttcttgggaataacctaagttattkctgaataaaatgaatcttaagagcatggctctacatcaggaactctttcctttctttccacttccaggtgacttgctcatagattttacagaacaaactgtagccttttggattatttggttagaaatatggcatcaggagcggccacttgctgttaggagtaattgataacagttacattaataggattccagggcatatgcacatggcctyccttcccctcaaaatttacaaaagcaaatccaattaaattgtgcaggcattctaggaagtcaagtttatgtgcyttttttctttttcaaggatgctttgaaaatagaggcagtgccatgaagcagcattggtatctgttgatgggtgtgtgcattggcataactctctgctgtttatatcacaggcctaaacattaggcatrtgctggcttgaagtctgagactatcctaaggaaataatctgaaatgcaaccaaaggcttattcagaaagacgagtctcagcattatttataatagaggaaaactttggaaaccatgcagacatggttttgtagcttttgtagcttttgcagaatggataacttaactatgactcgtctgcttataatatcattattcagctattagaaatgatggcccaggtgcggtgattctaacctgtgaggctaaggtgggaggatcgcttgagctcaggtttgagaccagcttgggcaacatgctgaaactccacctctacaaaaacaaaaccaaaccaaacccaaaaattagccaggcatgctggtatacacctgtagtcccagctacttggaaggctgaggtaggaggatggcttgagcccaggaggtcgaggctgcagtgaaccgagattgtgccactgctgcactccagcctgggtgacaaagcaagacccggtctcaaaaaaaaaaaaaaaaaaaaaaaaagataaataagggatgggtagactatataattaccatggggacatggtaggatgtaatgtaagagaaacattctaggagatgaaaatgtatgcatattatgaatagtgcataaaaggaaagccgggaagtatagattcactggagttgaatcttgaatcttttgggtgggttttgggggttgatgggttagggtctagtttatgagattatccttgaagattccacaagtcatggataaagtatagtatattaagtagtaattctttactaattgctgtgtctcaaagggtctggcctcaatatttcagttcctcctctggagatgccatcaaagctgttaccatgatctggccacctaaataatgcagctcacagtagtagaaaaatgtcatgcttatttcttttcttttcttttcttttttttctttttttgagatggagtctctctctgtcatccaggctggagtgcagtagcacaatctcagctcactgcaacctctgcctctcgggtccaagtgattctcctgcctcagcctcctgagtagctgggactacaggcacctgccaccatgcccagctaattttttttgtatttttaatagagatggggtgtcaccatattggccaggctggtcttgaacacctgaccttgtgatccacctgctcggcctccaaaagtgttaggattacaggtgggagtcactgtgcccggcctgtcatgcttatttctatagattttgctcatttgaactgactggcttctccttggttgcctccactgcttggggcttaccttgtggaggggaatttaggatggagttgtccacatcatttttaaaaattgctgttactatgattattattttttattaactaaactccagactttattcagatttcatgtttttccactaaagccttgttttgttcctggctctgatccaggacaccacatggcatttagtaccatgttattttttaattatacaaaatgcctgaatacattttcctttagaaaatcgagaaattacaaacagagctaaagatttcctttgactaccacccctaacctgagcccctttgcccctccacgaagataatactaagtataaccctcctcacttctccctcttcctctccccctccttctccccttgcccgctcccactccctttcctctccctcctccctctccctcctccctctccctccctttttcttcctcttcccccacctccatctctcacagctggtttctgtctttggatcagtacttctggttaaatgtgtgaatgttaactttatctgtgatgaggtcttctagcacctctcccttcactctgtctgtttttcctgttttccaaattttgaatactgcacattcttatcatgaatatacatttcaaaaaatgagtgtcaaagggcagctgtcataatggagatggaaatgcctgcagtgcagatgtaggtcacatgggtacggatgtaggtcacatgggtatggtcattccctggtatgggcataacgagtacagctgagtcagggacaggactcgccccagctggggtgggcttctggtgcttcaaggtatatgctttggtatgaggtagggaaccagtctgtgtaataatgagctctattgtctttcagatgttgaaatggatggttttttgggggagtcctttctcagctctctccaattctaaatatttgcatggtgcttgctagtggcctgtcactttattcacttctctaggggacatagtgaattatgaggccattcttgcctagaaggcactgattatcatggtgtatttgagtaaattatttttggttttattgtcagtgacattcccaggggggctcggggatggggctcatgcagctctaaggaggtgcaggtgtaagaatgtgagttcattattgataggcagctgtggcaggaagggaaggatctgaatgcagaattggaggatgagggacttctgttgcatctgaaatcagtgttgrggaaatgacttcacttctgtgaatctctgctgcctcatctttaaagggggataataaactctccttcttgagcatattgtgagggtttgatgagcaagcactttatcagctgctgtgcaaatgtaaagtttaatttttagtcattacaactcctggttagtactcaggctctgcttgatttcccctgcctttttgatgttgttaggcagcctttctgtctgkatctaaatcattttctgggcttttagatccagacaagtgagagtcaccctctgagacagttccatttcacctcctggccagaccacggtgttcccgacaccactgacctgctcatcaacttccggtacctcgttcgtgactacatgaagcagagtcctcccgaatcgccgaytctggtgcattgcaggtacgcagatggcacgtcacgtgtgacagatttcaaatgtcattatatatttatgagcactttacaaaagcaaagcctaagagggaatgtaataggcatttatgaattcaggaaaggtttggataaggaaccatggacttactccctaagccctgagcttccaaaacaggggttggcaaactgtaacccatggatcaaatctggtcagctgctgtttttgtaaataacattttctaggaacacagcatgcccatttatttatatattgtttatggttgcttttctgctacagtgacagaaagagaccatatggtttgcaaagcttaagatgttaactatctggccctttactgaaaaagtttgccaacccctaacaataagaagttagctttgaagctaaaggaattaatttaggacagaagacaggaggggctctgttgcccagtggggaaaaaatggctaaaatgtgccgccatcctgggttatgggcaacttgaatggaactgagattgaagaagcttgagcaaagggttatatgtgtggcatctgactcaaatgtgagtttgggacttaggccccagtcccaagctagtgctgtctgacttgctgaggcttcaactgagcaaatgtgtactgatcctgtgcattgccctcaaagtgtgacagtgaaggaaagcaagatatatgtacaaatgaggaactctaagagggttgcagtcgagggaacccactgtaataggcttatttctcttttctctcagtgctggggtcggaaggacgggcactttcattgccattgatcgtctcatctaccagatagagaatgagaacaccgtggatgtgtatgggattgtgtatgaccttcgaatgcataggcctttaatggtgcagacagaggtgaggccaagatctgtatttgacattccacccttcccctccatttnnnnnnnnnnnnnnnnnnnntttgacattccacccttcccctccatttttttttttttttttttttttttgagacggagtgcttgctctgtcgcccaggctggagtgcagtggcatgatcttggctcactgcaacctctgcctcctgggttcaagtgattctcctgcctctgcctcccaagtagctgggattacaggcacrcacaccatgcccagctaatttttgtaattttagtagagacggtgtttctccatgttggccaggctggtctcgaactcctgacctcaagtgatctgcctgcctcagtgtcccgaagtgctgggattacaggcatgagccactttgcctggcccttcccctccatttttaaaaggttgcattgtgtcatgcacttgtgttaaaatatgtcacccttccagatctttccagctcttggctgtgaactaacactggatttctttgcagactttaagctgacttggaattaaattacccaatacaagtgacatagtagtactgatgtcagtaatggaactactactgagatagtgtcaggattctttaccttgctgcctctgactcattaaataatcttaggacatctttgaactttggcttccaggttttaaactcataaaactggtattttccagtctttgtttctaagaaggtctgaccatctttaaaataagctaatgaaacaaactcatcaaacattaatgatgtgacrtatcataatgctgcttaaatgttaatacagcaatttatcctcacccagacttgtacattttaaagactatcaattatcatagctacagaagggtggctgaccagcggagaaaaggaacacttaatatcyatggtatagtttctgtactactgctggatttggttttacccaaamtgttactgagaagtgtttttgaggcatgttttcaacagaacatattgcaaagttgctttcctcaaaggggtgaatgttccttgaccaggatgagagcagaatattaattttgtatcaggctatcgtcctgtaccgatttagaactctatgaatatgtgctgtgtttttgagtctagcagggaatgttctagatgcctgggtacattgcrtgctctggggtgagcttggtggttgttgtggaaagagtgaaattcaactcctgtgttggtcaaaagagagattttcttttttctgctataattatataaagtagtatttctcaatcttttatccttttttgagaaacatagaactcttatccctgctactagagtctaatctcttttttatattttgaaaacaatacttattcatatgaaagcatttgacaatatatttttctctcctcttttttttttttttgagacggagacttgctctgtcaccgggctggattgcagtggtgcgatctcggctcactgcaacctctgcctcctgggttcaagcgattcccctgcctcagcctcccaagtagctgggactacaggcgtgtgccaccatgcccagctaattttttttttgtattttagtagagatggggtttcaccatgttggccaggatggtctcgatctcctgacctcatgatccgcccgcctcggcctcccaaattgctgggattacaggtgtgagccaccgtgcctggcctcaatatatttttctctgactcttccttccccaatcctgcttcctggaggtagccaatgtttatagtttggtgtacatctttataagactctttatgtacatctgtaaacacacacacacacacrcrcacacacagtactttgaaaaaattggatgctgttttttttttgagatggagtcttgctctgttgcccaggctggagtgcagtggtgccatctcagctcactgaaacctcaacctcctgggttccagcgattctcctgcctcagcctcctgagtagctgggattacaggtgtgtgccaccacgcccagcaaatttttgtatttttagtagagacggggtttcaccatgttggccaggctgatctcgcactcctaacctgagccgatctacctgtcttggcctccccaaagtgctgggattacagacaggagccaccgcgcctggccagatcctgttttatgtatgttgcttctctgtgattttttttctcctcttataatatcatggatatttttctgtgtcagcttatacccttgtttcctcttttcttcatcactatccacagattctgatatacctacctgaaggatagtcctcatccagctccacctgatcatctccttttaacctcgctcctcggttgagcattacagttgattcttactctgtacagtctcactagccaaggcaatcttgttggacatttgattgttcgaatgtgtgtgtgcattttttcctctacatttcctccttcctttgcccttccctgagactgtggcatttttccttggggaggggaggtgtggagtgtgctcttctggttgagaatcattgaggaaggacatcttgcttctgtgatttcagatttcactgcaatgttgttacctcttgaaacatgttcgcttgaaccgtttgctgttgggtggatggggtttgggagttgggcgggggaatgacctgtttgaaaataattttgggtgctaatttctgggacccatgttcattttctgtctctctctttcgttttyctatcaggaccagtatgttttcctcaatcagtgtgttttggatattgtcagatcccagaaagactcaaaagtagatcttatctaccagaacacaactgcaatgacaatctatgaaaaccttgcrcccgtgaccacatttggaaagaccaatggttacatmgcctaattccaaaggaataacctttctggagtgaaccagaccgtcgcacccacagcgaaggcacatgccccgatgtcgacatgtttttatatgtctaatatcttaattctttgttctgttttgtgagaactaattttgagggcatgaagctgcatatgatagatgacaaattggggctgtcgggggctgtggatgggtggggagcaaatcatctgcattcctgatgaccaatgggatgaggtcactttttttttttttcccccttgaggattgyggaaaaccaggaaaagggakctatgatttttttttccaaaacaatttcttttttaaaaaagactattttatatgattcacatgctaaagccaggattgtgttgggttgaatatattttaagtatcagaggtctatttttacctactgtgtcttggaatctagccgatggaaaatacctaattgtggatgatgattgcgcagggaggggtacgtggcacctcttccgaatgggttttctatttgaacatgtgccttttctgaattatgcttccacaggcaaaactcagtagagatctatatttttgtactgaatctcataattggaatatacggaatatttaaacagtagcttagcatcagaggtttgcttcctcagtaacatttctgttctcatttgatcaggggaggcctctttgccccgrcyccgcttcccctgccccctgtasatttgtgctccattttttcttcccttttccctcccagttttctccaaagactcttctgttggcaacattttcaacccattggttgggtgagaatggcgactcaaatatcaccttgagaatttctgtgggtgggaatgggagaagcagaggaatcctacagtggcagaaatccttttcttgtccctgtattatcctttttctcatgtctgtatttggtatgaaggattatttaaaggtgcaatatgtgaattagtgattcatgatgttctaggtttttagtaacgttttactcaggttggcattttatgtgtctgtgtctgtatgtgtgtgtgtatgttcagaagcgtggcaatctgtgaacacttcagcgtgaattcagtgtcagattaatccctccttccccaaagtccactggctttcgtctctctctgccgtgacacatatcggaatctactgtatatatatatatatatatatatatatatatatatatatatatatatrcactaagctctcaaaaacagtcattcctatgaattgaggtgtacaaagtttgaatttgtatcaaagatgtaattattatttttaaaaccttttcactatactgctgctgtaattactttgatttttaaaatgtagattaattttttttttttgcttcaggtgtgtatccaccaagaatttcaaatttatgtggatttattttattggtacataatctgtaaacttcttaaggcattaacatgaaaagattttttctttttattttatattgtggctcaggttatattttgaagatgttttgagtttatcctccaataggcaatgaagttgacaaggttttatgaaggaataaccaagtccctggagtcctgtggctgttgccacagtaatgygtcctgctgtaaacaggacaggtgtgtcctgttgagaatgtgagcgggctcttccagcctcctggtccctcctgactctgccacgcccctcacctcactggcacttcgataactgactggacgtgttaatgggtcttttagggttctaaagggtgaaccacacttttaaagccccggctgtggttcggagggttagtgctgtatgccttttatttccctttccctttgaggtactgaaaggatgaaaaggtggtgtcatgttttggggagaatcttacttctcaaatggaaattgcactttttgctgaatcctttgcatttttttggtagtaagcagttcattgagtatcaggtcctcaaaggaatgagttggcccggctagggtgggccctcttgacctaacttcagagggggccttggctcagtaggtgtgaatcagggaagccacattgtcctcagggtgctgtatgaagctgggtgtgggcggattcctcccacaccttcacactggcctgcctccaactcatacagatctcggagcggtcggtacttcattcataggtccctgttcaggcagcagttctgtgggctgtggccctctcccctccaatatgtccgaaaccattgtgatgggtggcaaatcccagggagctcctaagccctgctctgcccacatcactgccacagagaagtcagaggaagggacttgttgctaaaaaatcctttaaaaggttaaatactttaaaagattaaagcaacataactgtaaacatatygtataaaaatgaaaaacacaggaaccctcttcccttccgcctggtgtgggcttgggaaatgggcaagcggccccagcaatcatgggaggaactcttgcgggggagcggtctgggattccaaatgggcaggtcacacgaaggtcacgatgcttctctgcatcctgaaaagggctggggacagggccagtgggggtggtaagggtatttatagcacagtgcttgaaaagggaagattaatgtgtaaatataaaggacacacaggctgggggttggtcagaggcaagaggagggtgcctctgagcttcaacccctcccaggaacaatgagctcaaattggaagagtccagtggaatcggggggatggtgtgagcrcccctgttcagtctttgacaattgcatacagaaaagcagctggtatgggtttgggtgtcaatgaaagggccaaagactggtggccagctggtttgggggatttgggccattgatagcatctcccaggaacaacgactttttgcctccaaagttggatctagtgatgatcagcaccagcaggaaatgacatttggtgtctgcccactgcagccatactgtgacctccagccagacttccgcctaattgactccactggatttgtgctctgttgagtcagaggctcccgggggttggggatcgaggggcgggggtcagctatgcagcccatcacgtgtgtttttcatctgggatgaaaaagcctggttctcttttgaaatgcttgattgtacttattgagctaaacaagtcttggtgactgttgttgatttgcctcaaaagttttaagtcctgggttttcagactactgtgtagcagctgtgtgtttaacatactgtagctttttctcccttgggggcacatacaaataggatgtgttgatgtggactctaaactgtaattttcctgtaactattttggaatgatgcatatttctaatgtttgttatacttgtacagagtattgctgttggttgcttttttttttttttaaggaaaaaatggcctgaaaacatttttttaaagacttacaaataccaaatataaaaaaatgtcaatgcattatgcctttgcttctttctttcttcttttttccttcttacaatgtgccaagcagtttactggcctgcattttacttgggcatccttaacaaaaacacatttctctttgggatttccggattgttttagttttctagggctgttgtaacaagtaccaccaactggtggtttaaacagcagagatttacttcctacaattttggtggctgaaatccagatgtgggcagggttggtttcctgtgaggccttttttttttttctttttttgagacagagtctcactctgttgctcagagtggagtgcagaggcgtgatctcagctcacggcaacctctgcctcctgggttcaagcagttctcctgccccagccttcaggcgcctctcttcgtagcttgcagatggctgtcttctccccatgcctccacatggtcttccctctgcttgtctgtgtcctaatctccttcttttttttttttttttgagatggagtcttgttctgtcgcccaggctggagtgcagtggcatgatcttggctcactgcaacctctgcttctcgggctcaagcgattctcctgcctcaacctcccgagtagttgggactacaggtgcctgccaccacacccagctaatttttttgtatttttaatagagacagggtttcaccatgttggtcaggctggtgtcgaactcctgacctcgtgatccacccgccttgtcctcccaaagtgctgggattacaggcgtgagccaccgctcccggctaatcttataaggacacgagtcatactggatcagggcccaccctattgacctaattttaccttaattacctcttcaaagacactccaaatgtagtcaaattctgttttagtgggggttaggacttgaccatatgagttttggaagggacccagttcagcctgtaacacatattcagggcaatttagtgaagaggaggcttggaggaagtggctgtgtgtcttaagattgtgtgtgttcccagaaggttggaggtatgagcctgcaggtggatggatacccagttggttgggggtgtgttatgatatagttagctctcctgggctttctgcttagggacagcgcttgggctgcggataaagtatccatcatcttcctgttttgattcaggccaaagttgtcccagaacttttctgcccacagtgttggtttagaggaggcagggagacactgtattgctgacctgttatctgcatacttaaaaaaaaaaaaaaccaaactaggctaccctgcaaaatagcacagcattctctgctcctagcacttagtttgataaaaactaccttacccaggtatagcctaggaattgagatattgtgggaaagaaaaaccgaatgatcacctgtggttttataaaatgtaaagcttaagtgagaaaacaaattcatagaactataaacagagaacaatcccaataagaattaaataagtgcatagaagaaaagaaacacaactctagaataatataatagtgggattaggagtggattttatttttatattcacctgtttatagtttctaacttctcccaatgaatatggagtacttaagagtaactagtttaaaacttagcacttttccctccttgcctcaaaaaagtgaagctacagtatagttttaaatttactagtcaagttacaaaattctttttttttttttttttttttttttggagacagagtctcgctctgtcacccaggctggagtgcagtggcacgatcttggctcactgcaagctccgcctcccaggttcacgccattctcctgcctcagcctccctagtagctgggattacaggcgcccgccaccatgcccggctaatttttttgtatttttagtagagatggggtttcaccgtgttagccaggatggtctccatctcctgaccttgtgatccgcccgcctcggcctcccaaagtgctgggattacaggcgtgagccacgacgcctggccaagcttccaagttctgatagccatcccatcccttctggggtttcacagctctatttggggctgaacgtggcagatctctggggcctccaacatgagagcttgggctttacattcctgcaggcaggtgaagcctcctgacccaaaaggtgagtagtgggcccctgttggggccagcagttttggatgatgccactagatggcggcagagaactgggctgtggaagcaatccttggctaggctgtggcagggcagtggagcacataggattggaaaagaaaccaggaggtccgtaaggcaaggctaaaaaccagcaacagggcgaaggaagcgcccttgccagcagctggcagctttccgtataatttgttagataatatgttcatggtaaaaaaatttaggaaaagaaggaaaataaaaaaatcctatgttgtcaccattcaacaagatgtcccccaataatcctcccgcctggtattcacatttttgtgtagcccctcctccactgtagcagggttggtctgtgtgactggtagattgcagagaggtgatggcatcccacttctgagataaaactgtgcagtttctctctcgctgtctctctccctccagcccccctcccacggcactctctccaaaaccagctggcatgttctgagcagccttgagagaggcccacgtggtgggcttcttctgaacctcctgccaacagctacatgagtgggcctggaagcagattctcaggtcagcctttggatgacagtagccctggccgacagcttgactgcagcctcctgggagaccccaagccagaacctacccagactccctgacttgcagaaagcatctgagatgataaatgtttactgtttcaaactgctctgttttgggataatttgttacacagcaagagataactaatatgggctaatatatcccaccacataggaaataccactgttaacattttactgtaaataattctgtaacctttagaattctcacaaacaccacacacacacaccccccatatgtgcacacatgcatacatcttcatcttcatgtatttgctttcatctttttgcaaaactggaatcaaacatgttcatatttctttttaagattaacatatttctttgagtaatatttctactgaagcgtaatacagacagaaaaatgcactaatcataggttggctgtttgaataattgtccaaaaatgaacacacccatataaccagcacccaaattaaaaagtatatacgaccagcatgccataagccaccttggtgccccctttcagccacaccctggcaaagctaaccactatcctggctgctaaccttttaagttggttctgtgctcaattttttgaaacttgcttcttttttaaaattaaaaatttttatttttagagacgaggtctcactctgtcatgcaggctgcagtgcagtggcactgtaatggctcaccgtagcctcagactcctggactcaagtgatcctctcacctcagcctcctgagtagctgggactacaggtgcgtgccaccacacctggctaatgaaacttgctttttttttttttgagacagagtttcgctcttgtcacccaggctggagtgcgatggtatgatcttggctcactgcaacctctgccttccgggttcaagcaattcttctgtctcagcctcccaagtacctgggactataggcatgtgccaccatgcctggctaatttttttgtatttttagcaaagacagcgtttcactgtgttggccatgctggtcttgaactcttgacctcaggtgatccgcccacctcagcctcccaaagtgttgggattacaggcctgagccaccgtgcctggctgaaacttgctttttatacttgacatattgtgaactctttctgtgttattaggtattcatcctgttcaccattttaagagctgcataatactccatagtatggacacataccactctcgagttaactactcttttattgattgccattagattatttctgattttactctcctgtgaataaggatgtggcatctatcacagtagccagatctttgcagacatcacaattaatttcttagtaaacttttctataaaattaatgaatcgaaatatataaaaaggtagggctttaggctggtcgtggtggctgatgcctgtaattccagcactttgggaggccaaggcaggtggattgcctgagctcaggagtttgagaccagcctgggcaacaaggcaaaacgtcatctctaccaaaaaatacaaaaaattagccgagtgtggtggcacatgcatgttgtcccagttgcttgggaggctgaagtgggggggatcacttgagcctgggaggcaggttgtgccaagattgtgtcactgcactctaacttgggtgacagagtgagatcctatctcaaaaaagaaaaaaaggtaacgcttagatgaaattctgctaaatttttctctagatagcaatttacactctcattatagtgtgtgagaatgcctgtttctttacagcttcatccacaatgaacattataataatgaacacccygcccccctccttttgtaacttgaataggcaaatgaaaaagaagcaaactgtgctaggcctttcttggattgctgtaaagaaacaccacctgagactgtttaattgataaagaaaagaggttttagtttggctcatggctctgcaggctatacaggaagtgtggtgctggcatctgcttctagtgagggcctcaggaagctacaatcacggaggagggtgaccgggagccagcatgtcacatggcaagggcaggagcaagaaagagagggtgacagatggggggacgtgtcacatgctattaaacaaccagatcttgcgtgaactcggagggaaaactcgcacttcaccaaggggatggctgtgagccattcacaagggattcgtccctatgattggagcacttcccaccaggccccatctccaacactgggaattatatttcttcctttttttttttctttgaggcggagtctccctcttttgcccagcctggagtgctgtggcgcgatctcggctcatcacaacctccgcctcctgggttcaagtgattctcttgcctcagcctcctgagtagctgggattacaggctcccactaccatgcccagctaatttttgtatttttagtagagatggggtttcaccgtgttggccaggctggcctcaaactcccgacctcaagtcatctgcccatcttggcctctcaaagtttgtgattacaggtgtgagccaccatgcccaggaggaattacatttcaacgtgaggtttggaggggacaaacatccaaacaatatcacaaactcaaaacttctgggagcctttatatggagttgggagcaccggttcgagtctcccacttagtgagggccacacatccaggatctaaggaattctgtcctgtgtttccacagctgcagtcttgggtgtgagaccaggtgtcatatcaggagaccaattttgttatgtcaaaattgcatgctcaggggtcatggttgtgtcttggacaacctgatccagactcataggccctgatgctgcagccttggcagtgtgagggtccttctgaggcatttcatgttccctgacatgggccatagactccctagatgggaagaatccgtgaaggccctttcaacaaatccactggtcctatccactccacctagcctggaggcttaattacttccagaacctttagagggagggagatggcatggctctttcttggaaagtctggaaggacaccatgggctagaggggacagacacatgcctcatgtggcctcacaggtcagcctaggacctgtgacagtgacagggagacaggtttggcttaacacaaggaagggccttttgaggagcaaactcccctgaggggtcagccctctcatgggagcagctcaggggagaaggctcagccttggctg

SEQ ID NO: 12331 - DNA, 28951 bp, Homo sapiens
ttttcctttttttttgagatggagtctcgctctgtcgcccaggctggagtgcagtggcacaatctcggctcactgcaagctctgcctcccaggttcacaccattctcctgcctcagtctcctgaggagctgggactacaggtgcccgccaccacacccggctaatttttttgtatttctagtagagagagacagggtttccccctgttagccaggatggtcttgatctcctgacctcgtgatccgcccgcctcggcctcccaaagtgctgggattacaggagtgagccaccgcacctggcccagaattttacatttttaacacaagtctttgtctgaatagagtattcagattagtctaccacactccccaaatcctcagcctaagttattgccaaaactcatgtctgctcattctgccacttgcttctgttctcaaatccatttagcagtgcagccatggtagacagtcccagcatgctgctatgtcctctgtagagagtctttctccttttctcactcagatgtttctccaagctgtgaaagggtgtctattttgcccaagggcagcttgtgaattcaaaatagttaaagtccctggggataagtctcaaccaatggaaactgtgggttgttggataaatagtccacatcaagggtcccaaacccccagagcatggtctgttagaaactgggccacacaggaggtgagtagggagagagcactaaggcctgagacctgcctcctgtcagatcagcagcagcattagattctcataggagcttgtacactgttatgcactgcacattccaccttctatgtccatgtatgcagattttttagcttccacttatgagtaagaatgtggtatttgactttcggtttctgagttgtttcacctaagataatgaactccagttccatccatgttgctgtaaaagacatggttcattctttttttaaaccagtaatatctttagctctctctctttctctctctctcttctgtgtgtgtgtgtgcatgtgtgaacacatttaaaatatcaaaagttcttcactaacaaaagaccccagaactcaagaattcccactaagagaaaaatgcttaaaatattcttggtttctaaggctttgcttatgtgactactgtagatttcctgtttttcttgtgtgcctaggaaactaaagccacctgggaacggtatcaagaagaaagcctgtgaagccttctaagatgggaaagacaaaagaaagctggcaggattgtgcttgctaaggtgtgactgtgcagtatctgtggctttttctgacctcctcccacccctgcacccaacacccatcctcaaactcacatcggatgattcaggcatggctctgctaacactttattaaaagcatggattaattttacttccaagtttatttttactgcaccatcccatttgtggaaacaactagcttactcagcttttttttccttttataaaggaaagaacagaaaagtaaaaggaggaaagaaaacaagaggtgagtgaggcaactgaaaactgttcttggacctgcggtgctatagagcaggtatgttcactttcttttaaatgcaacttagttcctaactcaagacttggtttctgattcagagtggtaactgaggaatgggcaggaagggcagggtgcctgctgcctggcctgcaggagtctgtggctggctttagttctggggaagctcagcttctccacttgaaccagtgacagccgggcacgccgcgtccccctggatgtgctgttccctgatcatcaactcaggacagcagtgagtggcctggaatgagccctggtgggcgcctgcctggctatctctctcaggtcctgcggcaagccccagaatgcagagaacaaggagcttccaggcaattataccggaagggagagtttcttgtctatctttctagtggtcacacttaggaaagcttcagaataagagctctataaatctctatgtagaaataaacttaggccccacatcactggtctttattacttaaaaataattatatagtccaaactctgtgtgtgcgtgtgtgtgtgtgtgtgtgtatgtgtgtgtggggagggggtgggggaggaggggggtgttagtttcccataggaacatcagagtctcttgtagctcttgctaaacagatggatacttaggcctgggaatctgggtttgaacaatcctctcagttgattctttaaaaaaaaaaaagatgaagaatagacactatgtttaaaataaaaaagatttttttaaaaaccaccatgtcccatggtggtttgctgcacctatcaatccgtcatctaggttttaagccccgcatgcattaggtatttgtcctaatgctctccctccccttgccctccacccactgacaggccccagtgtgtgagtttcccacccccacccccagcgccaaccccccgccgcccgtgtccacatgttctcattgttcaactcccacttaccagttagaacacgcagtttttggttttctgttcctgtgttagtttgctgagaatgggatctaattaaagagcttctgcacagcaaaagaaactatcatcagagtgatcaggtgattcttatgtacatcagagtgtgaaaaccagtcctgaataggattgaacagctgtatttcatttagtagaagttaaaaggtctgtggttcccacacagctaagaaaccagagacctggtttatataaagttgtttgcaggagcagccacatcttcctagagctgcctttattgttcactttaaagaagggactgtacagttgcagtcactgtaatgtgatgaacacgttacacatcacattacaatgcatttcactgtggaaatcaggacctcgtgtttgatctccattttccttactcccctcagtgaagaatcagacaagagcaggttgtacagcaacagcgtgcttgaactttacagttttgcttccgtgaaaaatttatttgtagtttttgtttcttagtaacttatagtttgtatattttgttgaaatatataatctaatggaccaattgttattgtaattattgtagtaacctccatttaattcaacatttactgaaatcctattgtgtggtgcatgctatgcaaagatataaacttataatgtctcgttttattatcaaaacaccctccaggttggatgtatgatttaactcacagacccctataattaacaggctcagctagcttgacctccttggtcaaggccacataagtagtgaatgatagagctggtatttttggtggcattagatgcatcttgagtgtctgacatatcaattctaaactgagtatttgaggcatttgaagacaatattatgtttacatttttctaattataaggaaatacaggtatcatagaaaaccattttaatataatggcaataaaaatgtgccaggagacctacagaataattgtactttcaatactaaatttatggaattaaacttcacctctaaaaatattacaattaaatcccatatgcctttcacctcgattcacccaaaagtgacattgactttatctctcaaaaagaaatctctctaacttatctattaatatgtatgtacataatttatctctctctctagatatctataatttatctccataaataatatgcaatattatatgtattgttattcttattctttttcttattcttgtctgtgggagtaaattgcagagaacctgacccttctaggctacgtatttcagcctgtacttgaattctttagattctggacattctcctgcttcccttttggaaagatagcctgtattctctagagttttctcatcccatagtggatcctttcccttctcccttctattcccatcactcttccaaacctgtagataaaagacaaacatataaggtcacactgatgcattagagaacaagtttcagtatatgatgatcattaaaaagttactgcaggttgtcgatcaaaaaccttatagcataaccactgtctttgaggtaggttattttgacagataagtggttgcagtagcataacacagaggaataggttgcccgattatccaggcttttgtcttttactctcttttttgttggtaaaatatacataataaaattactattttactaattaagaaaatacttcggtgacattagttgtgcagctatctccagaacttcatcattgtaaactgagactctctacctttaaacaatgattctgcattccctcctcccccagcccatggtagctacacttctactttctgtctcaatgtatctgattattctagtacctcatacagtatttgttcttttgcgcctggcatatttcacttggcataatgtcttcaaggtgatccatgttgtagcatgtgtcataatttcctacatttttatggctgaataatagctgattgtaggtatatacaacattttgttcatctattcatctgtttagagtcatttgagctgttttcatcttttggctattgtgcataatgctgccataaacattgatgtacaaatatctgtgtgagtccctgcctttaattttttggagtgtatatgtagaagtagaatagcttgatcaaatgttaattgtatgtttggttttccaagggaccatcatactgttttcatagtgacagtaccagtttgcattccatgaacagtgcacacaggttccaaatcctcaacatcctagctaacacctgttttcagttttgaagttttgggctttttaaaaaaaataacagtcctaatgggtgggtctaacatgtacctcactgtagttttgattttcatttacctagtgattaatgatgttgagcatgttttcatgtgcttattggccatttcttctttggataaacgtctagtctactctatccatttttgaatttttatttttggctattgttgctattgagttttaggagttctttatgtgttctatcagaaacatgatttgcaaatattttctccctttccatagattgcctttttactctgttgatagtgttctttgatgcacaaaagtttttaattatgatgaagtgtggtgtatctaatttttttcacttgtttccagtggttttgatatcatacacaagaaatcattgtgtatgacataccagaaatccaaggtaggcagaacagaaaccagaacaggtagctcccagtcaggttagtgtgttacaaataaggtcttctttgctccctccacttcaagggagagaactgggaagtgaaaaaccacctcctccaaactaagactatgtcactgagtggagtgggcagaactggcaaacaaaatgccatgaaatcgcctaccattttgaatatgccttttaaaaatattggacatttgcctggttgctatagacttatgactgttttccagagctcctataagatcattttagccatttttttaaagttgttttgtgatgtctccaaggagagaaagacttagaacttcctagcctgctattttaatcaattgtccaggtttgtaagccgggttctatgatttctgcattcatcctttgtaagactcgtgatatcatttgtgtatttgtggctataataatctacaacttgcagatttttgtgtcagtggggttggatacttaaggcatgcatcacaggacttggagtattagtgggccccctattatggtaacaattacttggattttaatagtactactgaagtaaaactttaaagaagataatgttccatgtttcatcacttaatatcattacagatttgggagagtgataaaagaagccttgtgcagtcagctaatgctagattacatgttgtccagtagaaacacagaagtctcattagtcctatgttgatgggtgcttgggaaacactgagacagagaatgacaatgtaacgttatttctactgggaggctcttctaggttggcagttgccatggaatctggacccaaaatgttggcccccgtttgcctggtggaaaataacaatgagcagctattggtgaaccagcaagctatacagattcttgaaaagatttctcagccagtggtggtggtggccattgtaggactgtaccgtacagggaaatcctacttgatgaaccatctggcaggacagaatcatggtaagtggtatcctgggacacaggccagttgcttgattccagctatatctcagcttcttgattctctaccccagagcacatgaaggtagactccaattcctttcaataaaccaaccttctcattccaattcttaccaccaaaccactaccttacgataatccattctcatattttttccctcattcccattaaggaaactctacattactagtgcccagaatcctaccttcccttgtgtattcaagtcctgggctcctgtaattgtgtctcctttgtcttataacatattttgctttcctcatgtaatattcccatcaacatacaaagatgttttaatctatgtaatcttgaaaacgcttcctgaattccacatcccatgtggccaccaacttctgttttgtttttgtgtttgttttagtttttaatcacttttcaatgcaaaaaaagatctcaatttccctttttgagttttttccttctcgtgtctttcttcaacccactcttctctgactttgaaccccaccacttttcaagatgttcctgttatcagtgacctcctctttgtctgattcatagatttctctttgtctccattttgagccgttacttggcatcattctcacatttaatgtccctcgcttttttatatagattattcacaaagtaagccattcttgaggaaatacagaaaggaccatcatgtatgttggggtagttacaatccaaccagtctgatgctgtggccccagggcggcttggctgctctgctgtccctgtgcttagcttcctcctcttccctgcaggcttccctctgggctccacggtgcagtctgaaaccaagggcatctggatgtggtgcgtgccccacccatccaagccaaaccacaccctggtccttctggacaccgaaggtctgggcgatgtggaaaaggtaagacagagagtcatagacaggttccttttattccagacgtgatccttgtaattaaactgttgtgatctatttgtgcaaactagaaatccaactatagcaaataaggcaaactttgacctgtttgaatcacacttctagacaaggttagatatcatggtatattaggtaaaacattcttttatttcttggcacagtggtgaatgatttgattcaatttgataaaaggttgttaagcagttgagttccaggccttggggctgagtagcatagacattggtgaacaaagtaaaggtcctgcccacaaagagccttcaggatgtagtgtgactgggaaagaagcaggttgctgagagggaggagatgggaatgcaatgcaatccctgccctctgtcaattccatagggaactctgtggctggaatggcccttttgagttatcatgttttgggacaagggtgctaggccttcatccctggtgctggtcaatcactggaagtctgccctggaaaactttctcattaagagagctgacacctgtgatccaggcagcacctcacagctttcaccacatacagttgtgtataacagtgctttgataagaaagagaagaggtattgactccaatctcaggagatgaggagaggcctctcacccaccttctgagctaccatgtgaagagtacatttgagggytggaattaggagagttcagtttatatttctcatgatgaagctcatcaattacccacagagcattctggaaggctttgagacatttctgattgtgctcatcataaaaaagtatttgttcttcctacaataaacattataagatgaatttttgatatttagcttcttatgaatgggtgaaataaataatttctctcttttattgtcttactttgagagttatttgggaatgggttctaaatttctatacactttatttttgcccaaacaggygttagaaattctgtttatttttctgctttagtgttgtataattgacaaataaaaattatatataattaagctgtacaacttaatgttttggtatgtgtatacactgtgaaatgatcaccacaatccagccaataatatagctgttacctcacatagttaccgttttcttttttctatgctctctttttattttttggtgtggtaagaacaattaagatctgtcctcttagcggaagtgaaggtcacaatcaatatagtattgttacttatagtcacactgctgtacggtagatctccagagtttatttatctttcataactgaaattttgaactctgtcaccaacatttcttcatttctcgcatccccagcccctggcaaccactattatactctgctgctatgagtttaactatttgactattttagattccacaaataggtgagatcatgcagtatttgtctttctatgtctgacttatttcacttagcataacgacctcagtgttcatctatgttgttgcaaatgacaaaattcccttttttgagattgaatatatatagacggattcgcagctgaattctaccagaggtacaaggaggagctggtaccattccttctgaaactattccaatcaatagaaaaagatggaatcctccctaactcattttatgaggccagcatcatcctgataccaaagcctggcagagacacaacaacaaaaaaagagaattttggaccaatatccctgatgaacatcaatgcaaaaatcctcaataaaatactggcaaaccgaatccagcagcacatcaaaaagcttatccaccatgatcaagtgggcttcatccctgggatgcaaggctggttcaacatatgcaaatcaataaacataatccagcataaaaagagaaccaaacacaaaaaccacatgattatctcaatagatgcagaaaaggcctttgacaaaatccaacagctcttcatgctaaaaactctcaataaattaggtattgatgggacgtatttcaaaataataagagctatttatgtcaaacccacagccaatatcagactgaatggacaaaaactggaagcattccctttgaaaactggcacaagacagggatgccctctctcaccactcctattcaacatagtgttggaagttctggccagggcaataaggcaggagaaagaaataaagggtattcaattaggaaaagaggaagtcaaattgtccctgtttgcagatgacatgattgtatatctagaaaaccacatcatctcagcccaaaatctccttaagctgataagcaacttcagcaaagtctcaggatacaaaatcaatgtgcaaaaatcacaagcattcttacacaccaataacagacaaacagagagccaaatcatgaatgaactcccattcacaattgcttcaaagagaataaaatacctaggaatccaacttacaagggatgtgaaggacctcttcaaggagaactacaaaccactgtgcaatgaaataaaagaggacacaaacaaatggaagagcattccatgctcatggataggaagaatcaatattgtggaaatggccatacggcccaaggtaatttatagattcaatgccatccccatcaaactaccaatgactttcttcacagaattggaaaaaactactttaaagttcatatggaaccaaaaaagagcccacattgccaagacagtcctaagccaaaagaacaaagttggaggcatcatgctacctgacttcaaactatactacaaggctacagtaaccaaaatagcatggtactggtacaaaaacagagatatagatcaatggaacaggacagagctctcagaaataataccacacatctacaaccatctgatctttgacaaacctgacaagaacaagaaatagggaaaggattccctatttgataaatggtgctgggaaaactggctagccatatatagaaagctgaaactggatcccttccttacaccttatacaaaaattaattcaagatggattaaagacttaaatgttaagcctaaacccataaaaactctagaagagaacctaggcaataccatttaggacataggcatgggcaaagacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaattgactcatctgacaaagggctaatatccagaatctacaatgaactcaaacaaatttacaagaaaaaaacaaacaaccccatcaaaaagtgggcaaaggatatgaacagacacttctcaaaagaagacatttatgcacccagcagacacatgaaaaaacgctcatcatcactggccatcagagaaatgcaaatcaaaaccacaatgagataccatctcacaccaattagaatggtgatcattaaaaagtcaggaagcaacaagtgctggagaggatgtggagaaataggaacacttttacactgttggtgggaccgtaaactagttcaaccattgtggaagacagtgtggcgattcctcaaggatctagaactagaaataccatttgacccagccatctcattactgggtatatacccaaaggattatagatcatgctgctataaagacacatgcacatgtatgtttattgcggcactattcacagtagcaaagacttggaaccaacccagatgtccatcagtgatagactggattaagaaaatgtggcacatatacaccatggaatactatgcagccataaaaaatgatgagttcatgtcctttgtaggcacatggatgaagctggaaaccatcattctcagcaaactatcacaaggacaaaaaaccaaacaccacatgttctcactcataggtgggaattgaacaatgaaaacacttggacacagggtggggaacatcacacaccagggcctgtcgtgaggtggcaggagcagggagggatagcattaggagatatacctaatgtaaatgatgagttaatgggtgcagcacaccaacatggcacatgtatacatatgtaacaaacctgcatgttgtgcacatgtaccctagaacttaaagtataataaaaatatataaattatatatatattcaataaatatatatatgcatgctatggatagtttggctgtgtcctcacccaaatctcatcttgaattgtagttcccataatccccgcatgtcgtgggagggacctggtgggaggtaattgaatcatgtgggtggtttccccatgctattctcgtgatagtgagtaagttctcatgagagctgatcattttataaggggattccccctttacttggctatcattcttctctctcctgctaccatgtgaagaaggatgtgtttgcttccccttccaccatgattgtaagtttcctgaggcctccctagccatgctgacctgtgagtcaaacctctttcctgtgtaaattgtccagtctcgtgtatgtctttattgggcagcatgagaacggactagagcaatgcacatacatgtactctacattttctttttctgttcatgcattgatggacattcgggtagtttccatatcttggctattgtgaataatgctgcaattattatggatatatttaaatattcatacttccatatttaaatataaatataaatatgaaagtacagatatctcgttaaaatactgatttaatttcatttggatttatacataaaagtaagattgttggatcacatggtagttctatttttaattttttgagggacctccatactttttccataatagctgcatgaatttacactccaaaaaacagcaaatgttctcttattttatattcttgccgacaattgttatttttaactcctttggtaatagccatcttaaatgtgtcaggtgatatcttatttttgttttaatttgcatttccttgataattagctattttgtacacctttatatatacatattagccatttgtacgtcttcttttgagaaatgtgtattcaggttctttactcatttttttactgtttattttaactgcagcggtacatgtgcaagatgtgcaggtttgttacatagataaacatatgtcatgggggttggttgtacaggttattttatcacccaggtattaagcctagtatccattagttatttttcctgcttctctccctcttcccctcccacaccctcccctaatccccagtgtgtgttgttcccctctatatgtccgtatgttcttatcatttagttcccacttacaagtgagaacatgcagtgtttggttttctgttcctgcattagtttgctaaggataatgccttccaggcccatccatgtccttgaaaaggacatgattttgttcttctttacagctgcatagtattttattgtgtttatgtaccacattttatgtatccagtctatcattgatgggcatttaggttgattccatgtctttgctattatgaacagtgctgtaatgaaagcaagacatacatgtggccaacaatcatatgaaaaaaaagctcaacatcactgatcattacagaaatccaaatggaaaccacagtaagataccatctcacaccagtcagaatagggtattaataaaaagtcaaaaaattacagatactggtgaggctgtgggcttttacaccattagtggaagtgtaaattagttcaaccattgtggaagacagtatggcaattcctcagagagctaaagacagaactaccattcaacctagcaatcccattactgggtatatacccaaaggaacgcaaatcattctcttataaagacacatgcatgcataagttattgcagcacctttgctcatttttaatgaggtataaggattttttttttgctattgagttatataagttcctcatgtattttggatattagacccttatcaaatatatggtttgcaaatatttttctcctattccattggttgcattttcactccgctgactgtttcctttgttacctgaagcattttaatttgacgcagtctcacttgtctaattttgcttttgtcacctgtgctttcggtgtcatatccaaaaacatcattgcccaaaccaatgtcaagttttttccttgtatattcttctggtatttttacggcttcatatcttttttttccccttctatctaactaaaattttgtatcctttgactaacattttccaaccttcctgttcccctctccactagcccctcgtaaccatcattctactttctactgctatgagttcaactcttttagatttcacatataagtaaaatcatgcagtgtttgtctttctgtgcctggtttatttaactwagcttaacatcctctagattcctccaggttgttgccaatgacaggatttccttctttttgaaggcttaatagtatttcattgtgtatagatttcacattttttaaaattcattcatctgttaatggaaacagattgactccatgccttggctattgtgaatagtacagcaataaatataaaagaacagatatctctttgacatagtcatttcattttccttggatatatacacagcagtgggatttctggatccagtttctggttttccatttaagtctttaatccattttcagttgtttttgtgtatggtgtgcaataggatcaaatattgctcttctgcatacatgtggatatctgttttcccagcaccatttattgaggggaccatcctttcttcaatrtaagttctcagcacattagtcaaaaatgagttcgctgtggatgtatacatttatttctgcattgtctagtytgttccattgatctatatgtctgtttttatgccagcatcatactattttgactactgtggctttgcaatatatattgaaatcaagaaatatgatgcccccagctttgttcttctggttcaagattactttgattattcagagcattttgcgattctgtattaattttaggatttttttatatttatttaagaatattattggggccaggttgagacagcggaggtggcttgaggctaggagttagaaaccactgtgggcaacatagtgaaagcccatctccacaaaaaagaataataataaacaaaatgtctttgggatttttatagaaactttaaagtcgtctaccaaacagtgatatactcctgtctaaatagtttattgtttgtcacgagtcccacttctaagaagaatcctcattgattacttttttaaaaattaaggagtgggggacataaaaaaatgaataggctattcttcctacctccaaaatcccatatagaatctcctggaattatgtagaaatctctagatctcagtttttatatttgctttaggaaccagttacacatgctttttaggatagaaataattcctggactatgtataatttagacatgctatagtttataaaaacaaatttagcctgacctttagtgtccttaatcaaccaggtactggagctccctattcagtcttatcttctgcacttaccctctgctcagtcaggccaataaactctattcttattgcaaagactcctgaaatctacaatctctaattttgtttctgtgggtctttctacttgcagaatcaccttcatttcttcaaatccacattctatcgattttttaacattcagctcgtgacttccaggaaaccttcatatcacatacactcttcaattttcatagctcttatcttcctggatagacttgtaatttttaatttaacattatagctatgggttccacttcttatgtacattactaagatgttatctataaatattgccatttttattgaattcatcattatgaatgtttgtcacagctttgaaatagtcatcatgacagtaaatttattaaatttgcttttctaaacataagaacagtgagaaacattcttcagtttcctataagtgtttgctgaatttaattgaatataattacaatccccagttatgcatactatggtatggtttttatatgtgatgcatggccaataaatatgtgtagactgaagaagtgttaacactcatcatgaatatccaactgaaaaccagatattgtactagtttttccatatatgcatcttatttcatccaactgaggaaaagaaaaaccctatgaagattagaatccttttatatgtaaagaaattgtgattagaagacatattgtaacaaactgttgtttacattcatgtctatgttctttgtacagcaagtacattagctgaaatcataagtgaaagactgacaaaataaatgtctcagtgaatttctaaagactacactcctaagtcctttgctctaatgtgctttttagggtgaccctaagaatgactcctggatctttgccctggctgtgctcctgtgcagcacctttgtctacaacagcatgagcaccatcaaccaccaggccctggagcagctgcagtatccttccaggaacagaacagaaccaccaggtttcattgactttataggaatggagatcaagtcatttcctccttccctttgatgtaattacctgtggtgcagcacagggaacccaagacaaaagagagtgtttataatatttttataaaagaaatgtgtgaattgtgggcagacagttgcttttccttacctaagtcctagttatgtgacggagctcacagaactaattaaggcaaagtcctccccaaggcctgatggagyagaagattccacagagtttgtgagtttcttcccagactttctttggacagtacgggatttcactctggagctgaagttgaacggtcaccctatcacagaagatgaatacctggagaatgccttgaagctgattcaaggtatcagaatgtggcctgggctgtgggtggtccactgggtgtgtgatctgctaaacactgcccatcatctctggggtttcatttgtatttgagactagattgaggtctgtagaaacrgggactgaggggtatgttgaagagctctaggaatggagcctagttcacttaagaaaagtagagtctaaagtgcagataaattattcaagacagatttgttctttgtacaattagtacctcagcattcagattacaatgggtgctaagactttctaataacaagatgcttgtgatctgtgttttgccctctgcttttctgtgtttagaaaatgattgaccagataattgttagacatgaaattacaatgaaaagcctatctaataaaaatataaatgtgtgtgttagtccattttgcattgctataaaggaatgcctgagcctgggtaatttataaagaaaagaagtttatttggctcatagttctgcaggctgtacaagcatggcaccagcatctgcttctagtcaggaccccaggaagcttttattaatggtggaaggtgaagggggcagctggtgtgtcamatggtgagaaagggaacaacagaggggggtggtctcagacttttaacaaccagatcttgtgtgaactcattaccacaaggatggtaacaaggtattcatgagaaatctgcccctgtgacccaaacacctcccactaggcccacctccaacattgggggggggtcatatttcaacatgagatttggaggggacacacatccaaaatacatcaacatgttacacagatattattcttctcatggagggatataacttttcaatatccatatagttatatcatctacaaaaatgattttgttttctaaagcaacctgaagaagcacgtctttacaatctgtgccttttcaaaatttctgataattgtcggaatrttcattttactttctatgttatgatttttctcttaaacccaacatatgtatccatgctagaatttcataataattgttttaatgggttacatttatctgagtgtgtatctgataaaaccttatgagaaatatcaattccagtgaactcrttgttgctttcatttttctatttatgctttcttgaaacatttcttaaaaattcataggcagaagagcaatactgtcaaatcgaatacagtcttttaagagtttataaagaagtgatgattatcttaaaactaccttcttggctgggcaaggtgacttgcacctgtagtgtcagcactttggaaggaagaggtgaaaggattatttgagctcaggagtttgagaccagactgggcaacatagtgagaccctgtctctataaaaactagaacaaatcagctggtgtcatggtgcacacctgtagtctcaactactaaagaggctaaggtggaaggatcacttgagcctaggaaatcaaggatgcagtaagccgtgattgtgccactgccctctagcctgggcaatagagcaagacctcgtttcgaaaaaacaaaacaatacaagattatattcttgttacatttagtcttcagaggattttactaaaaaatagctaacattatacaaattcttttagcatcaatgtgcacagaagtatttaatttttatgttaaaggaggtctgtaagcatagaagatggcaaaaagacaatacaccctatcaaaaatacctttagctcccttataccaagactgttttcactatattctctgtttttttwatccctcaggcaataatcccagagttcaaacatccaattttcccagggagtgcatcaggcgtttctttccaaaacggaagtgtttcgtctttgaccggccaacaaatgacaaagaccttctagccaatattgagaaggtgtcagaaaagcaactggatcccaaattccaggaacaaacaaacattttctgttcttacatcttcactcatgcaagaaycaagaccctcagggagggaatcacagtcactgggaatcgtgagtctcctttttacttttctgtggggcctcatgtgtgttgaatatattgtataatgtgtttctcagaatttttgttagattccatatagaaaaactacgtgtatacaggtattcacactcagtgaagaaatgtgtataattatcacacttattgcaatttacaaattcctctccaatattgcaaactctgtcactgatatctgtggcttccacatatctgaaaaaaatcccccactgataaaataactaactgaatataaaaacatctataatattttcttaggggaaatattttctaagtcctatgtgttcagtattctttgccaagagaatagaaaagatatgttcaagtttaaaaacctctagaaggctgagggtggtggttcacacctgtaatcccagtactttgggaggcagaggcacgcagatcgcttgagctcaggagtttgagaccagcctgaacaacatggtgaaaccccatctctacaaaaaatacaaaaactagctagtcatggtggcacatacttgtattcccagctacttaggaggctgaggcaggagaatcacttgagtctgggaggcggaggttgtagtgagccgagatcacaccactgcactccagcctgggcctcaaaaaaaaaaaaaaaaaaaaaagtctagaaataaataaatattagcccataattccctgaaaatacattggtagcttcagaattaggaataaatgtgatatgatttaccctgcctcattttatctgtgtaaactacttttcttgtaattttttaaatgagaaattgtacttcctgcataccctctagtatgttagatacaagtagatatttaaattttttagcactgtggactggagatccataaaattgaagagtcattatgaaaataagagtgataatagcagaaggaggtagggatgtgggtgtatgtgtttgcatgtgtgcacrcgcgtgtatgtaagtgcatgtgtgtgctcagaaatgtagcctaggatcccactgagctttaatttcatatttagcccctaaatctcctggttcatttaggtctgggaactctggcagtgacttatgtagaggccatcaacagtggagcagtgccttgtctggagaatgcagtgataactctggcccagcgtgagaactcagcggccgtgcagagggcakctgactactacagccagcagatggcccagcgagtgaagytccccacagacacgctccaggagctgctggacrtgcatgcggcctgtgagagggaagccattgcaatcttcatggagcactccttyaaggatgaaaatcaggaattccagaagaagttcatggtaatttgccttagtcattactgttcatcatccttccccttgaagaatgaagcctatagttgcctttattgtcaccaatgctcatctgtcactgaggaataacttattgtggattctcatgagggatagagtttcaaaagactacatataagcacttaactagaaaatcttctgataactgaggtaaaatcaatacagatcacttaagatcctcaagtgaacacttctaaggattccaggcctgctctgaacacgcacaagtcatccctgagcagtgcactttttctgtgcatagtttacctttcccaggaaacaaagattctcttaccagatcgtaattccgggccattgttcaacttacattgctccttcttgtatccttgtaccattgaggacaggaacacaggatgataccattgcaacaaaccatagagattatggaatgtagtctcatcatgtcacagataaggaacctgaagctcaggaagattaatgaacttttccatagccttgaagagaatttctagcattgtaaatgtatgaagttttgtgtttctgattccacatctactccactagaatgtttttctcatgaggaccacagttagattgactctaccaccagattctttagaatttcatctcctccatgtttcttctggtgacatctctctacatttcccttgcaggaaaccacaatgaataagaagggggatttcttgctgcagaatgaagagtcatctgttcaatactgccaggctaaactcaatgagctctcaaagggactaatggaaagtatctcagcaggaagtttctctgttcctggagggcacaagctctacatggaaacaaaggaaaggattgaacaggactattggcaagttcccaggaaaggagtaaaggtaaggaataaggggagcatggggaagtttataggatagagtgaatggagtcttcagcaccagccgtgggtaataagagagcagagggatagcataacgccttagctttcaatgtccactacttaatatttatttcttagaataaaaatttttattccaaaacaaagagtatagtattcagaaatccaggagagacagaatgaaaattaccacctaggtggtggtaataaacataatagtagtaataatacaactaactcacgagctgttattacctacagtatactgttaaattcttccccagacattttaatttcatcttcctaatgactttaagaagcacctttattttggaaattttacagatctgaacttagtacccaaggatgattacataacttgcctaaagttctagccagcaagtggcaggagaaagcaacagcatagattagaggcagcattgcacactggaagacagacatgtataagcatcagagattgggagtttgtacacctgtgcacatagttctgcctggccggaacccaaaacgggtacagggagatattacagcagtgggaaaggcactggagggagacaggaagcaggaattgaggaggggctctggtcaccctaaagagcccgcacactttgtagggggccactttagaattttaggcataaagcaaaagttacaagaccataattgttcttgcaacactaatacccagaacatagattttcaaagaaatctaagtgctttttcttscttccataggcaaaagaggtcttccagaggttcctggagtcacagatggtgatagaggaatccatcytgcagtcagataaagccctcactgatagagagaaggcagtagcaggtatggggcagggctcagcttacacaggaggggtacrtttatacaatgccctctaacagatctaacaggaaaaccttcccaaaatgaggaatttcctcttctgtggaacacacactctgctaaatctkaaaataacaaggggagctatgattgtacatcagccagacaggcagagcctttcccatcacattctcaaatgcgctcttaatggtgtggacctgggtgaattctgtgatttctcaccctgcctttcagatttgrtttagtctcagctcagaaaagtggagatgaatcttcacctattattttcttctctttctaataccttcatggagcagtggatcgggccaagaaggaggcagctgagaaggaacaggaacttttaaaacagaaattacaggagcagcagcaacagatggaggctcaagwtaagagtcgcaaggaaaacatagcccaactgaaggagaagctgcagatggagagagaacacctactgagagagcagattatgatgttggagcacacgcagaaggtaagtctgcccttggcctcagcaggccagacggtcctcacccaggtacctcaggaagggctggtgaaggttacagcaacatcatgaaaggaagcacatcaccatttgctgcttggcaatcactaaaagccctgaatcctttttttcttaattgtttcagtaagacttggaattcttctctatattctctatacttagattctggagaggtaaggttgactatgatccctacaagtccttggggaatataaatagggtcgaagctgctgwtttgggagattttaaaagtaatctcaagaagttaaacatatgttccacacagtgtatttgatgtgaacagcagctggtttccttcaccaagaccacatattaccaggagctctagtaccatccaaacaccctgaggtagatccatgctgacatacaactcttagaaatttccagacttaaaaggacaggaaagggacagtttctaaacttgctgcagttgtcaccctgtatargtagcctgcccaaattagcacacagtgtagggagaattcttgcattgtccatctgaaagttctctcataagggatttctacatcagcttataagtttttggtattcctacaatatgggtgaccatgctgcccaactgggactgagaatttatgcaatcagaccaatggctacctcctaactggcatcttttgggcaggaacatgtagaatttgtcctcatacctaggttagcaccatagcaaaaccataatggtgggtggatattagtaaagttataaactatgcttcctcacaatgtctaggtccaaattctcctctaataactgagaaaatgtttttaggagtaaaataaagtttcacacaggttttaaatacaaaatgtaagtcttaaaagaatagggatttttaaaaatttactttccttcctacattgtctttaggtccaaaatgattggcttcatgaaggatttaagaagaagtatgaggagatgaatgcagagataagtcaatttaaacgtatgattgatactacaaaaaatgatgatactccctggattgcacgaaccttggacaaccttgccgatgagctaactgcaatattgtctgctcctgctaaattaattggtcatggtgtcaaaggtgtgagctcactctttaaaaagcataagctccccttttaaggatattatagattgtacatatatgctttggactatttttgatctgtatgtttttcattttcattcagcaagtttttttttttttttcagagtcttactctgttgcccaggctggagtacagtggtgcaatctcagctcactgcaacctctgcctcctgggttcaagagattcacctgcctcagccccctagtagctgggattataggtgtacaccaccacacccagctaatttttgtatttttagtagagatggggtttcactatgttggccaggctggtctcgaactcttgacctcaaatgatccacccgcctcggcctcccaaagtgctgggtttacaggcatgagccaccatgcccagccctcatttagcaaagttttaaacataaaaagtgcttattagaggatatcagtgcctggcccacatgagagaacagatccatacacactttgaaaaactttgttcacttttaggaaatataattttgaaaaatcatttacatacaagaggtccactgaggcattgcttttaatggcaaaatattgcaatgtacttgaatgtccttcacattagattggtaagataaattttagtatgtgcatgtactggaatattatatagccagtaaacaaattgacaatgaagctctatttgtaccagtaaagaatggtcttgaagagacattgtaaaatgaaaaaaaaaaaaaccaagttgtaaagcaatgtagattatcttatcagcatggaaaaaatgcaattattatatggaagcatgcaaatatatctctggaaagattaatcaaaatctattattattggctccttctgggaagaaccaagtgaatgtaggggttgaaggaacacatactcttcactttatactcttgaattttgtaaagaaatcttattttaccgattcagaaataaataagaaaatgtaagagacaatgctaataatgataacaataaaaaaatagtgaaattggctatcagatgatgaaattccttgttgcttctaggaattacatcagccagcccaatgaggggtctaagactaagatctgagtactagaatgcaaaaaatttgcatcatattcttgttttcattttggcctggtttttcgatcccttctatttgttttgagactaaggcatacacttttctgtggcctttgaaatctcagctacagtagcctctacttcctttctctgaattcaagttttaaggtgttagaagcataaattaccaaacattaagattaagcactgataggaaggatcctgccaaccttgtcagtagtggtctttttgcggtagcctcagatagaaaggacaatgtgcctttccagaactgaaccccctgatgggggatgatagacccggacacatagaggcctggtgttgacccttaattgttagaatctaagaagattcagttatagtaatgagtggcagactgcaaggcctgatggagataattctgaagatggccaatacaatggaccagccatagggttaaatgggacggggagaaaacaatcaagtgaagtaaatgctgtctatcaggatgttgagaggtagccctgataaagtgtcacatccatagccttgatctgagctaatttcagaccctgaactcagttggagtggagggcagtaccccaggaaaggacactgcaactccaggacccaaataaatgataatgatttcccaagttctcctcctaggaaacgtctggagccatttactagatatccatatactagggaaatacaaacacccaaatatttcaaggacccttggaatcaggatccaagttgcccatggtacctagatcatggagagtcatcgtaaaatgcctgttaaaatagggaattagggcctccaggttgtaattatagtcttggcacacatgaacttattgcaatatagtatttgtttgaaatgtaaaggtaaagtttgtttgaagacagataccttatttttctgtacatctccttgggagtatgttcaggcataggttgtgctaaataagcttcttttataaaaacaataggctgatgcatgggtgattattttcaattgataaaatatcatgaactttccagagatcagtggtaataagttgtttgaattttcgacaccagattaaggtctctgaggtggtttaaaggctatgaggccaggtgcagtggctcacgcctataatctcagcaacttgggaggccgaagcaggcagatcacttgaggtcagaagtttgagaccagcctggccaacatggcaaaaccctgcctttactaaaaatacaaaaattaaccaagtgtggtggcacacgcctgtcatgccagctacacaggaggatgaggcaggaaaatcacttgaacctgggaggtggaggttgcagtgagccgagattgtgccattgcactccagcccgggcaacagagcctgggcgacagagtgaggctctgtctcaaaaaattaaactaaattaaagctatgagaagaaaataaattttcctggtatagtgtccttctctagacctcatgtcctacagtctctgtgaaactgggccaaagatagaatttttttttctgtgctttatacagtgactcagacaaacctatgacctcacacaaatctgtaacttcatgtatcacagtctctataaaactatatcaaagaaagaatttttctctgtgctttatagagtggttcacccagatctgtaaagaaatgaagacaattttagagctttcaatatcctgtattgcatatcaggtcaaatctgatactttcaaaactggatagatctatttcagatatctttgatgcttttaacaagaatcccattcaatgttatctaaggactatagttcaagaagactaagacactattcagtcggggcacaataagaccaccttataagcaccactcatccttccttttctgagcatgcttttgccatgtttcaatgattcagagacattctagtgaatcccattttgacaacaaagtgggatcaagagaccccaaggccatcctcaggttcaatgactctttagaagacatggaactcagaaaaaaatttttttgggggggttttcttcttttttttttattttatttatttttcttttattattatactttaagttttagggtacatgtgcacattgtgcaggttagttacatatgtatacatgtgccatgctcgtgcgctgcacccactaactcgtcatctagcattcggtatatctcccagtgctatccctcccccctccccccaccccacaacagtccccagagtgtgatgttccccttcctgtgtccatgtgttctcattgttcagttcccacctatgagtgagaatatgcagtgtttggttttttgttcttgcaacagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatacgtgtgcatgtgtctttatagcagcatgatttataatcctctgggtatatacccagtaatgggatggctgggtcaaatggtatttctagttccagatccctgaggaatcgccacactgacttccacaatggttgaactagtttacagtcccaccaatagtgtaaaagtgttcctatttctccacatcctctccagcacctgttgtttcctgactttttaatgattgccattctaactggtgtgagatggtatctcattgtgattttgatttgcatttctctgatggccggtgatggtgcgcattttttcatgtgttttgtggctgcataaatgtcttcttttgagaagtgtctgttcatgtcctttgcccactttttgatggggttgtttttttcttgtaaatttgtttgagtttattgtagattctggatattagccctttgtcagatgagtaggttgcgaaagttttctcccattttgtaggttgcctgttcactctgatggtagtttcttttgctgtacagaagctctttaattagatcccatttgtcaattttgtcttttgttgccattgcttttggtgttttagacatgaagtccttgcccacgcctatgtcctgaatggtattgcctaggttttcttctagggtttttatggttttaggtctaacgtttaagtctttaagccatcttgaattgatttttgtataaggtgtaaggaagggatccagtttcagctttctacatatggctagccagttttcccagcaccatttattaaatagggaatcctttccccattgcttgtttttctctggtttgtcaaagatcagatagttgtagatatgcagcgttacttcagagggctctgttctgttccattgatctatatctctgttttggtaccagtaccatgctattttggttactgtagccttgtagtatagtttgaagtcaggtagtgtgatgcctccagctttgttcttttggcttaggattgacctggtgatgcgggctcttttttggttccatatgaactttaaagtagttttttccaattctgtaaagaaaggcattggtagcttgatggggatggcttgaactcagaaaaattttatgctcacagttagagcttattatatcgaacagtacaaattgaaaccaacaaaagcaaaagggacatggaccagagtctgagacccaggataggcttgcatttgtgttttctcccttgagagttgcacagacattatctaattctctcacaaataatgtgtgacatgtgtcaaccagggatggtcacacaaactttagtgtttttattagagggaagtcatgtaggaatggggtgctcatgtggctgatattatttacttagactcctgtcccttcagagctcaaactggtatggtatcacttaagacttccaccacaaatcacatttttagcataaagtacctggtgtcgaccaagccctcaacatgtccaaagcattattataaggctagttgttctaagggcttacctgttatgtcccaggaacaagttgagggccagacctttcttacagaattaaccttttattagatagtgttaaagaatgaagaaggtgataacatgagaaagacaaaataaagatttttattgtcttactggaagaatatgtctatttttttcttgactttttaaagtatcaatattctttctctgaaagacgtaactgtctaggctctagtaaaatatgctgcaagtacatgtttttaaaagtagtttattttatttcttgttattctgtgcttagcaacttccaatctgattacagctgacccttgaacagtgcgggtttgaactatgagttcacttaacatggacttttttcaactaaacacagtatgaaaatacactatttgaggaatgtgaaacccacatatatggagggccatcttttggtatatatgaattctgcagggccactgctggacttgagcatgcaaggattttgtatggattatccacagtggtcctagaaccaattctctatgtatactgagggatgactgtagttatttttcttgatataaaaaagaaaaagtatttaataacgaatatatgtatatgagccttaagaagttatcacagtgattgtaatctggatatggtacaaattttatggtactaatgggcctacaatcacttgatccaacattgggcctaaatttccttaatgtgctcaaactcaagctgctggagtttctcaaggaatagtaacccatgaaaataaattatcaatcacctttcaacaaccagaaatcaccactgaaacaggctttgatcaagtcttaaataaaaattgacatcaaatttttaggttgattcccacctcctgctgaattttctaccaccaaggtcatgctctgtcacctcgaatcagtttaa

SEQ ID NO: 12332 - DNA, 78996 bp, Homo sapiens
gaaaaatgaagacattcattatctcttgaaaaatgtccttcacaatctgtatttttaaaaatcttatcttttgccatttgaaatattaatatttgcatatcaaatattcatataaattaattcagactgatatcctttatagaagattccaaaaatgaattctaaggaaaaagtccaatttatcacatatatcaatccttttcacacatagcctcatgaataaccacttgacactgaaacatgaattcagaaactattattattttggcacaggaacaaacttcagaatcacagcatgcagatatctattaacttttattcaagtaaaagttttaaacacctgaataacttatggatacaaacggacatcggtttcatattgcttccatatgtaggaactagtcatttcagcaaattacaaatagatcaggatttaataaactgaatctgcagtcaagaagaacctatgatttagactgcataaatgaactaaaatgacatttgcaatattgttcagcattaatttgggttgatatggaattgtcaattattttccagttacaaataactgtacattcttatagaagattatttacaactgacttactctattagagctctgttaactgagagactagtctctagttagagactagtttaggacattctagtcctaaactggagacatcctcaatattcctcaatatagattattccaccattacttgacaccaccagacaggaagatgaggatacatagatatagagctgttttgtttttaacaataacatgatacatgcttttattgtatgccaaataggtgcctgctaaggctttgtctatatgttgttaatgaattacttttcaatatttctcactttgataattggtttctatataagccatgtaactaataactgttaaatgttaatgccactatatcacccacttcaccatccagtattttcattataaactccatacatcttttttattataaatttcacatacataccattgattatttgttgcagtcatcaaagattgctatcctatagtaaatacatttctttaaatcattgcaattggaatgcaaatgaaggataaatatgattgtacttgagaatagtaaaattcatagagacagaatagtggttttcaggggtaggagggaggagggaatggggagttactgtttcatgggtacagagtttcagtttgcgaagatgaaaatgttctggagatggatggtacaatggttgcacaacaatgtgaatgtacttagtgccactgaatgtacacttaaaaatcattaaaatggtaaatttcattacgtatgtcttgccacaatgaaaacaaaatgcttttgtttgttcactgctgttatgataaagatctcaacacctgacatcccctacaaggcccaatatgatcagacctaccattccaccccgaggtttttatactccagttacactaactgtcttttttcaagttattgatgacactagattccttcttactttaaacttcccttaacgttctttctggaatgaaatgctcctcctctcttttcacctggccaggtactattactcattgttttatccctcagcttacatagcactttctccaggatattgtccatgactctctccaatgatagatccttctatttacaatctaacagcacctatacttctttgttgcacttatcacaattatgatttattattcagtatctgtctcctgcaacatattgcaagatctgtgagaccagagactattttgctttttttttttttttgagacggagtctcgctctgttgcccaggctggagtgcagtggtgcgatcctggctcactgcaagctccgcctcccgggttcacgccatcctcctgcctcagcctcctgagtagctgggactacaggcacctgccacgacacctggctaattttttgtatttttagtagagatgggtttttaccctgttagccaggatgatctcgatctcctgacctcatgatccgcccaccttggcctcccaaagtgctaggattataggcgtgagccaccgcgcccggccgagactattttgtcttattcatcaaacacctttcaaagagctgtcatttagtacaagttcaaaacatatttatagagttaatgaatcaatacacgaacgaatacatctaaatggtaaagaataattcattaatgaaataatgagggccgggtgtggcggctcatgtctgtaattgcagcactttgggaggccgaggaaggcagatcacttgaggtcaggagttccagaccagcatggccaacatggcgaaacgccatctctactaaaaatacaaaaattagctgggcatagtggcatgtgcctgtaattccaactacttgggaggctgagacacgagcattgcttgaaccccagaggtggaggtggaagtgagccaagatcgtgccactgcactccagcctgggtgatggagtgagactgtctccaaaaaaaaaaaaaaaaaaaaaaaagtaaggattaccacttaaaaggtatttcaaagaaaaggaaaatacataatatgtacttatcattttaaaaataatacaaattccctatagaaaacctggaaaatccagataaaatataaagaaaataaacattgccctatcttgcaactcagtggtaatcattgttgcatatcttggtatatttccaatggcttctttcccgatttcagtgctacccacaggggaataagactccttctcttgcttttcataaatactacaacttggaaatctctgcaagtcaatttttgaacgtgggtagaacctgtgaatacgatgatacattactcctatgaacacgttacaaagggagattatccaggtaggtctaatctaagaaatggggacctcaatcctacaactgcaaggaaatagatcctgccagcaatctgaatgcgctgtgttaaaatcagatcaaactttaaaaatttttaaaagtttagcatgcatacaaagaacagtttacaaactggaagacatctaaccaaaagtggcaagaagcccagctcacagcagttacagtacagcttataaacattgaggaagaagtattttgaccttcgttacattctttttaaggcgagtagagctgttaagctgatttgtctatagctgattggtttaatttcattgactcacactgtcaaggacattttgtgttttgtttatgtctagagcaagtgtttcagggaaataaggatgacttaagttttggctacctggctatgggtggttggacttaaaatatctaaactggagcctctatttttatttatctttaacacttgaaagaaattcttcccagagcctccagataagaagccagcttggctcttgacttcaaatcaaggtgttcttcccagaggctccagataagaacgcaccaagcttgggtgggttcttatcttgaggctctgggaagaattcaatgaaattaaaccaactggctatagacaaatcagtttaaacaggtatgcttgccttaaaaagaatttaatgaaggtcaaaatactttctccttgatgtttataagctgttatatatccgtgattaccaggattgaacctggccaaaccttttgatctatagaattgggacttcttatctatagaattgtgacatcataaatgggtgttgttttcagctgttgagtttgtggtaatttgtcatacagcagtagaaaagtacgggttgagtatcccaaatccaaaaatcccaaacccaaaatgctccaaaatccaaaactttttgagtgccaacatgacactcaaaggaagtgctcattggaacattctgaatttgggatttttggatttgggatgcacaaccattgtaatgcaaacattccaaaatccggaacaatctaaaatctgaaacatttctggtaccaaacatttcggataagggatactcaatctgtaatacaaggggattgcataaaggcatgattatcaggaggcaaggaacatggggatcatgttaggtctgtataaggggccacagtaaccctgtccagaacagcagaactgccagttaactcatagaatcatgaactataatcatgaatgggggttgtcttaagccactcagatttagactggtgtgttatgcagttaaagctaattgttacaacttctggggtgagagaagtatagatcaattcctcttaaatgaaaagctccatcatatttccaaagatactgaagaatatagaaagggcatgagatctgaatttgggcccgtgactttacaagttatcatttattgatgacttacttattagcactgtggtaggagctgtatattcactatctaaaccatacaactctaaggtaggtattttgaaggctcagtgaatctatgctatattttcattttgtggagttagataaccttgattacattcaccatccaatcctcaattctctcgtctataaaatgggcttgattatattatttaattcacaagattacactgctctgtaaactcctgtgcaaatattagaactcattactagcagtccagggttccgttttcacataatatttgccaccgaaactcatctatagtgactacatcaacacactgtatctacatagcatgtactatatgagcatgtatatcaacacttggtttgtgagagtctgcactcttatgggtctgttcgcctccctgcttgatcaagacataccaattaactaccaaaagaatataattcacaggtgaatgatatgctctggttttggaattggggaaggggagctaatatttttgaaggcctctatgtttcaggcaccaggctagatgatttacttctaacagctgattatgattgaatttgtttggactgggtcatttagaaaccacctcaagtaattctactgtgagcatgggtcacagtaggattctactgtgtatccatgactgagaatttctgacatacaaaaccccattaaatcttgcaaaaatattccaaagtaggtgatatgtttattttacagtaaggaaattgatgcccacggacattaactaactttcccaagagcacacatcttgtaaagccaagttttttgccactttaccaaaatgacaggtttcttgaacagaggagacaaccactctcatcaaattaagggagatactaaaccgaaaagcaagaaagactgaagattcctacttaataatcaaatccccttggttgaccttgctatcccccgtgaaacttttccagccatgtcagtccttgtttgttgatctcctcactttatttctattacatgagtaactggctaattttgatggtgttcatacttatccttaccatatatttgctcctacatttgtcaagtcctgcttgtacatttcctagttgccaacctggtgtcacagcgggcaaatcatgggaagagccctggttttggagccagaccacctgaattggcctcccgcatggacttagctgtgtggcaatgagacaaggcattttattctttgaatttcagttttgtaagcataaaaaggggaaaaataaaacccagagtttagtaaggtttagaaacgctacactcagcaagtcatagctaagtcaccgtcaccaatggtagtcaagtgtgtggtgcagcaggaaacatttggagtcgactcctttacggaactcaaatgccctcacatttagggagaaatagaaagaattacgactcatgaaatcgagctggggctggcacttctgaccctcccaacaggtttccagaaagctatttacacacgatgcattcgccaaaccactggaaatcattctaccctgtacttttttccaccctgcctcacgtccttgccctatgaccgggttcctaccccaacctctgccccaacacttagaggaggagttgcgggcctctttttacagtggataggattccgaaggggagagtaaatcagtaaggctccacccatttcacaggaggcctagagaccggcgctcccctttcccctcccgccggacctgccaggaggtgggctggcgcggagggagggccctgtcccctgtccctttaaggaggagggccaaacgccggcctagagtgcggcgtagcccccacccgccgtgccctcaccccagagcagctgcagcctcagccggccgcccctccgccagccaagtccgccgctctgacccccggcagcaagtcgccaccatggtgaagatcgtgacagttaagacccaggcgtaccaggaccagaagccgggcacgagcgggctgcggaagcgggtgaaggtgttccagagcagcgccaactacgcggagaacttcatccagagtatcatctccaccgtggagccggcgcagcggcaggaggccacgctggtggtgggcggggacggccggttctacatgaaggaggccatccagctcatcgctcgcatcgctgccgccaacggggtaagggatgcgcggccccgcgccgctgtgcaccctggcgcgtgtgcgacgtgcggcccgcggcgcyctccctcgctcggggccggccgcttccgcgcgctgccgcctcggtttccacctcccgctcctccctctccttcgcgctcgctcttctggcctggaggcccgacggaggtcgccgggctggggaaagtggccacgggacccggcagacctgctcgcctgactcccggggcgcsgggaggtgcgggcgcggagcctcccaaggtcacgcccgactctccgtctctagccgctgccttccctctccccgtcccccgcccctcycgaggcgtctgacatttgccctaaccttgcagccttggaagatacgattacggcgcagagtgctgtcgccttaagcaggaaaggttagactgccgccgcctcgcccagagccccctcgcatcccgcccgctcctctgctattctcggctaggactggcgcttcccgctggctcggagcccgacactgtggggcaagggtggcgagagcacccatccccctggggcgtcaggttggcagatctcagcaggcgggtgccaatcttttctccccgccccctagtttgccttggttccgaactcctgccctttgcgcggcctgcttgctggggggcaggcgtttgaaacatctagtctctgcccagtggtgcccgggatctgttccaccgacggggctggagctgaattttcattagaatggcaacatacccaaagacgcccttacgcaagcaagcagtcgtggcaggccaggaaattaccgcaacaccttggttccgcccccggccaaggaaagttaactgacttgattgggcgggtccactcggataggggaaattaaaaaaaaaaagtttttcagtaaatctgatatatggaaatgtggggccgggcatggtggctcacgcctgtaatcccagcactttgggaggctgagggtggtggatcacctgaggtcaggagatcgagcccattctggctaacacggtgaaaccacgtctctactaaaaaatmcaaaaaaaaaaaaaaaaaaaaaaaattagccaggcgtggtggcgggcgcctgtagtctcagctactcgggaggctgaggcaggagaatggcgtgaacccgggaggcggagcttgcagtgagctgagatcccgccactgcactctagcctcggcgacagagcgagactccgtctcaaaaaaaaaaaaaaaagaaaaaaaaagtggattgataagttggggctaattattcacttacttttgtaaaacatttctaaggagttctgaggaccaagttttctttctatattttaagtgagatttgacttatgcccaattcttctggaacgcatcccctgaaatggatatttttattcattttaatagtactttatttatcttattttgttgacattgagtactatttgccaagcacyatggtaagcgcttcatttctgggtctcatttatcctcctgcagccctataaggtagatgctattatgggtatcttcaagttgccaacgaggacgctgaagcttaggtaggttaaataatttacaaaaactataatggcagcactaagagtccaatatagatctgccaatcccaagaacttgaacagctcctgagaatgaagaatgaacagcccttgatcttgaagatctgttttccaggctccaaaatctaaactgggctctatctayatctgccttcctgggccaaacatttataagcatcagtgagagaagattgcctggatttgtttactttgtggtcctgaattttcagacaagcgcaaattcccatgaaagaagaacagacaatagctgtatcccagtagatcatttccctgttaccacctgtgctgaatttgcatttcattcattcattcatttattcagtcagtcattcaacagatcctgttgaataccatgttcagagaaatgtgtggactaaaaggatgatgcagacccaagasttgtccttaaggagcttacagcagagtgggaattttaggtgcccagatggaaatttgtccatttgggagtagtgtggggtgggaaggaaagaattagttaagactaaaaraaaaagttcttaaaacttcatcaccctttagccattgccctattgctcttctctcagccaacctttgtaaaagctttctgcattcactatttctcattctcacctccggtttactcgccatttcactgcttctgccccctccactactccagtagaattgctcttgccaaagttactagggacttgccagttgctaaattcatggaatacactctggtctaatcttatttggcctttctgctgcatttggcagtgctgattttgtactcttgtaaagttcttcctcccttggccttgcttactctcctgattctactcacactttttggaagttccttcatgggctgcacattgactatcccctaggtttctttcttctttctttctttcttttttcttcttcttttttttttttttttttttttgagacggagtcttactctgtcgcctaggctggagtgcagtggcgcaatcagctcactgcaacctctgcctcccaggttcaagcaattcgcctgccttagcctcctgagtagctgggatgacaggcatgcaccaccacacctggctaatttttatatttttagtagagatgaggtttcaccatcttggccaggctggtctcgaacttctgatctcaggtgatccaccctcctcggcctcccaaggtgctgggattacaggcgtgagccactgcgcctggcctattccctaggtttctacgctcaggttgttctctgattttgttcactctctctactcactcgggatttaaatatgctactctttctcttgtgatatgattcagtccagatggcatcttcagaaacctttcttgacaccccatccctaccactcttctccacctattaagtgctcctttcccatagataattctagaatatatatattaaattctagtgaaattttccgtttacatgtcaacggcctccaactagagagtaagcttctttaagtcagacctgtgttttacctgtatctgcaatgcctaggactatgtagcattcaatgaattcttgtttatttgctctgaactgtgagtcacttttgtattctagcacttgatttaaagccagcatgtagctggtgaccaataaatttattcacatcaaacatttattatgtgcttgctttgcctcagacattgtacttgagatacaaaatatttttgcccttgggaaagacatagtctgggaggggtggtatacaggagtaagcagacagcacaatgtgtcaggtgttgtgatggagggatgtgcaggtgtctttaacctgaggggctgtacttgggaggggaagatgaagggagggaggctccatagaggggtggtagccgaattgagtcttaaagaatgacttggagttcccagagtgggtttgtctggtaggaggaattcttagcagaatgaatacaaattgagggagtttagattagatacaaatacaaatttctagtccttttttgtttcatccacaaaggttgggaataatacatacctgaagagcctgttgtgaggattagatgaaacaacatatttacaagtacctcacttggaaactgttcgaatgataggtgtgttatcaatgttttgttggtattaggacacaatccaacgtgatgcagatatgagccacccagatggtctcccaccttcctctaatcctcaacagcctcaaccaatatagaggggttccgtgttagtcagagcccaattgggtacaaatgacaaaaaccttacttggattactccaagtgaaaaaggaattttattggcccatgttactgaaaagtccaagagaatcccaacgaattctttagttgaaactattcctggtctctaaaaatcacttctgggtctaatgatctgcaaatgaccagcatcagaaattgaggagagtttaagctcacaaatgaatgtgtgcatgttttgaaggatgatttatcaccaccctaagcaaaataaaataaatacctttgtgggaacttatgagcaaggagggtatttgttgttgttgttgttgtcaagttacagggattcttttgtcacggctcctttgctactcatttgtgcaaactgtggagccccttctcagaatatatatttttaaaaatttgagacatggtcttactctgttgcccagactgcagcacagtagcgcgatcgtggcttactgcagcctcagtctccccaggttcagttgattctcccacctcagcctcctaagtagctggggtctacaggtgcatgccaccatgcctggctaattgttttatattttttgtagagatggggtttcaccaagttgcccaggctgatctcgaactcatgggctcaagcgatctgcctgcctcggccttgcctcccaaagtgctgggattacaagtgtgagccatcgtgcygggcagagtatttttatttttaagtgaataaaacaaaatacaaaccattacaaaggaagcaaaattatattgaagtataatcaaaatattaaaaaaccagatttgtgatatatcaagataatgcttctttactgacataggaagatttgtggaggatttaatactgccttacttcaaagtagtggtgagtataaatgatgttttgagacgtctgcaatctcagtattttgagataactataataggatatgaaaatataatttttattgatgataaattcctaggtagtagtagtaatagtagcagtagtagtaataatactgtggtttgcttcctacatttataataaaaggaggtgctaaatttcagttagatgttagtgaaaataaagattgttttgtttattttgtcattcatattcatggatcccattraattctacccaaggacctcttgaggtaggggaaggggatgtaagcatcccaagttaagaaccccacactaaacaatgatccttttttagcatcaggtgatgcctgcaccaaaatggacctcaaacacatgacccagaggttaagggtctcatgttctcagagcaaactagtgggactttgcaaacttcgccttatagtggaggaactccackgtctcccgcttgaagtgaaccacccttttctgaactttcatgagatccatctgcaaacactgctgaaggaacatgtttctggctatagcagttcacatttcttgaaaaggaaataaaagaacactgagcaggaaggggaaggttttgagactcttgggtagttggagttaggtggagacaccttgctacyttaactttaaaccttatatccctggggcagggatgacttggcagagaaacaccttcaagtcacttttttttttgagacactgtcttgctctgttgccctaggctggagtgcagttgcaggatcttggctcactgtaacctccgcctcctgggttcaagtgattcttctgcctcagcctcctgagtaggtgggactacaggcgtgcaccaccatacccagctaatttttgtatttttagtagaaacgaggtttcaccatgttggccaggatggtctggatctcttgacctcrtcatccgcccgcctcggcctcacaaagtgctgggattacaggcgtgagccaccacacccggcccaagtcactttttaacatgctgtaacccccactttaaaaaaaaaaaaaccactttttaattatggtggggccgggcatggtggcttaccgcacttgagtgggtcacttgagcccaggagttccaaaccagcttggacaacatggtgaaaccccttgtctacaaaaaataaaaaaacttaatctggtgtggtttcgggcgcctgtggtctcggctacttgagacactgaggtaggaggatcacattcaccctgtgaggtcaaggcttcagtgagctgtgattgcaccactgcactccagccttggcgatggcaagaccctgtctcaaaaataaataaataaataaatataaaatgaattatggtgggctttgaacaattgttctccccttgtttacactttctgattttgaatcagcactgaatgccagtatggataacctattgtcctttccatccaggagcatacaatcttttgggggagataagacagaagaaacacatagacatacaaagaacagaattagaaaacatgctgagctcagcgagagagagaacattttggattgggaaagaagaggtgcctgcacctaaaaccaattatgtcttgaagagcggatagtgtgcgatagaagatggggctacccttcaggaaggggacctgccgagagaagtgagaaagagrgaataggcaggactcttttttagagccggacacttagtcactaaacaatctttgttacataaaatacttaaatcagcttgcttgggactttttctttcttggcttcactaatgctcttggtgaaacmtctttttcctttttcttttttaatcaaatctaatgctcatgaaattttgtagaagaaaaagaaaaacgttctccctttctgagatagagggtttgttttgtttttgtaaacaagataacagggaagagtgctcyactgttttggaaagagtgactcattcaataaatatttattgagcacctattaggttctcggtactacggatacaacagtgaattgaacaaagtttctgctctacagagctgtggggttctcgttgagcctgacagatgataaacgtgtcaaatgaagataagttctctgaagaaaaataaaacccagtaaaggggacagcattagaggatgggctgctctttttagtgcagcaattgggatgtctgataaacctcatgagagcagagacctraatgaagtgaaggagtgagccatgcagatatccgtgaaaagacttccagacagaggaagagttagatggaaaggataaacacatataatcatttaatgttataaaattatgcctcaggtaaataaatgtagcatacattttatcgtacaaagggtcccaatatactatgacattttgcatatagattataagtattattctattataaatttatcttgggataataagatgtgtaatcaacattgatcraatatttaacaataatttttttctctcttggactctagggtagggaaaacttttcatctaccctcctaggttatatactrggggcttgcaaattaaatgtaaaagacaaatgagcaacaaaaagacatttgtgggagtttacagaaaaatgtgacaggaggcagttagacttgggggcctatacatcatctcagtaggggaaggcggaagaggagaagagcatttgctggaaaccacgactttaggagagataaatcagcccttaagagactagataggagatgtggtagttttatgccagtgtctatttagttatggtaatgagtcgatcttccctggttgtgaaactccagagttcctttggggcacactgcttttaagacagatgaaggagtttagtaaaaagcctatttttaaatgactggctcaaaataatttttatgtcacagtggtgtagtctggacccctttagactttagaagagctttcagcagattgatttgagtgagctrcacttctaagaaagtgaagcaggaaagtttgaactgatccctttattctcctccaagttcccttgaggcccacacagacatagccagttattctgctgactttgaagctgtgctcacagttgggatccacctttgaaaaatggctcctgagtgtgttaagtaagtaatggctagccragggcttcagttgggaggactgcggagaagacttttctcccctggggtcctcaaaggggaaagaaatcacaagggggcagcatagggagttgtttggaaagggtgagaaggctgtgcttagtgttgggatacgcggatggatgtaagctgggttttgttttgtttagttttttaaacttcagctgttggaagtcctccttcccatagcttctccaaatcaccactgagctgattccccaaggcataaagacagccctgaattaacacagtggggaatgctaattaagtcatgccaataaagatttaatcatgaatcagaaacacttggaaaattatgttttcatattggaaagatgttctttttttctctatgagtaccccaaagtgtttttgaaggatgaaatgcgataggtggtaggacagaaatatttggttgacttgtccagtatgctaatggtgttggaacagggactccagtcttctgatatttcatctggttggtcttttccataaataaatatatcccagagcaagtagttctggggattgttataatatgctggttaatagcatggagaaactggcttgggcaatgttaagtaggagtttcagagcttttaatatatgagtactgagagtttgtaaaaggaccccaaacagaagaattttgggaaataccaatctataccatgctgggttgataggaccatctatattatacaagaatcttckcagatttaagtttcttctttttaaactgccattaagggcatgcagggaaggtgaaattttgttttaatatccatgtataccatatggcttattttggcaactaatatatgaatttgttcttggctgctttgagtgtgattgattcagcccaataagtattttctaaccaggtcaccacatgtagagttatgaggtaagtgacaaaagtccttctgaccaaatattagtcctgtatgttgtactccaatgtgctcacaagcatctctgttgctcaagagtgaattgaaatggctactacattgtgtgagtccagagggcttaatctgcatggtgtcatagccatttgggggctaaaccgacargtgtgaggattgtaaactggcagggagctcaaaatgagctgattggtgaaacttcatggtgatctcgtaggttgcagcagagaacaatacaggcccagtcctcacatgcttgggacttaaggtgaaggtttgtgttggaggctaggtgggttacggacaagcagagaactgccacaaggtgctgtcagcactgggatggaggtgagcaaaggaggctaggaaagcataaaggaggcgtgcctggttccagcagagggagtagggaagtgacaactaaaaccagacctgaaggtgaagagcagagaggaatgttccaggcagaaccataggtgagagaatttggcatgtttaagagaaagctcccctcactgccccccaactccgtatttttgtttcatactctgcaaggagcaactgcactaaaaatgtacctcatgttttctattttacaagttactgccacatgcatggccttatttcctgtctacaacaaacctttcaggtgtcccaggtcacaaagtcaggaaaagagcctgggaactgcccccactcttcctagaatgtaaggggtgttgggccatgttccaaataccaggttcccactgagagtggctgaggataatgctaatctgggcagttttaagcaggaaatgagtatgtggagtagggaagtgcggagatcttgctatgtaagtcagagctatttttctcactactgggttgaattaaaaccagtttctggaatcacaatgtaaaacaagaggcaaaatccacctcgaggcacattggtttttattccttaaatgttccacataaaaaatgaaaactgagtcagtagaacagaatcgtaagaccagatggcttcccaggatcaatgggggcaagccattaactatcatctagttaatagaggaaattgcattttacagtgggatgggttctagagttcgrgtggaagatgaaacttcagtcaaaatcatccttaaagtcccataggaaagtaccacattggagaacaacatgtaacacaacaggtatgtctttaaatagcagaagtgcactcaagatacccatactttgagaagcacgtggggactaagactgagcargggcctgtggtcactgggtgaaatggtggcagaattgcccatgctgtttaaatttcactcttgtcttctttgtctccctggaagttctatatacaacagttacatttgtgcaagatraatacttgtatgatgtgactacactgcacattcttgatgctactcagagtgcacatatgagaatcatctcaatcatgattcatcacctgcaacttggagcacttatgccctgtgcctttctaccgggcttatatttgaaatctcagatttccctgtcaaggcttgatcttaccgctgcagatctgtttggaccactctgaaagagtatactttgaggtgccttccaaagtgaatttgatgtacaccacgtagcctataaggaatttttacgattttataggttcmatcagctgttgtaacagacactcaaaacaacagtggattaaacaagatgtttttctgtcttgtggaatattgtgggtcagcaggccaagactagcatgatggatccatgatgttgggacccagcctctttaatcctgttgctctgccatcttgaaggtgttgcccttgcccatctggttgcagatggcttctactaccacatccatgtttcatctagtgggcacaggggagagatggggcagagtgtcttccccctttaaaatcaggaaattgtgtacctgactattgctcacaatccactgggaagatctaacatgcaggccacatttacttgcaagaagggctgaaaatgtagactctatattgagaggcatatggccccctgaaaatgagtggttctgttaccttaaagaagagaaggaacactagaaatatgtgccatggtccacctctttggccatgaagacagccatgcccattgttcttcctgcccattgaaacacagcactcctttccagtggaggcaccccagattccttccagttacccagtcagtactcagtgttcatagttctctccatcaagcccatgtgtggctccttgtgtaaagttaaagacaaattatcaggccccctgtccccactacataactatgtataactatatatatagggagggagttacataactctgtgtgtgtgtgtgtgtgtgtgtgtgtgtgtgtgtgtgtgtktaaagagaggggatatagttgtatatttacatatgtagaccagtcactagccataggagtgttcacattgtcgcattgtcctggctgggaatgcacactcctgtcctggcagtggagtaggtccacagggaaccctggttccaccctcagggaggaactctatccacctgctcatgtaaatatatttattgagtaagagtggacattggagaaggccctaaaagtccttttggggctgtacagcttatgtaacctgcttcctgctgatgaaagttggaggaaaagaggcaggggtgacttttgcaggccaggctcctggctctttcactgtacagtaccttcacaaatttagtagtcttctggcctatcctgatcagttccatgtgctggtaatcacagtgaaagttctcacctagatagttttgaaacctaaaaactttgacttgtatttattggatgctttgtgcctcccttgatttctctattactgatggctaccttgagacaggtggaaaagataggctagtacgaaggcagtatccttaatctgattttgctggtgggctagttcccattgtctgacagagaatcctggggaatattttatttattattatttattatttttatttttttgagacagggtctcactctgccatccaggctgagtgcagtggtgtgatcatggctcactggagcctcgaattctcaggctcaagtgatcctcccacctgagcctcagcctgggactacaggcatgcaccactacacctggctaattttytgtatttttgtaaagatgaggttttgccatgttgcccaagctggtctccagcttctgagctcaagcaatccacccaccttggcttctcaaagtgtcagaattacaggtgtgagccaccgcacctagccctgggaaagattttagacacagccttctctgctaagcctgctgcttactgtatagctgatttaacttggtttcacaaatagttgtcatctcaactctgtgatggcacaaattcctggacttggacggtatcatttgcaggccacagtaaaaacaaaaaacaaaacttcccttagcagaacccaacctgcctttatttctctctgcagaatggccagcccttgcctgagctcccgtctttattgtagcaagaggtagttgacaagcactcatgttctgaattctgccaaccatttgtctcaagctacaaatttggttggccagtggtctgccttccatgctatcagaggcaacaaatttttccatgccataaaaagcatgctgatgccaatgttttagattctgttttggtacagaataccaacttttttgttaaaatgtaggtttggctgctgttagcagagtttccaaataaagtacttaaaagttgatagtaatggaacccttcctttcatatcctgggtgtgggcagtccagggctgatgtgtggctccattatacacagggacccatgccccttttcttctgttgtgcagccttccctggagtgttgctcttatctaggtccgggatggctgcccaccaccttaccttcatgccagctaacatgccaacaggggagaaagatggaggaaggcacacctttctcagagattgaacatatctgttgcactcatgtcgcattaatcaaaacttagctaagcctacctctagcagcaaggagggctgtgaaatatcagtcttattctgggtgtcatctgtcaagctaaacattggggatttgacaaaccaaatgaaacagagaattgatgttgggaaacaaccaatagtttatactgtcctaagcattccctccaaatctggtgaaaatcactgtcattttcaagtggtagtgttacagagagaagacagaacttaattttatatgggcagctagatttttggaagagaccttggccgtcaattattccaaccccactttagaaaggaaccaaggcacaaacattgccattgtacgagtcttaaactactttattgaggtatgattcacatactatataatttacccacttaaagtgaatcattcaatattttttagtctattcacagaactgtacaaccatcaccacaatctaacttcagaatatttccatgatcctaaaagaaaccccttacattagcagccaatctcccttgcttccctaccccttcagccttaagcagccgttagtctactttcagtctctacgtttgtgtgggtagactttacatggaccaaatgtccagttttggttgccaggcaggggaagttccatttaccaagtgaaaccacaggatcatgagaagcaaagtaagggctgtgtcaggagcagtggaattagtatcccatgcttctgtgtgccttgtcctgagcatgggagggttaaagatgtcctcattcgcaaggagctgccagttgaatggggaagattgacacatgcaaaaccagacagtaaccattaggtattataaaagctaacacagaaggaaaaagagatggtcatgggagctcagggccagcctgggataggcgagtgtgcctgggatgggtggtgtgcccagcgaaggcgttctgcagaagataagtgtgtctttcttggcagactctctgtccacagcagaccaggctgtcaaaaaaaggaggcgacatttctccagaatagcttcttcattttcgtgagggtaagcaatcagatttctttttttataaacatatttgaacttatatatccaaattagtatcgtamcctgccaaatcgccactctgggaaccrtgcacgcactccagtgatgcgtgtagtgctcaaagcatttgaaactcctctatgggaattatctttcagccagtcagtttatgggtcacctaggaaaaccagtcacattattttatagtcatgcctcatttttcacctaaagcgatgtaacaagatttgatcacccactttattcattagacatggctccagccaatttttgtctttttccaaagttcaaatctattctcaaaggatgagatttgtcatgactgaggactttcaaagaaagtgccgcagacagtaaaaacagttacccactaaaagagttagagaggtgtcagcattgtttgaataaatatgttgtttcccaaggtgattgttttgaaagagataatgctaattgagatgaatgtactcaactggcataactgtttaaagggagttactgtattttatactgttcaagcacattgacctgtagagaggagcttaagagacagttcttgctgaggcagagtcyggcattctgctttctgcagcctaccgcagtggcctggggatacagttctcttccattctggtaaacgtttaaacctgctttggtgaggcatttaggagctgtacaaaatgggaaggtttgttaaaatataaaccgacaaaatggccaaatacccggccctgacygaggaagagagtcctgtcagctctaaaccatagaacttgaaacccaaatgctaagccagtgcccacctcgactgtgtgaaattgtcccctgacttcagaggccagaaaatggatctgggatggtataactgggtggrgacagggaaaggccttttgatttagcaataaaactattaggttataccacctccatggggactttgaaaaatgcattctgtggaacaagatgaagtgctttttaaaggaagattttgaaatgaagcaaaagggaaatcagtgtagaaaactcagatggaatcagggataagactggcacctgtcatgaaagcccagcttcctctctgggctgggccacayagttcactctaaccgctttgtggtcaaatccatgagaaaatcacttaccccacagtttgccatagacagctcctccatatgtagaagtggtattcgaaagagtaatcgtaatatctgccttgaaagattcttgtgaggatgaaataaaatttgtgaagcacttgttatagggcctgacattgtaactggttagtaaagagaagattctgatgattctatgattattatgattattccaaatactgaggccattggaaggcagagggaggggataagaagatgggcctagggagrgtctttgtgcctcttaccaccctcactttttggctgtcctatcctgcctctgtccacacattatcccttggactttttctgtcaggcagaggttcacagttgctctaaatctcagccacaggcccatcaatctgagatcttcacctgttttgagtcaccagctagcagtggctagctaaggatggatatttcaggatggatctgtggaatggttactgggcccaggccaatgtcttgctgcagatgggaagctgcaagaaatgtatgctggcatttctggaaacctcctgggacatgtgaatgtgttcatttgacaagcattgcggaacacttttgtatgccaggcactgtgcacagtggttgggggtacaggatgagtaagacaaagtccttgtgcttagggtgctcatgctggtggrggagayaggcactccatgggtagttacaayagggtgcgaattctattacagtcagtccttgacttaccatggaatgatgaattacagttgtccaactttacagtggtgtaaaagtgatacacattcagtagaaaccatactttggattttggattttgatcttttctcaggctagcaaaatgcaggatgatactctaggagtgagccacacctcccagtccaccacgcggtcccgagggtaaacgaccaataatgtacaatacagggtactgtatttaataaattacacgagatcttccaacattttawtataaattaggctttgtgttcaatgattttccctaactttaggctaaggtaagtgttgtgggcccatttaaggtaggctaggccaggccatgatgtttggtaggttaggtggatcagatgcatttttgactgatgatattttcaacttacaatgggttccaaatggaagtcagaccacttggtggctacctaattttaccacataacctcagttcatagtagtgggttggaagtgaagactttgagattttgcttcaaatttcagtttcataattaattgtacaatatcatgtatactgcttaacttayctaaaactgttttctcaccagtaaagtgggattaattccaatatatgctatatcagagaattttatgaggatagaatgaaataatgtacatacaaaggttttgtgaattctaaggtgccactcaaatatgaattatttggttgtttttgaaactgtaatgttgcttcaggaaagtcattccactggactaatgtaagcctcttgccaaaaacaaatctctacacacagtttcgtctagttctctcaaagtccaaaattcagatgtgctaaagaataataaaaaaaaaagttacaggcgttttgccattttgagaatcttagtggaatatcaaaattacatcttttatgttaaaatttatgttaaaagtatatataatctttggtgtgagatctgagtttgattcctggacatggtagttattagctgtttaatcttgggcaaattgcttgagctgcttctttactcatttgtgaaattaatatgttgggggttttgatgggaaatacagacactttaaacttcttgcaaaaggtttcccggccattaccccctcattttaacttctcttcttcccagatttgccaatgacctgtcaagatgctctacacctattagcttataaatttcagaacagaaatatctttcttacagagagtgtttcatgcacagagcctggggggagggagaactgttctgtataactttaggttttcagtaatatgtcgtcagcctgatacttaagttttctcaaaagaacacagcagccagccccaaagtaagcaaaattgatcctgagtagcttaagtactggttacggtgtttggtgtttgtatgccaggtctaccccttatggttttaggatagtggttctggtraatagttgattaggtccacttgctccagaaatctccgtgaataagatttgatggggtgctttccatccctgaaacatttactgaatgttttcttattgcttaatacagtgctgtgtatttggggcatgcagtagtgcataaaacggtctccgcaagtgggcattgcaatatagtgtgagaagtgcctcgttagggtgtattgggggccctagggaggggaacacgcaggggtggtcagaggaagcttcccaggggagatgtgtttaagccaagtcctgaaggatgataaagaggaagccaggaaaaagtgtagacatgggggtatgaagaagacattctgtgtagtgggagcagcccttgcaaaacaaggagatccttgtagaaagtaaaagcacagccttagactgtaaagtaggactcatcctaactccagcattgcaggaagggaagagggaggccgccggtgactcagctgccttaacccctgaggtcacacaggtccttaacccctgaggctttcttttatacacaggccaacataagacccagtctgggaattatcctaaggcccagcctgggaattctcttatggccctgagggaagggaggattttggagacaggatcaaaaacctaaaaagctatctgtaggccgggcgcagtggctctcacctgtaatcccagcactttgggaggccaaggcaggcagatcacaaggtcaagagatcaagaccatcctgggcaacatggtgaaaccctgtctttactaaaaatacaaaaattagctgggtgtggtggcacatgcctgtagtcccagctattcgggaggctgaggcaggagaatcgcttgaaccaggggaggtggaggttgcagtgagccgagattgcaccactgcactccaacctggcaacagagcgagactccttctcagaaaatgctatttgtaaggaggattgggttgaagtatttgcccagtaacatattaaggctatcaggagctggacgtggtggctcacgcctggcctgtaatcctagcactttgggaagccaaggtgggtggatcactttaggtcagaagttcgagaccagcctggccaacatggtgaagccccatctctactaaaaatacaaaaattagccgggcatggtggcgcgtgcctgtaatcccagctacttgggaggctgaggcaggagaatcgtttgaacctgggaggcagaggttgcagtgagccgagatcacaccattgcactccagcctggggaacaagagcgaaactctgtctcaaaaaaaaaaaggctctatcagtttgctctgactctctttctttaaccagcaggttacgtgacacgtgacaccatctgcatgtgacctactgtcttcactgggacaggccttctaacttgggtcaactggcctgaacccatacgtagaatgattgatatatagttcactaagttaaattatacatttatagacgcaaaaaaaattttgacatacagtgtggttgtgttgtatcctactgctctaatattaggaaaggggctgggatgctaggtcagctgggaccctctttttctcrcttgcattcatctctttttctctcttactctcaccacttttctacctcatgttgagtagcgccatgaagacccctccttcatcactctgcctgcagttatcctgggaagcaattataagctttcagcctcaaccatgcagactaactggctctacttccttcactattgcagtttctagttctgttcgtaattgttgcacragactttgtgctattgcaactacttggaatgccagttccaggcagagtgccctctgttgtagacaccttgtgctttgggaagttgtctgtgattaggggagtaattttctatttgaggttggtctcaggaagggaaaccactcctgactcctgcctgaaaactcgcctccttgctcagaaacactaattacaggggtcgtttgatgctctcacttaaatattttagtcactcacacatttattgactatctgtatgtgcccaaccccattccaggtactgaggttaaaaatgagtgagatgcagtctctccataccacagagcaaaggaggaagcttgtttgtgtatatggagcatggcccatgcagggttacttaatgctagaaaccaaacactctgaggcaaagaaaaggtgtagggggttggggggcagggtagaggaatagtctacccagactgcctgtcactcagaccagccactctgctgcaaaaggagttggcttatctttttttttttttttttttttttaagcacttagcagtttcctagggctgctatctgctgtaacaaactgtgtggcttaaaacaatggatatttattctcttgcacttctggcagcttaraagtctgaaatcgaggtgacagcaggaccatgctccctctgaaggctctaggggagactctttccttgcctcttcctagcttctggtggtggctagcaatccctggtgcagtgtaacttcaatctctacctctgtcttcacgtggcattcttccctatgtatctcttctgtctctgtctccaaatttccctctcctaaatcctgtcattgaatttagggccaccctaatccagtatgctctcattgtaacttgattacatctgcaaagaccctatttccaaataaggtcacatccccaggttcctgggttaagacttcaatgtatctttttttttttttttttttggagggggygggagtagtgcaccattcaaccatgacatctatactctgtccaccaaatgcaggtgggttttgtacagacaccaaagcacatatactttgcacttgggcagtagccctttgggagtcacttgggatctatttcctcttaattttcttcaagtttaaacaaatttgatcatccaaaggagccatacatagcccaatgatgagaaacrtgagctttggctttaaaactggtgttgaagccwgcctttccaatttattgtgagtcctggagcaactcrtgtaacttctttaatcctcagtttccttatcagtaaaatgggaatagtgagaatacctacaccactgagttgttattaagcctgcatgaaaacctacatgtaatgatattcactgtgctgagcactttacatgatctcatatagtcttttcaacaactcttaattgattggtatttagacttctgttttacagatgcagaaatagaagctaagtgattcgcccaagatctccaagatactaaaaagtatcaagagttggaatttgaacctggatttccactgtgctctattcctcaagaccctttttaatagttatgtagcgctacagtctaggggttcctaaactttttaaggaaagtccaactttttatatccctaaagccttgctctcactgaagccttgattgaggccaagagagaatgccttgctgctgcccccaygagccactgcccatctmaggaattcccacagatgcccacatttacccacatgctttaaaagctcttgtttattgagtctttgctgttcacctggctgcatattacattacaaggcaaggtagcatgatagttacatgtctgggctctggagacagactgcgtatgacctggtgtcttcttagagcaagccttctaacttgggttggctgaatcaaatctatatgtaaaatgaatgatatacagacagttcactaaatcaaagcccatctccacaatctacctgacctcggacagatgacataatctctgtatcccccattttccttatccctaggataagggctgagaataataagcccctatacagttgttgtgaagattaaataagttaatgcttgtaatgcatttgaaacatgacccagcacattgtggcctactgaatttatcttctactacctttgagcaggcatcattgtccttactattttacaaataaagaaactgaggccagaaaggccatataccactagaaggttcgagcaaagcaaggattcaggctcaggcctgtttgactccagagcccagtggttacagcagggactgtacttgattctttaaatcctccttctgctacctgtcccattcctccagtgcctggaccattggagatgtttaatcagtatttatccacagataaacccattgcatctatgccctcctacctaggcttacctgctttcgagatcaggggatgtgttagaaggatgtgatcagtccttatcaataccctttctgtttttagtagtttggataacatttattgagtgtctactatatggccaggcattgtgagaagcatttcacacatacctttcctcatttactttcagaaccttytaaaggaggcttcactctctgcattttatggaaactctggcttacaaggaccccatygaaaaggatgttccctctttgtggccaccttctttcatgtcctttacagccggacatcctattttggccagaccatataattgaaaatgatyttaataatgagacagacagaaaataacctcaccatttctctcctcttcttcttcttcttttttttttttttttttttttttttttttgagacagagccttactctgttgcccaggctggagtgcagtggcgcgatctcgactcactgcaatctccgcctcccgggttccagcgattctcctgcctcagcctcctgagtagctgggattataggccctgccaccatgcctggctaattttgtatttttagtagagacggggttttaccatgttggccaggcggatcacttgaggtcaggagttctctcctcttcttaaaagccccagagtcccaccatattttaattatttgatggagggccaaccactgcctgccacaaaacttaaaggggcacaatttcccttgtgatcttggtgaagggagcccatagagttgtgcaaggctgctctgggcagaggtgagtgaagcactgccccttacgaggctgctggcaatcttgcttgtttttccattttccaccacaagagggcaacatatgaccatgaatgatttgaaaataaagcgattccttaactggttctctttttaccaaagaattttaataattgtgctcctggtaagttagaatggggaaagttcttctgttagcgccaagtgaatattcttaagggattgaaattcaaattgtcttgagaattctccaaaaaggaaataaaagacatagaaaaatgttatatgaaccacataaatggctgtttttataggtcaaaatgtttgaatatgggtcatttctgataaaacaggagactccttcacacgtgccttacttatgaaaaggggttcctaagccttgcacatcttcaaattgaggagattgttttcagacgtaaccacatgggttcagaatggcaattatgcagatggagaatgccttccatggcttcttgtctgccctgtgagtgctcatagctctcttgtaggctcccagatgagtactttttactccattttaaaatgatttgttggcttatctatctctccttctgcaccaaaagtttcttggcaacttgagtcttcctgaggtgtacagtgcctggtgaaatgaatacaacacrtcggtctatataggacatattgggtagatggatgggtgaacagatggacagccaactgacgcgtgctaaaggttgtacactctctgaggcagaggcagctgttatgtttgtttttattttcaaaatctacttcaggagtctctgtgaacatgggattctgtagagctctaagccatctggcccttgtaattcttctgaccttgtaccttcttccaattttaatgtaatttctccttttctttagrgaacatttcctaactctactaaaatgcacatagccaatggcccgtcccaattgttgggtatgaaacacgcctgcttgttttcagattcagagcagtgctaaaggctaatacttacgcagggcttgcaaagcactagaaccagctggtgctaagctctttacatttgtaaactcctgtctcttaatacaacaaatctatgcagtagctacyactttcaatccctgtttcaaaggtgagaaaatagaggcacaaagagcctacatcccttgcccacggtcccctagtcagaaaatggtactcggcctgtctccttgctgtggactgagggagctcaaaggagaaggggaggaagtgttctctcttccttttcttgcctgtactggacagcaggtgaggcctggctcacagctggcaaacaggacccaggtactacggagccctggtcagccctgtaaagagatgtaagcagctataagtagcagaagcccaattagggttcagtgagcccctatgaggcctgacacacaaggactgcacacagagagaggggcgtctcctgcagccacaggcagtggtggggcagatggacttcaagaccctgagacacattttgggaggccaggcgggcagatcgcttgagatgaggagttcgagaccagcctgtccaacacagtgaaaccctgtctctattaaaattaccaaaattagcagggcatggtggcacacacctgtaatcccagctcaggtgggattgaggctgaggcacgagaactcaggaggctgaggcacgagaattgcttgaacctggaaggcagaggttgcagagattgcacaactgcactccagcctgggagacagagtgactctgcctccccmcaaaaaaaaaaaaaaaaaaaaaaaaaaaaagaccctgaaacaagaggaacccaggcagcgtctcctggttgtctcagcacatctgtttcattttcctctctctctgctgacccatttgtcaatggaaattaggtttctcagtgtgtgtggttttttttttacaaactcatttaatcaagcacctatgaatatttcaaatttttaagtcaaatatttgttttcttttaaaattccttgtctaataaggaaaacttttcaagtattcaagttgttctcatgtaatcaaataataacagcagatccttgtacagggcatactatagccaccctggtttcagaactatctgtaaattgcttcattcaaacttgactacaacaagtaaagtagagctgctatcattatctccatcttgacagatgaggaaatggaagcacaaagaggttaagtaacttgtccaagatcatattactagtaactggtagaataagggttcagaccctgtcactttggctttagaggccattccctcaagtactatagtatactgtctgcatgtgatgacttaaacttataaatataatacagtccaagttttctggaatgttccactaatgtttataattttgataaaattcttctcataaaattcttctcatacctccttaaacttaaaatcctgtctaaataagtaacacaacctgcacttaattataaactggaaccacaaggctaatctttagataaactaatatcccacatttcttaaatgtatttcaaatgccaaatatacctagttttcccccccttactccaaaaatattaatactatgttcattttattatttgtatcctatgtgatatatttcatcatctgtacacttaattttaagagagtatgttttaaaatgcctacttaaaaaaccattctctcacctcaagtgatgaggrgttacctttccagttgaattggggtgacaccagctgggtgaggtgtggctcggccaagggtctggatgtggaggcaccgagtccagaataccagcgccaaaagggattctccagtggcttgtgttcccagcccctgttcccrattctcaggtctgatgaatctgcaagccctacctacgtgagaagattcatctaacctattttctgcttgatactatttcgaattcttttctgattcttcccgtacatcagatccacaactcttagagatgtatgaatgatcccgagttggatcctgcatagctgtcacggactctcacatattgtcaggctgtcagcagcagttctgtggatattctcatgcctcaactgttcttgccccacagctcataagtttacctgtctttctggttcaagggctaacctaatctggctagtacacttttgagtcccaattctagattccaaggagagaaaacatgagtggtccagctttagtcaggggtctaccccwtttgctcatggcctggagtcagggtcctggagtagacacctggcctcaggccttcactctcatggaatagttgggggacagttctcagagaagagaggagatgagtagaaagcacagtatggaaaaagggtcagaggaaagaggttgttcaaggagtatcttcacagtaggagaggaaaaaaacaaaagcagtgctcaaactgggccaagaactcagagttgaagttgtgtgtagaaagctggcagaggaacagtgctggacaagatcacattgactgggaccctcaaagccaccccagctaaggatgggaccctttttgcaagccttggttaatctttttccactcttatttctccaagccattcaaggcatcactgccagccagtcaactttccaaaaacatattggtttatattctttttgcttacaaatttccatagttccccagcactttcaaaataaagtttagcacrgttcacaaggctccatagacttgccccaactatttctccagtctcatccctgtcactgcaacctcttcagagccgcagctctgtaaacacaccttcaggatagcaccaaggccatcccgctatgatggctcctttctgatgtgaacttttttgagaacagaggcccatccacctttgtttctatctccaaccccactcagaatgtgagaaaaaaaattgtatctttacatcattttccagttcataaaggctttcctagacattaactgaggcaatcttcgcaaaaaccttgggagagaggtattatttcatgaagaaattgaggctcagaaggacaagggggctgacaatgaccgataatctaccttataccaggcacagtactgggtgttttcacatgtgacctgttttcagttttctgaacaaacttcagagctatccccattttataggctcagatgagttaagtaacttgctctagattgtacctctcatacattttacagtgaaagatttgagccctagttgtatctggctgctgaacctgtgcccttcccgttagaatgtagtgccttgcctggggctgagcatttactacctgcttagttactggtggctggagaaatgaataaccgttttccactcttggggacaaacacttcaagccctctggaacaggcacctgcagccatcacaagcatagggccttgggctggagtgtctgattaaccctgctgctttaagccaaatttctgcctttctttctagtgcttatgcctggaaatagggttatcaggctcatcccttatgcccactcctgggacattagctaagaaagaattcttggtgtgaagaggtgaacccattcaggccagccctcayatggggcctgggacaccattattaactgtccattaaatattttttaaagaaacatagaaaagaaagagtgaataaaggattggtaagtctacggtttctgctatgctctactgggaaggtatcactgctgatgcaaatggaagctggagtctttgcaaggctgggagcgaaggggttcataactctgccattgtgaaattgattggacccaagaccagtatgaaagttccttgtctgaagggagtaatccttaaatcccccatatggtttaaatgtaatttgtgtcattgtgaaggagtactggcaatgcaggcgaattcattaggccaaattgggttcgctatgctcgacagtaacgtttctgaagatgaagttcaacctttgctggagagctaaaacaaatgagtttcttaatagctgccccacttagtctgagtgtcttaggaagcttaatgtttttaatgtctcttcttttttactatacttcacagtccatctaacattgctgcttctggtaatatttttatatggggttgagttctatagtgttcataaaattatgatcaggcccatttttagaatagaagcttttctagggcaaggattatgttcttttggtatagttttgcatattgacaaacaccatgcctggcatgtgtcgttgcttaaaatgttgctctcrtaattctgccctcagaaagaacttcaccgagagactgggaggctgccagcagagactatgctggagtgtggtgtattatgtgggcagagaggctttggtatgggatgtgggaatatccttgtgcccaagtacccccaaatttaccctgggatttcaagatctcattaagaaaactaccaattatgtggttggctgctctgttattccaatgaaaagattattggaatgatattttataaatctggatctattatcggatatgtcaagacacacatgccagcctaattcacaagcccatataaaaccagggaaaacttggcacagaacttacaaaataggaatttaaaaaatcatttatagtacgttgaaaaacagtggttatgtaaactgttaataaagcatgcttgctttttcaattaatttctaaagaatttgacttttaaaaacaaattaagagcccaaaataagctataaaaagtagtcgtcttttggctgactggttttcaacataatagatgtgttttgtgaattgtgttaatgttrtgtctcgaggtatttcctgcacatgggccaggcccatttgtcatttgaaggggctcccttgccagtggcctactttctgcttgtgagcytgttattcctgctggtcttgtgcagagcagccccggaacacagcggcattcttgacagagggcagttggcagctaccagtgcctgtctactttcggatgctacttgacaagttagtataaaaagactcagattttgttgctcaagggatgattcacttttcccttcaaaaccttaattcctcagtgcatgtttggtctgttgtccaggctggaatacaatggcacgatcttagctcactgcaatctcagcctcccaggttcaagcaattctcctgcctcagcctcccaagtagctgtgactacgggtgcacgccaccatgcctggctaatttttgtatttttagcagagacagggtttcaccatgttgaacagactggtctcgaactcctgacctcaggtgatctgcccactttggcctcccaaagtgctgggattacaggtgtgagccaccatgcctggctgagaacacacatgtatgtatttaaatagatcattaataaaatctcagggatcaaatggaattagatatgaaatttatttaggtaaaatatttttaaacatcctagtttcttcaaatacaaaggacttaaactgcttccctaaaaacattttattaaaagtcaagtatgcttaaaactgagaaaatgttaaaaacgaatctcatgttcatattatttttctaaataaaaactcgatccaaccctgtgtactcagaaaaacatatgtatattttttccgtgttttgcttacatttttaaggacttggtgcatcctcacgcctgtttttttgtatattcaaaggaatgaccaagctgttggttattcagggcaactttggaggtatctgttcttctagaactgaacactgttttcttaaatctttggtggccaatgaataaatctgttagataatttttttcctgatagattgcatgtgtgaagtaaaaataatttcttaggtttcaaaatgacagtgatgtaagaaaaccaggggtaaattaagctccctcacttccattttaagattgacctttaacttgctaggtggcatggggcaactttagctgcagatggccttctcagagatgaatgcccagagaggctctggtttaagggatggcaggagcagtgagagccacaccagggtgtcttgttcacaaatctgcttcgtgggactgcatttgccctctttgcctgggctctgagagtggagcctgtcagccacctggtgtttacagctgaagttggctgcatgcagcactccttggagctatctctaccctaacggggaaatgagacaaaaataattgaagggtatttggcttggttaagtgggcagaagtgtcctcatcaaaacaactttgaagacctgctttgtgtgtgggtgcgagtgggtgtgtggcccttaacttgttcacaagggacaacaacaacaaggaattaaccaagctttctcattgagagtgatcgtccatgcaaaccctctattttagttactcatacgacactgttgcagcttcaggttggacagacctattttggagtcccttgactgctttctggacaccctcactgagccagtcggtggaagtgaaggatgagtgattttgaagaatggatttctgggacatatagaaaaatggaagaaggtcctctccctctgttgacttttgctacagctccctaccacgatcagaaaccaggaacaagtggattacggaagaaaacctattattttgaggaaaagccatgctatctggagaatttcatccagagtatattcttttccatagacctaaaagatcgccagggatcatcactggtggttggtggagatgggcggtactttaataaatcagcaatagaaacaatagtgcagatggcagctgccaatggggtgggtatatgataagtattgttatgtttctggctctccaaataaccttaattttacagaagtatacaaacgtacaaggatttatatgtggtatacacttcaattctactaacatccagctaagtttcattgtaacttcagtgattgtatattgtgaaaatacttcagaaattacattagccacactgggatacaggaatgttaagttcagcttcttaggtattatgctgtgttctgttgcttgacaaagtacctgttgctttttagacatttaaagcacactcccggtcttaagctgttttatctacattctaactagcttcaaggggcaccctgtcctgtgtaagagggctctactgaatggtggagagaagaggattttgttttctttcaatggctttcttgttgaagttcagtcacttgtcaaacaggaaaacaaaagccagggcatgctgttgtttatggatcctggtagtcacgcagaaatgctaggaggaggttggaaaatgttaggtgtgagccttttgaggggacctgttacaggggcacctgcttataatgaccttggacacaaagaagccgtgcgcatggtgaatttgtgcagcagggtagagataataactcctgtaagactatagtatgaggcggctctgctaaacctctgcatcgtgaaaaaccgtgttggctggattaagcaaatgagaaggaayattgtaccagaacgcattgatcttgataatctaacarttcgtgcagcccactggtttccaggaaggtgggcatcaggacattgatgtttttgctctgcaaattcctcagtgggaccagaaatacatttttagtgttttagataatgattagcaattagttggagcacatagtccttcagtacctgcaaattttaaaatctggtgtatttcttttctggaagagattctgattcttgstagataaaatgtagtattgcaactaagtgtgttagacattcattttcagtgtattttcaaaatatgctgagcaggtatgtttgcagaagcaaaattaaagcaaaacaaaataaaatgtaccaccacactaaattttaaagtgtttgtagatcctgttgtttataattagagttttcctgatactcagtttcagaatctgaatgcctctcatgtaaaagttgctgataaagcactcaaatatgaaattattatgaagcatacacatttttaagataaaatgtgacrtgccataaattttttctttgaggagagctgcaaagggaacagtattaagatgcttttaatcttttgagagggaacgaatggaacattatttctccacatatatctagactgttgagtggatctggtacactgtcccctttgctgtgatatatttggctccatttcatttttgtgtggagctgaagaatgtggaagaagtggtaggaatgtgtaattcaggcacaccctacagactttctcagatttgccctctgaaggtttgctaaataatacatttaartgataattgactaaatatggtagctgcctatttgttagagctgttggcagcccaagcaatattttcaagtcttttcaaggtaagcttagaggtgagagccaccttattaaaaatagcactgcatttaaaacagtcatgctaaccaactgaattgcttaaaatattagtggactggataaagcacttcaatcggatgcgctttaaacctgtgaaattctaaagggtttgatttcttctctttctaacatatcctaaattctgactgttttaacatgcctttgattgtgggtgggactgcagggaggaaatctaaaggaaggataattattaccacagattttgacaaaagtcagtgctcctttctcattttctttaatacccactgtgcccataagctgattyttggagggcttttcagcccactgagctaaatggagatcattttattttttttccctttaccatactttatctggtgcatttatgggttataagtttctcttcattttttatttacatagagctctctgcttttaaaggacgttttattgcacaaaataagatattgacgggccccttttagaatattgatatctcattcagtccccagagctctaaactgagaggtaagtttagaggtaagagcaggacccatgtgcatgattacaggacaaagaaaatggaacttgttttttaaataacctaagaaaataccaagccctgttttcaattaaaaggaatatttaaagtttactccctgccatgtttgactattagatgtttggagaacaatgagrtacccattttggtggggaggcgtgagttttaaggaaggaagtcgtgggaaaggaaggcaggcaggggaggccatttgaggatggactcttagtgcctggctgagggggttatctctaacttgggagccaggaaaggtaaaatgtacataacatcagatttaccattttaaccattttcagtgtatggttccctggcattaattacactcacaatgttttacaaccatcaccactatccatctccagagccttttttaaaaatcatcccatacagaaactctgtacccgttacacaatcattccccatttccactcccaccagcctctggtaacctctgtactactttctgtcttgatgaatttgcctattctagttacctcatagaagcagaatcagacaatccttgtccttttgcatctggcttatttcacttagcatgatgttttccagccttatccgggctgtagaatgtgtcagaattttattccctttttttaagttaaaaaatatttatccttatgacctggcagtcacatgagaaaaaaaaagaaaaaaaaaattatcctatatatgtccttccaatcacatccatatctatagattgcaatgtcatctttgagtacagtgacaaattctttaaaaagttttagttgtggtaaaaacatgtaataaaatttaccaccgtaaccatttttaggtgtatggttcagtgatggtaacaaaacattgttgtgcagcatatctctagaaagttttcatcttgccaaactgaaagtctrtgtccattgaacaactccccatctttccctcttctgagcccctgmcaaccaccattgtattttgtgtttctatggtgttgacttctttaaatacctcatgtaagtggaatcatacagcatttgtcttttgtgacaaatgctgtatgacaaatttcacttagcataatgtcctcaaggttcatccatcttgtggcatatggcaggacccccccccccccacacacacacrcacttttaaggctgaataatattccactgtatgtatacacaatattttgtttatccattcacttgatgatagacgttagcgttctttccaccctttgacttttgtgagtaatactgctgtgaaatttggtgcttaagtgtctgtctgcgtcctgctttcaattcttcaggtatatacctagaagtggaatttctgggagggttttggagtcagaaaagggacacagaattatgatttagaaagataaactagatgggtttgagtaggtcagatggatccagccagggtcragtaagagagaatcatgtgggacagaggcaggggagattgagttaggagctgttgcagtggtccaggcatctttaagggaaggagggtaatagagcagtgtctctcctgtatcagatcgagagcaatattcctgagggtgattcccaagaaagagcctgatctggaaggggagttcttccaccagatgtacctcttcttgggctcaagagagaagctaccttgcttctatctctcaactttccttcttactcttacccctggcataatcccctcagcctggaaccattgcaaatctcaccataaggaatggtagaattaaggggtgacatgggtggtgtagcttaatatcaccagcctctccttccacaccaaatacaatctatataaaaattggtatgcttggtgtgtaaatacaactcgacaagccacccctaaacccctcctatggacattctggaactgcccraacataggcttttattctcatcacaaccacacctggaaactgctggaaggtgaaatgtcactgtgttgagtcaggacgtttcaatactttcccccaccatggccgctaatgtgctgtgtggccttgtcgtgtcatctacgccagtgtctgccatagtacctttccattaatgcttgttattaytgctgctggatggaggcaagaatgaatgaatkggcaggatcatgataactctggacctcagcttcttcatgtttgcagtkgtacttgggaagagcaaatgtgggaatggatcaaaagtaccatgggatgtagaaagcactctgtagctcagtaacaatcatcrgtwttgatttcacactatctgcaggttcctgtagtctaaaaagcagcctactgacagcatccaccctggtggttaccatttcctggggaaggcaggatataaccaatatattaggggagctacaacaaaaattgttyggagattgacatatgagagccaagaggtaactgaagggaaccaggtgctccytgggaggtggttggtagtggagtrgttgacggttttcaatgggctatggaagggtggcagagccaacagtcccagagaaactctccccagggaatccaggtatctcacggacattttcaacaytagaaacacatcttccaccatcaagttgtttcttcaatcatgtttatcttgggtgaagcaaaaagaaataacaaatggaaaatgtaaaaaaatccctgttttttaagaggaactgacagcacctcaaccttcttttccaacttgagtcatgttgaaacagatataaattactgtcattttagcaaaaaagatttaggagcagtactgataccatctgtaagagatatgggaaggtaagttaagaatgcaacagaagtcccatctgtcgccctttcatgtaggtcattctgactggtttactcaggaataactccagcattcttgtcttaggcccaggaggtaacccaggtacactgtaacagaagtaggtgtgtcttgctttgaggaaacccactatatgaaaaagccaagcttgactggaaagataaattgatgagtcatttttcawtaatcttgatataaaatttgccctttttactttaaaaaagccttctctttgggtagaatccctttaattagctaaaccttttcttttctcccgttgtggattgaaagtatgattgaattggataaaaatgtgggttttctcatattctttcaatgcatccaaattgtgrccccgatctggaaaggctctttttaatatgctgtgttttcatgctggagccttacagtgcacacagaccacacacttctaaaactacaaagtcccgaaaaccatctgaaggaatttgttcaacattgctgattctatttcagtaatatggtggagacatccaagctgcagatttttattaaataaaatcttttcttgtccaacagattattactattatttttttgtccatctgcctgttgtcttggtgttgtttctgagckgtgactctggatgtattgatgttaaagagtgtgttctggatttcttctcctagatcggtcgcttggttrtcggacagaatggaatcctctccacccctgctgtatcctgcatcattagaaaaatcaaagccattggtgggatcattctgacagccagtcacaacccagggggccccaatggagattttggaatcaaattcaatatytctaatggaggtgagtttgctgtcattttgaggacaggtaagtttacattcagtaggacaaatcaatacctggagccttgggagaccagggttttggttctgatcctttgcagggggtagggaggtgctctttgcttcctttcagtgacagtgaaatgcttctcatttgactgtacctgaatatgaagagccatgcgcaaatcttccttaacatgatattttcttttagaaaaatcctgctactytgctgactgaatgatgaaatggtagatgtgctagtgaagaggaactgatgagctttggattctttgtatttccatgtgagctgcacgaagtaacccactgtttgctgtttggtttccaggtcctgctccagaagcaataactgataaaattttccaaatcagcaagacaattgaagaatatgcagtttgccctgacctgaaagtagaccttggtgttctgggaaagcagcagtttgacttggaaaataagttcaaacccttcacaggcatgtttactttcctcctctttctgcccactcctatttccaagttgagcgattttcctttcaacgttttagtagagggtcttcagctttggaaagatttccgtgagtgctctgtaagctttgcaagtgttagttaattaacaagtctggaattaggtttgggagaccagagacctgggctccctgggccctgccagggatcagctgcatgacatcgagtaagtcatttccagcactctaggcctcagttttcatgccttgactagaagacctgcaggattacattcatagttaacttttattgacctcttgctacatgccaaggtctttacacgtgttaatccattttattctcacagtagatctgtcagggcagcactgtcagcattcactattatagatgaggaaacaaaggctgagagagattaagtaacaggctcaaggtcacagtcagtgaatggcaaaacgaagatttcaactcaggtttgaatgattcgcaagactacactttccattttagttttcctcattcagtaaaatcaatcagactattttggggggaccaaattgcaactccctacataggcagctgtggctaacattttgttgttgaattattgtaataattgacagaataaatatttataaaagtattcagattaataaaatgaggatgagatgattggcaatgaacttgcattttgactttgccctaacatgttttctttcttctggattgcaactttatggaatgcattttattagtcatttagttcctggctaaaggatggattgcatttttttgtttgaacctactcagggagagctgacaattgcatcctaacaaagataaagtgacactttggtcatctcgaagacattcttgaggttcagaagattccagtagggagtttcttaaattcttcatattttgaaaatgttcagaacccctgaatatccagcagttttgaaaatgttcagaagccttgaacatccaacaagaacaacaatactaagttcttatatttatataagttttatttttgttttattccttaagcagtacctgtgaaaagtgattcattaaaaaatttcattttccacttagtaccattaagtcttgatgacaatggacttggaaaaagaaaaggaaagaaaagtggggattacattttctactctctataacaccaaaacacacctctcaagatgacgaatggggaagcactgtggtggcatagcagaatttatacaacctctgttgaaaatcccctgtgtgcctcatccaagctgtgtgggcaagtttcttaacccttcacacgtcgagtttcctcatctatcaaataggactaataacatttacctctcaggaaaattgttagtattgggtaaggattggtagtattagatagtatcggatatcacttaacagccgtattattggagctgttcaataattgtccttttaaaatagcaatagcaggtttacagcaatatagtcacatcagaatataatatttctaaatgtgtttaatccttccatcttttgatgttgcttgttctcacagtggaaattgtggattcggtagaagcttatgctacaatgctgagaagcatctttgatttcagtgcactgaaagaactactttctgggccaaaccgactgaagatcygtattgatgctatgcatggaggtatacaatcatttcttttcaattcccatctcttgaggataggaagttgccctcttctgtgtgtatcatgatgcttcaacaagccttttctcaagtctctctgatggtttttaaatagagttattttgcaaccagagcaatattcacacagataaaaatctaattgtatgtagcaaaaatagtagagacactcctcgtggtaagctcgtgtgaaggtcagtgtttccaccttaagcatcaggttctgagtaacatgcaactgctgttgtggactctccctccccctcagaagataccttacattcttgctgcatgcccccatgtatttctgagaggacggtcatttgggagatgtgataaacatactcctgagccccacacccccactcacctgcccccaaatgctcgttttcttagaagagggcaagagcaagctgaggattaaattcaggagcaacatgatgtgtacagccctctcttcttcctccgtgggttgtgtggtcaggtccatagagagggcagctatcactgtgaaccagaaccacgagggttttctcagacatgtaggtatatgagaatccctgaaacctatacacatacatctgcctggtyggagaagcctttctgcctgcaactgaacccttttagtgatgcaattcggggattcctgtgacactgcaaaccacagaaagtcttctgctggtgaactaaaaccttccatccttgaaacttctycccttgggtcctagctggcctctggactcccatagaatggatctacttccttactcagacaaaagcgattctgtcattttaaaccattcaacagatgtgtattgcatacctgcaaaatgcatgcctggggaataggcaggaactgggcagattactttcttcaaagaatgtgcaatgtttggggagacgaagtgggtaaaaaactaaccccggggtygggcgcggtggctcacacctgtaatcccaacactttgagaggccaaggcaggtggatcatggggtcaggagttcaagaccagcctgaccaacatggtgaaaccccatctctataaaagtctctataaaaatacaaaaaattagtcgggtgtggtggcacatgcctgtaatcgcagctactcaggrggctgaggcaggagactagcttgaatccggaaggcggaagttgtagtgagcggagatcacaccactgccccccagcctgggcgacaaagcaagactccgtctcaaaaaaacaaaaaatccctaaaaaactaactcctgccaggccaacaaaatgagagttggaatttcaagtattctctttggggttggaagaaggcataatttgactaggtataaagaaaggtttcctggaagaagtggcatccaactcagttcttatgaaagaaagatctagagtgatgaaaaatcaagcaatggtcattctcatggagtcggtggcygtggcaaaggcatgaaggcttaaaaatggatgtcacattagggaaacgagaggcctgggctggctggataatggggcatgtgaggagggcattgggtaagaggagcttctccggaagaagactacttttctccaggtcttttggctgttcctctaatgctttcgtttctatatccctcacagccctggctgccttgacctcattctgtggtgtgtcagtaacctgcttaataggtgatgcctcataggacacatttattctacagtgttatgacctctggggcatgtactgtattgggattagtaccatccttgatgaaaatactctctcagcatttcagagatgcgtgttcttggtagttatataaaatgtcactgtaaacatatgtaactggcttctcctgttgtttgttkttggtggtgggttttttattttcttttttttttgagacggagtcttgccctgttgcccaggctggagtgcagtggtgcaatctcagctcactgtaacctccgcctccgaagttcaagcgattctcctgcctcagcctcctgagtagctgggattacaggcgcccgccaccaggcctggcaaatctttgtgtatgcatgtgtgtgtctgtgtctctgtgtgtgtgtgtgtgtgtgtgtgtgtgtgtgtgtgtgtgtgtgtgtgtgtatatatatatatatattttttttttttttttttttttttttttaagtagagacagggtctcaccatgttggctgggctggtctcaaactcctgacctcatgtgatctgtctgcctcagcctcccaaagtactgaaattacaggtgtgagccaccgtacctggcctgtttgtgtttttttaatcagtttgtcagctagcttgtcataatataaagataacagctctgaatcccaattcccacttttcctagccatgtaagtttgggcaaatgtctttacctcagaacaccaacattccaatgtatctgtaaactgcaggtgataatcataatataaacatttataacatatctgccaggtactattctcagtacttcatagctattaactcatttaatccttacatcaatcctgttaagtagttagcattactaccctcattttgcagatggaagagactgaggcacagagagtttaaataactttcccaaaattattatacagccaatgactggcagagctgggatttgaacccagacactctgattccagagtccaggctcttaagctctaagctgtacaaccttctgagcttttctgaaggactgaatgggaaagcacaggtataccgcagggcctttataatggttggtttcctttcctttccccactctgcccttcatgaactggccccaccttttccaacataatctctcattgttcctttttagagaacattcttctccagtcaggcgtatctctccactagtccctgaacacatttcacacattcctgttgtttctcatgccattcttctccccagaatgcatccacctcacccctgaatcctcacatactttaaggagttttattttctgattctgcataywtttattccatgctgtatatagttgtgggaccgtatgtaaagaagatcctctgtgaagaactcggtgcccctgcgaactcggcagttaactgcgttcctctggaggactttggaggccaccaccctgaccccaacctcacctatgcagctgacctggtggagaccatgaagtcaggagagcatgattttggggctgcctttgatggagatggggtgggtataagtgcatttaagtgaactctggtgcaggccaggcctgatcctgcagatggggaaaaaagtgggctgcttctgccagacccagggaataactgttaaggatccctcattctgacccgaggtcagaactaaattattagaagcccctcttgaacaggaataggagtcattgaaatgaaacccayacrtttaatttcagacatccatacttgctaacaatggcacgatgattaggttctgattatgatagaatgactggtatttcctgagctgggtgagttctagatgcctgtcttaaggtgggtttctgctctcaaccagcagctggctacttatttaatctctggacaagattttggtcttataatacacccattcattcattcacatgagctgaatattgaagctgtaatttcattgcctatatgaagatgatattgagagaattaacattttaatcattctctaccattaaaatgtttagaaataagctgttttatttacaagggtgactatgtaccagacaaggaagagatgtgtcttaggtttatatccctggtatctcactgatggtaggcactgtatacatttacttagttgaaaatatatttttgttgttgctagtgttaccattagctagaatccactgtttcctgaaaaatgatttttcccttatcaaaatgttgggaaattaaaggggttccagcagacattattctgtagtacatctttgtgatgagtgcattctgggagtgttttttggccaccctcccagttactgtggtacacagactgtggtacacagtttacccagtagacctaccaaactatgtaaacagccaatatttcttctctcattgcattttcccctcccctgggaaaaagatgattggttccagagtctgaaaaaagtctaggaggttaaagttagctggcctctggagggagaacagaggactcagctcaaaaggaggttgtgcttggactttaattgaaaacagttttaactttttggcatggaggtgccttcggcccaatggtactgtataaactcattgaaaataaaacccagtgttaaaaatgcagtatggaaaggagatcaatttcaaattttatagttttacattttataaaacccccatgaaagatagtttgatttcttatagtttgattaaaaggtctttctttgatcctctcttctccccaaggatcgaaacatgattctgggcaagcatgggttctttgtgaacccttcagactctgtggctgtcattgctgccaacatcttcagcattccgtatttccagcagactggggtccgcggctttgcacggagcatgcccacgagtggtgctctggaccggtaggtgtctccattcccttggccttcctgtcttaggtcgtcccagtcttcaccrtacccttcactgtgcctggaacacgtgtccttccctttcagcatgggcatctgatgcatagagtgtgctgagcgattcttgtgtgaggggatggttggctttttctggattcaatgcccctctccgcactcccttggcaccctgggcctcctcctcctggcacttaccacactgtgttctagtagctgttttcttgatgggctgccctgctagactgtatacttctgcagagaaaggactgttttgttcaccatctggactctgcctgaccatagcgtgcctggcacatagtaggacaaacacacacacacacatacacgtataattttttaaagttaatgaatagttgagtgttaatgaataacaatggaagtactcaagacatcattctggaggatcacttttcttttgcagtgtgcacagagtgtgggtgaaagagcagtttgaagtaattttagagtttcaacgactggatcgctcttgcccacacaaacacagtgaatgtttatatatcacttcattgtacaaaggctttgaggtggcttgttagatcacacttaaaaagttgaaaaatgaaagtcataacagatgaggaccagggaaaacattagttagaatatgtcaggtgtgcaggaaatgtttgatgaataaaaggtaaagaatgaatgaatgaataaaaggtcaaggccagggaggaaagtaggctgtaatatatctctaggctcttataataatagctgatatttattgaacattactttgttgtagacactaaatattttgcatgttttaattcatttacttctcagatgaaccccatgaggtaaatgctgtatttaacaccatttttctggtgggaaaaccaaaggacgaagaagtaacttacctgaggtcacccagctggtaaatggctgactcaggatttgaacccagagcctttgctcccactcactgggccatgcagttgttttctgtagaggggagatggttatagaattggtgctgactttgcttcagctaacaagaaaatagccactaatatccatatagtggtttgtagtttgtatagtgtttttttacattcaccatctcaattgatcctcacagcagacctcattttaaggaagaggaaatggaaagtcagggaagttagcagtcttgtccaagatctcaccaccaaattagagctagcatttgagcccagcacgtctaccatcaggtcctgcatttgaaattatgagctggtttgaggtcacactatcatatgttaggcctgtcaggtcctggaataccttctatgtcatccaagaacagtgtaattccaatttttggaaaaattgataatccacatatagaatcacaattgaagtacctcattacccagataaaagtttattgtactttcatagttttcaaaatcatagatttgatttttcctcaaatatcagaatgcaaagctgacattgctttcctggaaataaggcaaacattctgggaagcaaatctcgctcaaacagtgaatggaacttatcaggtaacttttcatgttcaaagggaaaggaatttttttttaagtcactcagaggttttaaatagtttaaagatacctagagagaaataaaagacgtgttagaagggaaggggaaccactaatcagtgtgggtgaagccagtacttaggggagaccccactgggcgtttcccctggggagacttctgatgagacaaaagcagcactgaccagagagctgaatactgggcggtcggtcatcctggctttgtgacctttgtctgatcacataacattctgggccctgtttccttctctgtaaaatgctaactgcccagacccagtatgtcatgattctgtgattacaggtgcatcaaaacatcattcttctcttctttatagattgattatagatgcagtctgtatccaaaatgtggatttaaatagcttaaacagcagccctgaacattttactrcggatgcttcttctaaaatattaaactccatgatctgaattaattctttcttcttccgccttctctgaatccacatataatagcccattgtgcacaaggtttctcttatgattttccaccaatcttagaattatgtatgactctgagcaatgctaaatgggacccttgattacaataacgattgcccttttccgtccctcacrtggcyacgctaacagtcctgctgtgatgtaactttgatttcatgcctttgaagggtggctagtgctacaaagattgctttgtatgagaccccaactggctggaagttttttgggaatttgatggacgcgagcaaactgtccctttgtggggaggagagcttcgggaccggtaagtcacactcctgtgctagcattttcctccctgtaaccactatttccagtaaaagcttagactgctaaggyagcactgaaataccaacggtagccgatgtgtcctaaatcaaggcacaaattatttataacaaccctgatgaaatgtgcacatttgaaaaggggtgagcacattcagccagaaaggctaattttactttcagaggatcatatcgactcagacaggaagttggggggcctcctcagcagcgtggtcattgagtctgcagggattaaacagagcgataaacagatttttcttccttcggtggtcaaagaaacctttataaatgttttcatttctgagaagaaatacggtggagcaagtcggttttttgtttttatttaagaagaggtttcagcacagcattaaatctttctcttttataggcccaagttttctatagcagagtaatcaaggctaaatgaaggaagaccatgagggtggaactaagttgctaggtgatcaagaaattaaaaatacatcgttgtgcctgaggatgtttgtgtaattgtattaatattagagtgaaagaagggtacatagtattctcaggggatgaccccagacctatagacctcactctctgcgctctccttcctcctctctgcttgtccaaatattgacccgaactcccacctccttcacgaccttctctgctacctcatgctgcctgtatcagtctctctttcctaaaagtctgttcaggtgtgtggccctgtcccatgtatcagtctccggccaggttataaggtagttaagtgactgcatctcttctccttttattccctctacccaatatttttaagtaaatrtgctgatcttggtcctatagtactctactgtcaccctttagtgaagaaaagaagatcaaaatcaagcattctctcagctttgcaattgagttgcaattcatgccaggttaaacagaacagaatactgacttcatttcctttcctataagtctggaggtagagcaggtagaatgagctgctaaattggaggcacatatttacagagttctaagcaacttgatattttcgagagtggtaatattccttggcaatgaactgccttgatagaattggaaggtatgaagaaggctggatgagtcttggggttgaacaacttccacaacaaaggctagacagtttcccaaagttgtgggtgtttaaatcagagattacaaggccactgcttagtccttttctacttcatataatgggcatggtgccatgctattctgagggatactacatgartgcccaatgagcctatgaggtggycttctcccatgaaactccccacagggtcatctagttcaggcctggcttcagtcattctttatgaatgaagatgtctttgaaggcagcaactgtgtcaaaacctttgttttcctgttctcctgtaccagtatcagtgttgagcctagtgaaaagataaaagtctagagtcaggtttcccagagcatgtgagtatgtggaagaatactagttccatgagagggttctaggggtcaagaaaaattggaaaaattggaccacacttctctgttttggatattcacaatgatattagcatttgaagattccagaacattctgccataaagaatcctgttagtacagttttgcctaaatatagtttaccactayatataataattatgatgatatgatacaatatcatcaccacaataatgattattattattatcatttcgtagtatgtacagtaacttctttttccacagacccatgtgggaagccttggtcaagagggatcagagccccagagccaagtaggaatccctggtgctgacccacagggaacaggcctgaagacaggatagcacaagctgctcctcttacacaacaggccttcaaatacaagaagcagctctcaggtccttccttcttcaggccgtccatctttgtttcctccagtcattcctcatttcacattgtttatagactcagtgccagactctaggtgcttctgagtttgccagtgccactcttagaaggtgatgcccagaactgagcccaaatcttccagggttggcctggcaagtgaagagtggggtgggatgattatttctagtgattaggacactgtatttttcttgacataactttcctttatgttagtttttaggaagttgcataatactgtttagcccacataaggttgtgggtaattaaacccttaaagtttttacctagaactatttgccaagggaagtctctcatgttatgtttgtggaattgatttctttgaaccaaagtattagactttagactaytgttaaagtttgttctcatttattaacacattcaacaaatacctagtaccaatcatggttttagcttctccttggtatatttcatgtccaaagagagaatgctcttcattatcatgaggataatcacaagctctttctctctctctctcttcaaaaaaagaaaatttttgtgtaatatttctgagataaacatttaaacagccaggctgcrtagccatagatcgctgttgtgaacgagtgcagctgggcttatttaactgaactcctgatcttcttatttatagaggagttaatttttagcaaccacgccccttgctagtgaatgtttccaacagttctttcatagagtttctcagggtagacattagtgactctatgaactttgaaacatttgaattctatagcttaattgagcacagagtgctttatttctgtatttttccaggcgataggagagacaatttctyaaaaacgtttccttgacctttcagagtgggccaaatcccctgattattggctcttgtggcaccatgtacctcttctttgttgtacttgttgcagctgtgattttacaattacttatggttatttgattaatgtctgttggctgtatatgccatgaggacagagatcttatgtgtcttatcctgcattgtgtccctcgagcctcccgyagagcccagcatagaacaggtgctcagtaaacgcttgttgaatgagttcatgaacactattcacttggcaccttccatttagacagattcctgctattggaaaagaaagaactttaaaaggtatctgatgtaaattcytgtatgatgctggaaccatagtgactggtcactgctttctggctgaaccacccacctcaatggagaatccacacctcacctcttgccgtagtctgggacccttgtaatgactcaacaccacttccactccacagtccagggttgggaaccccagggtctttgcgggaagaaatgcacttttacaaaagaaaagaagtttgcttgcaaagaggtgcaaaggagtctaacttcaggactggtccaccgagtaaaacaaaccactarcatctgcagaacaatcttggaatattactaacattatacattagtctgtttgtatacattatacattagtctgtttgtgctggaggagcagcagctttctcacctggatatggtaaccacagaagctaggtcacttacttcttcagaggtcagcattacaaacaccagggataaatggggaccagaactggacaggataagcctgttgttgtttgttgatctcatggtacaaagctgttttttcttcctaaccgtggatgattatgtacatgtttatacacaatggtagagggcagactgtcagttccatcccaccttagaattgttgggactttgaaagtgaagtcactgaatagtatacaataccatgcatttgaacccttcctcaggaaaatagggggcttgggaaagagcgatgggaaaccaggttgatgatgaacttggtatcacttagagatatgtaagttatgatctggtcaggtctagaggctagcaatattttttccctgtcctrtctttaaaggttctagtgctaatgtatcatacaggagtgataacttaaagaaatacagcattaacactttgcaaatttcttttaatttttagtttcwtatgaaaagtccttcatgtttgcacattttgcattgattcattcctcaaatatttattgaactttgattttatcctggatactgagttagactctgggacacatggtgaacaaggccttctcatagagggctccatgaattacaggtgtgcaaagcaatagaaggtgaagtacagggrtacttcgggagctttattctcagggtgcctaacttggttctgtggtgtaggagatcagattttctttctggctttctgcccattctaayttgcatagctactgagtacatttccctgtaggcaaagcccacaggggaagattgtagcaccccatgtctggggatagcctagacagaatacgccagtagaactaggcttataccctaattataactcactcatttaaagtgttacctgcctgtctgtctccctcacctgtatgtctgtgctcatctgtgagggcaggggatacgccttgtgcatcttggtatcttcttatgtgcttggtacatgctggcactgattcacatttgttgagtgtaaagtgaagtttgtgttaggacagagttcctgcttatcaggcacttaaactaccttcttccaaaggcaccttatggaaaggaaaccaagttccaggggcagtaatgaggcaggtcaggcctcattgctaagtggaaggcctgacagttcctggggccagcctcctggggactggagtggtctggagaaggctttctgaggagctcaccttcctttccaagygaagttgtttgtgcagtggaagaccaagaggacaggactgcagacacagcaggtcagctgagcctcccagccagtcaactggggcccggccattstttgggcagactgtcttaacaactgactttgggccaacccctgtttggggagtacaactcatagtctaggatacggcgtgatcacagggagtggtagaagcacagagggcatggggagggcatcctggataagactgaagttgaaagtaattgcaggacatgttagccaggctagtaggtgtatgtggaatgggctttccaggcagtgagaactgtatgttcagggggctggaggagagagagaaattgacagaaaaagaaagagacagacagacactggtactttcagggaactccatgcagctgtttttcagctgtcatgcccccatcctcaggcctgtcacctggcaggggcagaagccaggacagctcctgagatgcccatactggtaaatgtaacccaatccctaaactgttagctcttggctccctcaggaatggttgacatttttcttggctgagacccaggatgtgccctggctgagccgagtatgtgcttatcacaaggtgctgattaggccgaagtaaagtgacaggtgtttgaagatgctgaaagggtagaattcctgtccctgagcggagcaagggtgaagagacccagtgcaaaacccaccactgtcttttgtgccagctgggactagaagtccttgcccagagtgttttacctttctcacagttaaatgagcttggcttcattctctttctaaaattaaaacataatgaaacaagtaatttatgttcattatgagaaataaggaaggaggaaaaaaacactaatcccagtgcccagaggaaagagcatattaggttatattcttccattttcttctccaatatgtacaatcaaggagcattatttttaaaagcataataaagtcagtggaaaatgtaataattttccataaaagccttttatttttccctttattcgaaacagtatctagtagttacattacacctcacaatgtataaactatttctacttgctttttcgtagtaatttctcacagttatgagagagaagttagcattatttctgttttgcagttgaagaaactgaggctcagaaaatgtgatttgtccaaattcaagtagtttacaagtaacagagcctcaaattcaggtttatctgattcttaagtatcaagctttatctgctgagccacagaaaatgtgatttgtccaaattcaagtagtttacaagtaacagagcctcaaattcaggtttatctgattcttaagtatcaagctttatctactgagccacaactgcaaaaagaatagctttagaaacacgtacctgcaccattggtattttccactggaaacttggcatcattcatcagaaccctgaagaaaatgaaatttgctccaacttcctgagtattaattgaattacctggaatttttgatacatccaaggtgattagtgatgaaccagaatatccaaagaggctgaggattatgcaattggaattggatatttgtttatgttacccagggcaggtattttgtttatagtattaggtgtatgatttagttatctccaagtaacttggccagagttgggtaagatttttagattttattttcatttccacataaaagaaaaaatcaaattccttgcttagggcaggaaaagccacaaggaacactgccttctatgctttcagtctagccaaaagagaaaaaagaaaaaaaaattaaggagaaaaagaaggaagaaaaaaacccagtggggcacagacaaataattccaagctgtatatgctgtcatgaattcccaatatattagggaagctgccagaatcttgcttctcaggatgaactgttgccaaaacatatcatttgcaaaagccgtaagagccagagagctttttgctccttaaaatagcagtaagggcaaataaaagtctaaagatagtaaaattaggtaaacatttttaaaatatgttatataaagcactaaaaatattgcctactctctagttttgcctgcatccgggttttgaggactgttaacttctaaaagtagtatcctattgaagagaaaagtcttttgaaagaaaaagtcatgtttttttaagaaccaaaaatagaaagagaaagtgttggagtaaattgattggttgattcattcacacagtctttcataattagttatttaccgtattccttgtgctatgctrgtcaccagacttaattacaaggataaataagagatgcccgtaagaagcacacagttagtggggagaaaggctcacaaacagatggttgagactcgaggaggctgatgccaccccagatgttttgtgcaggttgctacaggagaagaaagagaagggagttcatgactgcctagggaagttgggagctagtcttaaaaaagagaggacatttgagctgggtctgaaaagatgaagagaggaaggaaaaacaccacgtgcctcctgcatacccagcatggtgctagatactctaacaattccaagaagaataagaccagygggaagtgcagtagggcaggcacataaagaattcaacataggataatgtgagagcatgattatagagcaattgtgtacagttctattcagaaatcagaaaataaggctccatgtagactgctttctttcagaataaagagtttaaaggcaaaaaaatgagagttgtgttccatatcaggctcttggaaaagggtgtccatgcatataagcacatcctcccgagaagcccattttaaaattttgttaaagattttagcaaggaccttagcaggagacagatgtctcctttaagagacatcattaaggtttgtttaaccaaaccttaatggttaaagaacagtgtcttggagttgctggatccatgagtaggtccaatttgaaggstttgatccttttttgccaaattgatgtccagaaggattgtgccagcgtccactcccaccagctctttggtggaatcccgtttcccttttattctcctggcactggctgttcggatttttacacttgtggatttttacaccttttgtcaagcaagtagcagtttctcattgtggttttaactttaatttttcttcttaaaaataacaccagctttttattatactaattggttgggtgtatgtgtctatgtgtattgtttggcaaatcgcctattgatatccttggcctgtttttctattgaaattcttttttcttattcatacataagaattttttctatattgaatgtattaaacatctgccttaaaatatatcaaatgtggccgggcatggtggctcacgcctgtaatcctagcactttgggaggccgaggcggatggatcacctgaggtcaggagttcgagaccagcctggccaacatggcgaaaccctgtctctactaaaactacaaaaattagctgagcatggtggcgggcacctataatcccagctactcgggaggctgagacaggagaatcgcttgagcctggggggcagaggttgcagtgagccaagatcatgccactttactccagcctgggcgaaagagcgaaactccgtctcaaaaaataaaattttacatatatatatatagtatataaatatatatatatatagatatatatccacttttaaacaaccagatctctttaattttttaaagtttgtcaatgggcttttaattttgtccatagtagttttacactatagaaatgctgatttttaagtagataaatacatcagtgttttcttttatgaataccgaatttacattatttatcacccctaagatttatatatataaatatataaaaagacatgtatattaatataatatatactagtatttaaaagctttcaggttttacattcgaatttttagttcaactggaattatttttgttatggtgttttatagggaagaaaacaattttttaaagctatttatccagttatccaaacgccatttaaaaagtaatctactcttttcccacagccttgcagtgagacctttgtcatactcaagcctcwtgtgtgcttggatctctttccagatgcactcttgttctattaagctaccagactatttgaattattgaaattttgtaatggtcatgttcttctgctgtttgttcatttaagatctattgtgttttctcttcacattaatactttataactgatatatcaaattccacctaattatctcactgacatttttattgacttatgccttacatttctaaatcactttgggaagcatcaatttcttttcagtatcatgttgcctacttaatatgtgattcctcctgtatacccaagtcctcagtcaggcagtgtgactcttttatttgggtctgcacacctactgttgagtactgtattagtctgttctcacactgctataaagaactacctgagactgggtaatttatgaagaaaagaggtttaattgactcacagttctgcaggctgtacaggaaccatggctgggaggcctcaggaaaygtacaatcatggcagaacaatgaagaggcagccggcaccttcttcacatggctgcaggagagagagwgtgaagggggaagtgctatatacttttaaacaaccagatctcatgagaactcacttactatcaccagaacagcaagggggaactttgtcccccatgatccaatcacttcccatcacgtccctccctcaacatgagatttgggtggggatgcagagccaaaccatatcaagtaccttctcaggtactgggagaaagcacgtttcttacagcagcttgctgtcccccctccaggttctgaccacatccgtgagaaagatggactgtgggctgtccttgcctggctctccatcctagccacccgcaagcagagtgtggaggacattctcaaagatcattggcaaaagyatggccggaatttcttcaccaggtgagcyacagcccagctggggtacaaggtaaggtggggaagtgggcagagagaattcttgcgcatccacagcctctcctgtcttaagtgctaataaaaccctagktcatccagcctctctcaattggagactttaaaaataatctggtcagggatgaaatgaagtcaatttttatgtcagccataaagagtgaggctttaaaagtttagctaacataatcaaaagaataaatgctttataagcattttaaatgtgtccattgggtggacatgatcataacattggatttggattcagagaaatggattagaattttatttcttccccttactagaytggggagccatttagcttttctctgtactcagttttgtcatctgtagaaatgggaataacagtccagctgttgagaggattaaatgaataatgagtctgaaaatgttttgttaactttggggcactgaaagcctagaaactttttttcataaattatagaaacagttatgcttagtccacatcgacttttctgccttgtgaaataggtccccaagggctatatacttgtcaataatttttttaatttattcaacagatatttactgtatacccgatttccatcgggtacttggaattcagcagtgaacaaaatacttagaatacttagtaattattccttatcatgcgtacttctatttttaaaaagcattaaaaaatttttgacagtagtacttttcactaattccaatttgcctttcccccagttagtgtaaaaatctaacaagaatttttctggacctcagtattccaattatagagagaaaatatggtaaaaaggatattagatgaattgtttatgtataagaaatgaataggtgtaatttctctggacctcagttgcctgttctataaaatgggtgagttagactagagaatttaaaaaatatatcccagattttatagtccgtgatctctggatagtcaagaaagaattcaactaagtaaattaagctccttaatcagaattattttattaactttggacggattcattgatctctttctctctcacgttactgttttgtggaaggaataagtaataactacctgacaccacacagtagccctgggaaccaaggcaaaaaaatccctactttataacagacagaaaaacctggtcattcagaacagcagtcatgaactgtctagaacctagagtatcataaaaacaaggccatgtctgtttttgtgccctaagcacccaactcatagtagagactgcataaatacgttttgaaccgataaatgaatgagttaacaggtgaacaatagccagagtagaataaggttaggaggggttgttcagagaaagggtcacacccttgaattagtcacaatcctccatataaaaactattttaacatgattttattaattatcaaatataattgctaaccaagtattacaaatcaaatccttagtacctgcatttatgattagttaaaactccattataccttccacttactgaacaaaagcgctaggcacttttgcatgcattgtctcactttagcctcaaaacagttattgataaggtagctgagattctgagagatagggcagctggccctgtagtcacacaattaatagccaatagaggctggattcatagctcatctgtctgattgcaaaacccagactcttctattccacccctctgtgcctagggtttagaaaacatttctctggagtacccagaggtcaaaaatgtaaagcacaaacacctggttgtaatttcttgttgtttatcatgttaactaggggaaagagctgactttaagattaaggggactgtttggcccttgattcatagaatcctggagccagaataggctggccttaattcctcagcatttctcatgtctcagaggtgtcatcttgcatatatgatatctatttcacgattacaaataaatatagactctgctatcttgagcttctaaaaaataactctctcaagagggtgtatgccactaggtcaagaaaagccacctgtacaagtctttaacatcataagaaagaagtcaaaaagaattcttgaaggaaaactcatctttatagaatttcatttgtgatgcacttttttccttggccctttttcatccgcactgggcctcttctgtcagggtgaacccaaaggaccttggaccaaaatccactgccactgaaaggagggaggcagaacttaaaataaaacaaaatttaaaaaaaaaaattgggagagcatcaggataaacagctaatgcatttggggcttaattcctaggtgatgggttgataggtgcggcaaatcaccatggcacatttacctatataacaaacctgcacgttctgcacatgtatcttgaaacttactaaaattaatgaaaaaaaaaaaggcattttagatgtaaagagtcagtgtttggcgtcttcatctggtcggtgaaaacttggccctgctttaggaagctcctgtggagctggaactctgcttagtcaaaatctcagcagcctcaggcaggtctcaggctgggagcaggcccagcattcaccccagagaagcccagggagcttggaggagaagtgcctgagtcacgtgctcctttcaagagagttctccagagataacattgcttttcattttacctcctcaggatgtggtgactaaatgttagatagcatctttcaaaagcctttgaaacatcttagagctttattctgtagaaatgccaagatgggtgttttctgcttattcagaagctcataacccttccctgaaatcctccaaacccttcctttcatccctggcctgttccatccccagtgactgacaggcctgtattttttttgccagcttcttctgaagttagatagttttgcgggagggccaaacaaatgatgaagaaagtgctgactgataggccttggtgtgatctgcagtcagcccgtgggcctcaacttcgtgacttcttccaggtatgattacgaggaggtggaagctgagggcgcaaacaaaatgatgaaggacttggaggccctgatgtttgatcgctcctttgtggggaagcagttctcagcaaatgacaaagtttacactgtggagaaggccgataactttgaatacagcgacccagtggatggaagcatttcaagaaatcaggtagaaacagacckgtgtgtaagtgagagagagacctcagagcttcatctctgacatctcaagggaaaaattaaaaagttcctgttggctatttttcttttgctgctgtgtttttctagggtagctgttcttacctggttttctgctgtcccacgtgactctcacatgcactcgttgggacagtggtttatgcccttgttctgtgcactgtccartaccctcattctgggattcttaacctggactccagagggatttttgcactctctggaatgatatgcaagatgatgtgtccattgtacatgcagaaaggagccccagaatctaagaaagagggagaactgtgggaacttagatgtcaactcctctcttttctgtcagcagattatrgcagagtgacagcatgtaagtggcattatacttatacgtttctctcgtatgttctaatttctaaaggagagaaaaatagatgaggcattcccagacttagaaacgttgaccatcgtcattcgcagcacatgagtggcaccccacctaacacagcagtacctggcaagacgccacagtttaggacctggagcatctctagatgtggacagaattgttagtgcttcccttactgtgtgccgggtaccctaggctgcaggctgggtcaggctttctcctggcttctcatgaacacttacgcmccagggttctctcacctctgcttctgttgcctgttgkcacagagtaaactcatctctcacaattcataatagaataaagagcaggatgaagattctgttacaacctcccagtttacttttttccaattgacccagatttttggcctggtccttgtcaaggcatctcatagggtttggaagggccgggccgtgggatttactggaggcttccctctggggagcaggcagtgaatggatggatgggccacagcaaccctcagtgcctggagtctcccctcctcaacttctagcacaagtggtttctcatccttgtgcctgtttgccatttgtgagaacttggggtccagtttggatgattgtaaattatgcctgagataattagaagagagacctgtggttgaggaagaaaggggtgtagaaaaggagtggagctgagggatggcagagtgggacagaagtttgtgtcattaagccttcagagacagaagggaagtcaaggaaaagtaaatcccagctctgcagtgcctctggcatctgccaggagggagaagaggtgtaaaggtgtgtataggagacagtggcctaagcycgagagctgccctctgtgctgtaaagaaagcagctgccccactttctgtaatcagaaaatccaagcattttgatgtgagaccagataggagggaaaaatatgatccaacatatrtagatagaacatctgcaatctagtgaaaagaattttagaggcttcaagttgaagctgtgargaaaggagaccaaccctggtgtgttcctagaaagcaagaaatggtcagtgaaaatggaccgtatccttcccatagtgactaactgtggcatatcctctgtgtatttcatctactgtcttcactaatcagtgctaatgaatggcaccattaaacaccagatggggattggtgacgaacagcaggtgaagagcagcatctttttggtcagtctttggtgttatgcaaggttctcctttttacagaggatggatagactcataaagactgaagagtcctcaggcaacttctgtcccagccttcttccctcaggttgggaaatatctaccccagagttcccacacatttttccccaagtgagaagataattgaygtccagagataccgctggggaggaaaaagagagggcagcagagagaaggatgggcttggcacttcacacggacctcgctttgggtccatcagggattggcaggagattggccactggctcctgcttgttaggttgggaatagccagtctctgccatttgggacctctgacttcctgttctcttttgaggacctttgctagtggtttgtaagagtccttcccctcatctgcctgaaacctcttcagctctggtttcagcccctttggtccatgtttccctcttgatctgggggctgaatttttgcatctagcagctttatgtgcttcattattaagcttcaaactggaatggttagtccataaatcacagggaagtggggagaggagggaagccctcacatcacccagcatcactgaggtcaggtctcccctgaccctggaaatgcttctcccaccgtagctaagcccccatcagctggatgcagagagggtgacggaaggcaggctcacaaggtgcagctgctgccatttatcaaggatttaaccctccartgawcaagtatggatgaaattacatccccaaatagacccctcataatttgccagccttcagtctcccagcatttggggaaaaaaatctctgcttatcttttccagggcttgcgcctcattttcacagatggttctcgaatyrtcttccgactgagcggcactgggagtgccggggccaccattcggctgtacatcgatagctatgagaaggacgttgccaagattaaccaggacccccaggtaacgccyagccctgtgccctggttagttctttctgttcaagggaatgatagtttcccattgagcctgtgtttcaatgcccatttctcaaatgactcaacaaggtaccagctgtgcttactttcttccatgtttctttctccatgtcaacattatagataataattataataataaaaatagggaggctgaggtgggaggatcacctgagcccaggaggtcaagcctgcagtgagccaagatcacaccactgcacttcagcctgagcaagagtgagaccttatatcaaaaattaattaattaattaattaaaaataaaaaattttctgagcatttatggtttgccaggctgtgttgtaagcccattatgaaaatatactcatttaattctcaaataacttagactgttattctccctgctacagataaggaaactgaggcacagaaaagttaagcaacagttaataggtttacatgcctagtaaggataatgaatctctctttttttttttttttttttgagacagggtctcactctgttgcccaggctggagtgcaatggcacaatctcagctcactgcaacatccaccttctgggctcaagcaatcctcctacctcagctacctgagtagctcggattacaggcacgtgccaccatgctctgctcatttccttttttttttttttctttttgtagggaggaggtcttagtacattgcctaggctggtcttgaattcctagcctcaagtaatcctcctacctcagcctcccaaagtgctgggattatatgtgtgagccactgcacccaacccaggataattggtctttaaatcagcccctcatctggtgttctgctctgtctgcagcattttgttgctttgtttggtctgatcacctgcttgggcagaacacaccactgggtcttagatttggtgggggcagggagaggcagtttcatgtgtcttcacagaacagtctgcagacctgcagcttggtaagctgggttcctcagccattcccccaaaagtcttcagaagtatatcagagtaaggagggactctgggagcaaagggtgggacagtgaacttgaaggacaacccccaaaaatggaggagccaaggggaagcagtgaaggacaggacagtttctttaagtgtttttcacaatccttatctcaaccagagctccatagcttaaaaaaaagttggggaagtgttgtggtatattagccccttcttggtgattcacagcatacaatgcaatgcaccataaaggctccaagatttcggacatggtggcctrcacctgtggtcccagctactcaggaagctgaggcaggaagatcacttgagcgtaggagttctgggctatagtgtgctatgcctgtcgggtgtctgcactaagtttggcatcaatatggtacctcccgagaggggaaccaccaggttgcataaggaggggtgaaccggcccaagttggaaacagagcaggtcaaaactcccatgccgatgagtagtgggattgcacctgtgaatacccactgcrcttcagcctggtgacatagcaagaccccatctctaaaaaaagaaaaggaaagaaaaaaagagggtgctgagaagacttgcagtaaaggtgcctgtttacatagcatttgctgaaggacatttctccaaagaaaacatacaaatggccaacaggcgtatgaaaaggtggtccacatcactaatcatcagggaartgaaaatcaaaaccacaatgagctgtcacctcacacctgttaggatggctgttctcaaaaagacaaaagataacaagtrttgggaaggatgtggagaaaagggaaccatcagacactattggtgggaatataaattggtatagctattttggaataaccaaaatatggaggttcctcaaaaagttaaaaatattttagtactaatatacgatccagtaatccctcttctgggtatatattcagaggaactgaaataaatatgtcaaagagatatctgttctctcttgttcattcaatattattcacaatagtcaagatatggaaccagcctaagtgcccatctacagatgaatgaagacattgtggtgtgtgtgtgtgtgtgtgtgtgtgkgtgtgtgtgtataccacaatggaaaattattctgccttaaaacaacaaaaaccaaaatcttgccaatcttgccatttgcaataacatggatgaacctggaggacattatgctaagtgaaataagccagacacagaaaggcaaatactgcatgatttcacttgtatgtgggatctaaaaaaagtgaatctcatagaaacagagcagaaaggggcttactagggggtagtgaatggggraaatggagagatattggtccaaagggtacaaaatttcagttatgtaggatgtagcagttctagagatggaatgtacaacatgatggctataatgaataacacttgaaatgtactaggagaatagatcttaattgttctcactatcaccaccacaacaaaaaaggtaagtaggtgacaagattgataatgttagttggcttgactctagtaatcagttcactatgtatttgtatatcaagacatcatattatataccttaaacataaacaatttttattaaaaaattgaaagtaaaataaaataaatagcatttgccatgcttatttttccacaaaggcttttttcttttaacacctaattaaaatcctgtgaaactcatttggaaacccctggcatagtggttttgagcaaagttaaagagatcttgttttaaattctwttcctgccacttaataactgtgtgtccctgggtaagttgttacaattttatgaatcttggtttccttgtctgtcaaatggcagagtaatacctacttcatctagttgttaccggggtttaaggagataataaatgtaaaatgtttaaacactgtggctggcatataggattaacttttcagaataagcagcactcttagtttttttagtctaaytttaagtgtaacataatgctattataaccatttttaagtatatagtttagtaatgttgtacrtattcatattgttgtccaacgtatctctaaaacttttttcccccaaaactaaaactctrtacccattgaacagcacctccctgcttctcccttttcacaatccctggtaccacctttctccttcctgtgtctgtgaatttgaccattgtaggtacctcacatgagtagtatagttgcttttattacagaaagtgggagatgagagaatgcttcacttttacattttttccagtggccaggccccagtttcagtcatcaccagtaccttgttgtgttgtaggcatccctaaaacttcaaccaaaggcaatggggtctgcattatagacacttaatagcacaagagaaaaggaagaaggaaattgtgtttgtcttttgatcatcaagataaatgcctggcacgtggtagattcaaagagtgaatgaaatttgtttcctctgaaccatagtcctcagcaggtggaatggcagtggatggtgtgaggttcccacaatgcccaggtgtatcaccatctagccggggagctgcctttccttattctgcagctgctaggccatcagcactttgtggggactgcccaagccctaaggggaaatgtggtagtttcagcaggtggagttgattctccttttccaggtataatggatcrgtggagatttagataagaaaaagtagcaktcagcagtagaaaatgtactactcctggctctgctattgagtcatttagtcaaatcacttcatctctttgggtatcagttttctcatctgtaaaatgggcagttmaaccagattagtagttttttttttttttttaatattgaaagcayttattaagcaacagaattctctcttttttttttttttctttaagcgagaagtagatgtggggaggggttgttgcatttttaaagattcctgtattaggccgggtgcggtggctcacgcctgtaatcccaacactttgggaggccaaggcaggcagatcacctgaggtcgggagttcaagaccagcctgaccaacatggagaaaccccatctctactaaaaatacaaaattagccgggcgtgrtggcgcatgcctgtaatcccagtcactagagaggctgaggcaggagaattgcttgaacctgggagccagagattgtggtgagccaagatcgcagcattgcactccagcctgggcaacaagagtgaaactccatctcaaaaaaaaaaaaaaagattcctgtattagtctgttttcacactgctgataaagacatacctgagactgggcaatttacaaaagaaagaggtttaattggacttacacttcacgtggctggggaagcctcacaatcatggtggaaggcaagaaagagcaagtcatgtcttacatgaatggcagcaggcaaaagagagaaattgtgcagggaaactcctgtttttaaaaccattagatctcatgagacccattcactatcatgagaacagcacagaaaagacccacccccatgattcaatcatctcccaccgggtccctcccacaacayttgggaattatgggagctacaagatgagatttgagtggggacacagagccaaaccacatcagtcccattgggwacagtrtgggaaagaaattggaagatgcacaagtggatgtggaggcactcactgctccaggtaagagacaggacattgacttagcaagacttaacagcaggagagwggagagaaaagggggccatggagagagatttagcggggaaaagtcattkaggcctgctcatggactgggcatggggaaaatgcagaggaagatgtcaggagcaactcctagttgttcactttacatgaaagactgtagtgtygatccactgaaatagaaactgctggaactaggtattgggggaaataacatgtgtttgtttttggatttgtggagtktgaggagccttggagacctggaagtaggcagtcagacgtacgggtttggagctaagcatctgtgtttagaggaagtgatggaaaakcttctctctatgtcttcctcaggtcatgttggccccccttatttccattgctctgaaagtgtcccagctgcaggagaggacgggacgcactgcacccactgtcatcacctaagaagacaggcctgatgtggtaygtccctccacccccrgacycatccaagtcatctgattgaagagcatgacagaaacaaaatgtattcaccamgcattttaggatttgactttttcactaaccagttgaygagcagtgcatttacaaggcactgccaaacaagatgcccttgggagctgtgagggaaagaggacctgygggcttagatcaatctcaattccttttcatgccctcctgcattgctgctgcgtgggtatttgtctccttagccatcaggtacagtttacactacaatgtaagctataggtggagcatcagcagtgagtgaggccattcttcatccttaggatgtggcaatgaaatgatggtgcaagttcctttctcttttgtgaawctttccccccatttcctgtttacatgtaacccaacaaaatgcaatttctagtgccttctgtmcaaycagttctttcctctgagtgagacgtacttggctacagatttctgccttgttttgcgacattgtcccattcacacagatattttgggataataaaggaaaataagctacaattgcttgtcgtctttttttcttaactgcaaagtacttttttgattttagaaagaaaaacaattttttttttagaaggaggggagtattgtattttgttttcatgtcctagtcagaaaatgaaatggtctctaggctaggttgcaaatccttagactcaagaactrtaattttttttattgtcctgaatattctaaaaagtaacataaattttaagagaattgtaatttaaaatcttagcagggtcaactgagctctggattcttccaaggtagacaaatcaagcttgacatggttaacttggaacaagggaaaggaagagtgattttcctcttcctagtgcttaaatagcaaagcactggtacgtgctctgcagtgcggagatgccttgacgcttattgaagggatggaggcagaaccctcagaatctgagagcagggttactgacatttggccaaaaatctgagcccactggcatcttattcagctcagaacacttatattccatccatgagtatattatagttaaataagcgtagacttgagagccaacagacccaagtttgaatcccacttgagaccctgagtgacttttgaatatcattaccctatccttaaagtggggatgaaagtagttctacctttatgaattgttgagtaccttaagtgagtacatttgtgtaaagcagtgagcacagtatctagtgcatggtacattgttaaataagtgaaaactagaattatgtttatgataccatttttagattttaaagtactgtatatacaggaaaaacaaaaactgtaacactaatatttgtaacacattttacatttccaaggtactttcacaaagtcaccttgccatatgggctattctaaaaagtcagcccagctctgtacccctcccctactcagtatggactccctgatacaggtggcaggatctttatctggggtaagatttccattgttgccagctcagcaaacaaaactatgctttgacaatgatgacaatgatggtggtggtggtgatgagtttgtctggaacgttaaccccttgccaggcactttccatatattctttctgagcgctttccatatattctttaaatcttcctgacaactctgaggtaggtactctgaatattcccattttacagatgaggttcagttactcaaccaagatcacactgctggggagtggtagatgctcccagacagtgcagctccagccctacagggttcaaaccacttcagatttcttctacggactgtctacttctaggctacacctaacgtggaagaaaggtgtgcaaatgcccctgtgctttacgcattaaagggggatactgtgtgctctggatgccaaagaatctgttattttggcattatattagctcctgcagagatctggatatctggatgtatcagtcagcccggaaatatgtattgatccacattaagtgtgaggtgcttgggaggaagagctgtataacacagagcccatgccatcaagctgcctgtaagacttgccaggggaatcgaatctagcacaagtagaaactgtatgggataaatgttatgagttgtgtaggtaaaacctacatattctccaagcacctattctatctcagatgttgggctagatgctttccagtaaccctcgaagcaagacatcattcttctcgctttccagttgaggcaactgaagctcaacagaagctcattaatttgccccaggttctcagctaccgtgtgatggaactggaattctgaccctaagtatcgttcatgtttcctgacccttttctgcctcctcatctcttgaatcagctgcggatactcccagttctgtggcccctggaatggcttcaaaaatttcctcctccctgatcgtatttcaactgcttttcctgcctccacttggcaacagcttggaagttaaaagctcaggggaggaagaaggaggtggctggagccatggggcagtggaggtgggtgtgggtagtaaggatcactgtgtctctccagggcttccaaagagatgccgcagtgtgtgtgccccagggagtgcgggagaggagtcctgagaggcgggcagcagcacccagccaggcttccccgccttccagcgttgatgtggtctgtgagtcaggcttgttttctttggggtgtggtgagaattacagtgagaaaattgggttggaactgtttggggcccaattctgaaatttcactttttctctccctcttgacattcagctattctctcagagaagcagtttcctgttcagcgatgtgccccaggcctacacagtggccaggcttccagtggctgggctctgcctcatagggagtgaaagcagaggccaagctcactgtggttctggggagtgtcatctccttggcccttcaaggccaggcttgaggacagggtccctctgcctcctctgccatgctgctttcttcaacgtttcttgttgactcattagaagctggccttgcttataagaattctccagaaaacatattaccatgagtaagaggtgccccccttgtgtttctgcgttctgaacccccccagcagagggggttggatatgagtataacagccttcatgcaggactcactgcatggcctgtgggctttggcgggggcaccccatggccttctggccttcccacttgccccttctgatccattctccacaccaccagctaagtactctttcaaatgttgaagtgcagaggcctttgtgtagcctccaggtccgtgtgactcacctgcctgtcacttcccgctcctctccccctactcacagccttacattccaagcttcagtcgtggggaaccatggcacctccctcctgcccccaggccttggaagctgctcttctttccacctgaatcacctttaccctccatcccaccctccactacattctccacctttcccctccattccaccatccgccatattctcccaactcctacttgttcctcaggtctcaatttaaacatcgtttcctccaagaagtgctttctgagcctccagtgtctggtttgggagctttttctggtgttcctatcacctctatttcccccttcgaggcgcttatcccattctatgttcataacctgtttactttccatttcttctactgccctgggaactcctacatggcagagactgcctttttcaccagtgtttacccaggatctaggcctgtgtctggcacatagcaaaagccccattaaatattttcagaatgagtgaatgaaatctactagttgcacggcagaatgtttcattatgctggaatctccctgacctataaggcaggattgtctcaattttacaggtgacaagtgatttgagcaacttccatgctagtcactggttaaccaagaactctttcaaaaagtgttagaggctgcaagtgagaaagcacccaggagaggcgggcaggagggtactkgcaatagatgggagttatgtgtcatggtcactttgaagaaaatgtttaatttaaatgataaaacacattttatctcccactgctacaaaattaattgggaggtatagttggggaagagttctactgaatacagaaatgagtgctttaaggaacagaatcaataaaaccagcctcaatccccaaagcccccctctgagcagattcacggaaaggaacccatgatgggtaaagtgggtaccctggcactgggcgtcatgctggcatggggatcctcctctgagcatctatttctggaagtctgagaggctcttctcagttcccattatcagaacaagaagcattcccacaagtgtgtcattatccaaaacaagtgaggtcactggcgggagcatgtctcatgtctgtctgatcgtcctatggaaaccgtggagggctttggtttggttttcaccaaatatgaaagctccacctccatccagtaagttgtcattgtgggtgtgggttaataactattttccagaaagcatgtcttattgagtgcagctctccaattaacagaaaggctagttacgagtagcaatctctttgcttctcatgacggtgtcatttcataaaagcttcatcttcattggtttctgacttcatttttacatgatggtaggagtgctattattatcccagataaagcaatggaagttgtgagagtttatgtgatttgtgcagagtcccactaatgatgaaggagaaagcagaccagccacctccaatcacccttggatgtttggatttttttttttttctgttcaacctttgctgtataacaaagtaccccaaaatctaatggtattaaacttttgcatgattttatgatgctcacagactctgcgggtcaagaagccagtcagggcacagtggagatacaagcttgtctctgctccacaatgtctgaggccttatctggtatctttgtctgtttgggctgctataacaaaatactgtaagctggtggttttgtaaacaatagaaatttcttacagtgctgaaggctgggaagtccaagatcaaggcaccagcagattcagtgtctggtaggggcccactttctagctcatacatggtgccttcttgctgtgtcctcccatggtggacggggcaacaggtctctctcaggcctcttttataaagacactaatctccttcatgagggccccaccctcatgacctaatcaccttccagaggcccatcacccactgccatcaccttggggatttagatttcaacatgaattttgggaggacacaaacattcagaccgtaggctttggtcctgggtccccaaatttcatgttcttcttacatgcataatatactcattccaacccattagcctcaaaagtcttaatttattctgtcatcaactcaaaagtctgaagtccagagtcttttctaaatatcagctaaatcagatatgggtgaggcttaaggtgcaactcatcctggggcaaatttactctccagctgtaaacctatgaaatcaaacatgttatgtgttttcaaaatacagtggtaggataggcatagtatagacattcccattgtaaaagggagatacaggaaagaagaggggtaacaggtctcaggacccaggtctgaaacctaacctggccaacaatgttaaatcttaagactgagaataatctttggtttgccatccaacctgctggacatgctggggcagggattgggacctcaggctccagatggccctacttccgtggctttgctgggtacagcccatgctacagctctcgtgggttttagtcaagtgcctacagttctcccaggctggaatcacatataggcggttctactggtctgacagcagctctactagacattgacctagtagggactctgcagtggcccagccctcttggcagccctctgcctgggtcacacacctgaggctctgggtagttccatcctttgaaatcttgatggagggaataatgcctccttggcttgtatactctatgtgctggtgaaggtggcatcttgtggacactcccaaagtttactctctgtgccctctggaggaggagcagctacagagtaccactatgcacttgaattcactagagctgaacttggggcagccaaagagcttggcaaagagcagagccttgaaattgttctgttcccccagtcccttgcagtctggacctgtgaagtgagggggcagccttgatgatctccaaaatgccttcggggttattccattgtcttgcacaataggtcctggcttctgtttagacgggagtctaatctccccattgtctggatgaatagcttctagctttgattgagatggcccctctgaactaacttccttatcaaacttggccacacccttcatgttctctctcaaacaagctttctgattttttctaatatggataggctgagaattttcgaaatttttaggctctggttcccttttggttaacagtttcattaactt

SEQ ID NO: 12333 - DNA, 369478 bp, Homo sapiens
  misc_feature (1)...(369478): n = A,T,C or G, or insertion/deletion polymorphism (see Tables 1-2)
ggcgagccaaagggcggtcctggcactgggagcggcggcggcggcgcggggacaggcgggggtgcggggggcccgggagccagccacttgcccccgggggcaggggcgggcccgggcggcggcgccatgttctgggggcatcaaccctccggggcagccaaggacgcagcggcagtggctgcagcggccgccgccgccactgtgtacccgacgtttcccatgttctggccagcagcaggcagcctcccggtaccgtcctaccccgctgctcagagccaagccaaggccgtggcggcagccgtggcggcggcagcggcggcggcagcggcagctgctggcagcggtgccccagagcccctggacggtgccgagccagccaaagagagtggcctcggcgcggaggagcgctgcccgagcgctctgtcccgcgggcccctggacgaagacggcacggacgaggcgctgccaccgcccctggccccgttgcccccgccgcccccgccgcccgcacgcaaaggctcctacgtgtcggccttccggccggtggtcaaggacaccgagagcatcgctaagctctacgggagcgcccgggaggcgtacggcgcggggcctgctcgggggccgggacccggcgctgggagcggcggctacgtgagcccggactttctgagcgagggcagctccagctacaattccgcctcgcccgacgtggacaccgcggacgagcccgaggtggacgtggaatccaaccgcttccccgacgacgaggacgcccaagaggagaccgagcccagcgcacccagcgcagggggcggcccagacggtgaacagcccactggacccccttccgccacctcctctggcgcggacggtcccgcaaactctcccgacggcggcagcccccgcccccggcgccgcctcgggccacccccagctggccggcccgcatttggggacttggcagccgaagacttggtgcggagacctgagaggagcccgccaagcggcggcggcggctacgagctgcgagagccttgcgggcccctaggaggccccgcgccggccaaggtgagccccgcgcccgccccgccagtggcgccttcccacctaccctgtgcgcggcagggctgcggggccgggcggagaacgggaattttgttccgcgcaggcgtgggagcagcaggcctcggccactctccgcaggcccagccttgggcgcgctgcgaaactgggcccacccgcaccctccagtgagggtttcgaagggaagggaagctgggggcggcgggaggactggggaacttgtgtgctttgtttttgttgatgggaatggggaggagaccggctgagactgccagacacagagacagaaaaggggtgtggagaaagaaagaggaggtaagaaaggaacccagagccagagaaaagcgctcgcccgggtgggcatcagagccccaaggaagaggagaagagaggacagtgtggcctctccctgagtcgggccccagcagtaccgggtccccggaatctcccaccaccccaactcgcagttttccgagtctcttcgcactcccgccttgggaaccacagggttcgttgctgggaagctgtctcgggaccgcgtgcggagcgggaggggggctctcaagctggcagggccggggcttgaggggcaggatgcagccaggctggagtcgttggccattttgaaagtgagtgcgcatacctgtacattcggttcattaaaacacgaatcattaaccggatgcgaaaggcgtcatttatgccgcggacggggcactggcgggagggaaaatgcctaaaaggaggcgggtgcagagggtggaggacactttgaacgcccctcggcttgggagccgctttgtgtttagagtaattttcccgagggcgctaacaattaccctgaatctacaagggggcaagggtgcgccgcgtgcgtcactgtgcccgctcaagtccagcgggcgcaccaacctttgccactccgtcggctttccctcttggccgcggggtagggctgggcgtctttgggccgccgcagggcgccmccctaatcgcctgtcatttctcggccgtcgcaggtgttcgcgcccgagagggatgagcacgtgaagagcgcggcggtggcgctggggcccgcggcctcctacgtctgcacccccgaggcccacggtaacgcctgtcgcggccgctggccactgtaatgggggaaccgcagacagagggccggggtcaaggaaggcctgcgaaggaagacaaggagagagacgcagagaaagagggagagggaaagaaaaataatgaaaacaaggaagctaagctagtactcccaacaacttccaatctttagttacttaaaaacaacagtgacaacgccctctccaccacacgcacacacatgctgcagtacacccagacacggcgttaaacccttaacaaaatcacgcccgacacggccttcaaatcctctcatttattcagcaagtgtgtttggccgcggggtcccctttggctaggccggatcggggcggaggatgggggcacatggccgcgcgcttgggtaccccagaagcgccagggtagctgaggcccatcgcggggtggtgggggccgccctgcacttgcgcgccttaccaggttcctcacagaggaggggttgggggcagcggaaaatcgggcaggtcgaggcagccgaaccccggacgatgtccccccacccaccccgaaggtcgcagcctgggccgcgttctcagcaggagtcgggcggacagacccggcggccacgcgcgctcgcggtgccccagtatctgcgcgcgatgtaggtcgctcgtccctggtgggctcggctgctcgcctagctcttttccaaggggctggggcgggggcctgaagcccggagatgagcagaccaggcrcgggggtggggggtgcccggcccaaagcctcagggcgcgctcctgggcgcacagccgggaaccagaggcggccacgacgcttttaattagggctggggcgccccgaccgcggcagctccggcagtatccgggtcacggtttctttgcctctcttgaaaytcggtttgttgccttcaagagccagataaggaagacaatcactcgcccgccgatgatttggaaacgaggaaatcctatccagaccaaaggagtatctcccagccaagtcctgcaaatacagacagaggtgagccagcccttgaacccatcgctctccaccgcacccaggagctgggacccaggtcgcccaggttcccagaggcttgcgagaaaggcttttaatcaagtgtaagcggctgccagtcttcttcctcggcgagcagataaatatttaacgcgagcagggtgcaggccaggttttctgaattgctgcctccttggtgggtttgaggttctttcaggtaagggcagaggatgtactaaaaggaaatggagggacgtcctcacccacataaaataggtcaaagggcatttcctgcccttagatggcccatcttccctgggccgtctcctccaggggtcactctcctactctctactgtaatgtcctagaaggtggatagtactggattcctgtaactgtctcctctaaaggcagaaggtctagggtaggtccctgattcgatgtggttcctgggaagctcacycctcccctctcaagggctttcctaggacagaacccctcttacctgcccctgtatcccaggcgaagatgggcttaccttggatgtcacaggaactcatttggtggagaaagatatcgagaacctggccagaggtgaggataaatttgtgaaaaaggtgtacgctgtgcttgagagtgatgggtcattcctgtagaggggtgttatccctgtagggggtgagtgtggaaaagacactcaccaaggccttgggggcatgagttttcctttctttgggtggaaagtaagatcctctggacacattaccctggcacagaggtatgtatgtgtgggtagagcatgggagtaaaacaaacccccagaagtttattggaagtttgggttcccaaggcccgggtctgtctgaatagccttgccagaaagagaaatgagtaacgatgatcagaatttttgatgcctgtggacaatcagacaggacagtctgggtccgctgaattcaatggaaaacaggatttcaatgcaggattgcaggaaagcatttattttaggaatgtgagaggtgttttcctttctcctggcattgaggtataaccacctccaccttaccctaaatggagtgtggatggagcttgtttgcagaatggggatccctgtgttactgctcagcctgtaaggaggagactatggcttggggtgcagagtaggggagtccctagccccactttgcccttctaccttccattcttgcatttcagaggagcctctcctggaggagggcccagataccaatgacctcatggtcagggcagttgccacatctatccctctggagttggttctgagggcactaacagaggcctctacacctagctccctgcccctcaactagcccatagatggtcttgggaatttgtggcaggaggaagacaagcattggtggtcttccattcttcctagttacagatttacagaaaatgccattaccttcaaaatcactggtgctttatagtgagggttcttagcatggatttggcagtcttcagacctcctgaaattgtaggcaaactgttgtatgtgtatttttctgggaaaggtgtccaaggctctgaccaaagcctccctgatttatattgaaagggcggcggtgcgsgggggggaggtcggggccggggcgggggcggggtctgtcacttgaagtgggaaatcaagtttccgtgggccagcctcttaggttagggagtgaggaacaacttaaagcagttgcccagctgcatagttcctggagccagggcctagattccaccgtcctgaatttattctcctgggcatcctacccacagcccagtttcttcacccaaatcctttgaatgcagttggtaaagccagagagcggagggcctccacctactggtcatccttctcaactctcctttcagggttgttggccaaggcagaacctgagctccaaataaccctgctttacctcccactttacctcccacttttcccctttcacagaggaattgcaaaaactgctcctggaacaaatggagctccgcaagaagctggaacgggaatttcagagtctcaaaggtacccactgccatcctgcctcaccccacctcatcaccgagccttccaccagggtgccccgacctactccgaaagccgggtgccaggcaactggtactaggtgccctgcaggagacaagaaactgtccttttccagggctgcaggcgaatggctgggtgggagttgcgggtaggggtgaaagggggggccaggagtgagaaagtggagccgggagagggggctgtgcgtaacagctctcacttaatcaatttgcacagataattttcaggatcaaatgaagagggaattggcttatcgagaagaaatggtgcaacagctgcaaattgtcagaggtaagacgggagtcaggtgagctcgtgcacgggccgtaactgcctctcgtctggcaggagccgcaatgttggctcagtcatttggatttaaattgaaggtaatttaacaattatttttttatttaatatgctttgtatactctgattagcctcagaatggcaagcgagcccagcaaacggcttgcaggcatcattacatggagtgattgaacttcttatcgcggcaatttccatggtttctaaattaaaaatcgaggcgtaaaattacctgggaagtaatgcctaagtttgctttaattttggttagatccatctgcctttaagcgccatcccaggccatttccttcctccgccagtctgcagttaggagctccggtaccccctcccccatccctggagttgtttctgcgcggagcttagccctggggagaggaggaagcccgggctgtgaccccggcctttcggagggtggtctgcgtttcctcactggcccctccccttgtcttccagataccctgtgtaacgaactcgaccaggagcggaaggcgcgctatgccatccagcagaaattgaaaggtgcggaagccgggaaacaaagataggaggggtgctgggtgccggccgtgctgtcgactgaatgaatgaatagtgggactagtgaggaaggccacgatccacgtggatcaggatctgtgagggagaaaagtgggaactgattttaacgggaagattattctaggatggtgggggtaaaaagaaagagccccttgggctttggacgtcagaaaaatctgccttctrttaccaattctggctttgagcaggttgactcctctcttactgtgcctcagtttccttttctgtaaaatggggctactgaaccagagcagtggttctgaatcaccagcttttgtcctaccctcctgcctcctcctgatccgctcggttgagattccctgaccccaaagggttggtaaggccggggaggggaaagggtggactgcgcggtgaggtgagcctggagaggcgcccagagtgaccctcgcgactgtctycccagaagcccacgacgccctgcaccatttctcctgcaagatgctgacgccccgccactgcactggcaactgctccttcaagccaccgctgttgccctagggccggcctggccgcacccctgcgccctcaasccatgctgctccttgtaaatacccgctgctgcggtggccctgagcgaggaacaagccattcggacccgaccgatgtaaatacagccgcccgtccgcccgccttcctcccgggctccccggmcttgcccgccccctcccgggcgtccctgtccagggccccggcttggtttccaagtgtaaataccgcctcgcgcctcaaatccccctaccccgtgtgaactctagggcatcggacctcaaggggttaactggacagacggggggcgggaggggagagcgccccctcccattgtatagccttgaacccgattgtgaatacaatgtagcaacttcgctggcgcctgccccgcactccccgtcccgtccacttctgaaactcctgttcctaatgacaaagtggctatgtgcaatggatataaatgtactgtgagtctctcggttcagtattaggttcactttaatttatttrtgctgtaagttatttttgcttccttctcctggacccacttccagtcccgttttgcattcccctttggattttgctttggctattttttgttgtaacctcttgatgtaacagcactttaaaagggcgacaactgactcacgagatggcaaccacctggagcctgtttggggagaccaccctgtacccgtgactttcgtttttaawaataataataataataataaaagatgtcacttctggggctacggaggtgggagtgcaccggcggagcggggcggcggaacaccgtgcaacaggtgggggtgggagssgccccgcgggttctggggctcccagggtcagaatcgggcctgctcaagtgggcagcagcgagcactcaacctctccactgtgccctccagacacactcagttttcccccacagggcactccctctccgcgtttaggaccctcccttgggcccggratggaggaggggcattacgtcacggtccttagcgcagcggtcccgggctctttcctcaagagctcgaaggcgccgagggttcatccatgcccatttccacgcctgccacaccggggaagttacctccggggcgctcacagacagggcgccctgccgggaatcccaggttcaaccagaattgtccctttagatggcgcgggcaccgccggcctggcctggcctgggagcgctgcggcagggcggaggtctcagggagtaaggtggtctccgccgggcaggcttggaaaggaaggcgggacttggagagctcggtcacagacggcctcccgtctgccccgccgctacccgaaaggagggagccccgtccgcattttctgttcggtccattttagttcgagaggggctaaggactcgccgggcctcggctggggcgtccgacgtccgggtcacggttggcaaggcctcccagcggcctcagtttccacagcgcacctcctgcttgggctacagacgacgctgcaaattgcagaacactctttgcagggaggagagtgtggatggagtgggagagagctcacggcacagggaatcattcagccttggctttcatttctcgccctcggctggctagygggggtcccgggttgagcccttcttttatctttcctgggtctccgtttcggcctctatgaaataacacgcaggcctccgtccatgcggctcgtagaaggcgggcggcaggccccgcgccaccggccagcagctcgggaccgggagccctgggctgagggggccgggaagtttcgtggcgggttgtcttggtgggccttggacggagccggctagtaggggcgtgctctgggcctccccgaagctgtgcagacgaggagtcccgctgcgcggtacagccaggaagccagtccctagagtcctttgcgctgggggtcggagccttggagtcccaggatgttccgasggctaagaccagagcggacacaaaggagataacaatgaagagggcgccggcaaatggcgaagcatcgcctccggacaggccatctccgggcagggcccctctagggagcgggaacgtttcatatgcatgggacccaccagatccgctttccgctggacckgtggcgaaactgaggtccagagaggaagagactggagtctccaggccgcgccagggcccgcggaactgcgacggggcgggacagcgcgggtgtgggagtttgccggcccctttccccaccgcggattgcacctttggaagctgcacttttcttctctgtaaaatgggcatmaccattaccacccaggcaggaagttccgtggctgcrgctcgacagaggagccaggcaaatgctccttcccacccttccttcccaactccccccaaagtggaaaagctcctaggcagctggggccctccggaagggacgccccatctgggcaggaatctctgcggactggagtcgtaggcggatccgacccagaaagctcagtcgcaaaaaccctcccgggcttcgcgtcccttcagaagtggtttgttccccccaaaaatgttaataaccaaacgattggtatggatgtaattatcaataattatactaattattgctgattgcggggctcgtagctactttaattagtttaccagattctaattaagttaaatgaaacattaatagggaaaatatgctttgaaaaaaaaaacccaggatttaaaaaaagtctatttctcgccacaatgttgccaccttgcgacagattttaagcattacagccaacgcccgaaggcccagaccagggtgcctggggtcccagggagaaaaagtggggcctggaagttggaggaggcagttgaacacagaatatcctgtgggctgttctcctggagtgtttggtttggcctggtccccagcggtgcctacaggaggtctggctctggagtcccaggtctggggtaagggacaagagtgmacggaagccggggcccctcttgggatccgcagtgggaagatgatctctatccccacctgttctggcaaatccagagtgagagactgagcaaagttggagccgccgttggagacagcatcaagtgggtttatttttcacccccacgggagaaagcagtaagtcccttccsatctccatttcctctgcaaatcagggtaamctgtgtgcaaaagcaccacttagaagaccccttaactcctggagcacaggtgactctgtgttctagtggcactcggttcatgaggctagcagggcactcacctccctttgttattcttggttgtaagtgtctgttgccctaagactgaaagtaagtccacagcaggggtcacaccttgcttttccttgcaatcttcaacacagggcccagggctccacaggcacacaacacatgtgtagatgaaaggcttccaactttgcggttcatctaggtgctgaaaatgtctgagggaaggaatccctaggtgcttctggacaacagccactgataagcaattaagctcatttgcataaggttaattaaacacaggtttactgctcagaaagaagatccttcatcaataggattcgttttgggagcaggtatcagrtaagtgattgttaacctagaaaaggaaaactttgttcctgttccaactgtgtcctaaagggggtattccttcactccgtcatacttttccaggtcactggcacacaggtccacccattcgtagctaccctgctctaaagccttgatccgttrcaaacatgtgactcctgccttgaattcagaacaccaacaaaagcagaactggatctgcatgctcttcccatgaattctaaacagcctcatctcctctctccatcctcagatgcttggctaagagcacaaactctggagccagatttactgaggtctcaatgctgccctgtcattgatgagtgacattgggcaagttgttgaatctctctgtgccttagcttcctcatctataacatagggagattaacagtacctacttcatagaactgttttctgttaatatatgtaaagcactgagaacagctcctggcatacaagaagtgctattgtattggtgtttgcaaagattacaactccctctgaattcactttcctgagactcaagccaggaatgcttttagagtcccaaaatgtaccccagtccatcaccctcctctcctccaggggcccagaaagggggcccagaaaggaggacaaaccggtgctttttcaagcctggactattgagctttctgaagacacattcataagaatctacaagcacagaggttggaagggcatcctgcaacgccaatgcatggactattgagtttctggagacacattcataagaatctagaagcacagaggttggaagggcatcctgcaacgccaatgcattgactctatgtgtccaaagaggcgaagacttgcccaagttccctcagcaggttagtgcagaggaaaggaagtcagccaggtctctggattttctggggctaggaactgcctgtctytttcctaatttctgttctaatcttttcttttcttttaagtagcgacagggcttcaccttgttggccagactggtctcgaacccctgacctcggtatcctcccagctcagcctcccaaagtactaggattacaggcgtgagccactgcgcccgaccagtttctttagaacaatctcaacagtcctttttgggccaagtccttcactcttggattctattttactccccataacacccccttccacatacgtagactaataatattccagtctgatgggttgtctgtgctgaaagagagggagccacatcgacattggtcgttttcttatttggcatcccaagggagacatttaaaactactcacccaattgcccaagtggcctccaaagaaccagatatctctaggggaagaacagaaatccagccaacaaagattgtcctctaacgccttacatcgaaggcccagagccaaggaagaggcggagatgtcccgcagtcccctatkctcggctgttacctggaaaggatcatttcacytccactgaagagaaaaggaatgagtcctgaatggaatgctgcccggcagctcccagcgcccgctggtagagtacccgccgctgtccctgggtggctccggggcttcgagcctaacagtcctcctgcggcgcgcctggaggctgggagctgtgcggccgctcccggcagatcgactgaggtcccagtggccgcagggcccacgtgcatgctgaagcactagcaaagcagttgcaccatttttctgttggaaagatatttcagaaaacattgcctaagtcatcgcaggaaatctgaacgtggttggactttgtttcctctttgtcttaccactcgggactgtgtttttgtaactcaattacctgagacctgggtcccgatcttttcagggtctgtgcctctgtaagtcttatcaggctttacctctcagtgattggtgtaaaatgatgacagtaaaacagtaaaacccacagggtggggctgtcaggaattttttaaacattattttatttttctgccccctcccccttttctttttttcttttattatttatttatttggtctggaatatttcaatgaaatattggtgaagcccttgacatatggtagatactcattaagtggtggctttttttttttttttgattcaaaggattctgtcactcttattgcaagttcctcatacgtttatcgttgcactagttcctgttatgtttcggagctgaaatggatcaactttggcaagacgaaatttccttaagtgtaaggtactgcaatactcaggattgtgcagagggaagcagaggcaagatgggaaagatcgcaaactagggcccgagggccagaggcaaaatgcaccgcagagatgaatctgcctaggccccacctccttctattccgtctcctaggactactacattttatttgtgttaaaagatatcacctgtagatgaaaggtgttttcagtggtaaaccgtgcaccggcgtataaacgtggtgtaaaaaaaaaaccaaacagaaaaacaacctgatgtaaaaacagaaaaacaacctgatgtaaaaatatggaacgcttcacgaatttgcgtgtcatccttgcgcaggggccatgctaatcttctctgtatcgttccaattttagtatatgtgctgccgaagcgagcacggtgtttcgtcctttccacaagatatataaagccaagaaatcgaaatactttcaagttacggtaagcatatgatagtccattttaaaacataattttaaaactgcaaactacccaagaaattattactttctacgtcacgtattttrtactaatatctttgtgtttacagtcaaattaattctaattatctctctaacagccttgtatcgtatatgcaaatatgawggaatcatgggaaataggccctcttcctgcccgaccttggcgcgcgctcggcgcgcggtcacgctccgtcacgtggtgcgttttgcctgcgcgtctttccactggggccggggmggcgcggagggttcagacgcgggctcttactcaaacgctgatccccgaaactaccgagcagtgtctgcgcgacgcgaaagcatttttggagcgaggggccatggtgcccatgggattcccacgggtgttggactcgggaccccgaaaaggttgcgagtcgctggttggacccttccctgcgcggggacccgagagacgtgaccctagcgaggcctggggccacccactgtgggctggaaggggccgacaggggttgcggcgggggatcgtggggagggttggccagggcgcgccttcagcttcccctcggcttctcggaactagctctctgcattcggagccaaggcgatgagggtgtctgctttgggacgcaaacttccagtagtggtggaagtctgggaagggtcaccaccgtttgagccaacatttagaaagagccaggcgcttaacctaaatggtatcatttcccccattttgcagtttagcaaacaggctctgggaggttaaaccatctgctccagtgatcctgccactggttaaagtagttgggatttggatgcgagtctggtttcaaagacttttttttttttttacgcagtggagtttggaaaagatttgagaccacaagtgcagcctccgctttccttgttagagttactccagaagccctgaccagctcagactttccttcctacttccattccttcaacaaatattgaacatctgtggtgtcagcacccgggcttcagggatgcgtgagtgggcagggttgctatggtcatggagctcggttccagcaggggagccaggcagacatgaaagagccctctggatgccgagacgtgtgctgtgaaagtgtggcatagaaagtgcctgggrgatgatggccacttcagtggggcaagagagaaggtgacattggagctgtcattgatgataacggcggcagcgctgaggggacggggaccgagatccaggcagaggaccttgcaaccacctgactcagtgtcacccatctgggccagcccttcccgggagaccactgtggtggtagttgctgctcccagcagtgctgtggctcagtactgagagaggggagggacctggggagccactgccagggagttcgggctttggaggcttsagttctccccactcggtacgcctcttaagtgaaatggaagtcatttgactagcttctcatctgaccttactaaataagcagtaggcaaacgcaaacctcagaatgctaatatggcctttactgagtgaaaagagctaatttggacaatgatgtttacctcagatttacaaaagagaattgcaaataaccaaaaagcacattaacatggatgggagatgatgctaatcttcaattagcatccacatttttattcatttatttagaacaggtagggctggtggtttcataaatgccttattgtggaaactagcatgagatacacctagttattggttcaacatttctggctacatgagcatgtgttactttgagccagaggtagattttttgttgttgtttgtttttttgagatggagtctcgatctgtcacccaggctggagtgcagtggtgcaatctcagctcactgcaacctctgcctcctgggttcaagcaattctcctgcctcagccaccatgccaggctaatttttgtattttcagtagagacggggtttcaccatgttagccaggctggtctggaactcctgacctcaggtgatccacccaccttggcttcccaaagtgctgggattacaggcgtgagccaccatgtctggactctttttttttgagatggagtctcactttgtcacccaggctggagtgcggtggtgtgatcttggctcactgcaatctctgcttcctgggttcaagagattctcctgcctccacctcccaagtagctgggactacaggctcactatcatgctgggctaatttttttttttttttttttttgagtcagagtctcgctctcttcagcaggctggagtgcagtggcatcatcttggctcactgcaacccctcctcccaggttcaagcgattcccctgcctcagactcctgagtagctggaactacaggtgtgtgccatcacccccggctaatatctgtgttttcagtagagacagggtttcgccatgttggctaggctggtctcaaactcctgacctcaagtgatctgcctgcctcagccttccaaagtgctgggattaaaggcgtgagccaccgcgccccgccaattttttgtctgttttttcttgttgagcaattttgcagaggagaaagatctgagttctagttctcattccacctggaactgtttgtgaccttggcctgctccctgtacctctctgtctctggttctgttttagcttctgcaaagtgaggaaactaccctagagatgatccttgacatttttcagcattgaaatgctggcattcttgcagctggataactgaaggacgtttttggataattgtaattttctgatattctgcattctcccagtaccatgaaaaaaaataataattagcaagatgtaaaaattcaagagggtttttgttttctctttgagaagggcgaagcaaactggtcatcctggagccatggagggccccaggatcagcccccaggggcggctgtggatctagggcctgggacctgctgaaccgtatcacaacatgcctctgagctccaaaggccagtacagacgaagcgggaggctggtgaaggggaggggatacattgaatgtagcatggaggtggaggagaggaggaagcatggaggggctcagggaggggagagccgagtggaccatgacttcatgggaagtcccaagcccccacaggccttgagggaataggcattgcaggcgaggagagtgtgggtgccagagaggactggactggtgggcaggcttggagttgcagtgggagccggctcctgccgccttcagagttgttggcttctcttcactctgcagtcctgaaaagaactgagtcctggcagtcttccctgaatgttctggactacagaaccccaagagatgaggagtggtccccctatcctgtttgaggtggtacttcccactacctgagtaggagagagcagagccaactttatttcgaacaattaagaaatgggctgtttcatatggaaaaaatgtcagtgaagacatgaactcttagcattctctaaaattatgtagtgtttctcttacagccagagagcattgcatgttttcgtgtatcattttatttgaagcaggaagggctggggactcccagcagccccaccggagggaaggagggaggaaggagcggggatgtggagagaggcccctgtgaccytgtttatgtgcaggcctgggaggaatggcattagtggtttcaggaggtgttgccctgggaytgtagcacagggacaatgcgctgagttcacatgcctgaccctgaagctccaaaggcctcagacacagagcatggccagagcagggttggaggaggcctgagtgtgggggaggacccactcccccaggctgccagaaattcctgtgagctgcttatgctctgagttaagccttgttcttataacatctcttttgaagtgcactctgtcacctaattcacctcaatgtgaatgagtttttccaaagttaagctgaaggggggtggagtaggcaaatcggtctgtgtgcccacagctcagagggtggcctgggggaagagacagggtcagctgtggccagctgacctctcagagggagtttctttcaagacttgtaagcctggtgtgcccagagcccttgctctgctggggtggcccctggtgtgttgagatcagttctaatccatcccagatgccgggcctcagtggagccctctggtcccgcccctccccctgcatagcccaggctgccccttttactctcccccagatctcatatttgtgcccagaatgtcttaaaagatctgtttcctcacctgtgggatggtgattgtgctgcctgctttgcagggtcatttgaaggttaaatgcaggattgggtgtgaaaggccctagcacattggatgagctgattgatgccaagtgtttacaatagtcctgggctattctaatgctcaatacataaccacttacttattcttcttttccttcgtcttgcaactatctgcatgaaataaactttctttaaggtaaaaatagcagggtagggaggagtccctaagttttgctccttttagccacgacggggagtatttttgcccagatgtctttaatcctttggatttgagtttccaaaggccctggttaagatgcagttatgttttgagacgggacactacatagactcagtaatacctgtttacgtagcttagtacgattccttgccctttaagaccaacacagggtcttctggcatcctatttcatgtgagtatctctgagacataagcatgggggtgcaggggtagtgctggttattattcctcttttactgatagggaaaggcgaggcctacagaggttaggtgacctatctaaggacacagctagttagtgacggtcctggaatttgctctcggatctctctgactccgagggctcactttacacctacatgtaatatgggagtacagtttgaggggttctggagtgctttctccaaataatctcttactgctcttactcttgccttaaatcctgccactgatgcgtcattattttgagctgttgctgtatcgagggttcactgtaatttatttcatcaagacctttttttctggcagtcccaggatggcctaagggcataaggcgcttaggtttagggtgtggaggacttgctcagaaagaaggtgcaaaaagaggaattgccaagtctgagcatggggtctgccagcttctctctagctctcagtttccctgtatgggattgcaaggatgggaggaaaagtgtcacacctcctccaaatcctggctgccctggagtccagacatcgctccctgccaaggctacagtgacygcagcagtggtacaggggaagactgcaatggctttcagccaagaaggtccatatttatgtctcatcaactgtgactaggtgggtcaccagtctcttccagttgctgaccctgttttctcgtctctaaaatggaagtgatgatttttytacttaccacacagggttgtgaggctccattgaaatgccactgtaaattgctatacaacaaaagacaggaatatcagtattgtcagacacccattggagcctcaggcagctcagcattccccttacctggtgagtgaggcatttgtgcattaggaacagacctacaaaatcagagcaccaaaatgaaacatcacactgtattaatattttcacaccacttagctctcattaaaatgtactttgctgaatttaatatgtgatttcaaatgacacaacatattaagtgcttaatatactagaaattatgaaactattatagttgatgccatatgaaataattacactgaattaaactttagcagccaagtgaaggaaagacttcaacttaaaacgtcttaaagaagcttaagccaccactgtaatccccaaaataaatgtccagaaattaggatctttaaataaaaactggaacttaatctgtacttacaccgggaagctcttctgggctttggtgatgtgcagcattgttcccttggggaggtgaggggccctgggacccactgcaggccagggtgttgggatcagggcttcagcgggctcgctccatgggcctggctgggggttggctcaaatggcctggagtaaagccttctaccgaagtgacagattagtctttgctcgagattagcctattgacaagttaaaaataaaaacaaacccaccttatggaacatctattcagtgcttcctttgtgccagccattttatatgcatttcctcatttaatcctcacaatacatctgttttaagagccactgtttttcagatgaggaaacaggctcagaaagattaaatgaataatccagggccttaaatcagaatccatagtgttcacccctgcatcagattgcctttctctaaactcttcaacctcctcattagtgtatgtgtatgcatgcatgtatgtactacctcctattttaataatgattcagtgactgatatggtttggctgtgtctccacccaaaatctcatcttgaattgtagtccccataatcctcacgtgtcaagagagagaccaggtggaggtaattgaatcatgggggcagttttctccatgctgttcttgtgatagtgagtgagttctcacgggatctgatggctttataagtgtttggtagtttctcctgcattcattctccttactgccgccttgtgaagaaggcgcttgcttcccctttgccttccaccatgattgtaagtttcctgaggcctccccagccatgcagaactgtgagtcaattaaacctctttataaattacctaatctcgggcagttctttatagcaatgtgaaaatggactaacacagtgaccaaacacattagcctgctatatgacagtgacattacctatatctttatctcattccagtcatggagactagggaccatggcttgagagtttcaccttaaactgtctcgatacactcagtctggctaacttagacaggaagagctctgtggatacttgctgttaattcaattaaagaaaaatgaattcattacctcctcagtatcctgacatattacctttgtgtgcttgcttaaataagatatcctcttataaagagcaaggatactttctatcatagggaataccagtgtcttagctacttaaggccctatgtctcaattacttatatcacatgaaaatacccaatgggctgtttgaaaaatataaattttagtgtggacatttaaatgtattatcatttactgaccagcaaaaatgattttcatagagacaggaaaatttggctcaaccaaacacatgtttgtaatgaactgaaaacatgtatttctcgttaagagtcaagattaggctctgttttgtatcatagaaaagcaaataacagtggctttaagatgatagaggtttatttctctttcacatgaaacaagttgtcttttaaggacttgtctggtagctccattgtggcagacagccaggctcktttatcctttagggccacaattcatggtccaagatgcttgctagagctccaagttccaagcaggaaaggcaagggggaggccattactgccccgagtaaaatccataactcagcataccacctaacactcaggagcactcagtacatggtactcttggctgttgctcatcttccgttctgcacaacaacaagaaggaggaagggaagtcrtatttactaataccatacagggttctcaggaccatgctggacatttacacatgattgcattcaactttcataatccagtgagggtggtgtagcagcaggttaagtaggaagtgaggctgtatccacatgtggaggtaggaaattggaggggaagggtggaatgtttccataagaagccgaagggctttcaagaaggaagggatgaagcctccaacacttgctctctgagattcaagttaatacacattttcagtgtggatcaaatggtcctgacgaaggtgcagtggcaggaaagtgttaattatgctcttagaataaaattgccatgascatagaaagtgaagagattaacaaattttaaaaagacattagaaaagctagcaaaagacttgaacaggtgcatcgcaaattaggagctccaaatggtgaatgtraaaatgtmctcaayatctttaatcatcaggggaatacaaaaccacctcacaattaacactgagaagtctgataatgctgttaactaaaaactcaatcawtatataaatttggaaaggagagctttgtttcttataaagggttatagccagcaaggtggccattctgacaggctgggaagtgttagccttggtcgaagcccagaaacacacttcaagggagagagggaagggtaagacaggaatttaagctgaatggttggccaagtataggtattcaacaggatacaggaggagctatgaatattcatggaggtggtcctaatacatgcatacttgaataaacatgcatattacatatgacccatgttctctttgcagtggagacttttaaatgtaacatttaaatgtagtacagttaggttctatatgtcaaaaggtcttttcaggacacaaaggcactcaagtgtgcagtctctgtaaaccagccagaccagtccatggttggtggtcttctcatcaggagaaagttaactgaaataactcttgtccaatcaaagctgtagttatgtcttgtggaacagggggtcagttaggtagcatctggcgatggattgagttgcagattattttaatattgcttatttcaagggcagtgcttgtttagctgctggagaaaaagaaaaacattgtggcagttggaacagagttaattttttaagtgtaggggagcgtagtgacttaacccttgcattgcatggccttaggtgttgtttatagtttgatatagtcataaagagtccattctatcagtcttattatctctattttaacattaaagctgatcagttgggctggatgcagtggctcacacttgtaatcccagcactttgggaggctgaggtgagaggatcacttgagcccaggacttggaggctgcaagggaattatggtcatgcaacttcactccagactgggtgacagagtaagaccctgtctctaaaaaataaataaataaatacaatgctgctcagttattgtgtccagattgcaatatgacctcttgtctcgtcatgaccaggaactcagtttttaagtcctgttggccaagagtgggggctccattcagtcagttggggggcttagaattttatttttagtttacaatgccaagtgctgatgaggaagtagagcaaccaagatatgagaatatatgtctggggagtggggagattggtgcaaccactttggaaaatggcatactcctaaaattgaagataagtataccttatgactcagttgttcctttctagttacatgccctagagaaactcatgcatatgagcaccaagttacaggtaaaagaatgttcaaggtagcattgtctgtaatggtcccaaactggaaacaactcaagtgcccatcaacagaagaatggatatccacactgtggtatattcatgcaatagaatactatgcagtcatgaaaatgaatcaactacagttattaggttggcgcagaagaaattgtgtttttttgccattgaaagtaatggcaagaaccacaattacttttgcaccaaccaatacctccagtgttaggggctgaattatatcccccacttctacctccaaatttgtatgttgaaatcccaacccctagtactgyaaagtgtgaccatatttggagattgggtctttaaaggggtaattaaattaaaatgaggttattggatggaccctaatccaatatggctgatgtccttattagaagaggaaatctggacacagacatgcacagagaaaagrccatgtaaaaacagagaaaatgtagctgttgacaagccaaggagaggaccttaggggaaaccaaccctgccaacaccttgatcttgggcttctagcttccagaactgtgagagaattaatttctgctgtttaagccacccagtctgtggaactttgttaggcacccctaaccccccagcagactaacacaccagcaatgtggacagatcttgtaaacatgatactgagtggaagaaggcactaataacatatacagaactataccatttatataaagttcaaaattaggcaagaccaaactattgtttaaggtcgtatatacaaatggtaaaatgatgaaagcaaggaagttaccaaaaataagaaaatgggaggcgacacataaaggcttctgggagtggggggttggggtcgcctaacagttccacagactgggtggcttaaacagcagaaattaatttgcctgtttcttcacttgggtgctggttactcaggtgttctccctagagttgtgcactgaactgaacatttatgtgttgtgcacgttgcagtatttataataaaatgctgtaaaaggaagacagaagcaggtgggggaagaggagaagcagagagagaaggaacgaggagggggaaaaggagggaaaggaggaaggacgagaagcgggaggggaagaaataaatcagtgggctggcctcttaccaagtggtgtggtctaagagctgtgagaccacagctgtcagttaaaggtgggtcccaagctcaggtgctgcctctgagtgtgaacctgagcccagaatctctcccctagagaagggcttagaaactttgtaaccttgggaaagccagagtatttttctgagatttgtttctacatctttagaccggggaagataaacacctctcaataaatgtaaggctcttccttttactaattcaggtctctgctctcatgtcacctcctccaggaagccttccctaatgatcttttgaaaatagcacctcttggctgggtgaggtgggtatgcacctgtggtcccagctatttgggagcctgaggcaggasaatcgcctgagcccaggaggctggggttgctatgagtcatgattgcaccactgcactccagccttggcagcagagcgaaaccctgacaaaaaaaaaaaaaaaaaaaaaaaaaaaaggaaaaatagcaccttgatgtggcttggctctgtgtcctcacccaaatctcatctcaaattgtaatccccacatgttgtgagaggggcctgattggaggtgattggatcatgggcagacatcccccttgttattctcctaatagtgagtcagttctcatgagatctggttgtttgaaagtgtgtggcacttccccctttgctctcgctctctctcctgctctaccatggtcagatgtgcttgcttccccttcgccttccaccatgattgtaagtttcctgaggccttccagtcttgcttcctgttaagcctgcagaactgtgagtcagtaaaacttcttttcttcataaattatccagtttcagatagttttgttttgttttgagacagagtttccctctgtcgcccaagctgggagtgcagtggtgcaatcttggctcactgcaacctccacctcctgggttcaagtgattcttctgcctcagcctcctgagtagctgggattacaggcacccaccaccatgcctggctaatttttgtatttttagtagagatggggtttcaccatgttggccagactggtcttgatctcctgacctcaagtgatccacccaccttagcctcccaaagtgctaagattacaggcatgagccaccgtgtctggcctcaggtagttctttatagcactgtgaaatggactaagtacctcctttcattctttttccatttatttttctttacagtacttaatactgttgataartatttatcactgaaattatgtcaagtatttgtgcatgaggaggagcaggatttttgttttgctccccattgtattcctagtgcctgaaacagtatctgacacatagtagatgctcaatacatatttgcagttagtttgggtgtgttggctcacatctgtaatcctagcactttgggaggccaaagcaggagaatcacttgaggtcagaagttcgagaccagcctggccaacatggcaaaaccctgtctctactaaaatacaaaaattagccagtgtagtggcacacgcctgtaatcccagctactccagaagctgaggcatgagaattacctgaacctaggaggcagaggctgcagtgagccaagattgtgccactgcactccagcctggaggacaagagcaagacttcgtctcaaaaaaaaaaaaaaaaaagaaaagaaaagaaaagaaaaaatttgctgttacaaacattagataataattttgtgatgccaggcacctgaggcactcaataaatgctcgttctctcctccccttttagctgagaacctcaccctcatttcctggagctggcagccccttatctttttccttcccccctccaacctgggactgagaaagtgcctacaactgacgcctctgatcagtagcaacatttcaccccctggggccaatctggcccatcatctgtcccctccccacacccttgccaagggtcacagtctccctgccccaggggagggtccctttccctcagaggggccgagctgcccctgggtgacccaggctccaagtgcttacagcactttgggtgcatggactgttgcctccattgataatttactgttgtggkcttagagtgaggccctgaaaacccgccataaaggtttctctcactccttcaccctcattaattgctcccgcctccctgttcttcccactcagatgcctatatttagtgctgattttcttctgccttgtttagagttagttgtttacttgtttgcttcccctgccacctcccagaccatgaacccagctgtgaggggccagactttattcattgctgtactcccagtgaagtggcaccattcgcctggggggatacctgaggttcattgtctcatgccagggaaatcaaggacatggacacacaaggagtgaggttgagagcggaggtttaatagaaggaggccaggcatggtggctcacacttgtaatcctagcactttgggaagccaaggtgggtggatcacgaagtcaaaaagatcgaaaccatcctggccaacatgatgaaatcccgtctctactaaaaatacaaaaattagctgggtgtggtggtgcacgactgtagtgccagctacaggctgaggcaggagaatcacttgaacacgggaggtggaggttgtagtgagctgagatcacacgactgcacttcagtctggtgacaaagtgagactccatctcaaaaaaaaaaaaaaaaaaaggcgaaagaaagagaaaacctttctcctacaaggagaggggtcctgagcaggtttccagtccacagtgaaatgcagggttttatagatgagcttgagaaggtagcgtctgatttacatagagcacgaaagagtgcttggaccaggtgtgccatttgcataaggcatgaaaaagtggttaggactaggtatgctatttgcatagtgtgtaaaagtctggccacccccaccctaatcttttattatgcagatgagctttctacctggctggcaccatgttgcctgttcctttactgtacacatggtgacaaaagggaagttgaagcctccatattgaacatacctggccctcaggtaacccttttctattggcacaggtgctggcattcgcccgtgcaagcttccagcttgcttatctgtttgcagctcgatttttcaggctgctctttgttagaaaagcaatgattttgggctgctttttgttgaaagggaatttctgccgaggactcttaccctcacgatctgcctgaataatttctttctgtctcctgtatcaccagcacctggcacagcacctgaattttaaatcttatttatttatttatttatttatagagacaagttcttgctctgtcgcctaggcgacactataacatcaacctcctggcctcaagtgatcctcccactttggcctcccaaagtgttgggattataggtgtgagccaccacacctggccttaatagacacatttttttctttaaagcttctgttacaaaggacagataagaggatttcaagagttaagatgaccacagatcaaacttccttgatgtgccatcttccaacttaaattcgaaagctacttgagacacagaaaaagacaaaaactgagaaccattcrgaaaacttagtggtcagttgttggccagagtccaagatggaaatttccctaataacctgccactggggctgggggaagtcacatggtaggtggcctgtgcatactttgccctctaaagtggcccagaacctgcagacaggaagcttgcagggagaagcttaggccctcattcactgtacagggctgcactcaccagcaaatgggcagcacactcctaacactcaagtatggttttctgaggcagtcacttctgtccaccctcaccccttccgttagactgtctctgcctgtgtctgtggggacactgtggcactcagtacctctgagcagggagcagggcaggactgatgaggaggtggcctaaaaggcacgctcgcctaatgcagggaccctacagatggaaagagtgcggttttatttcaaaatatctgatacacagtaatatagataccttgtagtacttaaatcgtattaacccagtttgaaggtctttggcttttagtatcatgcgtttatttttatgttggcatgtttggttttatttcttttattttggtttatgccttctctttttcatgtttgtttttgtttttgccttctatgataagcaaaattgcatgatgatgtattttttatttatttattatttttttgagatggagtctagctctgttgctcaggctggagtgcagtggcacaatctcggctcactgcaacctccacctcccgggttcaagcgattctcctgccttagcctcccaagtagctgggattacaggcgcccaccaccatgcccagctaatttttgtatttttagtagagacagggtttcactgtgttggccagggtggtctcgaactcctgacctgatgatccgcccacctcggcctcccaaagtgctgggattacaagcgtgagccaccgcgcctggcccttttttttttttttttttttttttttttttaagacagaatctcgctatgttgcccaggctggagtgcagtggcgcgatctcagctcactgcaacctccgcctcctggattcaagtgattctcctgcctcagcctcctaagtagctgggattacaggcgcctgccaccgcgccctgcaatttttgtatttttagtagagacagggtttcaccatcttggccaggctggtcttgaactcctgaccttgtgatccacctgcctcagcctcccaaagtgctgggattacaggcatgagccaccgtgcccagccgatgatgtatttttttagagtcatggtctcgctatgttgccaggctggacttgaactcctggtctcaaatgattctccagtctcagcttcctgagtagctaggagtacaggtgcaccattgtacctggctgatgatttgtttttatcttctgtaatttgaaaagtatatagctatatagcctattgttttaattctgccaacaccttgaagatttttaaaaacttttttgaacccatgtagtatagtttggacttcccctccaaatctcatgttgagatgtaatccccaatgttggaggtggggtctggtgggaggtgtttgagtcatgggggtaaatcccttgatgctttcccrgagatagtgagttctcatgagatctggttgttgtaaagtgtggcacctcccccacgctctctcttgctcgtgctctgccatgtgaaacagcagctctccctttgccatctcccaggagtaaaagtttcctgagaccttcccagaagccaaacagatgcctagcaccaggcttcctgtacactctgtagaaccatgagccatttaaacctcttttctttataaattacccagtctcaggtgtttctttacacaatgcaagaacatcctaacacaccatgtttctctatcagattgaaaataaatctaccatgtttgcctcccttccaatataaagtgagaagtttttcaggccctccttccatatctcttcattagaggcctaggttatcacacctctcttttttaaaatgatataggtcttctttttacaaaaaattggttttaaatttgggatccaaattttagccatgtttatcattatttatttgatactctgtgtttaaatggtttccacatttcctgcakgctccacttactatggctgyaaaacaaattagccccaaacagtggccaggtgcaatggctcgtgcctgtaatcccagcactttagragaggccgaggaaggccaatcacttgaggccaggagttggagaccagcctggccaatatggcgaaacctcgtctctactaaaaacacaaaaattagccaggcaaggtggtgtgtgcctgtagtcccagctacttgggaggctgaggcaggagaattgcttgaacctggaaagcagaggttgcaatgagccaagattgcgccactgcactccagcctgggtgacagagagagactgtttcaaaaaataaaataggccaggtgcagcagctcatgcctgtaatcttagcaccttggcagcccgaggcaagtggatcacctgagatcaggagttcaagaccagcctggccaacatggtgaaaccctgtctctactaaaaatacaaaaattagctgggtgtggtggcacatgcctgtaatcccagctacttgggaggctgaaacaggagaattgcttgaacccgggaggcagaggttgtagtgagccgagaccacaccactgcactctagcctgggtcacagagtgagactgtctcaaaaaacataaaataaaaattaaaattaattatcctaaagcttaatgcttaaaacaataatcatttattacctcttgctctttctgtgcattacagtttagacaaggtataacagggatggcttatctctcctccaaaggagatgtgaaatgtctgaggcctcgcagtaaaactccaaagttgagcctctagcttgtctagaatcatctgaaggcttgcttacctgaagttggtgctggctgtcactcagctggaggcctcgctggggctattgaccagaacacccacacatggcctctggtgtgcctggtctccctcacaacatagtggctgagttccaaaggcaagcatctagagagagcgagccaggtggaagccattgccttttatgacctagcctcagaaatcattcagtgtcacttctgctgcatcctggtggttgggacaggtacaaagttctgcccaacttccatggaagtgtgtcaagatcactttgtaagatgaacatgtgcgggtgcccacatatgtacacacgtgtgtgcatgtatacacatgtacatgcatatgtatatgctgatatggtcatctttgaaaaaagaccatcagccatactgtatttccttaaattcttgattttcaacttatgtttcaggcagttgcagagtgtctttgagtaactttcaggaagattgcatgctatgagtctcaatgtgcagtatgtaaaacggccatcttctttcttattttaaaattcatagccaggtgcggtagctcacccctggaatcccagcacttgggaggccgaggcaagtagatcacctgaggtcagtctctactaaaaatataaaaattagctagggggtggggcgggaggagtgtaggaatggcacatgcctgtagtcctagctactgggaaggttgaggcaggagaactgcttgaacccagcaggtggaggttgcagtgagccgagatcacatcactgcacttcagcctaggcaacagagtgagactctgtctcaaaaaaaaaaaaaatcacaaggccagccatggtggttcaagcctgtaatcccagcactttgggagggcaaggtgagaggatcccttgaagccagtggatgctcaatgcacttgcctcctgcactgtggaagaagccagttttgtctccatttgcatatgcatttcaatcttcctgatctatatgtgtgtctgttctttgcattctcttttgaactggttgtaggctcctactgggtccctcattaataatgagttaaataaaatccagaacacatgtatattttaaatctgcatgagaatcataatcttttttgaaattatcctttaacattcctttcctgaaaagttgagaaacgatgtattcgacactatctatgacaatgtaacagccatgatttaatgatactgatggacagtagaatgtacatatgcagatatagtgtrgttagaactacatttaatattaagaaaaaaacactygaaaagataaaatgtgttgaattgtttaacatttttctttattatattttccaaaaatttaaaaacaggctgatgctaccttggtagagaaatccagtgaagctaaactctaagcctctgttttattgagggattagtaattttttttttttttttttgagacagagtctcactctgtcacccaggctggagtgcagtggcgtgacctcggctcactgcaacctctgcctcctgggttcacaccattctcctgactcagcctcccaggtagctgggaccacaggcacctgccaccacgcccggctaattttttttgtatttttagtagagatggggagtaattgttttatggttcttgaagggctgggaggggcttcctggtctctgcatgtcactggggtcagtgggagtgctgctggaaagtgagggaacatatgatgattaatagtaataataataataaatcagtacttgtaatgtcccaggarttgtgtcaagcagtatctcatttaacccttacaacagccctttgaagtagatactggtagatggtatttccattggctaggtgcggtggctcacgcctataatcccaggactttgggaggctgggatgggaggattgcttgagaccagcctggcaacctggtcagaccttgtctctacaaaaaataaaaaaaattaactgggcatggtggcatgcactcgtgtaattgcagctgctggggagcctgaggcaggaggatcctttgagcccaggaggtcaagattgatgtgagctgtgatcccaccactgcactccagcctgggtgacagagtgagaccctgtctcaaaaaaaaaaaaaaaaatggtatgcccattttacagatgaggaaactaaggttaggaaacttaagtgacttgcccaactagtatgtggtggaacccagactgagacatgggctcttaacccccctgctactgtgtgtcatgtgagaaatgttggagaggaagtcctgggatctcctcctgaagaaattgtccccactactggatccaagccctcagaatcaattcatccgtgaaacattcactgagcctcctctgtgttccaggccctgaggataaaacgtgatctgagtcttcaagtaactcaggagccagggtgaacagccagggacgggagtcggccaaaggaggggccttggcaggggtagggagggtgaggaggtgcttccaggaggtggcggcaacctgcttgagtcttaaaggacaggaagagccaggctggtaaaggggtgagggttgggaaaagggcattgagggcagaagggcttgagcacagaggggaaagaaacccctgagagacaccatcagcacactcatttcagctctgcggctcacctgcctccactgtccccgcttctgccgctgccctggttaccagaagtcgttttgttcagtgggaaggtgggcacaggtcactgctaggggtgggtacctgaacatgccaaccagagcctcctttttccaagatgtttgaacatgggtcagatggtctctctccagggcctgacggtgagaggtgcagcctgcagaaggccttagcagtgggtgtgcagggggcaccgtgagagtgggcagaccaggctgtctgagcaaggactcaacacacctctgaggtcccgctgcatgctcagcatgggtcccgggacacatgccagggccttcttaacacatttcttgtttcctttagattgtccaaattgggtttctgtcacctgtaaccaaagatccttgctgacacagcccctgagttggtcagactcaggagagggacatttaaactaagagaggctcacctatagatcaggaagccaactgactcatttcccgtgagaagtgtcacggctcagtgggtcagcctttcacatcattactgccggtgtctcctttccctggagaaaagccatctggattgacaactggcctcttggagcaggccccaggcccagcaaggatctatagctagaggcatcaagcaaggactgcccaagggtccaaaaactgtttctgttaaggtccagacagtgaatattgtagactttgcagtctctgttgaaaccattcaactctaccactgcagtgtgaaaacagccacagacagcacataaatacatgagcatagctgtgttccaataaaactttacttataaacattgaaatttgaatttcatacagttttcatgtgtcctgatgtattactctctcttttttcttttttgagacggagtcttgctctgttgcccaggctggagtgcagtggcgcaatctcagcttactgcaacctctgcctcctgagttcaagtgattctcctgcctcagcctcctgaatagctggaatgacaggcacacaccaccacacctagctaatttttgtatttttagtagagacagggttttgccatgttggccaggctggtctggaactactgacctcaggtgatccacccgcctcggcctcccaaagtgctaggattacaggcgtgggccacaatgcctggccaatatattactcttctttcaacttttttaagaacattaaagccattcttagctctcagaccaagcagaaaccagtggtgagggaccagatttagctttgcagcctgtagtctgcctgctgttggcctagggcatgaacacgtatgctgagaaagaagatggttgacaaggaggctggacaactgggtccatgggccaggccagggacacttctggggctgctatgcaggcttgtcactctagctgcttcttctctagccattcagatcaccctcttcagtctacaccctcctgaagaagaagctcaggacccatgagtgggcttaagtgcttggaaatgatgacatgtctagtcttgccttccaaaatttagccttggactgccttgatgcagccgctcctgacgcttctaggggcagctgtcctgcccctatcccctgtgaaaagcagattatgaaagcccactcatcccaccccacacaacccaggacccagaggccagggagagaataggctggctgcagccgctgactcatgccctggcatgaaggcatgaacttgttcgagagggatcttaaaagatacagtaggaagctgcagttacaagtgggctctgtggctgggtgtggtagctcacacctgtaatctcagcactttgggaggccgaggcaggtggatcacttgaggtcaggagttcaagaccagcctggccaatatggtgaaaaccyatctttactaaaaatacaaaaaccagcaaggtgtggaggcatgtgcctgtagtcccagctactcgggagactgaggcaggagaattgcttgaacccgggaggtggaggttgcagtgagccgagattgtgccactgcactccagcctggggaacagagtgagactctatctcaaaaaaaaaaaaaaaaaaaagtgaactctgtgactggaaggttgagtagattcagggaccagggtagttgtaggaggccagatgtcagttgaagttgggggaatggagattggtggaagagataacagtgggtatcctggagacagagattgaccgactgactggctgaaagagagacagacacagcaggtgaatcccagacctgccttgtttctggcccttcctgaggcttgactagggggtcttcactgtaacttcatagcccccttcccctatacctggggtaatctgggtaatcccaatgcttctccaatacgttctatcaaaccagaagctgtggagcaggtaatttctttctatttatttatttttggattggtataaatttatgggatacaagtataattttgttacatgcacagaattcgtagtggtgatgtcaggctttcagggtatccatcacccaaataacatacattgtacccattaagtgaattctcatcatccatccccacatccccttctctgcgtccactatcattcatactcacacccatatgtatacattatttagttcccacttatgagtgagaacatgagtatttgtctttctgtgtctgacttttttcacctaacaacctccagttccatccatgctgctgcagaagacacaatttcattcatttttgtgtctgaacacgattccattgggtatacagatcatattttatttatccaatcatctgttgatggagacgtaggttgattccatgtcttggaggacgtcatttccgctgttggcggaactcatcctgagcttctgatcttactctccaagggaactctgcacttcatgttggggactttttgctgtcttggtgtctgcaggttggaatcttgcttcagccacaaaatttcacagttgggtggtctgggtctcacttccctcacctcttaaatggctgtcctgcatcatgcaccatttactatgacaatgttgacctttatctgagccctgtgcctccagaaggcagcgacgataaagttctccaacctctttaagttccaaggaaagagctaagccacaaaggaccaccttaagctcgcatcccaaggaaatacggatctccatcctttcttactattccctaagattcgctgatgactccattgtttacctgcctctctaaaaccccagtcccctttgagatgctcctcattaatgaacgttctccctattgcaatggcctgaatgaaatcttaactgtctggggcttttggcgttcacaatgaccataattgtgctrttgtaagcgtcaatcgggggcgcagccggagtcccaggtcccagtcctggcttccccatgtcaggcttccccttcgggccggtttcaggtctcaattgggagctccctaagggcccctggcttagaatatgtgtgagtggcaacccagtccctcaacccctgcgcggggagccggggcagagcgaactgctgtaactttcgcwcgccgccaccagagggcggcggctccgcggaggagggccccagcctctgcgccggctcgcgcccgcagtgcctttaaaacgtgcgttggaagtagacgccacgcagcctgctttccagagtcccggcgtttcccctcttccrccgctgcactccaggggcctcccttacgcgtccgcacgcggcgagtccttccactatgcagggcgcgccgcaggactcttgagtgggcgggaaggctggaaagccagcctggagcttctggtctctagtgctgtgcagggcacaaggtccctgcccctcccgcggccgctggcctctcttctccttaagccaggtcgaaggattcctgaggcagcgggaaatggggaggagggacaggagtcccaagaccactgtcttgggtgcgggatttaaccagtcacacccgtcagccccttggaacgtcacagtgttcccttaaagtgggcaagacaagaactgttgccccgtctgaaagtgggcaaacgggctcccaaagaaaaaagttgattaggagagctagtaaatggcagaattaggacaggaactcagttctcctaggcccagacttggagctcttggggtggggcagcacagagatggctgtctgcctggcgtaagtaaactggtcccttcagcagaaacgggcgctgcacatcctcttcccgcaggacggcgacccctggacatcaaaatgcagccacttttggactcaaattgtagagttcttttttgttgttgttgttatttatgtatgtatttatttattgagacggagtctcgctctgtcacccaggctggagtgcagtggcgcgatcttgtgtcactgcaacctccrcctcccgggttcaagcaattctcttgcctcagcctcccgagtagctgggactacaggcgcccgccaccacgcctggctaacttttgtatttttagtcgagacggggtttcaccatgttgatcaggctggtctcggactcctgacctcgtgatccacccgcttcggcctcccaaagtgctgggattacaggcgtgagccaccgcacccggcccaaattgtagagttctatgtacagccacgtttccatgatctttttttgttgttgtttttgttttgtttttgtttgagacacagtctcactctgttgctcaggctggagtgcagtgatgcgatcttggctcgccgcaacgtccgcctcccaggttcaagtgattctcttgcctcagcctcctgagtagctgggattacaggcgcccaccaccacgcctggctaatttttgtatttttagtagagaggaggtttcaccatgttggccaggctgctctcgaactcccagcctcaagcgatccaccacctcggccttccaaagtgctgggattacaggtgtgagccactgcgcccggcgtgtttgctttttaaagtgcatatgtctacatacacattttagaggcaaatagaaatacaaaagccaaactgtccacagtggctgtctgtggcagttggagtagcagtaatggaaattgcattttctctgtattgtccaaaatattcactactagcatatataaatcagaaagaggagcaatgattcaggacttctgtttgacaaaatgataataataataattcctctttaaataattggaaaatacaggctggatgcagtggctcatgcctgtaatcctagcactttcggaggccgaggtgggaggatcccttgagcccgggagtttgaaaccagcctgggcaacatgtcaaaactccatctctacaaaataaaaaataaaaataaataaaaatgggaaaataaagagaatgaagaaaataaaattcatcagtaccccctgccaaatattggtatttttctttctggttggtttctttctctacaaaatgtgaataacggtattaactgtacaggaatgttgtgaggattgagtgagagaacgtatrtaatagttaacattccagaagtgttagctatttttatatgtaacaaaatcagcaccagactgtatctactgtttctgtgctgccgtcttcacagccaacattgcttcatgaacagtttcccattcaattatgctttttaaaattgtatttttagtgatagtacagtattttattacatttaagtacaatttatttaagttatcccctattgttaagcctttagattgtttccaatttttgctgttaaaataacagagagattaacatctttaaacatctacctttgtcagcatttctgattatttccttagatgaattttttagaggtaggattactgggacaaagggtgcaaatatttttcaggcttttgactcaggttaccaaattgcttcccagaaagatcttgccaatttacattcccacctgcagtgcgtgagaatgtctgccccacagcacacaaaggagggattttattttgggatgggtgagatttgagtctgttgctgaaccgaggaaaatgagccccccaagccccatagcgaggtagagtttaaacttcgggacagagaggggatgtcaaaacaggcaaagtccatgggagaaagggaggggatttggagcaggtttacagagattgtcttggatttaagaagggacaccttrtgtttggagactgatggaaagaggtatgattgggtgtagacagaatcattgtaaggaggtaggtggattcaagaggctagtccctagtggctaccttttctcagtcaagtaggaggttgggtcatctatccaaaggtaataggtgagcctgagaaggggacttgaggagagaggtgcgaccctttaacttgaggacaataaaagagttgactgtccagttgagggtgatgactttgagtttgtcatggcaccattctgcagagctgtgggtactttctctacagcacgcagtcacctggggaaagaaaaagtcatacatattaatttaaaccaaatctttcaaaatgtggtcaacagtagaaaactatttttggggagctggagggattcatggtaatgaaaaacttgtgggtttctggagttgtaccgaactttcaaggatcagttaatttctatcttatataagttgttccagaaagttagaaaagaccaaagttgcccagatcattttatgaaaccaatataatcttgattccaaaatcagtaaggacaaagcaataaataaatgtattaagttcatttcacctatgaatgcatgtataaaaatcctggccagacacggtggcttacacctataatcccagcactctgggaggccaaggcaggcagatcacttgaggtcgggagttcaagaccagcctggccaacatggtgaaaccccgtctctactaaaaatacaaaaaattagctgggcatggtggcatgcacctgtaatattagctacttaggaggctgaggcaggagaaacgcttgagcctgggaggcagaggttgtagtgagccgagattgctccattgcactccagcctgggcaacagagcgagactctgttaaaaaaaaaaaaagaatcttaaataaaatagcaactaatctagttatatgttttttgaaagtaggtttatcccaggaattccagctcaacattgaaaatcaccccactttaataaaggacaaaaatcacatgaaaaaaatcacatgagtatctcaaatggtgaagaaaaagcagcatattgataaagtttttcmcctattttttatttatgaataactcagcatatgacttccttgaacttatgaaaatgaaaaaaaaaaaaaaacttagcaaactggaaataggaaaggtgtgtttaatttgataaaggttatatagggccaggtgcagtggctaacacttgtagtcccagcactgtgggaggccaaggcaggaggattgcttgagcccaggagttcgagactagcttggacaacatagtgagaccccatttctaccaaaaatacaataattagccaggggtggtggcacatgcctatagtcctaactacttgggaggctgaggtgggaggatggcttgagcctcagaggtcgaggctgcagtgagccatgattacaccacttcactccagcctgggagacacagcacgaccctgtctcagaaaaaactggttatatagcaaaaacttaaagcaaacactacacttaatgaagaaactaggagcattcactttaacatctggaacaaaataaggcayccaactgtactgctatcatttactatataataatagaagttccagacaaagctatgaatgaagaaaaatgtaagacatacaggatgagaagaaataaaattgtcactatgtgaagatattttcatttgtcttgaaaagcaaagagaatcagcatagacttttaaaattaagataattcagtcatttagtagatagaagattgaccaaaaataaatccttaacatttgtcttcaccacaaacaacatctattcacaacagcaacgacaaagtataaaaaaatctagtaatgtacttaattaaaaatatctatggagaaaacatgaaaatgctaattaaggatgtagaaaataacctgactaaatggagagaaattttatgttcttggatgaaatgattgaatattatataggaatcagatctttatgagttaatctataagttcaatggaatcccaataaaaattctagctctattttccaggaacttgataaactcactctcaaatttgtgtggacaaacaggactaagtcaaccttaaaaaaataaagagctagaatttgtcctaccagatattaagcacactacaaagctatgtcaaaccaaaccaaatcaaacaacattgttttggcaccaaaacagaccaatagaccatggaatggaatagaaaactgaaagtcagaccattagcatacaggtgggagacatcacaaatcaatgaagaaagcagattaaacccgttcgctatgtggggggaaaatctagaatccctgccttacaccaaagggaaaggtatatgctgtgtggtgttctgatatatatattggttttcgtccatatattggctcctaactcccatagcccttgttacagtcttgttagaatgttcagtgtgtgaggcctcaggaaacacaatctctcttctgccctcctttcacctgccccaaggcagacatctaatctatccccacttttctgattgtgggtcttaagaccctccctgagcggattccacctcataccctgaggggcaagaatgtttccataaaaatccaagaggactgggttcagagagatccagatagctgaacacatgcaggctgacaggaagaacgcattcatgggcctggagggtggtgtaycccaactccatggggacagaagctcctgtgctggagacccttccagaactcgctagaggtctcttcatctggctgtttatttgtatcctttaaaatatcctccttagtaaactggtaaatgtgtttccctgagttccgtgagctgctctagcaaattaatcaagcctaaagagacgggcgtgggaaccccaacttgaagtcagttggtccgaagttctgaggcctagagttgtggctgcggggaaggagggagaagtcttgggaactgagccctcaacctgtgggatctgacactatctccaggtagatagtawcagatatgaattggaagacaccagccaggtgtctgctgcttggtggtgggggaaacccacacacatctggtcacaggaggttctgtgttgatgattgttgctgtgtgatgtaaaacactaagtgatgtaaaactttaaggtgagaaataaaaccaaagttaatagaagaaaatataagggactatctttgaaacttgggctgggagagggactcattaaacagaacttcaaaggcacaaacccaaaggcaaaaaatgcattaatttgatgacatccaaattaactatttccatacaaaagaggatactatggacaataggtgacagaataggtgaagatatctgtaaatctaaaaatgataagggattaatacacagaatatgcaagtaccattgacacaggcttttattctcagtcactttgcaagccaggaacctctggctggcaatgccccacccaggcctcccttgaccacactacctgttgcaggagatggcctgcccacttggcccacccatgctgagtatggcttgcacacctgttyctgagttcttgtcctgtgcccaagaagaatgaggatgcactgacagtcaaagaatgagcaaggcagggaattttattgagtgatgaaacagctttcagcagagaggggatgcaggggtggtccgcctacccgaaggctggaaagtccccataatatgactaagtccggggctttttacaagctcagaatgggggaggggcaggccacaggtagtattggaaaaagcaacattctattggttaaaaggcattcagaaagaatcagttgggaaagggaggcaaaaagaacagaagttctcattctgggttgcagtttcatccaggaccagcagtccaatctttcagccttcaggctgtttttggctttaggtggggtttcaccggggacctgcccctgtctgcctaggctgccccctgttgctgtcactgtcatccctccatatccattggggatgggttctasgctccccctcaggtaccaaaatccaggactgctcaagttccttattaaaaatggcgtagtatttgcacaaaacttgtgcgcaacgtcctggatactttaaatcatctctagattgcttatagtatctaatataacgtaaatgctatgtaaatagttgttatactgtgtgttttttaagtcattgtattgttgttgttgagacaaggtctcactctgtccctacaagaaatttaaaaattagctggggctgggtgcagtggctcacgcctgtaatcccagcactttggtaggctgaggtgagtgaatcatttgagatcaggagtttgagaccagcctgaccaacakggtgaaacccaaattagccaggtgtagtggtgggcgcctgtaatcccagggactcgggagggtgaggtatgagaattgcttgagcctgggaggtggaggttacagtgatctgagatcatgccagtgcactccagcctggttgacagaatgagactccatctcaaagtaaataaaaattagatgggcatggtggtgtgtgcctgtagatctaactatttgagtggctgaggtaggaggatttcttgagcccaggagatcaaggctgcagtgagctgtgattgagccactgyactctagcctgggtgacagagcaagaccctatctcagaaaaaaaaaagactcaattatattgttgtgtaaaatatacccactttaaatataaagatccatatagactaaaagtaaagagatggagaaggataagaaagatataccatgctaacactaatcaaagaaagctggagtaggtatattcagacagagcagacttcagagcaagcaaattaaacagggataggaggggcattacataatgacaaaggggttgattctccaggaagacataatctttaatgggtatgcccctaacaacagagcatcaaaatacatgaggcaaaaactgatagaactgcaaggagaaatagatgaattcattattttagttggagacttcaatacccctttgttgaaaatggactgatccagcagtcagaaaatcagtaaggacatagttgaactcaacagcaccatcaatcaacaggatataattgacatctatagactacttcatccaaaacagcataatacacattcctcacatgtaccgttcaccaaartagaccacattctgggccacaacctgcaccctacctaatttaaaggaacagaaatattacaatgtatgctctcagactacaatgggattaaacagaaagatagctggaaaatcccccaaatacttggagactaaacaacatacttctaaatgacatatggctgaaaaagaaatctcaagagaaaccaaaaactatttgcaactaaatgaaaatgaaaactcaaattatcaaaatttgagggatgcagtaaaagtgcttagagggatatttatgacattgaatgcatatattagaaaaaagttctaaaattataattcaagctttcatcttagaaaaagaacaacaaattaaatgcaaggcaaggaaaaggtagcagatcccatagaagaatggacagtttatcaagagaaaacttataaaagtggtaacccaaacaggcaagttaagggaattattaaaaattaaaatcattagtaatcaaagaaattcaattttaaacaacaatgaaatatcagccttacacctagaagactggcaaaaattggaaagttggaaaatgtcaagtgttagcaggtaagtggagatatagtttccttcacatgctgctggtgggaatgcagattgtcaaccattctggagagcagtctgatacattagatatactagataaattaaatatatgcacagcctgggacccagcagatctactcctgggtgtatatacactcaggataagtaatcatacaggtccatcagggaatacagattagaacattggctgctgtgtcagttctgctagcaggcaattggagacaagcagttgtccatctggagaggaataaatgggtgaaatgtgaatgatgcatgtagtagagtgctttagtctgttttatgctgctgtaacagataccacagattggatgatttgcaatgagccaagatttatttcttacatttctggagatgggaagttcaagatcatggygccggcatctggcaagagccttcttgctgctgtatcataagatggcagaaagcatcagatggcagtagagcaaagagagggttagagagggccaaattcactctttatctttcatttttatttttttgagacaaggttttgttctgtcacccaggctagagtgcagtggcatgataatagctgactgcagtcttgaactcctaggctcaagggatcctcccacctcagcctcccgagtagctgggaccacaggtgtacaccaccacacccagctaattttttttttttttttttttttttgtagagatggggtctcacaatgttcctcaggctggtttcgaactcttgggctcaagcaattctcccacctcagcctcccagagtgttgagattataggcatgagccactgtgcctagcccctaaacttgaactcttgggctcaagcaattctcctgccacagcctcccagagtgttgagactttggattgtctgtaatgctcatgcattacaggcatgagccactgtgcctagcccctaaactcactcttttataatagcaccaatcccactcatgagatggaagctgtcaagttcttaaaagtcccacctcttaatactgctacaatagcaattaaatttcaaaataagttttggaggggacaaactttcaaaccatagcagatgtatacatagcaacatgaatgaatcttaaaaacagccctcagtgacaaaggtaggaagcataatgagataacttgataccatttataaattaaagtagatgcacatatttttgtaatttattgtatatgttaccaattttaaaaatgcatacacacaaaacttgaaatggatcataagcctaaatctggaagctgaaactgtaaaacttcaaggagaaaacatgggaaaatcttatgatttgaggttaggcaaagattttaggattaaaaaagcatgaatgaaaaaagaaaaatgaatgaattggcatcatcaaaattaaaagcatctgcttttcaaaaggcaccatcaagaaaatgaaaagacaaactgtagcttgagaaaaaatatttgcaaaacacacaaatgataaagggttttgtgacagtcatcaacttattgcttcttggctccaaattcacccttctttacctgctctgtgataatggaggtgggttaaataaatatttttctttgatacatgatgttaagccagtagtaggcatgggaggaggaagaaattgtctcttactctttcccttttcctgaaaagggcagcttctccagctcccagttctggcagtgcatggtaaccttcagtgcccagctgacagaagcttccctcagcatcttctctaagtggtgtgccactggcaaggcacctgaccatgaacggcttcccccagcaccccatcacctgaagaatttgcagcaagtttcaaggtatggcacttctctgtggacaacaccccctagtaccctaaagggaagattccactattacactgtgagccacttcagtgtcttctccaccacccaggatgccatgctgtgctctccccagcagggtctggagttcttccttggacactctatcctgctggcagcggctgttccctgtatttgccattcttgcattcatcagagttctctataactcttatgagtcgatttcccattactcaaatctcctgttatttctttatgttaaactttacctgttttccatttcttgattggacagtgataccaaattctatccagaatatatacagaaacctcccaactcaataataaataaaaacactgacttaaaattgaacaaaagatttagagctgtttaccaaataagatataaaacaaacactaacttaaaaataagatataaaacaaaagatttaaagctacttcgccaaataagatataagcacataaaaagattctcaacataattagtcaatagagaattgcatattaaaaccacaatgagataccattaacatcacaaaatgctcaaattttaaaatcttgacaatacaagctgaggatgtagagcaactgaagctcttatttctttttctttttacctttccttttttcttccctgggatggatcctgagcaactagaacacttatatattgctgatggaaatgcaaaatgggacatyggtttggcaatttccgataaagttaaatatatactgatgtatatatctcattgttttaatatgcaattccttaatgacaaataatgttgagcattttgttgttgttgttgttgttgctgtttgacagagtcttgctctgttgcccaggttagtgcactggtgcaatcacagctcactgcagcctcgatctcccaggctcaagtgatcctcctgcctcagcctctcaagtaactgggactacaagagtttgctaccacaccagctaattcttaacttttttgtagagacggggactcgctctgttgcccaggtgggtctcaaactcctgggctcaagtgatcctcctcggcctcccaaagtgctgagattacagacgtgagccaaccccacccagacatttttaaatgcttatttgccatctgtttatcttatttgttgagatatctgttcagatgatccattttaaaattggtttctttgtttttgttgagttttaagagttcactgtatgttttggatacaagtactttatcagatacatgttttataaataatttctctggtctgtgactttttcattctcttaacagtgtcttgtgcagagcagaagttattaattttaataaagtttgacatcaatttttctttcatgaatcatgcttttggtgttgtatctgaaaattcatagccaaatccaaagtcatctagtctttctcctttcttcttctagaagttttatagctctgcattttatattaaggcctatgacccattttgaattaatttttgtgaaaggtctaaagtttgtttctggatccttttttttttttttttttttttgcatatggtgattccagagcaatttgttgaaaagattaaccttttcctattgaattgcctttgctcctttgtcaaagattggttggctattactgaatgtaaattataccttaataaattaacataagaaatacatattttccaaaaatacaaaaacatttactgtaaacatagtaaagtggttgccaaggtatatgagagagtgtgtaatatgaatataaaagagaatgggctgggctcacgcctgtaatctcagtactttgggaggccgaggcgtcgaatcacctgaggtcaggagttcgagactatcctggccaacatggtgaaatcctgtctctactaaaaatacaaaaattagctgggcatggtggcacatgcctgtagtcccagctactcgggaggctgaggcaggnnnnnnnnnnnnnnnnnnnngaaagaggcaggggaatagacgaaatgttcgttagtaggaaaaggaaagaaatagtacgtttgggaggtggcgtgggtgtcagttcggccccaggaagcagagggcaggtttgtgtgtgtggaggcagagggcgggggcctgggaataggtaggggtgatgacaccaacgcgccggaaccgagggcctgatcgaagggacatggcagaaaaggaaaagaaagggaatgaataccgggatggaaacaagtgaggggccttgcacgcaattataattttttttttttttttttttttttttgagacggagtctcgctcgtcacccaggctggagtgcagtggcgcaatctcggttcactgcaagctctgcctcccagattcacgccattctcctgcctcagccttccaagtagctgggactacaggcgcccgccaccacgcgtggctaattttttgtatttttagtagagacggggtttcactgtgttagccaggatgatctcgatctcctgacctcacctcatgatctgcccgcctcggcctcccaaagtgctgggattacaggcgtgagccactgcgcccggccgtctttattcttaatctaatcgggcaacatgtaacctaacgaaaatatcagtgttcctctaggatacatatttctttgtagctgtaccttagcaatccatctccatgtgggatagtataattttttgtttctttgcttgttttgcttgggagcagtatggtaaacatcttggacttagagcagaataaatatgtaatttatcacacatactgttactcagaagtccagatttggtcttctttagtgtccattttgaattgcagctgattctattactagttttattagaatttgttgatgatgtgctgattttcttttgtttatcggcccttttcaccccagcaacttacatggtgaatgacattcatacacaaggcacattctcctggccataaccatttttttgtggaatattaaacattttatggagaagtaaggtgaatagcccctcagattttttttggcatgagatttatcaaagcattttataaacatattagtggtgtaaaatcagccctttaaagaacttttaaaagctctgtcattttataagaaaaagtacacaaatataaccaatctaattttttaaarcataaagctttatttaaattaaaattttttaaacaagtttaacatttttccatgtctttctaatacaatagataacatcaggaaaggaacaagtatgcactgttgcagaataaacatgaattaatcttattttactatttaaaacgataacagaatttatgtatatatatcaatatgactatgattatgagaaatagcacttaaccatcagtttctctccttttgatttggtaatcattgctgttgtgtggtttataacagaaattatccctgggtcatgctctctcctgtgtctcctagacgtggatgtagtctttgtgtctgagttgtctcccctgcctctttccatattaagaattcatctatgggtacgattaacaagaaaattaaagtaagtataaaaatcatgctgggcacagtgcctcacacctgtaatcccagcactttgggagaccaagctgagaggatcaggattgcttgagttcaggagtttgagactagcctgggcaacatagtgagacctggtctctacaaaaaaaaaaaaaaaaaaaaaaaaatcaaaaaatttgctgggcatggtggcatatgtattttttagtcccagctaatcaggaggctgaagtgggaggatggcttgaacccaggagatcgaggctgcagagagctgtgattgtgccactgcactccagcctgggtgacagagcaaaatattgtctcaaaaaataaatacataaatttaaaaaaataaaaatcatgactcccaggcagcaagtttttaaatttatttgtggtgcaactgtcaggggtactagccactagctgaagcagagataagttgtgggtcaggtgaaagtctgggtacctcattgtaccagccatatctctgcttctccagaaagcagatggtaattcaagggagtgagagtgccttattatatttgaatgcactctaatttttcacagttagtgatatggtttaggtctgtgtccctgcccaaatctcaagtccaattgtaatccccaaagttggagatggggcatggtaggaggtgattggatcatgggggtggatttcttctttggcgctgttctcatgatagtgagtaagttaatgtgagatctgattttttttttttttttttgagacggagtcttgctctgtcacccaggctggagtgcagtggtgcaatctcagctcactgcaacctctgccccctgggttcaagtgattctcctgcctcagcctcctgagtagctggcgtgcaccactatgcctggctaatttttttgcatttttagtagagacatggtttcactatgttggtcaggctggttttgaacttttgacttcgtgatctgcccgcctcagcctcccaaagtgcatctacactcccaaagtgcaaattagccggccgtagtggagcatgtctgtggtcccagctacttgggaggctgaggcaggaggatcccctgagctggagaagtcaaggctgcagtaagctgagatcataccactgcactccagcctgagtgacagtgtgagaccccaactcaaaaaaaaaaamcagaaaaacccattacagacacagtgaaaatttccttaaaacacatcccccctccattattgaggtatagcatagatggttaatttatttttaacaaatactgttcaaaattcagttactgaagcacaatttatgatttatttcttgagacaactttgcctttgatgatgacataacaaggtgttgttatgtcatccaacagcaggactgttggaaaatgtatttctcaaaccatcaaattcatgaaggaaacagtctcttttgattttcyctattgaaatataacttcaccagaccaatctggttcaaytgtaasaaaggttaagtaacctgagcatacccagtgtgcatgaaccaagcgtgcaatcaccagaggaacctaagtgctcaaacccaaggagcggggagtgaattaagaagtggacaccacatggcaggatccaggatccaatcagatcaatccctgctgtcacctcatggcaggatccagtcagatcatgcctcccagcatcacttcattgcaagatccaatcagataacaccttattaccctatacttataaaacccagcccaggcccccagcttgggggagacagatgagcattttcccatctccttgccagttgactcaataaacctttcttgctgcaaaaactcagtccttcagtgtttgcctttccattgcatgagggcaaatggacctggtttggtgatgtaatatgtcatttccacactttttttgttgaatatataaatgtaaattcagcattcaaaaatataaaagactacaaatgaaaagcaagtttcttgtccagtgttgtcctgaaatcactcataatttgtcctcccaggaggcagctaagactacagtttcttgtgtgtacttccagagatattttatgtattcaatgaattttcacaatataagtatctctcataaaacagaaacgcaactatcctggcttaaccaagcaggagtttggatttctctaatgagaggtctggggtgggtgtagcgtctccactgtatcatcaatgtcccggcttctatccatgtttctactcagttacgcttaatgtaactgagtagttacgttatcttgcttattaagtcttacggtcacggtcacgagttgactgctccaccttcactctcacatctgcgtctcagaaatgaagaagtagcagggaagagggaaaggtggttcctgtattaaagcagaaatgtcctcagatctccagctgtctcccatttatatctctgtggccacagtggtgtcacatagccacttggagggagcctggggagtgaactattttatctaggcccattccactctcaacaaaatttctcttagtaaagaatgacagcaaataattgcatactatatattaatcctaccttgcttttttcacttacctactgtatgtgactcagcatacgtgtccttctcagataacaatcaatgtcatttatttatttatttcaatttgtcatttatttatttatttcaatgccatttatttatttatttgagatgtggtctcactctatcacccaggctggagtgcagtgacacgatcatggctcactgcagcctcgacctcctgggctgaagcaatcctcccacctcatccccccaagtagctgagatgacaggcacatgccactaagcccagctaatttttgtattttttgtgcagacagggttgtgtcatgttgcccaggctggtctcaaactcctgggctcaagtgatccacctgccttggcctcccaaagtgttgggattataggtgtgagccatagtgtctggccccatttatttcttcattcatttaacataagaatctgttgctaatttatgtagtggagagtaactgccttatatctgtttctgctgggtttttttttttgttttaagacagggtctcgctctgttgtccaggctagagtgcagtcacacaatcatggctcactacaaccttaacctcccaggctcaagtgatcctcctgcctcagcctcatgagtagctgggactacaggcatgcatcaccattctgggctatttttttttttttttaaatcaagacagggtctcattatgttgcccaggctggtttcaaactctggagctcgagtgatcctcccaccttggcctcccaaagtattgagattacaggcaggagctatcatgcccagcctgtttctgctgtttttagaacacagattattaactggacacaggcacccagaataagactaaatttccaagcatgcttctgactaggtgtggccatgtgtctaagttctcgcctatgggatgagaacagaagtaaaatgtgcctttgaagaggatgtgtgccttctccttcctcttttttcccttcctgctggctgcattgtgcacttggcattgctccatcatgcagatgagaggttgtatgtaacagcagccaaaactacatcctgactaatacctgtgttaatgggccagacactgcactaggggctcaggacacaaaaaccaatacaattaaatttctacattccaggagctcaaaatcttgggtagaagaccaaagggtaagcaaacacttttgaagtcagcactgtggtagccccagggcctctggagcacggcatagccaatcacctaccatgtctatctatccatttgtgcatctctttagccatccgtgcatttcttaatttacccacctacccatagatcagttcctctctcatctatctgttcatgcttgcatttattcatccatctctcccacatatctcatgaggatcctgcagggtttttgttgttgttgttttatgagacaaggtctcactctgtcacctaggctggagtgcagtggtgtgatcatggytcactgcagccttgaccttctgggttcaagtgatcctcccatctcagccccctgactagctgggaccacaggtgcatgccactgcacgggcctaatttttaaaatgttttgtagagatcaggactcaccatgttgctcaggctgatcttgaactcctggyctcaagtaatccttctgcctcagcctcccaaagtgctgggattacaggcatgagccaccataccargcctctgcagttatttttgttgagaattatatagggcccgttcaattgtatttttctcaaattcaagccaatcagaatggcacctttcacctcaattttaacagataccaggaaccaagatcaccacacacacgcaatataatgatgaaatttcatgttcaaatcacataactaaatgctgatttgtgaacatttttagattttcctaggtgataaaaatgatacagtcattagtttttttcaaggacagtctcccacttctcctgagttggatgtgccaccagcccaccttagagccagccctggggaaatgcagagggagacagagggcaaattcggtgtttgttataatcatgtgtgatgctatgtaagagctatctttagctgtgtacctcccttattcttgaggggtagagtaaggtggggtgaccaccaaaggaagccagcaggcttcgttcgcctccagggaatgagattccttgtctccctctctttcttactttggccactgaaatttctccaaaactcttcttaggaataaagaaaaaatcaagggtgcagattatggcaagaacatagttaaggtatgcagttttgtttcatttaatgagaaaatatagtggttgtgttaagaaattaaatggctcacacattgatcctcattgatatatattgaatgttgtttatcaaaaacattgtgaatttatttggtttaaaacaaatatcaaacttcaaatcaaacttaagtagtaagtctaatattaatggagatgaactaggattcgaactgagcaaggagggggaagggatggaggaaggaggactttttctgtttaaaatctaaggagccctggaacttacagaaattcagccctgtttttggtactagggagatacaaagatcagatctcttctgcccctgcttgtaaggcaggaaattttctgtctacttaagtagatgagacacaaatctgcaaagtcatatagcagaacaggaagctactgtcaagagatgttacaaaggggcgggggagagtagggagttgaggtggcgggtaaggatatgccaagtgtcaagtagatagtgcaggaaagaaatgcacatttctccaagggggtggtatccacaatgggttggaatggccagggaagctattctctccccttcccttccttccttccagttctaggcattgggggatacagtggtgaagaaaacagaaagaaatcctgccmttctggaatttacattctaatgggggcaagacagacaacaaatgaaataaatacaaataacagtgtgtaagacagtgatacgtgctatggaaaaaataaaacagggaaaaggaatcaggactattgggagagtgtaatttaaatattatggtcagggaaggccccacagaaaaggcgacgtgagtaaaaactgaaggagatgagggagggaaccatgtcagtattcagaggaagaacattcggaacagagggagcaaatatgcaaagcacttattcggcacctactgcatgcccacatgacagcaatagcaatatgtggctatttgccaaactgtcttcattcgtgaaacatttaagcttactacagaagataagagtttttttctttcccatgaggttgagaatatatggaggatgggttgcccagaagcagtggcaacatttgcattaaaagaaggcagccttttaacccgaggaggaggctgagaatccaatgacttttctgtcatacgattgaggggacaggagcctagtgataatgggacacggagcttcggctgcagagctctcttttgtccacaatttagggcaactgtcttgcactctgcctccatcctctgggtagactcagtggaggaaacgtttccacaggcaccaggcaaccgggctcctggaagcagcagacccgggagaggagagcaactccccagcttggtgttagatatcatctgagactccttacaccctcgcagcttagaagctcctcagattaccaggcaaggcaaagttgattttgacaatgtctggggaaggaagggctgctcttcctggctggctggcataatcagactctggaggagtcggcctgcctatcaaaggaggtgagagctaagttgttgctgcctttccgcttcaggatgaatggattccaccccattgaactggagtgacctggygcctggattctttcatctctaaaatgggaaaaataattgttgcacatatatggtgttgaaattatggccctcaattggtgataattatcattacttagtattaataattattatttgtgaaacttctcccagaattgctgcatggattgcaatgtccaaataagcttataatggggcttccagacactagcagtgaggcagtttctgtagaggttgagtggcggctcttcaccgactaactgggtttgcgtccccygcctttttgttttccttttttaaaatayattttttaaatatcatggagtgtcactatgttgcccaggttagtgtcgaactcctgagctcaagggatcctcccactttggcttcccaaagtgctgggtttgcatcctggatggcctcttaggagctgtgtgcccttgggcaagttgtttaaccttcctgagctcctgygtccctatctttaaagtgaaaataataatagcacgttttactacttggaaggaggctggaccaggttttctacagccagaccatctacgctttccaaagggcctgggcagcaagtgagtattagtctactaagagtgtaattatgttatattaacagcacctacctccaaaggttgctgcgagcagagagcacctcacagtgctttacagcagtgcccggctataaccatcacagcattattattaatgtgattagcctcattttgcagatgaggaaatataggcccagagaggttaagataccccacgcagggacctgcagctagtcggtggcagggatggcgctggaatccaggggttccctccagaaccccacagcggcccatgctgaaaaccagacaacgcccgcccccgccagaaggcaccctgggaacggaaagctggcagccttccaagtcccaggacgcgctggggcccagcccccgctccgccctcccccatccctggaacaaagtacacttctgccgcaggaacattccagcaaactgaaggcatcgcgggcgcggccgccgcccccgcctccccacagctgcacrgagcgtccacggccccaggccgagccccactgtgccccgcttccgaccccgcccgccctgccggctccccgtcgcccgccgcgtgtgcagacgcaatcgcaccggaggaattctctggtctctttgctaacctcgggacccgcagttgcaaaggctgagggacggggtgggcggagcagacgctgaggactgcggtgcccttaggggcacggagtcgcttggcagcaaccgctcctgggcccgctggtccccggtcctgggcagcccccactgccccactttactcctttacaggataaaggcatgctgttgttaataacaagtagaactaggagaaagatctctattaatcccaccaggctgagacaactgctattaattctggttatgtccttcctgactttttgtgtacacaaaaaacacagatgtacattaacacgaaatatcctgcgatgatactgtttgtttctaaattaacgaactttagttgttagagcagttttcagttaacagaaatttgggaagctagtgcagcgttcccatataacctcycaccgctccctcagtttcccctgttattaatatcttgcatttgtcacaattgataaaccagtattgatatattagtattcactacatttcatggcttatattaaggctcactctttgtggcgtgaagttctttgcgttttgacaaatgcataatgtcgcatatccaccattacagtatcatacagaacaattggcccaaaaaatcccctgtgatccccttgttcacctctcaccctctaatcccatgcagtcactgatctttttactgtttctatggtttggccttttccagaatgtcatatagtcggaatcgtatagtctgttgccttttcaggctggcttccttcacaaaacaatatgcctcttaagattccttcatgtctttttgtggcttgatggctcatttcttatttatagctgaataatattccatagtactgacgtaccacaatttgtttatccattcaccttttcaattgcctccagtttttggcaattatgcaaaagatgctataaacatttgtgtgcaggtttattttactgctttctggcttgcttttaaaaattatttcagtccaggtgaggtatggagtaaagaaacaaacaaacaagtcatgaatgtcattcaatataaatgtagatctatatcatcattttaatggctacataagatactatcagagtttatttaaccagccccagttgtacaacatagattgctgtcttctttgattctgacctcataaacctgtaacaacttggtctacacttgatagtatcttgtagttgttaaggcttagttgcttgtgtcctgtgttcaaatcccagccactccacttaattacttggtgtccctggataaagtatttaattccttatgagtcagtttcctctttgtgaagtgggaataataatggcacttattgtgaggattacatgagctgatacatgtaagatgtttagaacagtttagaacctagagcaatacaaactcataataaaatttagctctttttattatttatttatttttttagagacaggatctcactcttttgcccaggctgkagtgcagtggggcaatcatggttccctgcaacctcaacctcaagcaatcgtcctgcctcagcatcctgcatacaggtgcacaccaccacgcctgggggtttcgccgtgttccccaggctggtcttkaactcctgagcttaacaaaatgatccacccacctcagcctcccaaagtgctgggattataggcatgagcccctgtgcccagctaaatttttatttttatttatttatttatttatttgagacggagttttgctcttgtcgcccaagctggagtgcagtggcgcgatcttggctcactgcaacctctgcctcccaggttcaaatgattctcctgcctcagcctcctgagtagctgggactacaggggcgtgccatcacgcctggctaatttttgtatttttcgtagaggtggggtttagccaagatgttagccaagatgttctggatctcctgaccttgtgatccacccgcctcagcctcccaaagtgctaggattgcaggtgtgagtcactgtsctcagcctatttattttattttatttattgtttttggagacagagtttcactctgttgcccaggctatagtgcagtggtgcaatcttggctcactgcaacctccacctcctgggctcaagtggttctcatgcctcagcctcctggagtagctgggattacaggtgtgtgccaccacacccagctaattttttgtatttttagtagagatggggttttgccacgttgcccaagctggtctcgaactgctgagctcaggcaatctgctggcctcggcctcccaaagtgctaggattacaggtgtgagccacaatgcccggcctttttattttttattagagacaagtcctyactrtattgcctaggctgatcttgaactcctgggctcaagggatyctcccaccttggcctcccaaagtgctggaattacaggcatgagccactgcacttagcgctcttatttattgtctattgagcatctactttgtgtcctgagctaggcttggggaagttatcaaatactaaatcctatgtatagtttttttaattaaaaaaatattaatttatagagacaaggtctcactatgttgcccagattggtcttgaactccygagctcaagcaatcctcttgccttggcctcctaaagtgctagggttacaagcgtgagccactgtgcctggtcatatgtgtaatgttaccctcaaaacactttagtttggctcctgctgggggataatgcaaagcacagtagtactaactctttatgttgttttctctgygccaggcactgttctggaccctgggagtagcagggttggaatttgaaygcaggggtctggttctaaccaccctgcctctctgtacaagtaatcccagtgcaaaagacaaagcaagatgtgttctaataaaggggagatgaagaactatgagaattcagaggacccagtgatggcttccagctgggcataccagggaaggctctttgttaaacttcacttagtgaacacctatggagcttttatagacaatacacatccctaagcactgggggagtaaagaagcacataaaaccaatgggaaacatataatttggtgggagagaaagaaaacagactcaacaagcaaatgtcaaatggcaggttgtgacacaagctacaaaggaaacacaggcttccttgacgataatactcggggtgtggtggggattggcaccttggtcaggacagccttggaggaggcagctctgaaacactgagcactgtgagacgaggagccagccatgggaggaactgtgggggatattctaggtgccagaatgagcaaaagcctggaggcagaagggtgtcttggtattatatgttttaaataccatcggaagctaatatggaagggacacagggagcaaggagcaagtggctaaagatgaagttgcagagtagatacrggccagtttctaagaactttctaacctaaaagaacttcctgaaagtggctgaatagcctggaggtaaggacaagaacatccactccacgtgcagctgtgatggaccaggctctatacatgctcttcacacagtgttgtattcaaacttgcctacgactcacttggcaagatagggagctgaggattgggttttattcccagtgtgtagggaagccactgaagggttttaagcaaggaagtagcatggctggattgatattgtagaaagatcctgtgggctgctgtgggaatggagtgaatgtttgcaagggaggaatggggggaccaattacctgactactgcagtcacctgggcaagagagagaatggagatttggctagaatgatggcagtggacaggaagagagatggatttgaattatatttcagaggtgaggctgagagaagatgttgatggattagattagggtggggtagggagaggaaggaaacggatatatgctcattttaagtgactcaaacaattcagaaaagtataatgaagaaaccatttaaaatcctctaaaatccacttgcccagagagtactattaacttgatggagacaccctgctagacagctttctayccccaaacatagggaataartgggctccttcagttgaaaaccacagagatccactgaagctgacttatgtaccagatactttgtttcgaggacttaggggtgtctcctggaactgcacaccagtcagcttcatgaagaactggaagcagtgcagaaagccrggaatacaggggcctcttttttctctctggggcttaccatctamttctccctgcctcctctagtcttctcttctttggctgactgaccttggtgtgcacactccatgtggctgccctcccttgctttgtattactccccaactccagcatctaacaagatgtgctgatggccttgagtcacagatcccattttctgggagagaaaatgggatccagcacactgacgatgaagtggtccattctttgtgtattggtctgttttcacattgctataaaaaactatctaaaactaagtaatttataaaggaaagaggtttaattgactcacagttctgcatggcaggggaggcctcaggaaacttacagtcatggtggaaggcaaaagagaagcaaggtatgtcttacatggtggcaggagagagaaaacgagcagggaactgccacayacttttaaaccatcagatccagatctcttgagaactcaatcactatcatgagaacagcatgggggaaaccaccctcatgatgcaatcacctcccaccagcttcctcccctgattacaatttgacatgagatttgggtggggacacagagtcaaaccatatgactttgcaggatggagaaaggtcactggtacagatgcaggtaggctgtttcctttggtggtgggaagatgaggtggctctcctggatgctgcttttatttcaaaggaatgggygaggttgtcaggtgtgaagctgagagtggattggggatgggatgggatgttttctaaaaaacaagaagatatgaaataatttgtgtttgagagtagagacatgaatgagtgctgatggcccacttgaggtttgtggtcataaatgtaaagagagattagtggacagagttgttttcttccagtcacatstagctgctcaggtgaagggaatttgctctggccatttttcaggacaatataatgaggaagagaggggccaggagtggttattgtgttagaatctaaagggataattaagaaagtgagaagataagtgaagggataggtagtgaaaacattaggaactctggctgggrttgaagagttattgagtcaggatactagagtgagagagctggaaatattggaagggttggccaaagagtgaggtggggtgctaaaaatgatgattttaaggtggtgaagcagtcattgctgacagtccagggcctgaccatggcagcaggagactgaggccataatgagtacaagacagctggagaggaagagatcaggagtctgggcagccagcctcctacctggccctagtggttctcatgaggtgtattcactccccttgactagtccctcctgtgctcattggggctggcatgtgtaataataactgtatgtcttctgaggctgtgttctaaaagacattgcagcttctgtctttgttctcttggattgtctcagggaagccagccaccaygccatgaggacactcaagcagccctgtggagagacctacctagttaaccaaccagcacgaatttgtcaggcatgtgagggagccacgttggaagctaatcctccagccccagtcaagccttcggatgattgtggcagccccaggagataggctacagcagcatcrgagactctcagccagagtcatctgtctctggctccccaaagcctgcccatagaaactgtatgagatcataagtgcttattgagttgttttgttaatttggtttttgtttgttgttgtcattgttgaaacagagtcttgctgtcatccaggctggagtgcagtggtgcgaccttagcttactgcaacctccacttcctgggttcaarygattcccctgcctaagcctccctgcttcagctgggattacaggcatgcaccaccacacccagctaattttttttgttttgttttgtwtgtttgtttgtttagtacagacagggtttcatcatgttggccaggctggtctcgtactcctaacctcaagtgatcaacctgtcttggcctcccaaagtgctgggattacaggcgtgagccactgttcccagcctattttgttaatttgtgatttgttacacaatagataagtaatacagaacctgaaaatctaggatgttrgatgggtttttgataccggagttggttgaaatcacaaaatggtgagtactgctgatggtgagagaggctaagagccagcatctaaaatcttcagggagtaagggagattatccaggaggcttcaatgagaacagtgagtggtatagcctaaggacacgaacttcaagggaacagaattttgtagaraaaaggaaggataattagtctagaaaaggcagtgtacagccaggagggtacctacccctcctccaggtctgtagtatatggggtgtaggagaaaaaccagcccctgctttaaagggccacaaaaaagcaacgtcctcaggcacaaccagattttagtgaaagcaggaaggggaaatgaatgtttggagragaggttgaggattgaggacattttcctgagggtggaccatgaatttcagggtcacagtggaagaatggaggaagtagggaagggtgggaaactggttagattaagggatgtgataagagtctgggtgatgatggattacctcagagtcttggatatggggcggctattgagataaatagggatgtgaggcatgcgggtgagtctggagggtctcagagaggaaaatgggtaattagtttcttctcagggttcatgctttatgcagtttccaatggtgagacaaaagagagctggtcttcccaggaacactaaagacctcttttcttttgacagggtcttactctgttgcccaggctggagtccagtggcatgatcttggctcactgcagtctcgacctcctgggctcaagcgatcctcccatctcagcctcccaagtagstgagactccaggcatatgccatcatgccaggagcctttagcaggcatgtcctgctaaaattttggttgtattttgtagagacgtggtcccactatatttcccagtgtgcgtcttgaacttctgagctcaagcaatcctcctgccttggcctcccaaagtaccgaccgggattaaaggtgtgagccaccaagcccagccaaagacctcttataaatgctgttataggtagtgtaggggccatgaaaagagttttgcaaaaagaaaaattgttcatatttgagaagaagttctttgtctttttttttttttttttttttttttttttttttgagacagagtcttgctctgttgcccaggctggagtgcagtggcgtgatctcggctcactgcaacctccatctcccaggttcaagcaattctcatgtctcagcctcctgagtagctgggattacaggctgcaccaccacacccagctaatttttgtatttttagtagagagagggtttcaccatgttggccaggcttgtctccaactcctgacctcaagtaatctgcctgccttggcctcctaaagtgctgagattacaggcctgagccaatgcgcctggcctgttggatccttttatctttttcttattgctttataaatgatttatatattctggctacaagccctttgtcagttctatgtgttgtaaatascttctcccatttcatgacttgcattttcactatcttaatgctgtcttgaaaaacagaagctccaatttaccaatcttttcctttataattagggcttttgtatatcttgaccaagaaatctttctttactccaaagtctgaaaaacattctggtatattatattctaaaagttttattggtttgcctttcatatttagactgtaatacatctggaatttattattctgtgtagtgtgaaataaaggtaattttcatttttcctatataaatatctagttgacctagtaccatgtactgaaaagactttcctttccctactgcagtacagtgccacctttgtggtatatcatatgacaacaagttcatgtrtctgattctgggctttcaatctgttctgtggtctatttgtttgttcttgttccaatactacactgttttaattaccatggcttcatgagtcttgttaattgtttgtaactcctcccattttgttcgtcttctttaataatgtcttgattattttaggctctctgaattttcagatacattttagaatcagtttgaaaatcttggcttggcgtggaggctcatgcctgtaatcccagcacgttgggagggtgaggcgggaagattgcttgaacccaggagattgagaccagcctgggcaacatagtgacaccccatctctacaaaaaatataacaattagccaggtgtggtggcacatgcctgtggtcccagctactcaggaggctgaggtgggaggattacatgagcctgaaggtcgaggttgcaaygagctgtgattgggccactgcactccagcctgggtgacagggcaagaccctgtctcaaaaaagaaaaaagaaaaaaagaaaatctccacaataacagcctattaagattggcactggggttgcattggccctgtaaattgattgggggagaactgacctctttatgttattcagtagccaatccatgaatatccagtccataaacatcctacatctttttgtgtagaaatgtaagtgatgtttgtaaattgattttatacctagcgtccttgctaaattcacttattaattctaataatgacagttttgtttctttctatccaggcctcatatctctcacatatatatatatatatatatatatatatatttttttttttttttgccttattatactagctatgacctctggtacaatgtcttaagtagctttattcatggtcgcaaagggaacactttcaacatttcactggtaagattgatatttggaagccgaggatagcctgtagtctcagctacttgcagccacttgggagggtgagacgggagaattgcttgagcccaggaagcaaaggttgcagtgagccaagattgccctactgtgctccagcctgggggacagagcgagacaaaacaaaaaatttattggctgacatttttcttacttcctgaggtatatgcttaggtaattgattttcagcctttcttgttttgggatatatgtgtttataagtctatacatttctctctaagcacaggaagttctgatatgtcatactttcattatcattcatctcaaaatattttctgatttccaccataacttgttctttaaccatcctggttcaattaagaagcattcttaggccatgcgtagtggctcatgcctataatcccagcactttgggaggccaagaatcacttgaagccaggagtttgagaccaatctggtcaacatggcgaaaccctgtctccaccaaaaatacaaaaattagctggatgtggtggtgcagcctgtaatcctagctactcaggaggctgaggaatgaggactgtttgaacctggaaggcggaggttgcagtgagccgggattgcaccactgcactccagcctgggccacagagcgagactctgtctcaaaaaaaaaaaaaaaaagaagaagaagcattcttagtttccagatacatgagagtattccaatttcctttttgttattagtttctagcttaattgaagtgtagtcaaatttactccttatgatttcaatgttttagaggttgttaagacttattttattgcgtagcatgtagtaaattttaataaatgttctttgtattcaattacatgattccatcttgtttattgggtgcagtgttctacagttgtcaataaggtcaagtttgctaatcatatgcaaattttctatatccttctaacttttgacagcttgttctatcacttaaggagagaagtgttttaaagtaagcctgtgtgaatatgtcttttctcctttttgtttctatttttgctttatgtactttgaggctaaatattgagtataaataaagttagatgtaytttatctttctagaatcaaatttttttcattatggaatgttcctctttatttagtaatgcttttttgctttgaagacaattttgtcagttttaactttcaaactttctgtattcttatatcttacagttgtttcttgtaaacatacagtagggctttgttgttttttatatagcctgacaatctttgtcatttaattggagcatttagtccatttacatttaatataatgtaaatggtcattgatttttcatcactttttgttagttattatttttatttaattctaacattaattatttgcttgcaacttgttcctctgttttatgttctttcccccccattccttcttctcttcctttgaaatggcttttaaaactgttaatagaactataatgtatgtacagaaaaaggcctaaatcttaagtgcataccttgatgaacttcatcaagttagcttcataagctgagcagacataaaagaccacataaactgagcacatgtgtataactgaggcaggagaatagggaattaaggtagccaaggattgggtaataagcaaagcagttaggttggagcataagcaaaggagtagcaggtgcagccagttcacagaagcaagaaaacagcaggtgcagccagttctaggcaagattgggcagcatacaggccacctctttactcctgtgataagacagaagtttccacttcggcctctgattgactggtccaagcctccactttagcctctgaatagtcacagggcaatcctttataggttgtaaccaattgraggcctctaaaagcacctaggggtgttgccaaagtcctttggcttcataaaaaccccggggagcattgcggtgaagaagcgcttgagctgcttgtttgagctttctcccgctctgtgagttgtactttcgcttcttcgataaatctgtgcctttattactctgttcttttgttgttttgtttgtgcatttgttgcttcttttgttgctttgtgtgttttgtttactctttgcacaacacaccaagaacctggacaactcacagtcaagaccttctatccagtaacatactttggtgggccagccagaaggtaagcccaaattttgggatttgtttttccttttctttgtcaaagctgtcatttgtgggcatgagttgaacagataaaagccagtagggtgcccgtcgcttgaagtcttctgtgacaggataacttggtcatagaacaggacacttaggtcctgctgagatcaagacaaattcgtgcaacagacaggtttttgtttgtacggcaaaatgtctttgaggaggttagacccctcaggccaggcacggtggttcatgcctataatcccagtactttgataggtcgaggcgggtggatcacttgaggtcaggagttcgagaccagcctagctaacatggtgaaacctcatctctactaaaaattcaaaacttaaccaggtgtggtggcacatgtctgtagtcccagctgcttgggaagctgaggcagaatagcttgaaccygggggcaaaggctgcagtgagctgagatggtgccactgcactccaagctgggcgacagaaagagactctgtctcaaaaaaaaaaaaaaaaaaaaaaggaggttagacccctcattttctgattcctatactggtcttgttgatgatttgtcgggaagtagtagtgcagaattacttttccacttatttatattcctctttaagagtggggaaagagactgctgtttcatgaattctttatatttctcttagagtggggcaaaggattcctgttttatgcagaattctgytttcatgagaacccggaatttttaatggtttgtagggataaatccgagactttattgttaatggttttaaggtacattgcaaggtctcttgtttcatgagggttacaggctgaagaaggatcacatgagtccaggaattcaagaccagactgggcaacatggtgaaaccccatctctattttttttaaaaaaagtaaataatgtaataaaataatcataggccaggtgcgctggctcactcctgtaatcctagcactttgggaggctgaggtgggcagattacttaaggccagaagtttgagaccagcctggctaaygtggtgaaaccccgtctctactaaaaatgcaaaaattaggcaggtgtggtggtgcatgcctctagtcccagctactcaggagactgaggcaggagaattgcttgaacctgggaggcagaggttgcagtgagccgagatcatgccactgcactccattctgggcaacagagcaagactctgtctcaaaaaacaacaaaataaaataattagaaacatgtttgtgtctgtctcattttgctcaaaattatttgtaaaattaatccatgtttgtattagtctgtaaatctgccatagcaaagtattagacttgggtggcttaaacaataaaaattagttgttctgtaggcaagaagtccaaaatcaaggtctatcagggtggtttctggttaggcttctcttcctggcttgcagacagctgccttcttgctgtgtcctcaagtgacctttcctttgtgtgtgtgcagaaagagatttctggtctcctcctcctgtaaggacacccgtcctattggattagggccccatccttatgacttcatttaaacttaattaccttattcagggtcctatccccaaatacagtcacactggaggttaaggcttaaacacatacattttggtggttgggtagtggtgacataattcagtccagtacaatattattgcatgtttgttacttttcatagctgtgtagaaattcttcgtgtgcatatactatactatgtatatgtatacatggtatgcatatactatgtatatgtatgcatggtatgcatatactatgtatatgtatgcatggtatgcatatactatgtatatgtacgcatggtatgcatatactatgttttatttgtgctactatcaatgggtatttgatcggtttccagtttgaggttattatgaatagtcttctgtgaacattatatgtgttttgggtgaatattacagatttctgtttggtatatacctaagaattgctaggttcatggaatattcttgttttcagcattactagacactaacaattttcccataaatcaatttagactcccaccagcagttacgcagagttctttttcctctacatctttgtaaatatttgttattatctgactttatttcttcattttaatcaattctggaggttgtgtggaatatctcatgattttaatttatatttccttcataactaatgaagttaattaccttttctgtgtttattggccatttggatatgatttgttgatttatatttaaatataaattatattttatgagacagggtcttgctgtgttgcccaggctggagtgcagtggtgcaatcacagctcattgcagccttaacctcccaggcacaaacaattttcccacttcagcttcctgagtaactgggactacaggcatgcaccaccatgcctggctgattttttttcttttctgtaaagatggggattcactatattgcccaggctgatcttgaactcctggcctcatgcaatcctcccaccttggcctcccaaagtgctgggattataggcttcagtcaccaygycyggcctatttaataatttatatgattattgtgaagtgcttgttcaaatcttttgtccagtattccattgtttcgtcattctgttattgatttgtgggagttttaaatgtattcttgccacatgaatacagacttgtaactgtaatagatttgttgcctgatgcatacagcaagtcaatatgccaagacactggcttgcagcagagaaagaggtttaatcataaggtcaccaaagggcttggcgcagtggcagcagcctgtaatcccagcactttgcaaggccaaggcaggctgatcacttgaggccaggagtttgataccagcctggtctacatagcgaaaccacctttctactaaaaatacaaaaattaccctggtgccatggtacgtgcctatcatcccagctacttgagaggctgaggcaggagaattgcttgaactcaagaggcagaggtggcactgaaatcacaccactgcgtgcaactccatctcaaaaaaaaaaaaagttaccaaacgagttaactttgggaggaaacctcaaatccatctccctgaaggagtttgggggtaaagtttttaagggttttggagtgggccaaagtgtagagattgttgattggtcaaagaggcagagtgaagacatactgatcccattcctctgtgggagtcttctaactggttgatatcagctgttttactagaacttcaggcaatccttaaacaaaagccttatgattctaatgtcagagatcctgtcataggaacagtrgagatgcaaataaattattaaacagttttatgaccctactgtcagaaatcctgtctataggaagaacggggatataaatggtcaggagctagtgctacgtgacttttagcaacaaggaagtgaaccaaaggtcagcctgattaatgcttaattagaactatatttctatccagaacccagcattcaattcttgtcaaccctgtggggcagtttcagcctctgttgttgcaaataccttcttatactcggtggttttgttatcggaaaggggtcctgatccagaccccaagagagggttcttggatcttctccaagaaagaattcaggacgagtccatagagtaaagtgaaagcaagttagagaagtaaggaaacaaaagaatgggtactccatagtcagagcagcagcatgggctgcttgactaagttatacttacggttatttcttgatttatttacttatttattgtttttttttgagacgtagtcttgctcttgtcccccaggttggagtgtgatggcatgatctcggctcactgcaacctccacctcctgggttcaagtgattctcctgcctcggccccccaagtagctgggattacaggtgcctgccaccatgcccggctaatttttgtatatttagtagagatggggtttcaccatgttggccaggctggtctagaactcctaacctcaggtgatccacctgcctcagcctcccaaagtgctgggattacaggcgtgagccaccgcacccggcctatttcttaattcttgtttagacaaggggtggattattcataagttttccagaaaaagggcagggatttcctggaactgagggtttctcctcttttagatcgtatagggtaacttctggacattgccatggcatttataaactgtcatgacgctggtgggagtgtcttttggcatactaatgtattatcgtataatgagyagtgaggacaaccagaggtcacttttgctaccatcttggttttggtgggtttgggctggcttctttaccgcattgtttcatcagcaggttctttatgacttgtatcttgtgataccagtcctgacctcctactcatcctgtgactaagaatgcctaacctaggaatgcagcccaataggcctcatcctcatttttatctaggcactattcaagatggagttgctctggttccagtgcttctaacagtttggcattttactgtctttcaataagcagacattrtaaatcttaatagagtccaatttattattttccyttayatagttggcccatttttggggtcttgtttaagaaacttttgcatactacaaagttgtgaagatattttcttatgtttccttcaaaaagctctattgttttttcattcatatttagatctactgtctggtggatttatttcttatgtgtggtgggagatagggaccagaattctttttttcatatggacattcatataatccaacaccatatatttgtttttaagaaacccacaaaaccttagacaaatttaatttaacagattttatttatttatttttttgatagagtcttgctctgytgtccaggctrcagtgcagtggtgcagtctcagctcactgcagccttgacctccccagactcaggtgatcctcccacctcagcctccagagtaactggaactgcatgtgctctcctctaccactagctaatttttgtatttttagtagagatggggtttcactatgtcacccaagctgctctcaaactcctgggttcaagcgatccacacacctcagcctcccaaagtgctgagattacaggcgtgagccaccacacctggctaatttaacagactttaattgagcaaagaatgagaacctggcagcctcttaacaagaataactccagaaaggttccagtgyggccttgaggtggaagatttatggacagagaaaggaaagtgacatatagaaaaccgaagtagggtacagaaacagctggattggttacagctcagtaagtttgccttaktagagcatggtttgaacagttagccacctttgattggccgaaacttggttattggcactggagtaggttacagtttatttatttatttacacatccagttaggttgcagttcactatgtatggagaaggctttaggcagaacttaaaatatgaaaggaggcagctttaggtgaaacttaattgaacatattaaaagatcttcttttttccacatrgtattaaaacatacctatttagtctttgtccctaattcctgatacagagctactaaaacccaaggaatttcctgagtgataggaatatcttgttattcagaacaagccctttctatcacacctaagtttacgctactaaggtgacagggtggagcctatagatagcatcagaatggggctggtcactagaaaacccagtgattagagtgttggaactttcaaccccacccatcaacctccaggaatgaggggaggtggagattaagctatataaaaactttgagcaatgagatttgataagcttccaggttggtgaatgaatccacttgctggagagtggtgcaccccaactctgaaaccaccattgcaaaattataactgagacagcaaaagagatctgasctaaccaactctatcttgcttgtaacctccaagccatccttgtttattcctgggtataggttgaactaactttgggaataacttagtttatagtttaaaacaaagacaataacagccctttcccaaaacaaaccctcttcttgccttggggatagactgcctttgtatgactaacaaattagctaaaagattaaaaattacagtttaggagtcatgcagcaggaggctacaagattctgaccttctcctggggataacatctttattgtaagactaagatcagtgcttgagatattttgcagaccttgcacttgatggatcagctggcaccacccagatcgataaactggctcatccaatgttgtggcggtcacacaggaastgactcagcgaaagyggacagcgtctaatttctataatttcatctctgacctgaccaatcagcactccygacttactgcccccaccacccgacccaccaaatgaaccttaaaawctctgatcccccagtgctcgaggagaccgatttgagtaataataggatttgagtaacaacagccggctgtgcatgaattactttctctattgcaaatctcctctgtctctgcagcaggcaaggtgagccagctgggtggttacaaatcaagggtaagcgcctgaggtcaggacccttccaggccttgcctgtgtgcttcttcatctgtgataataaaccggcaaacataagtaaagtgtttccctgagttctgtgagaaatactagcaaattatcaaacccaaggagggggctcatggaaacccaaatttatagccagtctgtctgaagcatgggtcacagcctggaatttgttcttggcatctgaattgggggcagtcttgtgggagtgaacctttcacctgtgggatstgacgctatctctaggtagattatgtcagaattgaattgaaatacaggacacgaagatggtgtctgctggaaaattccttggtgtgtgtggggaaaaccctcacacatctggtacgaaagtgttctgtgttgtgagagtacagcaagagaaaaagtgtttttttcaccccaatgtattgcagtgttaattttgttataaattagatgactaaatatgggtctaactttattggtttgtctgttagggttgatatgttttgttattctatttctaccctatgactttttttttttttgagatagtgtcttgctctgtcacccagcctggagtgcagtggtgccattacagttcaccgcagcctcagcctcccacactcaagcaattctcccacctcagcctcctaagtagctgggactacaggcatgcaccaatgcacccagttagtttttttgtttttttttgtagagacatttcaagagccatgtttcccaggctggtcttgaactcctgggctcaagtgatctacctaccttggcctcccaaggtgttgggattgcagatgtgagccacagcatcaggcctgaatctgtgacttattaaagtctaacattatttggtagttttacctccttcctaggtgtaagagaggaaagaaacacaaactgcagctcatcagtaaagacaggtttactttagataaaatatgagaggggcttctagctgatttttttttttttttagtcaggagtgctttctcttacagactaagagtagacattggttttagggtgagggggcttatcacaagcttggaatgtttctatgtgaaggagaagggttttttgttttgttttgtttgagacggagtctagctctgtcactttgggctgcagtgcagtggagtaatcttggctcactgcaacctccacctccaaggcccaagcgactctcctgcctcagcctctcatgtagctgggatcacaggcaccctccaccatgcccagccaatttctgcatttctaccagagatggggtttcaccatgtcagccagggtggtctcaaactcctgacctcgtgatccacccacctaggcctctcaaagtgccaggattacaagcatgtgtcatcgcgcccagtgaaggagaagttttatggcagggttggaatgtctctgggaagaggggagttcatcttggggcagacatctttctggtcagagggggttatctcgaggctggcatcttcctggctggaagggggttatctcagggctagcatgtctctggttggggaggagtttggaacgtttctggttggagatgttatttgtggtttatggtcatgttgaccttagccattaggctgatgccctttggatttaggtggttttttattaaggtgaactttagaatgaggggcttgtccaagatggcaatgctcctgctctgtcaccaggaatgcaaggaacttgcattcaactaacttcatttattagcctcctcaacttagatgcaatttttaaaaatgtattttagttttgtatatactttaaacctcatgagatattgttgtggtggtggttgttttagcrgttaagagtcaatttgactatttgattcatccctatatttgcttatattgttgctctttaatctttcctgtatctctgtgctttcatctggtatctttccccatttgcctgaagaatacaaaatttcctttgaatcaaatctgctattaattgattctyttaaatttattcttctctctttctttttctttctttctctctccctctttctctctccccccttctttctccctctttctctctccctcttytctctctccctctttctctctctccctctttctctctctccctctttctctctctccctctttctctctctccctctttctctctctccctctttctctctctccctctttctctctctccctctttctctctctccctctttctctctctccctctttaaatagagacagggatcttactatgttgcccaggatggtcttgaattcctggtcccaagaaatcctcctgcctcagcctcccaaagtgttggggttgcaggtgtgagccatcacagctggccaattctcttaattttcatttgtctttttttttttaagagatggggtctcactatgttgcccagactcaattttgaaaatgtttttattttaaaaaaagctttttatttcatcttccatcttgaagtgtatctctgctgggtgtaggatttcagtgttctaatattgtattttgagctccattgttttgttcagactttacatgtcattctaattattgctcctttgaaggaaatctgctttcctaagatattcattgtgtttgagtttatgatttgtctggaagtggttttcttttytttttttttcattctgttgggcatttgtaagaattattgcatatgtggcttgatgtctttaatcagttttggaaaattctcaggcattatctcttcaaatattgtttctgcaccaattctctctcctctctgtgtgggactccatttacatatatgccaggccttcgcattgtattgcctgccttctatattttacttatttttgactctccatgctttattctgattttttttcagatctgttttttaatgcatttcttctctcctcagctttgtctaatctgctgttaattccacacactgagttcttatttgttggttgtggtgtttttttatatctagaatttccatttggttaatttttatggtttccagttatttgytgaagttctgggggaatacaaatacttgctcagtgtattcatgagcaggtagactcttttgctctgggactggctttggaaccacttaaggagctgccrgaacctattgtaacatggacggtgccctatgaatgctctctattgatcaacaaagaacttcttagtttatggatggcagttcgaaagtgaacggacagcattctgctcaaaaggctgccactctgatttaaaaagtaaaaagaaattaactcatcaaactgaattgcatactgtttgccccagtgttttactgactcatgagcagtggtcaatgtcctggccttatggtcaggcagaagagcaatggaaaagtggcctcttaaagagatgcccatatggggcccacctytatggaaaccactagggggaacttgagggatgcattaaagtagaacatgttgatgcccatcttagtgtttgggtcataatttataaaggtgactgagtaacagcacctagaggctagtttcactgaaagaagatttttattcacatttcctgagaggagggtcatgttacaccattctggaccacatagggaagcaccagtattgatcaggaggcagaaaggagtgaggggaaggcatagaccacaggcaatattggggtttccatgagaaaggcaagacagggtaaagtaaacagcttaggattggctagtttgaataattccagtgggttttggggtatttgggattttcctagttgtttggtacctagttcagtgttggtttaggattgggaaatattggcttggggtgtgagcatcagatgaggaggatgatcagcgtatgaattcgtaaacaacttggccattagtttggtcctataattaatgagtgctaaatagacaaatgtgggatctaaaaacactcagtgagatgcgaaatatcaaaagaagtcccttcaggataagaaggtcattggtgtcagtgagtggatatcttgatatgttcacttgaggtgatcacctgggtcatgaaacaagtrgacattgtggggtgggggctgtagcaatgcaaagatgggctaaatttaggcatattccttttgcaccctctgaggtgcaaaatgccagtaagtacagttctgtctgccaacaagagagacagactcagatggctatgggacagattccctggggggaaggcccagcacatagctggcaagtgggagtgatgctggtagcactagaggctataaatgggtccttaaagwaatagatgtacacgctggactgggttttgcatacccagtggtagatgcaaatgctcagatactataaaagaactggaacagaagatactacaccaatttgggtggttgagtcacatttattcagaccaagggacacagtttcagcatgtaatgtccaataacggacacagagatgtcctccttagaataatagtttaatagagaattggaatgggcatttaaaacattggttggccaaaatggagggagatataggcatgaagggctgatttacatgccttcatgagtgtatgctcacacctaacatcagagtgccaagccagtgccccactagctagaatcctctgctatttttgtggatctgaagatgagggggtgggagatatgctggtataactatgcagttcttcccacgaaaggaatgtgctggtatgactatacttttttctttcttccctataggatcttaactgctttttttatttttaattttttaaaataaaaatagagacaaggtctcactatgttgcccaggctggtcttgaacttctgagctcaagtgatccgcccacctcagtctcccaaactgttgggattataggcatgagccaccgtgcccagcctcatctcaacttctttttcctacctaatgcagtggtcccaggcacagggctgtaacaagtgctggaagcaaagataattcctaagcaagaaaccataaccatamttttaaacctttatgtcagaattcctaagggcctcagggagcaggttgtatcttgatcccaggtagcaaarctggggttaatagtggatgtagctacgttgcttaatggtagaaatagctgagttctgtaccttttataaccctatcctagatgagatgagatgaatgacagtgaactgaggaaggcacttgctagactagtattgctgcctgcaatctaaaccagcactgtagctaaagctaacctcccttccaaagatggaaaagttagggcataaatagaagtaggaatagtagctgtgagtaaaggaatggataaatgtgttatgcaatgagggaagattcaatatttcattaatactttgaaagaagctccaagtaagagatgacgttgtctcttagctcacttatacaagatgcctgaaagggtgaaatcatatattgctgagaccacccctctttatggaaccatgcaagataaaatagaagcttgcaaacctgagcaaacttaccctgggagacatttggtcatacaatatgatgactggactaatcagtaactgaatgggactctagcaaagttccaaatatcattttttatttttcaggttgcatctaccacagtgtgataatgatataacactggtattgttcacaggattataatactgatgttgatggtcaaatgtataaggaaattgaattaaaagcctcctatccctatcctacactggtgcctccaaatgttaggcatattcatgttggtactgtggctgtgtaagaggcattcaaaccagagtgactccatgttgaatagggactgggtaaaataaggctgagaccgactgggctgcattcccaggaggttaggcattctaagtcacaggataagataggaggttggtacaagggacrggtcacaaagaccttgctgataaaacaggctgtggaaaagaagccggctaaaacccaccacagacaaggtggcaataaaaatgacctctggtcgttgtcactgctcatttatgtgaattataatgcatttgcatgctaaaagacactcccacgagcaccatgacagtttacaaatgccatggtgacgtcaggaacataccttatgtggtttaaaaaggggaggaaccttcrgttccggaaattgcccacccctttcccagtaaactcatgaataatccaccccttttttagcatataatcaagaaatcaccataaaaatagccaatcagcagccctcagggctactatgcctatagagtagccattctttattcttctactttaataaacttgctttcaattttctctgtggactggcctgaattgtctcttgcacaagatccaagaaccctctcttggggtctggatcaggacccttttctggtaacagtggtatatgttatattaatgctacaccaaatrtaggtgctcagataggtttgatggttttgctataagatagccataaccaatgaccagagggtagcctgttgtatgataaagaatttgtctttgtcccaggtttctggcttctaaaaccctgggcatttcccaagtgatcagagtgtctttgttattcatggaccccttggagcacacctgagtttatgctaatgaggtgacacgtggtgggcctctagttagcttcaggacagggcctgtcatggtttaagccatgtcatatgagcctgacctcccaacctccaggaatggaatagagcctggagattgaattcgatcatgtggctaatgattcaatcaatcatacctatgtaatgaaaccccaataaaaactctgctcactgagctctgaggaacttcctggtcagtgaacacgttgatgtgccaggaggatgacacactctgactctgtggggagagggcacagaagctctgtttgggaccctcccagacctcactctgtaagtctcttcgtttggctgatcgtgacttgtattctttatcataaaattgcagctatgactatagggctttcctgagttckgagttgttctagtgaattgtccaacatgarggggtcataggaacccccaactttgtagccagttaatcagaagtgcaggtggcccttgaagtgtggctggcatctgaggtaaggaaggtcttgttggggagcaactgtgcctttaacctgtagagtttaaggctaattccatattgttagcatcagcattgtacaggtgcttctcaacttacaatggggttgtgtcccaataaacccattgtaaattgaaaatattataagtcaaaaatgcattttaaaaaattagctgggcatggtggtacatgcctgtagtcccagctacttgggaggctgaggtaggagaattacttgagctcaggagtttaggactgcagtgagccctgatggagccactggactctagcctgggtgacagaatgagaccaccycttaaaaaaaaaaaaaaagagaatacatttgacacacctaacctaccaaacatcatagcttagtctagcctaccttaaacatgcttggagcacttacattagcctacagttgggcaaaatcatccaacacaaagcctattttataatgaggtgttgaatatctcatgatataatttattgaatcctgtactcaaagtgaaaaataaaatggttgtatgtactcaaagtgggatttctactgaatgtgtattatctttgcaccattgtgaagttgaaaaattgttaagttgaaccatagaaggtcagggaccatctgtattttggaacaataactggtgtcagaaaagactccaattatttatccttagccccaaaaggctgtcaaatactctgcttagcttctcagtctttctaatgcctcttctagactcatctgatgcccgctggggaaaggtaacactaaatactgagattcattccctaggttttcttctgaattttggtcctataatttttcaytggcttgttagctcttgagtccttcaatcagatgttcttcatattctgcccagattttcaaattgtccttagtagaaagtttggtctgagttatccagtctactattaatagaaacacaaatccctcttctcagtgacttatttttcattgtggttatatatacataaaacataaattttgtcatttaaatcattttaaaggccaacatggtggctcacacctgtaatctcagcactttgggaggcctaggcaggtagaatgtttgagcccagaaattcaaggccagcctaggcaacatgataccctgtatctacaaaaaatataaaaattagccaggtatggaggtgtgcacctgtagtcccagctactcccaactacctgggaggctgaggtgtgctgtagtgagctgtgattacactactgcacttcagcctgggtgacagagtgagcacctgtctcaaaaaaaaaatcattttaaagtatacagttcggtggcatttaatacatcctcagtgctgtgcaacaaccaccactctctatttccagaacattttcatcaccccaaaaggaaactccatactcattaagcagtgacttcccattccctctctcctcagcccctggcaaccactaatctgttttctgtctttatggatttgcctattctgggtattcatataaatggaatcatatagtgtatggccttttgtgtctggcttctttcacttagcatgttttcaaggtcattgattttttttttttttrtatgtgctgttttctttgtctaaatattctacagttactgttttgatttcttctttgactcaaagcatttaggagattgtttttacatgttctatttttattactttcagttttgktgcactgtagtcagaatatgactgcttctgtttcaattttttgtaaattttctttgtggcctgttgtactatcaaattttgaaatatctcatgggaacttgagaataagatatagtttctatattcagaatatagacttaaatactctttacctgtccggcaagctagttaactagctatcatctattatcaatcttattaaaaatatcattcaaaatctcaaytatgtttcctctatttgattcgccatcgtctgagaggtgagttaaagcaccttgttgcagttgatttctgtgcttagttgagtattgcatcctgtaaataaacccttataatttttatatttttactttatgtatttcagtgctattaacttattgtaatatatatttgcttgcatgcagcctgtcattgacaaaactcttgcctactttttgtttggatttgcctggaatatgtttactccttcattaatttcaacctttgtgggttctgttgttttaggtatatctctcattgataacatatcaatgcctcccattttacattcaaaagtgagtttatatcagttttattcaagcctataacagacaggtttagtctacttctgtcatatttttgtattctcagctttggyttctatgtgatctgtttttgtttgttgctttcaaatatggaacgtattcaagctgttttttagttctactggtagatatctttgtgattgtaaataatatgtttaggccaggcacagtggcttatgcctataattccagcactttgggagaccaaggcaggtggatcacttgagtccaggagttcaagaccaacctgggcaacctaataagaatccatttctacaaaaatttaaaaattatctggttgtgatggcatgtgcctgtggtgcccagctactcagaaggctaaagtaagagaaytgcttgagcctgggaggttgaggctgcagtgagctatgattgcatcactgcactctagcctgtgtgacagagttagaccctgtctccagaaaacaaacaaataaataaaaataatatrttcaatcagtatttctcaatttataatcttcaaaaaagaaacagtaccatttattccctcttaaaaaaaaaaaaaaaamggaaattggcgatttaaaaaaatcacccttgcagcagccactgtggaaaacggtgtggtgattcttcaagaaattaaacatagaccaggcacaacagtgcacgcccgtagtcctagctactcgggaggctgtggtgagaggatcacttgagctcaggagttcaaggctgcagggaggtgtgatcgtagccagggcattacacctgggtgacagagtgagaccccatctctaaataaataactaaaattttaaamaggarattaaacatagaattatcatatgattcagcaattctactcaaaagaagtgaaagcagggacttatgtatttgcacacccatgttcatagcagcattatttacaacagtcgaaagatggaagcaacccaagtgcccattaacagatgagtggattaacaaatgctgtgtgtgtgtgtatatatatatatatgaaatgaaatactcagccttaaaagaggaggaaattcccataaatgctagaacatgaatgaaccttgaggacgttatgctaagtgaaataagacacacacacacacacacacatacacacacacacacactgtatgattccccttatttgagatatctagaatagtcaaaaatcatagagacaaaaagtagaatggttgttgccaggggttaaggaaagagaatggggagttagtgtttagtgggtatagagtttcagtttgggaagataaaagttctggagataaatggtggtgatcattgtgcagcagtgtgaatgtacttaacaccacagaactggtcaatttggccaggcatgttggctcacacctgtaaccccagcactttgggaggccatagtaggaggattgcttgaatctaggagtttgagaccagcctgagcaacatagaaagacccaatctctacmaaaaatttaaaaattagctgggcatagtggtgcacatctgtagtcccagctacttgggaggctgaggtgggaggattgctcaagtctgagaggttgaggctgcagtgagccgtgattgcatcactrcattccagtctaggtgacagagcaagaccctatctccaaaaaagagtaaatctgatgttatatatattttgctaccataaaaacaaacaagcaaacaccaatctccttttccttccattccttctttaattatagttttaggaatttcccccatatgttctattatcaacaacagcaatgattaacaaagaaacattttgtagagtgtttttttttcccacaataactataacgattatattattttccagtaaatgtgatcattacggttatataggctttcatgttcaaacacatttaatgcttaccaccagcctgtttatacctcagttttctcctatgtcagttctaaatttggattcatcatctgtctctaacatgtcctcaagtagagtgatatatttcctggtgaaataatgatgagaagctatgtcttaygtaatgtctttagaggaagaccttcaggtctcagtggtaacagctcctcccctgtggctgcaggctatgggattgtagcaccatcctcttggtttcccttaactcttgcctatacctcgtcaataatccctttactaaactctcttccattaccaagcttgtgagtggcttgtttccagctgggactatgactgatacagcctctgccgcctctgctctccaagcaccccttccttcctatctcctctccctctctttcttttcctttttccatcttccactcttatccctccttattcttttcctcctcctcccttttggagtgaggtgacatgtgggctatgtaggttagcatatcacgctccgcatctggcccctggctgcccttgtccctgggtggtcaagaacagagtattccttctttctgagctgctcagtgttctggctgcttttcagaatgtgcagcccatcccccagcctctcagaagccccaccccagccagcagcctgacagagctcacaattctgttttaagcttactcccttacaactagttttatttcctagtctgacatcttgggaggatgggtgagaccaaatctgttacatcagtgtctagatggagcattcgctagttcaggccaagacattatgagtttcatttttatggctctcccaatccttgtgtgtgcagattttattgtgttaggagttaaaaatgtaataagcaaggagaaaaaaaaaattaagtcacttcagctaaagactacagcctaacaaaatccttaacagacgcttgttagtcctgttgctgggaagtatttgtccagcagacctggaacagtttaaaaaaggagtgggggtttggttaacattaaagaaacacaaagatttttcatctggctctgggggagaccagagccacagagggaacaagaaaagaaagaggggattgaacatttttgcaaacaaatgataaaactgccttttaaagaaggaggggggatcccttgtccaaacaagacttctgccagggtaggaaatcatttctgcaattgtttacaatgctcaggcagccggtcctaagtcaacatggcctgggagcgttgccctggagcctcctgcctttgccagccgcctgccatctcgagctcagctatttctgggacttagctccctcccttgaaaaacaaaccgtggccctcactgtcatmcccaataaaccccccagtttgtgcagccttaatcatgttttccagaagagttctccaactgacggcctggatgcaatgtgttgggctcaggagagccagtatgtgtgggggaagggaagctctcatttgtggatgccaagatggaaatttccattgcagtacaagatggcttcacctgtggccaaggaaacctacttcatctcaaagaggagaacttggctaatgaacagcctgaaatttatgtcctttcttagtttgttccataaacccagagcaaagtttgcttttactaaaaagcmccgtaattactagtcataacccttcacatctggttgtcacttagtgtagaagtcttttcacttctgttatctcatttgttctccmccatgagaaaggcattattagtcccatttatttaccytttttgaaaaaaaaaaaaaaaaaaaaaaagatgagatctcactatgtttctcaggctggtcttgagctcctaagctmaagtgatcctcctgtcttggcctctcaaartgctaggattacaggtrtggaccactgtacccagtcaatcccatttatttaattaatccatctatttgtctccttattkggkgttaataatacagtcatgtggcttgaaaattttaaattccagkgaaaagatgtcttctcttctactcttycacaattcttctggtctctatctgcccacaggtaaccactactgttcatttttctgtgtatctctccagagatgctttatgtatatctaagcaacttggggtggtacaaggagaaagagtattgcagagagacagaaaagtcccaggcactaggcctagctctgtctccagttggctgtttgacattgtgcatgctactttccctctctgaacctcacttacctcacttacgtcatctgtgaaaatgagaataaaagctaacattcattaggcttatatgtgcctgccactgtgataagtgtttttatatgtgttagttgaattaagctcrctacagtcctataaggaggcactgtaagtcccatttatccatgacaaactgaggcacagagaaattaaatatcttgcccaggtcctagttaattagagggagagcctgggttttatgaagctaggtagtctaacagtagagctcattcaccacttaaacccctgcgctatatacggccactcatttatgatactggcactaccaaatgatggcttgaaacaggaggctgccccagagtggttcctcccaatttaggtatctaaaatcctatgtccagttcccataaaaccctggccaggcagctctgagtcactcagccccattcagatgggatggtgacagctggcaaagagcagcagacagcagggcaaggctcaggcatgaaccctgatgtcagaccagtgcttccccctgtgtccctccaggggaatcaggacaactccttaataagaatttcttattttttatcaraggtagtaacgcacgtaatttaaaaagccaactcatattcagagacaaaagacagcagcccagaacaaacacttttaactcctttggttagttctgtatatatttatctcccttattcttgtcaaccttaaataatattcagaaagtatgattaaatatagagttcatttgagcccaaagcttgaggatggccacccaggaacatggattcaagttgccctgaatatacattctaattagcagcacctacaaatgggtttttaaagggaaaaaaagaagaggcagttcctaagttgtttaacaagaatttacattaaagtaacataagctattaattggttatacattgttctttgtatcacaaattctaggaacatgaagataatgggtgaggccagctagtcaggaacaaaatgcctttaaacaattgcccccagggcatgggcgggatgcrgaggtgggggtgagggatgagagtaggggcctgactgaagtcccaggtctctctgagccaagtaaattttgcatacctctcatagcttacagcagtctgagctatttttcttttttcattctaaacctagatagtaaatattttcagctttgtgagccatacaatctttgttgcaatttctcaactgccttatatctagaaagcagtcaggcaatatatacataaatggacatggccatcttccaatacaaccttatttacaaaaacagatttttaaagcaaaaacagatttgacctgttgatgcgggatttttctcggtcactttgccagccagagacctccagccagcaatacccctggcccaggccttgctcgggcctgggttcaccacaggagaggccccatctacygctgggctatgccyggcttgcactccagtgtgggtgctgtgtctgctgtgactgtgctggcaggaggggatgtgtgagccagtgacagcagggtccagccagctgttctaagagccggcasaggagtgggatccatgcagggcttgtggctgaaccaggtgtgtcacaagcgactcctgtggtagactctggtgtccagacgaggggaatgtggtggcacccaagcagcggtgccctggaccctgaagcccagagggtgtgttacagtgtgctaattagctcttttagtcccattttccgtggcccaatggatggcagtgtgttaacagctctgtcagccccgttgacccgctccagcccgtggctcggccttgctgctkcttcctattgtttagggcagctgccttctgctggcagagggcagaaggccacagtgttacagccttctttgtacctgcattcagtgggtcctgagttcttgtttcacatccaagaataatgaggttatgctgacaaagggtgaggagggcagagaagaattttattgagcaatgaaaacagctctcagcagagcagggacacaaggttggtcccccacttgaaatcaggtggtctttcaatcaatgtggctgggtctgaggcttttatgggcccagaatgggagagygcatgctgattggtttgtgagtacgcaagaaagcctaaaacgaaggtaccactcaaaggtgggcatgacggtgtaaaatcccaattgaggaagggtagatacatgtaaaataggtgaagggtagggatcaatcaggggaargcacaccaaatgggaagagaggttctcaatctggtccaaggatttacccaggacttgtagctagggttcaaacagtctttggcttgaaggtcaggtttcactggggacctacctctgtctgactaggatttgtctgcttcctgttgctaatcactgtgggatgtagtttactgatatctgttgtaaattcttaaatttctgtttcttaatttataaattttaattaattttctattgtggtcaataaaaatttctttttcttcatttctatttttattttttgagacagggtctcactctgtcacccagctgggtgacaatcattactgactgcctggagtgcagtggcacaataatggctcactgtggcttcaacatcctgggctcaggtgatcctcctacctcagcctcccgagtagctgggactacaggtgtgcaccaccacgcctggctaattttttgtatttgtttttgtagagatagggtttcaccatatttcccaggctgatctcaaactcttgggctcaagcaattctcctgcctctatctcctgaagtgctagaattataggcatgagccattgtgcctgcccccaagaatttrcctttcttaaacagctctcctctctgcagttgtttaccctcccaactcatcctaatagagttatattgtaattatcagttacattaatattcaatgtttatattatgactaggtaaatactgttctctgttgagccaaacaatataccatctcctttctcatacggcctttgtttttacctggagttaactatttcattcttttttttttttttcatttgcatggtgtatttgactttcaacagcctctctcagaattttctacatggtttaacacctcttttttccagtgctactgttttgctggaggaggccctcctacagccttccagactgccactccagtgtagactgggattccctgggcctgggcttatctcttatcctaaaactttctttctccactatcctggaaatctactggatctcttctctatattggatctctttttcctagatcccatgtcctcctctgatttacttcctcattttccttaatccactatcatttttttttttttttatggagtcacactctgtcacccaggctggagtgcaatggcacgatctctgctcattgcaacctctgcctcctgggttcaagtgattctcctgcctcagcctcccaagtagctgggattacaggcatctgccaccacgcccggctaacttcttgtatttttagtagagatggggcttcaccatgttggccaggctggtcttaaactcctgacctcaggtgatccacttgccttgacctcccaaagtgctgggattaaaggtgtgaaccaccgcacccagcccactatcactcttgaatgatagttttggaagggctagtattctagacaggaaataattttttccccaatattttgaagcatataagttgttagaagtctgatatgttttaaattcttaatcctttatatgcaatctgtttttcttctctagaagtttttataatcttctctttattcctaatgttctgaaatttcagcatgatgttgtcagaggcatttgaaccagagcaactccatcttgaatagggcttgggtaaaagaagtctgagacatattgggctgcattcccaggaggttaggcattctaagtcacaggatgagataggagttcggcacaagatacaggtcataaagatcttgctgataaaacaggttgtgtaaagaagtcggccaaaacccactgataccaagatggcaataaaaatgacctctttttttttaagcctcatattcattttctgyattaccttgtgcctctagttactgagcctttttgagtttctgcagggtaagttgacttgcttcacatggtatcacccatgcacagtctattaagagtcagccgcttctagtctgataagacaccctsgatgtctatcgacttttcatcctcctagcgcatgttgacgactctttcccccattgtttccattcttgtcctctttgtccttgtgaacttagtttgttcctattgcagtgcccccaattggtctttgtttctatccttgttcaatctttgtccttttacagtgtattttccacagagaagcaaaggggtctttaaaaatgtaagtcacaaattcagaacatttgtggacattccataggacaactgcactaacctctttaatagtcaacagcatgaaaacacaaggcaaagggataggtagggactctcctactacattaaaaaatatttaggaggcaggccaggtgtggtggcttacacctgcaatcccagcactttagggggccaaggtgggtggatcacaaggtcaggagattgagaccatcctgtctaacactgtgaaaccctgtctctactaaaaatacaaaaattagctcagcctggtggcatgcgcccgtagtcctgaacccaagaggcggaggttgcagtgagccgagatcatgccactgcactccagcctgggcaacagagtgagactgtcaaaaaaaaaaaaaaaaaaaaaactaggaggcatatcaaaagttgtaatgtgtggtcacgatataagcaaaccaattgtaaaaagacatttgtggactattggggaaatctgagtaaagaaatttaaaaattattaattttgttaggtgcaataatagcattacggttatgtaggaaatgtattttctagagattcatattgaattataaaatatgatgtctgaaaatttgctttcaaaagctcagcaaaaagatgaagcaaacataacaaaatatttatttatttatttattttattttatttttttgagacagagtcttgctctgtcacccaggctggagtgcagtggcgtggtctcggcttactgcaagctccacctgccaggttcatgcaattctcctgcctcagcctcctgtgtagctgggacctacaggtgcctgccaccgtgcccagctaattttttttgtatttttagtggagacggggttttaccacgttagtcaggatggtctcaatctcctgacatggggatccgcccacctcggcctcccaaagtgctgggattacaggcgtaagccactgcacccggcctttttttttgttttttaaagacaggacctcattgtcttgcccaggttggaatgcagtggtgaggtcatagctcactgcagccttaacctcccaggcttaggagatcctcccacctcagcctcccaagtacctgggattataggcatacaccaccatggctggctaattcttaaatttttttgtagatatgaggtctccttatgttgcccgggctggtctttgtagatatgaggtctccttatgttgcccaggctggtctttgtagatatgaggtctccttatgttgcccaggctggtcccctgggtttcagtgatctgcccatgtcagtctcccaaagtgcctgggttacaggcatgagccaccacacctggcctctttatggcacttattatcactggcttttacatttttgtggttaaatatatttatctttttaaccttttttttttttttcctgagatggagtctcgctctgtcgcccaggctggagtgcagtggtgcaatcttggctcactgtaacctctgcctcccaggttcmagcaattctcctgcctcagcctcctgagtagctaggatcacaggtgtgtaccaccaggcccggctaatttttgtattttttatagagacagggtttcaccatgttggtcaggctggtctcaaactcctgaccttgtgatctgcccacctcggcctccaaaagtgctgtttaaccatttttaactacacatttaattggcactamgtgcatttacattgttgtgcaaccaccactattatctatttccagaacttttttgatcatcccctactgaaactctgtactcaataaacaataacaatatgttcctctccccagcccctggcaactatcattccactttttgcttccatgtatttgactactctcagtacctcatataagtagaatcatgtaatagttgtccctttgtctctggtttatttcacttagcataatgaatgtcttcaagcttcatccatgttgtagctgcatatcacctgccattttatacatttgtttggtcattcgctttttatcgtctgctctcccgactacccaaaaggtaaggtcgttgggggcaagagctttgtctgttttgcttgttcatctagaacagtgcctgggcacagaataagtactcaaatatttgttgagtaatttgcctcctgttgggacaatctcctttttttgcatagagttggccttcttttctgaacacgatgtgtccatttagaaagtaatttttagctcccgctgtgcaaaacactttgggggacaggaagataaggcagcgaagcgagttagagtggtgcagctgacggggttagagtggtggagtagacatctgttttcattgttttgttttgttttccctgcccaacatttactccccttcttctgatattagcagtgggattttcctttgggatatctcccttccccattctcagtctgtgtggttataaaggatccatctcatcctctggcttcaaggcaagataagtaacccaggcctgccaataagacccaggcatgagacttctgttgcaatcattacactgagcctacaaaactgggagaatgtgagcctggagttctgatgcctcactacgttgaaatcttatatttgagaatgaagacaacacagaagaaaatagagttcagagatggacaaaagggaataaagccctgatcacattatttgagctcctgaaaccagccatgcccgaagtcagagatccatttcctggacttttcagctttgtgagccaataacttctcaacgtcttcccatttatttgtttatttcatcttattttgatttgaattggacttctgtcgcctgctgccaaaatattcctaatataagggagacagacaaaaaggaaagaaggtagagagactcaacttgtggggtttggaggctcagctgttatctaggaaaagcataaaggatttaagatgtttacctcaaagaagagaagcctctggaagacagggctacatctttagatatgtaaagagctgtcatatgggagaagaattaaatttgctctagataatgcagcaggaaataccaggwccagcagctaaatatttttaggaaaaaaagttaattcaggaggraggaaaatgtagaggccccagaagcagcctagaggtactgtagtgaagtggaagtgaatgagcccaaggtggggagacacaaatggtatacactggtgagaaaaagggtagccctgcatggggcctcattgtagataacccttaaggtccctgtcttgggaactccccacttgtgctgactgatgtaagcagagattgagtttgtcacctgaaggcattagacacatggcccctcctcctcaaccctgggcctcctactcatgccagaagctaactacaaggttgctcaaaaacacagttgataggggctgaccattatgttaacccatggagtataagatatgttagtctgttcttgtgctgctataaaggaatacctgaggctcggtaaattataaagaaaagaggtttattttggctcatgtttctgcaggctgtacaggaagtgtggtgccagcatctgcttctggtgagagtttcaggaggcttacaatcatggtggaaggtgaagggagagcaggcttgtcacagggtgagagagagagaaggaggtgccaggttccttttaaactatcagagatcaaggtaacagagtgagaactcactcattaccatggggagggcaccaagacattcctgaggggtccacccccatgaccaaagcagctcccactaggcccccctccaacattggggattacatttcaacttgagttttggaggggacaratatccaaactatatcatgggagaagtgggctttctcaaggaatttgaaaaaaatttttcttgtcagcctcttctgtaaaagaatatccagcaccaaagcatgtgctgtggttttgttaaaaattgttytgtaatttgaagagtctgggtcacagccccagagagcttctggatggcaactgcatcacagtcctgaaataaaagatgctgtcaatatgctgccatccagtgcccacgccaccctttcccgtggcaatgtaggaagtctacaaagacttcctcgcctgcctcccgttccgggccttccctcttcacccaccggatatcttttcctttcttgccttttcctgtccccagatcttgctcttggaccagygcctaattttcagaaggtatttccagataagaaaagctacagtgacaaagaaaacgcatcagtctaggatcactgtggtggcacagggagagtttgggctttgggatcagaaatgagtttttttactttttaaaaattatttattttttaaaagcttttttttggtttgtttttaaatgagatgtagatatgccttagaagtcaaccaagtttaagttctgactctaccttacatggaaaactcaattttcctgggtttcaatcccctcatgtataaaggaaggataatgatactttattttggggagtctcgctctgtcacccaggctggattgcagtggygcaatcttggctcactgcaacccctgccttccaggttcaagcgattctggtgtctcagcctcctgagtagctaggattacagacgcgcatcaccatgtctggctaaattttttttttttgtatttttagtagagatggggtttcaccatgttggccaagctggtctcgaactcctgacctcaagtgatctgcctgcctcagcctcccaaagtgctggtattacaggtgtgagccaccacgcctggtccaatactttcttaatagggtattttgagaattaaagatgtttctgttaggtgcttagtacagagaatggatagtaattgaaaaatgacaaatatttaaataatgattgctaaaagaccaaaggaccttcaaaacaaccaaagaatttaaatggttggtttaagtggttggacccttaaatggtttttaagtacaaggagagattagtgagagaggtgtgtttttttgttgttgtttgttttttgagayggagtctygctctgttgcccaggctggagtacagtggcgtgatctcagctcactgcaacctccgcctcccgggttcaagcaattctcctgcctcagcctcccgagtagctgggactagaggtgtgtgccaccatggccggctaatttttgtatgtttagtrgaggtggggtttcaccatgttggtcaggctggtctcaaactcctgacctcgtgatccgcctgcctcggcctcccaaagtgctgggattataggcatgagccaccgtgcccggygagaggtgttttcttaagaggaggtcaargagagtatgaggaatgcttggagattgtcaaggctttgtgccggaggttccgctactacctacaacagtccatctcccttctttcctgggcttatagccaagattatattttccagctcccctttcagttaagggtggccatatgaccacattctctccagtgaagtgtaagtgatgtaatgacatgtggcatttaaggggctagggcttaacattctcctcctctttttccttcccattagcagcaacccagatatggctgctaacccggcgtcaaccatgcagwtgagaactgggctcttggaatggcagaacaataacttggaaagagcctgggtcttgagggactatgggctgcagagctgccagccttcaaggactatactgtgtaggaaaaataaattcctttgctccctaagccatggtttagttggatctctttgttatagcagatgagccttatcctaaatgatatgtcagatatggaccatcttggtatagggcatccatttctcaaacttgggttccttttaataaacaataggcagttgaggtagactaggaaaagccctggactcaaagtgaagaaatttggctgctcagtgaaaataattaacattttgtgctttgcatcatagttgaccaagatttcctctgagagacctagcttctttttttttttttttttttttgagatagagtctgtcacccaggctggaatgcagtggtgtgatcttggcccactgcracctccactttccgggctcaagccattctcctgcctcagcctcctgagaagctgggactacatgtgtatgccaccatgcctggctaatttttgtatttttagtagagacagggttttgccgtgttgaccgggctggtctcaaactcctaacctcaagtraaccacctacctcagcctcccaaaatgctgggattacagttgtaatttctttataaaatagcaaccacagaggtatgaggagtgtaagtgaaacttttaagttgtcaagtgtyatgcaaacatgmgggcctctcagcatctggggcattggagggcactagacgtgttctgtctcagctgagaggcaaggtggggtcctctgaaggaggggccagagagcaaaagtgggcacagtctgctgcckcgtctcctggacagattgacatgcaagaggcccacggtggaatatactcctagccaactaattgtaaaaatatgcagaattatagatacagagagagcctatataataccccacatgactaagagcaatctctgcagaggagcactgcattaaaataacagccgcggcaggcatgaggccgccttcagagataagtgctggagtttggctctaaatgccaacatccttagctaatctaagtaatgcatgagcaggaagaattccgtggctgggagcccaagtggagttgtttaaagaactcttaagaacagctagtaacctccaagcagtaggcccaagtgcatgatggggaatttaacatttaatagaatctgaggggtgaggggctgccgagagggctgggggtggggacttggatctcaatgagaggcacgctgttaaggggcttctggcagcgccwccaccatgccatagttggtttctgtctctggttcatttgttttgtgcaagatcaactcgaatcaggaatcccaggttagaaagtccaccatcctctcattaaagaggccaggaagggcttgaccagaaagttaggggaaaagatgtcactcctgttgagaagggaggcagcctcctacctctgacattatggctctatgatttttggaactggaatattcacctagagattgtctcatatattctccacctccccacccccatcgccaactctcatgttatagttggggaaactgaggcccagcacaggggagcaaagctcccaaaaacacgcagtgagtcgggggctgtggagatcacctcctccaatcagaaccactgcctacttcccacccaccccattatttcacaaatgcagataaggaggtgcagagggagaaagtgacaatgtcaaggtttcattcatttcagggcagaagggtgagtggcagctaggctacctggttcaaaaccrtaagattttgaccaccacgtttcagcatcttatcagctgagagtgatgactagcaaaggcctctctcctggtctggctcaccaggactttctgcasctgttgcactgggatgggcttccaagctcacccccgaggttgctggcagaattcaggtcctggggagctgttggactgagcaggctcctctcaggtccttgcctcatgggcgtctcctacacgctgatggggaaacagagcatgcaagccaagttggatgtccctggcttttataatctcttctcagaagagacagcctatcacttttttattcttttttgaggcgaggtctcactctgtcactcaggttggagtgcagaggtgctatcacagctcactgcaaactccacctcttgggttcaagtgatcctcctgcctcagaccccaagtagctgggtaggtgagaccacaggtacataccactacacctggctaattgttgtattttttgtagagatggtgtttctccatgttgcccaggctggtcttgaactcctgggatcaagcgatctgccctcctcagcctcccaaagtgctgtgattacaggcatgagccattgctccccacccacttttgttgtattctagttctcaaaagtcattaggtccaggtcccctacsccatacacctaaccatcacacagatgtgcacgcacacatacacacacacatggagaggtctacacagggcatgaatactaggaggtggaggtcaccaggtgcttttcagaagctgttgaccgtaattctctagcagtacataaaaagcatcctggtcttggccgggtgtggtggcacagcctgtaatcccagcastttgggaggccgaggcgggtggatcacrmggwcaggagatcaagaccatccyggctaacacggtgaaaccccgtctctactaaaaatacaaaaattagccaggcctggtggcgggtgcctgtagtcccagctacttgggaggctgaggcaggagaatggtgtgaacccgggaggcggagtttgcagtgagccgagattgcgccactgcactccagcctgggcgacagagcgacacwccacctcaaaaaaaaaaaagcatcctggtcttgtagcaaactcccatcatatggaggacccttgtcccttcaaccagggctctcctggtaggttcatgacttcatgtctttgacctccactggctgggaggctcatgggggcaggggagtcattgcctatggtgcatgcagtagatgctctgctaatactgtactctttagggtaagtggagggtagagaaaggtttctcagttctgccttaattcaagagtgccccaggcaataaactgttgcttgttcttatagaatggcagttgctttggacaaatgttttggaagatttttggaactccagagtactgcagagagtactttcagacaaggttgtcgattggaaaagaaactgaaaagggcctggaccaggctgggctggacacataatatatccacaatatcctggactgaacttgagccattgtgtatttatgtaattgtcctgctgttggcaaagggcaagtccaagcctgaggagtggggtagattccactgaagaaatgttcccatgccagtcatcttgggaggaagtttgtcctggggtagaaattgagaactcaagatgtggacctttggggtgagaaagaagtgtgttctctctctctctctctctctctctctctctctctctctcaacaaagttgggtctgccctacaagggaagacatgttccaggcaacctgagagaaggagctgggctggaccctgctgatggggaacaagctggggctgaacagctaggtggtcctatgagattatctgggtaccaacctgggctctgakaaaatccacattggtcactgtgttgagtatgtatttctttgtattttattcttcttccatggtgcccaratttaatcagctcctgctagacactgcatctggtttctgttgagtatgatgcactgaggggaaggctctggccatgcttggggctgagtggccaccatacctggcctgaacattttaatagaacttttcactttacaaaacaatatcccactcagaatgctgggctcggtgcagggacagacaagctcagcagtgtgggaaatcgcagcaggtgtgcagactaaggaagctggagggggagaacataagggcaagttctggggcagtggtaacttagcacctggggcctctccaaaatagctagggatggtcctgcagggactgagttcctatgtgggccagtagggttcaaaggaaattgtagcttgagcattaaatggagataaggcagtttattttcattggctggggaggcctgaacatagttgttctattagatgttgtggtagtaaaaatagataacagcaataatctagtatgtcaacatgtgaggtttttttgtttttttgagacaggatcttgctctgttgcccaggcttgagtgcagtggtgcattacagctcacataatgcttgaactccaaggctaaaagcaatcctctcacctcagcctcctgagtagctgggactacaagtgtgccccatcatgcccggctaatttttgtgttttttgtacagatgggatctcataatgttgcctaaactggtcttgaactcctgggctcaagtgatcctcctacctctgcctcccaaagtgctgtgattacaagtgtgagccaccatgtctggcctcaacattttaatagaacgtttcacttttacaaaacagtttcctatatatccatttctagttgatcctcaaaataatcttatatgtagaacaggcattagattgctaattgttcttattagttacaaggttaaactatatgaaattgccatattaataagtcaaacactgttaaatgtaagcaactttgtatggtttatcctcattacataaatcataactattataaataacaataatagtgtcttagtccattttgtgttgctgtaacagaataccatagactgggtaatttattttaaaaagagatttatttcttacagttctagaggctgggaagtctaagatcaagggacttgcatctggcaagggccttcatgctgtgtcatcctgtggcagaagatggaagggcaagagagcctgagagagcaagaggggacgaaggccaaactcattccttttatcaaaaaacaaactcctgagatcatgaacccactccttcaatagtggcattaatccattcatgagggcagagcccacatgacatatcacctctttttctttttttcctggagacatgactcactgtgttgcccagactgaagtgcggcggtgcaatcatagctcactgcaggcttgacctcccaggctcaagtgatcctcccacctccttagtagctgggacttcaggcatgcaccagcacacccagctgtttttttttaaattattttttgtagatacagggtctccatatgttgcctaggctggtcttgaactcccaggctctcaagcagtcctcccaccttggcctcccaaagtgctggaattacaggcatgagctatcatgcctggccactaatcacctcttaaaggtctaacctctcaaaactgctgcattggggattgagttttcaacacatgaactttgagggacacattcaagccatatcatgtaggaacttaaaaaatatgtacctggcatattgctaagctctcttcacacattttatctcattcagagatgcatattctagtggatatagcaatgttcctttcagattcctcttcagagcccacacactcattcccagctgctgggaatattggctacttccctcactgggaattgcccttggccacaagtcactgcttccaccaaggtgatgcccagaccccaagggtagtcattaggctgtgactggctgacgtgaggatataaagcctgggccccttgcctcaatttgggaccctctgaagggccatgtggctcagagctccctgtaggattggctcttcctggttgcaaccacattgggggtcatcttctccctcttctcartcctgccctctcacttacgtacaggtgtatctcccaaaattactgcctaagaaaccttctgcagacagaaaccacctccatctcagagtctgcttccagggaacccaaacttaggacagttggtgtcagaggggttcaaggtggcagactctaaagtgggagtttggagagggatcacttgctagtcagctctccatgaactggtataggagtggtaaggatagtccctgccatgctgtaactgcatgatggctaaaacttgcatttctggtgaactggggcgtgatgggatgcagaaaatgctgcttcaaataataacaccttggaaattgagaaaatagtagaaacaggaaggctactctcaccttcccctctaccttcttccctgaagcaaggccataaaacttaggaaggtgacaatctgaccttctcccacccttctctcctgaaaaccctcaggtgacaggtgtcctgccctataccttgagggaatgtcacacaagaacggacaagagtctaaacaaagaggccttgtgaagatccccctctgcagtttatcactattagatcatctcccctttgtcccattagacttctgcaggactgttcattcttcatcaaagccaagcataaggatacacaggtttccctstttctttgagtcttcatttctgaaggctcctgtgtcatgtaaaactaatattaaatacatatgtatgcttttctcttgttaacctgtcttttgctacagagtctcagccaagaacctagcaatgagtaggaagataaatcttttctcccctacatatggtatatgggtggaaggggtcacactcattggtgtagtatctctggcaactgggggccgtagtgactataaggactatggaaatgaatgaccattgctgagtccatttacttgctaaagagacttaatgatagcctcagagtgaataatcaccaaggtaaaatgttaaagccagatggcctcctgggcaactgttaaggaaatccctcctgcaaagggaggatcaggcataggatttaatgttaaaaatagcagagctttggagaaggtttgatttttcagccctgacaggcctccaatgccagggtcagagccataataggtgaggactgggaacctgagacttgggttggggatatatgagtagatgcagtcaagcaccttgaattctcaggtccttctgaacccactgggtttgcagaagtgacacacttcttgttggcaaacagtggtgccccttatttgaagattgcactagtctgttctcacattgctataaagaactacccaagactgggtaatttacgaagaaaagaggtttaattggctcacagttccacaggctgtacaggtctgggaggcctcaggaaacttacaatcatggcagaaggtgaaggggaagctggcatgtcctacatgactggagcaggaagaagaaaaagacgggggaggtgctacacactgtcaaccagaactcgtgagaactcactcactatcatgagaacagtaaggggaaatctgcccccatgatcaaatcacctcccattaggctccttccctaacactggggattacaattcaacatgagatttgggtggggatgcagagccaaactatatcaaagatcatacaaggtttccagtgaggcaggtgccctacatgagaatgcttgtcctcctcagaacccaactttacttccttcctggcgatctaataaaagttaaatcccagctgtgctgagcatgctaagggaggagaggcactatatgctgcaggagccacaggatctagctaatacatttaagcaagcactgtgcacagaacagggtcctgagtaggctggatcaagaggggaggaaggtaaaggtggataagagcaggtgttaatatgggagtactctccatgatacagaacttaacactctggcaaggaacccagggtaagggggtgaacacacttcagagatggattttagaagcttaggaaaagcaatggttcacactaagtaaagtagaaatattagaactgctgtggcagataggagttcaagtcttggagwagtagtccaggtatggtggctcatgtctgtaatctcagcactttgggaggctgaggtgggmggatcacttgaggacaggagttggagaccagcctggmcaacatggcaaaacccgtctctactaaaaaatacaaaaaaaaattagccaggtggggtggcctgtacctgtaaccccaactactcaggagtttgaggcaagagaatcacttgaacctgggccagattgtgccactgcactccagtctgggcaacagagtgagactctatctcaaaaaaaaaaaaaaaaaaagaaaaagtaaaagtctcagacaagtgggcctgctagagtgtttgcagcacataaagccagaaaacccatcagccaactctgttctgtgggaggccctggagaacactctatttactgaagcaataaggaatgagtctgtgggagctagaggtggcaccagcttcactgacagtaggaggtgctattacagaactgggctccctgatgcccataggtatgatagaatcccaaaataacagagttcaggtggtggtgcttgacctttaaaccaaggtgactgcaattgcaatgaacagcaaaattggatcctgacccacagagcactatggagatggctaatagaacacagtgttcctagaagcaagatagatgggtggccaacagtgcattgcttaatttagacagtcaaaagaaatcaaggatggatgatcagggggttgaaagcagccacccccagtaatacatcatgatttcttatcctgtttctgacctgagccgttgactaaaggagaggttaggtctctgtgaggaaggatctgtaacatcatggcaaatgtgttcagtagtaatgccccagtcctttcctaaaacaatctatggccatttactgtgtatcaccatgagaaagggggaattctgagggctttgaaggactattagccatggggtctaactcaacactgatatctggtgacccaaagtgcttttatatccctccctcccatcagaatgagggagtatgggttccaggtgacaacgaagccstgatcctgctctaattcacagtgagtccagttgggtgcgtccaccaacccactgtggtcctatccctgattcctgaacgcttcggaatggacatacatggtagttggtagaaccctagcattgattccttgagtctctaaaagtgccgactctcctttgccatgatagtaaatcaaatacaagattgttttttattccaggaggaatggcaggaattagttccaccttcaaagattaaggaaatacagggatggtggtttttgttgtatccccatttaattcaccaatctggtccctacaaaaattgcataatcatggcgactgagagtacactcccacaaacttaaccaagtagtatccctacttgtggttgttgtgctacacacggcatcttcctggagcggatgaatacaccctccagatgcggtacatgaccaatcatctccttattgccttcttttctatccctatcagaaaggaggatcagaagtagctcacattcacacggagcagacaattagatatatttacatgttgcctcagggccatgttaattttgctgcctttatcataatgtccaaaaggacctggcccatctggattttccatggaatatctaattagtgcagcatatcaataacatcatgttaatgagaccaaatgagcaagaaatgacaagtatattaaagactgtggcatgacacattcactccagaaggtgggaaataactcctacccaratttagggcccagacacatcactgaaatgcataaaggtctagtggtctgggcataaaggtaaaggagtgctggagctctgaggtaaagaatgtaaagaacagggcaaccccctcgggtccccttccacgctgtggaagctttgttctttcactctccacaataaatcttgctgttgcaaaacaaacaaacaaacaaaatgtaaagaacaaatggtgagccatcacatttgtacatcagtacaaggatggcatgaaattttcctccacagctgcagctgataccacagggaggctgaggggatgtgatacagggcacttgaagtgtctactctaccccattttacagatgagaaactaagtctctgagaggttaaattgctcaaaaacacagtgctggcaagtggtcgatctaaggttaaaatccggatctgtctgacttgaaagcccatgttctttaatacctatattgtacagataaggaggctgggaacagagagattaagtggcctcttgttgcatcttggacttyctgggaggtagattctgagacagattgtcatgcaggaagtgtattgggaagtgttcccaggatcaacaccctgagggggagtggagaaggcaggactgggcagagggagaggctgggctgtgatgctatcactatacctctggagtgctctgcagaggtgtcccctgttggcagcagggggcggagccttgatattcctgcacagaggcagtccttgggctgccccaggaagaggacatcaccttgagagagaagctcctcttcagccaagggcagttcccctgggagactctgcctaccactgtcagcctttgatacttccggctgctggggggaatgactgcttcaggcctggtagaggggatctggggtgatgtaccccagcatccactatccctctttagggtccttcagctagtgggcaacacaaaagtaggtcctctgactctaaaactaacatagtcctgcttttccagctccataataggtccactatctccgagtgaacaaccaagactatgggatcattgattggaaaagaactgtaatccactcaaacttgatcaaattagaaggagagagtgttggtaataggaatcttagctgaggagagggaaaagatttcattcattcaaaaatatgtattgagtgattaccatacaccaagctccattctcagtgttggggagacaacaagaataatcaaagctcctgctcatgcagaaccctttctaatggagaaggtgtcggggaaggcccagtcctcctggagaccaggaacaacctgcctccttaagagatggaggagccaaatctgtgtctcatcttttcgtaaatgtctgtaggagaataatactgagttaatttctcatctgtttatctgccatatacaagtaaatgcatagggaaaggttggtaacagttgttacctctggggtgggagtaaaatggatggaacacgggagtaaaggagagcttgacttttctctctctctttgctgcccctcctttcttttcgctagttcctcattttgctagtgtacccaggttctaactactgcgtataaaggcagtgtcagagacggcccctgctttcttcccagctctagtttcaggcctgaaacggcagctggaatttccctgccctgtctcctcttttcttcctctctagagactcctcttgctgtcagctgagaagggggaagcagtcacctggagattctgtaaaataggccacacatttgggagatttgggaaaatagaagagagtcattttgcaggctttagtcctttatatatttctgcattacttgaatgtttcatagcaagtgtgatttgtgcattatacatttagctgttgctgttgtggaggtttttagttttttggggtttttttttttttttgagacagagtctcactctgtcacccaggctggagtgtagtggcatgatctcggctcactgcaaccgctgccccctgggttcaagcgatttgcctgcctcagcctcctgagtagtgggagggattacagtgtgcaccaccacggctgggtaacttttgtatttttagtagaggggtttcaccatgttggccaggctggtctcaaactcctgacctcaggtgatccacgcgcctcagcctcccaaagtgctgggattacaggcatgagccaccatgcccagccagttgtagaggttttgtctgtttgcttctgcgttttgacgttgcagatggaagactctggctgacaaaccaggcctggctcgagactttctttttttttatttatgtattttttaattatactttaagttctagggtacatgtgcacaacgtgcaggtttgttacatatgtatacatgtgccatgttggtgtgctgcacccattaactcgtcatttacattaggtatatctccttacgctatccctcccctttccccccaccccacgacaggccccggggtgtgatgttccctaccccgtatccaagtgttctcattgttcaattcccacctatgagtgagaacatggagtgtttggttttctgtccttgtgatagtttgctgagaatgatggtttccagcttcatccatgtccctacaaaggacatgaactcatcctttttttatggctgtatagtattccatggtgtatatgtgttactttttcttaatccagtctatcattgctggacatttgggttggttccaagtctttgctattgtgaatagtgccgcaataaacatacgtgtacatgtgtctttataacagcatgatttataatcctttgggtatgtacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgttgtttcctgactttaatgatcaccattctaactggtatgagacagtatctcattgtggttttgatttgcatttctctgatggccaatgatgatgaacattttttcatgtgtctgttggctgtataaatgtcttcttttgagaagtgtctgttcatatccttcgcccactttttgatggggttgtttgattttttttcttgtaaatttgttgaagttctttgtagattctggatattagccctttgtcagatgggtagattgtaaaaatcttctcccattctgtaggttgcctgttcactgtgatggtagtttcttttgctgtacagaagccctttagtttaattagatcccatttgtcagttttggctttcgggactttctatggtaaagacctctaggcctagcacctgcttgtggcgaaattgtgaaagtggtcaggctacctctgggaaccttttgtggccataccccmtcctgttctcctgaatggttctaattctgattgtgggttatcccrcagaggtgaggactaagctctgattttttgatcttgcccaaattcttatctaaggggtctggggaatcatgccctacaaaccatacattcttatcagatgagttttatttaaccctgtatatcatgactkactttccaatctgactctcatataacaagaaagaaaatcaaaatatttaaccctaaatatgtttcctagccatttcttgaaattgccctgcaaagtctcttgtgggaaaaatccacattctataaagaatctcttttcccctttgttttccttccttcctttccagatccaggagataatcagctagaaccagacacccttttaggtctgataagaaacattttacaacttgctctctctgaagtctgctatctgagagcttcctctatacaataaaacttggtttccgcaatcctttattttaacctgaacatttcctttctattgatcccagatcttcagataaactcaaccarttgtcaaccagaaaatgtttayatttacctatagcctggaagcccccaccttgacttgtccctcctttctgaaccaaaccaatgtatttcttaaatgtatttgattgatgtttcatatctccctaaaatatataaaaccaagctctaccctgaccaccttgggcacatgttctcaggacctcttgagggttgtgtgacgggccatggtcacacatatttggctcagaataaatctctaaaaatgctttacagagtttgactctttttgtcaacagaggacaagtgtgtctccaggtaggctttcttcccttgggcttttgaacttcacagtggaccttcttgcttggggtgagaggcctgtgtcctgaggaaggaacatgcagcagcagctggtgacgctggtgatttggtgatggcacattctccctagagatgacccgtgagtcccctggggagagcgaggctggctttggagaaaagtcatgggatccatagtggataggcatgaactgctcttgctcagcactcaatggccacttttctggtgacagcactacaattttgctttagtgattgacctgtcttgcatttaatacagccttggtaagattgccattcaagggaccccactaccctgggccaggaaatgggccatgtgacctaaattaggtcaatcagatgctgtcttctaggaacttgaattttgagggactgatacaaaaacagaaaatgtttggggccaattcatcctaattctggcagtccaaggcaacagaccactggttgctgctttccagattcctcaaactgccctcctgcctgtccttctggagcatggrgcttcagcttttccttcatctttctgttgcctcactcttccaataaagaactttcaaagtaagttacccagaatcgatttctgttgcttactacctaagacccctgactaatacagcatccataccatctaggcctttgaagacctatcacctccccaaaaagctcaggcttttcaggtgtgctgtgtatgtttcatggtgttttatgtatgctgtggatatggagtggtcaggggatgagcagggcaggttgggtgttagggactaagagagatgtcagtgtcagccaggttcatatcccacattcctgagccatgctgtcagactgggaggtgcaacacccacgggaggggtccagggctgagtataggcagagcatgaaaccacaggctgaacacactacgttttctggaggtgccaatttgaagattttatggcaggtggggagacacaggttttttttttttaatttaaaattgaatatgtatatattttggcatagaatacaagaatctgtgggaatttttatgagaacacaagcatgcactaagaaatttccatctggcagaaagtcaattccatatacgtatctagacctcttggcagtacacatttgctctgcaactataaagggttctttggtggaaatttagagaaacacagacctatggtattgagagcttcaactaaaccacagactgttctaatgtaggtgcctcctctgtctgccctcagattccttttagggttggactagaagtggggcctctcagtcctgttagctttgatatcttttcacagaccctagttactgctactctcatgtacaaccttgttaaaaatcattcaccaaggaaagacatcccctatctctgtgggtaaatgcaagaaacttaaaatcagggaagtggttctcatgatggaggagaaggaagtcagtaaagaaaacytgatctcgccaggcgcggtggctcacgcctgtaatcccagcactttgggaggccgaggcaggtggatcacgaggtcaggagatcgagaccatcctggctaacacggtgaagccctgtctctactaaaaatacaaaaaatgagatggatgtattggcgggcgccttgtagtcccagctactcgggaggctgaggcaggagaatggcgtgaacctgggaggcagagcttgcagtgagctgagattgtgccactgcactccagcctgggcgacagagcgagactccatctcaaaaaaaaaaaaaaaaaagaaaagaaaagataaaagaaaacctgatctctcttttggcatgtgtgagattccaaatatatggatttctattatgtgctaggtatttgtaatgtttcatcattataaccccaagccaaagatggtattataatatcatggtatggatgatgattgttatgagctgaacacttttcatctccccaaattttatgtgtagaaatcttaacccccaatgtgatgatattaggaagtggggactttgggagatgattaggtcatgagggtaaagccctcatgaatgggattagttcccttataaaagggatccccaaagagctctctggatctctttctgccacgtatggatataagaggttggcagtctgcaaccctgaagagagccctcaccagaacccaacaatgctggtaccctgatttcagacttctgttctccagaactgtgagaaataaatcyctrttgttgataagccacgcagcttattgtgctttgtgayagcagcctgaattgactaacacaaygatcccagggcccagtgaggttgaataactcacccaaagtcacacaggtatttaggccacttattgtagacatcattcttgttccaggtccccttttgagattgctctcctgacctgaatacagaataaatcagatccacaagactctagtccgaataggtttattgtctgtgtcccttgtcctaatggggaggcctctgctcaccaagagtgtcctgaccacctggggctaggggtgctggagaggagcacagagaggaggaagggcctgaagatgatttccccaacaactctgtactgtgggggttaagagtgtgggctctgagggtaaacagagctggatttgaagcccactctcctcctactcatggtatagataagagggaaggagggggtagagtgggagggaaaccaccaaccycagcaagccacagactccaggaggccaccaytgggtcccgaaccatgctcctattgtctttacaaaggggaatggcagctgctccacctcccacaacatccaatcaggcatcctgcagacggtggcaaatcacagagaagcaatggcaaaggggctgtggatgggcctgactgtctggacatggccaaatctgctgcccagccacttgctcttgtgacytcatcctgacctgaagygtctgcctacaggtgctcctgcctctcccctggcccagcaaggaccgcaggatgcccttccttaactcctgggtaggagcccacagtggtgactgatccacgtgaggtcccttaggtggtaaaagcgtctccacccccagccttcccgggacgtcctgtgcagcaggagttgataacgctgtgtacaggctgatgggggtagacacgctcttgttgccaggccctggacrctctgaaccccagcctgggctcctggccttaatggggcagggaggggaccatcggggcacagagccagggatcctgttactctctacatagaggtgccaagtaggctacttwttsaagttttcttttttaaaaaaactttctttccattctatgactctttaagggaagaaattccattgtgcactgtaacactgaggacttttacaccagagagtctcacggggaatattcaggccttggagaaaccactagagtttctgttgctggaggacaggggccctgtcttagattctcttgctcaggcctggaaagatacttagggatggtctagttcagtctgagtcagtgtgagcctggcctcatcccagacagacaaccatctccctacaaacagcaccakgatgccttgttgagttcatggtcccgcctgctccaaggcactgctggatgatcaaaataaaggtccttcctcttacgtgctgtgagtctttaagggggtgaagaagtcargcactgagtgggaagtacacctrgaggcgcagtgtccactgggctgcatgtcaaagtctgtcatgtgtctcctgggtgacgcttaacaaattgcttagcctctctgggcctctgatggctcatctagtgttaataagawaataagccaggcgtggtggctcacacctgtaatcccagcaatttgggaggctgaggcagaatgattgcttaaagccagcagttcaagaccagcctgggcaacatagggagaccccatttcttttttttttttttttgggagaccccatttctacaaaacttttttaaaaaaattagccagatgtrggggygcatgcctgtagtcctaggtactcaggaggctgaggtgggaggatggattgagcccaggagatcgaggctgcagtgagttgtgattgtaccactactacactctggcctgggtgacagagtgagaccctgtctctaaaataataacaataatgttataatactactaataatacagtagtgttaggtccttgtggctgcaatacactttgtagtttacaaatcatgtttgcatacctggagtcttagagcttccctacagactactcaaagcagatatttttagccctatttttgagttgaaactgagctctagagaggactagtgactttgtcaagatcacaagtgaccttgtgctgttgctgtttcgagagagtgtgtaatcctgttgctgtttagagagagtgtgttttagatttatgtgacctagaagcaccagcacgggatctttatcctgatgttcttgagccaccaccagctctcctccaggcccaggcttttgtgaattacagtgaagaaaatgcagaccaggcgacttgctgagtgacatggtcacgtatggtggggaatcatccaatacctttaaaatatttttttgaaccttggtggaaaagtgtgtttcttcattcattcatttcttcattcatctgttcatcaaagttttgcgaggctctaaatgtgtgctaggcatgatgcaaggagtggggacaaaatggaaccagccatgactactgcccttgaggaagtcacagtaggtaggaagatggacatcgagacataagtacagcagaaagtcatttatttattcctgtcatttgtgaatcctcttccatcttccagtagtccttacggaaaaagcaaatacccataaaaagatctcttaaggcgactgggggcacacacggggtgggggtgggagtttggggacaaacttcagcacctcacagtcttgtggtggggcctgcatgcatatgtgggtggggcatgaggaggagcacgtgttcttagagctcagtgtccctcccaccacattcccctgtgcgttgccccaggcacaggaactttgtaatcacatccagcctgggaytataaccaaacacagcattccaccaccctctgcaacctctttgtttgatcttccccctggagacacaggtcaagaggaagagaaggggaaggggggcaaactgcagggagagtgtgtggggagcttcctttgaattgtcttttaattcagaaacagaaaacaaagatgccatttcccaaggcctgagataccgccgctctgcattaaaggggttcagtctcagaatcctggagcagggtccacctgggaggtcactagtctgacccacctggtttacagagcccaggaagggaccataacttctttgatgtcacacggcagagaggggcagcattgcagtgtgatgtcacagcaaagaggggtagctactcatggagaatgactcaagaagcctgggggaaagccttccccaccagttgctcagtaacacctaaactgccttgcctgtgggacccagccttgtactgcatcatcagagattagcctgacaagcaaatgcaccagggaggaagcctggtaatgggggctcatttatgctagggcgtggatgactgatatcagggtctttcacaccaagaggcttagccggaggcagaggagaggagatcagaagggcactggagactgcaagggcaagaggtgactggggctaagcctagagggaagagggcatggagctgagagcttcaggcacaaaagagaaacttaatacctgctttgtaggccccaggtcctgtgcctgattttctctttcctctgagaaagaagctgtgaggtttctgaagtgtcaagtcactcttcatgtctaatcctgttgctgtttagagagagtgtgtttcagatttatgtctgaactgcatctaaaggtatcagcaaagtcgttaatttcagccacctgaatctggtggctgcctctgcttacgcacagcaacacttccttcctccagtcctgtgggaaataaggtatttcttcgggtgaggtttttgttttgtcttgttttttaataatttaagcttcctgttttatgtatctaatctcttcatattttcagtatgagggtactactaaggggcattttacattctcgaagtatgctgtaattgttgtttataatttaaatttaatctttttctttagtgtttttaattacwtaagaaatacatactcattgtaaaggattcaaaagatagaaaagtacatgaaataaaaagcatcactttatcgctttctactgctaaaggtagacacttaacattttggttttctttctttctttctttacttttttctttttttttcagcaaaaaaggtattatatgccacgtcagcaggtctgtgaattcatgaagatccctgagaccatttcaggggtccacaaggccaaagctatttttataataacactaagacaaaatttgctttttttcccacagtgttgacatttgtactgatgttgcaaaaagtaaaagtgggtaaaaactgctagtgtcttagatcaaggaggtggctccttgaactgtcctggtgggtattctgtccttcactactacactctcagaggagccgaaatgccagtttcttaaagaatgtccttaatgaagtagtaaagatgataaattgtattaaatttcaaccctggcgtacctgcctttttaagattctgcatgaagagatgagaagtatgcttaagccctgctgcattccaaagtccactgaccatccgaggagacactcgtgcagctgtttgtgttgcaagctgaattcactgtcccccagtcgccctgtcccccaccagggaacatcatttttactcgaaataatgactgacaaactatggttgttcagatttgggaattttcagacattttctcaaaaaatgaatgaaatgaacctgtcatttcaaggaaactgacagtatttgttactaatgatgaagtttcagctttcttttattttctttttaacttttaagttaaggggtacctgtgtaggtttgttacataggtaaacttgtatcataggggtttgttgtacagattattttgtcacccagatattaagcaaaggacctactaggtatttttcctgatcctctccctcctgccaccctccatcctcctacaggccccagtgtgtggtattcccctctatgtgtccatgtgttcccatcatttagctcccacttatgagtgagaacacgtagtatttggttttctgttcctgtgttagttttctaaagataatgacctccagctccatccatgtccctgcaaagacataatcccgtgcttttttatggctgcatagtactccatggtgtatatgtaacatgttttctttatccagactatcgctgatgggaaagtttaagctttcaagcaaacattagaatttccaaagacttatattttccactgtgagttggacagcttcccaacacttaaagactttagtgatgaaaggggtggtgataataaatgtgatttttgatgctgttaataaaatgtgttaatattagagctacataacttagtgaaccaatatttttcaaagactcatgcataatgttataaaatcatttgtggaagataaaccaatggattttaatgtaacggtatagattgttcattgatatgatttattttttatttttattttatttatttatttatttttgagatggaatctcactctgctgcccaggctggggtacactggtgtgatcttggcccgctgcaacccctgcctcctgggttcgggcaattctcctgcctcagcctcctgagtagctgggattacaggcacctgccaccacacctggctaatttttgtatttttagtggagacggggttttaccatgttggctgggctggtcacgaactcccgacctcaagtgatctccccacgttggcttcccaaagtgctgagattacaggcttgagccaccgcacccggcctcattgatatgatttagaatccacgttgccactaacctttcagaaactaccacttgtcaaattttggtaaacaatcaaagaacaatagccataataatctggaaagactattaaaataatcctcctttttcaactacgtgtgtttgtgagaccagattttcttcatgtacttcaaccaaaacaacatatcacaacagatttaatgccaaagcagatatgagaatacaactgtcttatattaagccagatattaaaacacatttgaaaaaatgtgagacaatgccagtcttctcactaaatgttttgatatagttaactttcataaaaaggatatgatttatagtaacatgcaatgagtttattaccattatttaaaattaagaaactcattttttgaaattatcttaatgtttaatacaataactattgatagacatagcctacataagaaaatctccagccaggcgtggtggctcacacctgtaatcccagcactttgggaggccgagacaggcagatcacgaggtcaagagatcaagaccatcctggccaacatggtgaaaccccatctctactaaaaatacaaaaattagctgggtgtggtggtgcgtgcctgtaatcccaactactcaggaggctgaggcaggggaatcacttgaatctgggaggcagaggttgcagtgagctgagattgtgccactgcactccaccctggtgacagagtgagactccgtctcaaaaaaaaaaaaaaaagtcccttgggatcctcaatagtttataagagcattaagagggtactgagaccaaaaagcttgagaacagcagctctacacattattccatacttaatcattattacagcgctacagattattctatacttgatcactcaagtatgtaggccccagctcctctgcatgcttttttgaaaacttaacctttcccctattgatggatatttagattagttataatttttcattattgtttataatgcacaacaaatatcttttgtacttcttacacaattttgcaagtctttatgtcagacaaatgactagaagaactattgaatcaaagactattcatatttaaaaacttaatactttcaaattacatcctaaaaaggtgatatcattttaaacttctgccaaaaatgtgtaagaggttgggcatggcgscttgtgcccataatcccaacgctttgggaagtcaaggcgggaggatcccttgaggccaggaggagtttgagaccagcctgggcaacagagcaagaccctgtctctacaaaaaaatttttaaaaaattagctgggcatgatggtgcatgcctgcagtcctagctactcaagaggctgaggagggaggatctcctcagcccaggaggttgagcctgcagtgatccatgatttcaccacctcactcaagcctgggcaacagagtaagaccctgtctcttaaaaaagaaaaaaagtgtaagtgtctattttctcatcatctttttttcctgtcttcttaaattaagtattttatgactattttttctcttcttttttttgactcttttgcctcaaaaagcattagagtgagcttaaaatgaaattcgggaacatagacaaattaacaaaagcaggtaaggagggttatactaaaaatctagatgaatggaagacatgtagctaagcactacgtttaactctgtgctttcaggcaactgaggtgaaaaagaaaaacagtgatttacatatctatgactatctactagcaggaagtcaatgagtacccaaaaagagagcaaaatctatgatctatcccttttcttttttttaagagatgggctctcaccatcttgcccaggctggtgtcaaactcctggattcaagcaatcctctcatcttggcctcccgaagtacagcgattacaggtgtgcaccaccacttccagctaatttttaaaatttttgtagagatggaatcttgctaggttgctcaggcttgtctcaaagtcctggcctcaagtgattcctcccaccttggcctcccaaagtgctgggattacaggcatgagccaccatgcctggcctatatgagatacttagtcaaatttatagaaataacaagtagaatggtggttaccaaggacttaggggagggggaaaaggggaggggttgtttaatggtgatatggtytggctgtgtccctacccaaatctcatcttggattgtagctcccacaattcccacgtctcatgggagggaccctgtgggaggtaattgaatcatgaggagtgtgggtctttcccgtgctattcctgtgatagtgaataagtctcaggagatctgatggttttataaaggggagtttccctgcacaaattctctcttgtctgcagtcatgtaagacatgcctttcactttctgccatgattgagaggcttccccagccacgtggatctgtgagtccattaaacctctttttctttataaattacccagtctcaggtatgtctttatctgcagtgtgaaaatggactaatagaaatgggtatagaatttcagatttgcaagatgaaaaagttcagaagatctgtttcacaataatgtgactatacttaacattactgaactagacacctaaaaatggctaattttttcaaaaaatggtactggaacaactggacatccacatgcagaaaatgaatctagaaacagactttacactcttccccaaaattaattcaaaatagatcatagactgaaatgtaaaatgtraaatgtaaaactacactactcctagaagataacataggagaaaacctaggtggcctgggctatggtcatgactttttagatacaacaccaaaggcacaatccatgaaataaataattgatttgctggatttcattaaagtttagaactgctcagcaaaagacaatgtcaaaagaatgagaatacaaccatagacwgggagaaaatatatgcaaaagatataactgataaaggactgttacccaaaatatacaaagaactcttagaactcaacaaggaaacaaacaacttgattaaaaaatagacaaagacctgaaagatatctcaccaaagaagatctacagatggcaagtaaaagcacatgaaaatatattaagcatcatacatcattaggaaattacaaattaaaataacaatgagataccattacatacctattagaatgtccaaaatccaaaatactgacaacaccaaaagctgatgagggtctggaacagcaggaactctcattcattgctggtgggaatacaaaatggtacagccactttggaagactttttgacagtttctcacaaaactatatatactcttaccgtataatcaatcaattacacttcttgttatttacccaaatgatttgaaaacttacatccacacaaaaacctgcaacagatgtttatagtagtcggcagctttattaataattgctaaaacttggaagcaatcaatatgtcctttcataggcaaatggataaataaactttggtatatgcagacaatgtcaagtgattcaacactaaaaagaaatgagctatcatgccatgaaaagacatagaggaaatttaaatgcatattactaatgcattttccaatgtgaaaatgttgcagactgtataataccagctatagagcattctggaaaagccaaaactatggagacagtaaaaagattagtggctgccaggggttagaagggagagaggtatgaataggcagagcatgaaggatttttaggtcagtgaaactattctgtgtgatgcatgtcattatacatacgtcattatacatgtatacaatggtagatacatgtcattatatgtatgtcaaaatccatagaatgtataccaccaagagtgaatcctaatgtaaactatgaactttgggtaataatgctgtacccatgaaggttcactgcttgtaacaaaggtaccattgtggtatgggatgttgatagtggaaggctgtgcgtacgtggggacaggagtggggatgggaactctctgtactttctactcagtttttttgtgaacccaaaactgtcctaaaaagtaaagtttattaattttataaaatggttaagatggtaaattttatgttatttttatttatttatttatttatttatttatttatttatttatttatttttagcacaatttaaagaatctagaactgggcatggtggctcacacctgtaattgcagcattttgggaggccaaggcgggagaatcacttgagcccaggagttcaagaccaccctgggcaacatggtgaaaactccatctctacaaaaaaaaatacaaaamttagccaggcatggtggtgcatatgtcaccagctactcaggagctgaggccagaggagcctgggaggttgaggctgcagtgagctgtgactgcaccactgcactccagcctgagtgactaagcaagaccctgtytcaaaaagaaaaaaaaaaaatgaaaagggaaattaaaataaaaaaaaaaaaccacacacactgcaaagtctcactttcattccatcctgttcttgtcgaagaggcaaccatttaaatttatcctttcagtgtttttatgcaacttccacaaatataagtaatgcatatgtttttctcttcctttcattcacagaaagtaacatcctatatacactggtctacacttcctgtatattgtgttttcacttaacaatctatcctggagatctgtattaagcagtgctgtccaataaaatagtcactacccatatatggctattaagcaaaaattaaatacaattaaaatttagctgggtgcagtggctcacgcctgtaatcccagcactgtgggaggctgaggcaggtggatcacttgaggccaggagttggagaccagcctggccaacatggcaaaaccccgtctctactaaaaatacaaaaattagccaagtgtggtggcacgaacctataatcccagcgactggggaggctgaggcacaagaatggcttgaacccaggaggcagcagttgccgtgagccaagatagcaccactgcactccagcctgggtgacagagtgagactctgtcttaaaaaaaaacaagattagttccttagctgaactattcacatttcaagcagtcaataaccacatgcggctgatggctaccatttgtccaagaatagaatatgtccattatcacagaaatttctttcagaaagcactggttataaacatcttcctcctccttttttacagccatataatactccactgtgtaacagtttattctaccaatcccttcctggagacatttgagttgtttgcactattttgctgtcataaacagtgccctatcatcacatgagtttttgtggaataggttctgcactaacaaaaggcatggtaagataaggctgtgacctgaggcagtgattgctctgcaggcaggccataccagggtgggatttctacttccgtggatctactcagtccttagctatgcaaatctggaaatgttcaggctgatgtcacattagccacactcataagacactattgggcatcaaaaatgagcaattacttgatattaaatggaggtagttstttagatttagtgaaatcctcgtgtctgctgcctaagacattgccttcccagaaggtaagccttgcccaggggaaatggataattctgacacatatttcatccagacatgacaggttcctgttcctaaaccaagtatgcctctccttttatcggraagcttgtgttcactaggaycaccatttcctgtgcagcattttcccctgggccatctttgcacagatgcctgggaaactattcctcttctgccagctctttcttcaggcagtacacmgtgtgctcgggaggtttcaccttgtttggtgatggtcatgtttcagtgcagtttcaagtcctccccaaattcttcagttatataaccacaatgtcttcaatattgctattgtgacatatggtggttttaaaatacgcctaaaaattctttactactctgctcttcaagtgatgaaattagctgagcatggtggcatgyacctgtagtcctagctactcaggagactgaggcaggaggatcacttgagtccaggagttcaagtctgcagtaagctatgatcatgccactgcactccagcctgggccacagagcgagaccttgtctcttaaaaagaaaaaaagatggaacttaattcccttcctgttgagggtggaccggactttgtgacgtacttgtaatgaatagcatgtggcagaagtaacagtgcgtgcagcttctgtgattaggtcttaaaagggaatgtggcttcctccctgtctggctttcttgaattattcattcagggtaggccaactgccatttcatgaagacactcaactagtcctgtggagaggtccacgtggtgggaactgaggtttcctgctaaaacccagcactaacttgcagggtgagtgtcttcatgcattttgtgctgctctaacagaatacctgagaccgggyaatttataaagagcagtaatttatttcttcacagttctacacactaggaagtccaagattaagacagcggcatctggcaagggccttcttgctgtgtcatcacatggcagcaaggcaaagagagagaaaaagaggggatgaactcatccttttgtaacagtatcaatcccacctctgagggcagagccattacgacctaataacctcttaatgttccacctcttaatactatgacaatgtcagttaaatttaaagacagatattcaaatcatggtgccaggtgcaagagccacctaggaagtggattctccaggcctcatccagcattcggacgattgcagacctggtcaacttcttgaaaatctcatgggagaccgagttagaaccgcccagccaagctgttcctgacccacagagactgtgtgaaatactaagtgtttattgttttatgctactaaatttggggaaaattcattagcagcaacagatagctaacatatctagatggctgagatcatccgtttttgttttgatccttattaatttccctcttgcagggttatcttgacttctaatctacagggacactcgagaacactaacctgtgaaccatcattttcttatctgtaaaatgcaagattggtatgaagggcacaaagcagggacttaaatggaaatgattaatattgttgtcgatgctcattaataatggaagccttgggtatcttccatttgcccctccatatccatgtccatttccaatcttttctcaccctactctgtgccccaggaggggctgacttccatggactatgtcagtggcctctctggttctcagccttccggtagagtttggcaaatgagaaatactggcaggagataggaggagggccagaggaaagggatgtatttccttggtttcttcctttccaagtcaccatgctttatcttcattcctctacctcaggccaccctgtcttggtactggtaactactgtctcctctctcccctccaggcctctgaatgataactgctcccctcttttgctagccccagggtgtgtcagtgtcctttggtgggctccctaagctctgtctgcacaactttgtaaatagtccctgtattaaactcacctcaaattgtatagatcccctgcagggatcctraatgagaatggctagttttagttgcttttaataatgatcctggattttttaaaagaaacaaacattctataaccagaaagatttctgagaatccaaatagatacaagattgascttagaaaaatctaaagaaatggttgtttagaatatcccaacttgaattatctggcaaatgtacgtatcacagatatgaaaggaaccttgtttccctcctgagagcaaaacccagracctccaagcaaaacccaggacctccaaagtcgtctgtggaaggagtatagctggagtaagacagcagggagagccaggcgccatggctcacacctgtaaccccagcactttgggaggctgaggttggcggaccacttgagatcaggaatttgagaccagcctggccaacatggtgaaaccccatctctacyaaaaacacaaaatttgttgggtgtgatggcgcatgcctgtaattccagctactcgggaggctgaggcaggagaatcacttgaacctcggaggcggagtttgcaatgagccaagatctcgccattgcactccagcctgggagacaagagcaagactccatctcaaaaagagagcagtaagaccagtgggagagggcrgttggccagccttgacagtgtttcctgagaggacacttctcaccctgaatgctactgcctcctgcccacagggtgttgctgcttctctttcatgctttccctagaacttcaacaacagcaacaaaagctttatagatatttaaggagaccaaaaaggagaaagcctgaggaagagccatccacttargctgctcctcatcctactggaatgaggaagtgtagcttggattcccagcctggctgacttctccaagcgttgacatctgtcccaccccatggggccaacacaccttcccaggcacctgcctgagtttctcatcttckaagtgggcataatactatattgagagggttcatctatgtaaagtgcctgggacagtgttgacaccctgtatgtgctaattttaatagcagcagcagcagctgtagttattagtgaagataatgggtgtggaacatgaacatttgttttgacatgtagggttgaaatttatgccaagagcctctgcctaaacccaagagtcccaagagtgtctgggatagactatgaaaaagcattaaaagcctgatgtctgtacagagatcacacaaattggcctgtagatgatttttgttgaaggggtggtgacagagcagtaataaaaaacytaagttgttcttatccactgagttgagtctttagaacccagcttaatattttcatggctcagatttattttgaatcttagcttttatttagtgctttaaaatgggagcagattgggcttacgaaaggatgcaaaacttgccctgacattaaatggccccaattgctagcctcttcagttcttatatctcaattataattttttatattataattgttggcctgtttcctcacgctatgcttttagcagccagatcttattgcttagaaagtgattaataaatgttggttcattagtaatgtttggttaatgactgtaaatgctttctcattttccatttcccctctttattgttaattgcttctaatctataaactgggaagacagatgtcaaatcttgtagtagtgtatgcagctggaacaagtcagtactgggaaacagattattttactcttggagcacctgcccatgtggagctccttttgaagaaagccgatcatttgaccctgccaccatggagcagagatggacagcaaacccaacaacagttggctatagactgaaagccaaggagtcagtctccaaagaacatcagaaaccaatggaaccaatcaaatcctctcttttggagagtttgaatgtgagtctcaagaggacatcccatgctgaggaggttgaggctaacccatgcagagataaggcagcaagcaagcccttaggtagagcgaggctgtaggaggagtagccgtggaggcagagtggctttgttgcctgatggtgraacctcagagtcaggggccactgggcaatgctgccagcatggagctacagtaattccaaatgactcctaaccatgtcctgctgacttccatgactgttagaaggaaagttggtgctgcctagttgttcccttgcatgtggctgtgtgggctgttttggtttatttgtttaagaggcaaactgtggagaggtaaagaactttcacttactctaaccagagtatccttattttctagaacactttttaaaaatttaagcatttgatatatggaacctggtatagatattaaaatgcactcaagaggaaacatgcttttgagctgaggtcctattttccagcttcttttccttttttttttttttttttgagatggagtctcactctgtcacccaggctggagtgcagtggtgtgatctcacctcgctgcaacctccgcctcccgggttcaagtgattctcctgcctcagcctccagagtagcggggtttacaggcaygtgccaccacaytcagctaacttttgtacttttagtagagacgggttttcaccatgttggtcaggctggtctctaactcctgacctcgtaatctacccgcctcaggttcccaaagtgctgggattacagtcgtgagccaccatgcctggccagtttcttttccttttattttgggtctggcaggaggcttttatattgtctcccaggtgtgaggactagtcactgtatcatgcttgtaaagaatgaaatgggtttggaaaaagaaaaaaaaaacaatttcaagttgctactggctttaaaaatcctactcagagtatcagctagcacagcttttagatgctcaggtcaaggtcatggaatctctctttcctcttctttgctttctcaactcttcaggtacacacacccccatccacttcttccactgacttctcagactgtcttccctccttaactctttccattctctgtgttcttctgacacaatgtaatacttcccagcaccaaacattattacactgtgttgatagataaagaacccaaggtgctggcctgagagacagagccaggctcagtgaggacattcattgccagctgtcatgggagagtggatggagattgtagcagtgggctcaagaaagtcagaaaacaaaggctttctaaacaagtggaggagaaatctagaagtcataaaggaaaaatgaacacatctgactacataaaatatcttaaaactataagtggaaaaagataccataaacaaagtcagaaggcaaatgacagagtggacaaaaatattagcaacacatgtaacagataaaaggtaaatgtccttcctatacaaagagtgctctacagtttaaaaaggaaatatgaaaggtccaatagaaaaatggtttgaggtttgaatagacaattcacagaggagaaaatgcatacctccagaagacataaaattatgcttagcattactttagtcaaagacgtatgacataaaacaatcaggtttttgtctgtcagattggataaaactaaaatgacagataagagtaagaaaatggctgcattgatatagttagtggagggtacatcacacaaccttttggaatagagtttggccatgtcarttaacattaccatgtgccctactcagtgatccagcagatctacttctagaaatctggcatacagaaaaactcatgcacatgcataaagatacatggatgagattttcattgtagctctgggatataatagcaaaaatggaaaactgaaatgttaataagggaatgtttaaataaaccatgcatggtgcatggttaacctaggcagtagataaaaagaatgaggtggctctacagacactaacctacaaagatgttcatcgtatattaagtgtaaaaagcctgttgaaaaattggataaacagcatgaatcaatttctacactttttttaaagtatgaagaaatagtgatttatgggtaggtatgcagggataaatacagagcaaatggttaacagcagtttaatctgagaagtggaaagtggggtcttgtgagactttgtatagttctttctttctaagcacagttgagttatgggaggttttgctttatgtgtttttcactaactttctaaaatatctcaatgacaaaatatggtacaattgtaaggacatttgtgataactgatcgatctgttatatgcctattttgctttaggcactgtactagagtgattccacaagctaattttatcttcatcactccctatgcaatacatattattattagaaccattttgcaggtgaagaatatgaaacttaaagagctgaagctacttgtacacagactctggctgtggtcatggcttataggcaatttgaagcaaagatgttggcaataatgtaacacccagggtgctataaggactagattgaaagtctgccatctgaggaactctctttaaagcacatgaatagtccttaaaaactgggtctcaatacatccttccccagctgtggtcaagtcccccttcttttggcttttgatgtcctggctttgtaggcttgctgtactctagacaaggaatgcaaatgagtgttgaatgagagtaggggtttgaagtcccaagcactagaaggcaaatttaccttcccccacttaatcctgggtaagcaaaactgaatggtagcccaggtatgtcagctgccctcattctcggcaacacttccaactccttttctgcctctttcacaggacaaatctccagctgygaagtccccagagacaccttccacaaagctggcagcctttgcccagggctgtggcaattactccaaatgttgggagagtccaaacctcstcttctaactttgtgtataggggatctctgtcttccatgctgggggatgggagaaaggggttgagtctgcatagggctgaagctgccagcaagagctgggacccaggagagcaggygagaagggaggggtcagggcagccagaaaacttgtggttctgaaatgaatctgcatgagtcatttgtttaaaaagggcggagtttctggagcccccagataawcctggggaatagagtagaccagaaaagacaaaatacaatgaaaggatcaagggacagctaaatgcctgagataggcccttggcttgtgcttaaatgatccgtgtaggtgtgtgtgtgtgtgtgtgtgtgtgtgtgtgtgtgtgtgtgtgtgtgtgtgtttagtgaagtctgccaagctctcatgacttgattcaagtatcaggtcacctgtcccaccaatcaaatatccttatctttcggttggagaatcttccctcctccctgattccactccccagtgcaggctaccgtcccagctttgttaggggataggcaaattgctcaagatcattcagtctcrcctaccaagtcaggactgctttcctagagcagttagcccgcctcagctcagctcaggtggcctttggaaaatccctggctgttaccagatcacggccttcaatttttttttttttttaactgcaacccttagtaagaaatacatgttatatcataacccagttcataggtgtgcatggccacacatacacacaaacggacacagaagtttcaacaaacagtacttacttaatacttagcccaattatctgattcttttccattctattctttaatttttcatttaaaaaaaatgtttgtaggccgggtgaggtggctcacgcctgtaatcccagcactttgagaggccaaggtaggtggatcgcttgagcccgggagtttgagatcagcctgggcaacatggtgaaaccctgtttctacaaaaaaatacaaaaattagccaggtatggcggtgcgtgcttgtagtcccagctcccagctactcaagaagctgaggtggaaggattgcttgagcccaggaggtyaaggttttagtgagccctgatcacatcagtgcactccagcctgggcaacagagtgagactttgtctcaaacaaacaaacaaacaaacaaacaaaacgaaccaaacaaaagtaacaacttgcaattcattcagttaatttcaatacctatgrgttaagatgagcrgattgaaatacacattcaagcctaatctctgaattatgcagagattttgagaatattccttcattagccacagccatgtgtgccacacaggagaaaccaggttgacgggcaagtcgtggtccaaggtcatccatggaccctcattggtgagagatactccctcaccagagagttgagtgtattgagtcatatgatgaatggggccactgtagttttagaataaaaatatgatttattttctttctttctttcttttctttctttctttctttctttctttctctttctttcttctttctttctttcttttctttctttctttctctttctttcttctttctttctttcttccttttctttctttcttccttttctttctttctttctttctttcttctttctctctctttcttttttttctttttatttttttgagacaaagtctggttctgtcacctaggctggagtacagtggcacaatcacagcttaactgcagcctcaacccctggactgaagcgatcctcccatttcagcttcccgaataggtaggactgcagacatgcaccaacacacctgaataatttttgtaatttttgtagagacgggggtctcatcatttgcccaggctggtctggaactctaaggctcaagcgatccacccacctcagcctcccaaagttctgggattacaggcttgagccaccctgcccagccaagattagctactgagagctttctatgtgccaagcattgttctaagcactttacacgaattaacgtatttaatcctcacaataccaccatgccatatgtagtattattaatccctgatgtatggacagttcgggaatttaacatccagaaaatagttactaaatatggatccaggtatcaaagccaggcagactggctccagagcccccagctcttctgcatcacatgtacctccccactacagcaggccttctcggaccttccacgactggctcactttgccatcttttccaaggatagtgtccagtgctgagctcagcaagctgtggccagaattccacagaggacttggactagagctggagctccagtgtggtcaccaatccaggtgatcatttcattagatcagtccagcagagcattcgttcaacacccacttactaagccttcaaacccagaagttcagggctggaagacactccagaaatttccaactacttagggactttcatacagggtaaaagggacacagggatctctctactccaagacttccacttttatctgtttcagagatagagtttctgcataagcttatacttgaaaaaaaatagtcttgctgttaaaacaagtttattttgggggaggtgagagaaaattttaaggaattagcagtcttttgggaaataattgatgacacgttttttagagtggtaaaatacatataatgtaaaatttaccatgaatgacagtgcagtcacagtattgtacaatattcaccacattttcatctcccctacggaaaatcccatacccgctaggcagtgattccccattaccttttctcctcagttcctggaaaccactaatttactttctgtgtctgtaaaattgcctcttctggacatttcacataaacagaawcatataaaatgtggccttttatgacttgttcttttacttagtataatgttttttwttttygagacagagtctcactctgttacccaggaggctgcagtatagtggcatgatcttggctcaccacaacctccacctccccagttcaagcaatgctcatgcctcagcttccctagtagctgggattacaggtgcatgccaccacacccagcctcacttagaataatgttttcaatgttgtagcatgtatctgtacttcattctttgttatggctgaataatattccattgtttgagtacatatttgtttatctgtttatcagttgatggacgactgaattgtttccaccttttggctgttgtgaataatgctgcttgctatgagcatttgtggatgcatttttgctcgagcacctgtttcaattctttcagttatattatttttatttatttatttcttattgagacagggtstcaatccgtcacccaggctggagtgcaatggcatgatcttggctcactgcaacctcagcctcctgggctcaagtaatcctcctgcctcagcctcctgagtagctgggactacaggcataaaccactatgcctggcttatttttgtattttttgcagaaaggggtttcaccatgttgcccaggctggtcttgtactcctgggctcaagtgatctgccctcctcagcttcccaaagtgctgggattaaaggtgtgagccaccgggtgtggctaattctttcagttacatacccaggagaggaatggctggatcacagggcaattcttgtttaagttattgaagaagtgccaaattgctttctacagtggatgcaccattttacatttccaccagcaacatatgagggttctaactgctccacatcctcaacaacacttgttattttcctttataaaaaaaattataaccattctagtgggtgcaaaaatagtgtcttattgtgtttgtttatttgaatttccctaatgacaatgatactaagcatcttttatgtgcttcttggccattgtataacttctttacagaaacgtctattcaagtccattgcccatttaaaaattggttgtctttttgttgttgagttgtaggagattttcatatattctggatactacaagtccttatcagatatatgatttgcaaatattatcttccattctgtacattgtcatttcactctcttaaaagcatcttttgatgtttttgattttgatgaaatccaatttatctaattttttctttttttttccttttatttatttatttatttatttattttttgaggcagagtcttgctctgttgcccaggctggagtgcaatggtgcaactctcgctcactgcaacctctgccttctgggttcaagtgattttcccacctcagtctcctgagtagctgggtctacaggcacgcgccaccacccccagctaatttttgtattgttagtagagacaaggtttcaccatgttggccaggctggtcttgaactgctgacctcaagtgatctgcccacctcagcctcccaaagtgctgggattacagatstgagccaccatgcccagcctctaattttttcttttgttgcttgtgttttttgtgtcatttcttaagccaatgccaactctgaggtcatggacatttacctttatatgttcatgtaagagttttatggttttagctcttacatttaggtcttttgtccattttgcattagtttttgtatatggtgcaatgtagggttccaacttcattcttttgcgtgtagatacccagttttcccatcataatttgttgaagaggctcttctttccctttgaatggtcatagtagtctttgaaaatcagttgaccatggatgtatgaatttatttctagactcttaattctatttcatttatctgtatgtctgtccttatgccagtacatgtacctgatgattactgtagctttgtacgaagttttgaaatcaggaagactaagtcctccaacttagttctttttcatgattgttttggctattcatggtcccttacaattccgtatgaattttaggatcatgttgtctatttctgcaaaaaggcctttgggattttgatagagattgcattgaatctgtagattgctttgtgtagtattgccattttaatattaagtcttcaaatccacaaactcaggatgtttttccatttatttagatcttctttattttaacaatgttttcattgtattagtctcacatcttcttgrttaaatatattgttaagtattctattttttaaaattgtttaaagttttttttgagacagggtctcatttgcttgagacagggtctcattctgtcacccaggctagagtgcaatggcaccatctgggatcactgcaacctccacctcccaggttcaggtgaccctcccacctcagcctcccgagtagctgggaccactggcatgccccagcacgcctggctaatttttgtatttttttatagagacagagtttcaccatgttggccaggttggtctcaaattcctgggttcaagccatccgcctgcctcagcgtcccaaagtgctgggattacaagcatgtgccaaggtgcctggcatattctattttccacccccctacaaagtaatagaccttattttgggagggcagttttaggtttacagaaaaattaagcagaaagttccagtatacatcttttaaaaaaattttttttttggtgatattatacaacgaaattgttttcttaattttcttttttggattgttcattgccttacatgtacagaaatacagctgatttttgtgtgttgatcttgtactctgcaactttgctgaatccttctattagttctaattgctgttaatatttgacgcttgccctagtccatataccatctccctgccatttaattgttgaagaaactaagtggctaggacttgcccagggtcctgctgccttttatggctgagcttgggacaggcttagcactttttcccttcagagctccaactcactccttaaattgaaccccartttttcagtgtaatttgcaggtacaaatttcagccagttgcctctacaaagcccctgtccattccttccaaatccctgatctcttcctattcatttgcccccatatgcccattatcatgagcccagcgtggactcccacgcggacccaggcccccagccctggccacagggtcacagagataactccgtgggaaattataccccakggccctttgctcctgactccccacgtggagcagagaaccactcagatgcgtgcttccagcccccacctcggacgacccgctgtccccctctcacggctgtttgcccgggcgttctaggatgctctggtattagagcaccctgcctgttcctggccccctgagcaccaacaagcccgtctcaggcctccaaagctctgcatacgttgccctggcaaggtcagaccctttggctgcaacacgtccgtcaagaagccaggcaaatctagcatgcaaactaggatcattttcgggcgttggggcccccccgcttgaaatctggtttccatgttcacaaaacgcagcccgactggtggaactcgcgactccagacgcagagaagctgtgggcagaggcggaggcagagggtgggaatgcagcctggcgttggagtggggagaaaggggagggaggaaccgcgcgcccaggccccgcccggttgcctaggtgacggggagcgagaggaagaagtgggggctgagctgatccgagcatttcagatcttaatactgaacagctcagccccccaagagggagtaggatggaagccccaagccaagggagtcatcttcattattttaccctggtacctagtgttctgctgctcatggagaaacagaatgtcagtcctggaaaagagcttgcgaagtctccttgcccagtggttttcaagcaggtttgtagctaaagattctcgtttcaaagaaaaccttaccaagaacctcagtttgcraaacagacctatagggagctaagtcaccccacttcaccttcccagattgtggaaaaactctggtctgggcccaaaccctccttgtagagatgggaaaactgaggtccccagacaggcactgcattgcccagggacacccaggacataaattcgctgcagaaccaggattggaaacgatctcccagtgatcaccatagagcaagcatgaagaagcggatcctttgaagtagctgggaagagaaaaggcacacaggatgttttaggaacctggaatttccagacctgctgagacaacacaatccccttattttacagacgaggaaactgaggcccagaaaggaggcagtggcaagttagtagagtggtcctaagtggagtaatattcccttagaaagaagatgcatttgagcatttggctttttggctagctcaagcaataaatctttgctgaaattctgaggtgccagatggcgcaggggaggagcactggcctgggagtttcatccccctctgttactgacgaaccccatgaccttgggagatttattttaaagagtcaaagggatcatccccaggtttgtaagaggtccagaagagtaataggattaaayggtgcttcagagtgttttatattgtttctaaatgtcagggcctctttgggggaagggaagtaagcacactgctctttaaagactgaatttgacagtgggttttttaaacgctctttatttttctttttcatttttcatggctaattataaagtaacacatggccatttcagaaaatgtgtaaagtacagaaaatgaaaggaaaaaaaagcagaaaggaaaatcacccataaacacatcacccagaggcaaccattgttatacattgttgtacatttcctttcagtcttttttctctaatttttttcttgtgcagcgtaaattgtatttttaattatgttgtaatttttaataatttcatttaattgtttaataattaatattaaacttagaatattaaagctaaagatctgtctgatcaccacccacagccctgggttctttgatgtattaattttgcagaccatttaatttttttcccacttatttacactcatttttcatttatttatacctatttcatttatgtagacccacaggaaatgtacagtgtaataataaatgtatatatatatattatattgtatatgtgttttacacaatggtataatgttttctctgcaatttgcttttttcttttttgctcatttgacacctatattattcaatcttatgtataagccactttgtatctacccattttgttcttgatgagcatatacattggttccaattttttgctactgtgataaattctacaatgaataacctttgcatgttcttctgcacaggggctagtgtttctctggtggtagatgcacggaagtagaattgctgaatatgcatttatttacttttaatccacactgccaaattgccctctaaagctactgcgtataatgagcatccttgttagcttataacactgctttgcttgattataagacttcacttttttaaaaaaacttaaattttttagaatctactgagtgaaaataatttatttttgtatgattttcctgattattagtatgattaagcatattgtttactggctatttaaaaaattagtttatagagttgctttatatatttaggccactatctttttttctgtatctatcacaagcattttcctcagtctgctgattattttttaatcttgtttgcaatgtcttttgacatgcagaattttaaatacttaatatggcaaaatttatgtattttcctttatagatttttgttttttgttcaaaaagatttgatctacgtttttcactaataatttwaagtatctatttacttatcttttttttaaacattaaaacattgactccatctggatttattttggtgtatgtatgtgataggaatctaattttgttgctttgcatatgggtcgttaattgctttaataccaattattgaatagtcttttttccactgattttgaataccacctctatcatataccaaatccccatataaacgcagatctatttcctgaccctttactcttttccatttatccatttatctccttttctatttttatgcaaatactacactgttttgactattgatttataatgtatcttaacagctgatgggcaatttacccactttttctgtttcattgccttggttcttcctgtacatgtattcttccatacgaattcatttatgaaggtctgtgaaaagtcttttgagtaatttgattgttattgcatcaaattcatacctagattttgagaaatgtatctcgaatatagcgtctttctatccaagaatctgacatgttgatttattgggtcttttaaaatgtgttttagtcaagtttaaaatcaccttcataaagatcttttactaaaatttttcctaaagactttatagtctttgttactattgtttttttccaattacattttctcatagcttatacttgtaagtagaaaggcaattaattttggtacattggtactattaattctgacagtttgttcattggttcttttaggtcttctagagaaggcaaccaaatctcatctgtatataattaatgctttgctttgtcttcttctcttctaatatttatatgtctattttggaggtaatcttattgcatgaagttgggtatgatgaagaaggggaatagtgggtattctaatcttgctcttgacattaatgagaatacatctaatgatgtaccttgttagtaggctcagtgctgtaacagaaaactccaatacctcaatggccaaacacaacatactggattaaggtgggccctaaatccaatatgactggtgttcttataagaaaagagaaatttggaccctgagacagacacacagggagaatgccatgtgatgactgaagcagagattggagtgatgtgtctataagccaaggattgctggcaatcatcagaagacagtaagaggctaggaagccacctccttcagtgagaacatggtgtcaccaacactttgatttcagttctagcctccaaaactattagacaataaatgtctattgtgttaagccacacagtgtgtggtaatttgttatggcagccctagggaaccaatgcaaaagctaagttaattcatcattagtctttcttgctttatagtaagtgcaagtaagtttatatatttccctgaagactactttaacgtcatcttaaagtagtacttcagttaattctaattttattgtagttttttgtcaactcattaattatttagacctgtgttttaaaacttctcggtgtatacaaatttctagccatcttcctgttgttgttgacataaaattttatcattaaatgttttatattatttcactttacttacttacttattttttgagatggggtcttgctatgttgctcaggctggactcaaactcctgggctcaagcaatcatcctacctcctcctcctaagtagctgggactgtgcccagctatatcacttaaaaaatttttttggaacttactgtgcagttaaatacttagtcaatacttagtcaatttttataaatgttccatttgtatttgtgaagaatgtacattttctattcaaagttctacatatatccattacattgacaggtcgtctgttctttgctgtgttaaagactagctaattgatgaacaaacttgttccccttcctcctgggcacacaactaggctacatttcctggactttttgcaattagatgtggtcttgtactgagttttggccaatggagcatgagcagaaattatgtgtgccacttccaggcccagcttacgtgtgtttctcctttctgtctgtcactatgaatgccaagatctcaacacacagagtgaccttggcaactacatgttgaaggtggcagagtttctatcagcttgaattcctggcagagacccttcctccgtgccccacaaccaaacattgaactttacrtgaaaaagaaattaacctcgattgtctaagtgttcagctactcttagttaaaagtttatttgctacagttgctagtgtgacttaaactaatactgttttgctctttagatactctatacttttttgtcttcttgatttgtcagtgtctgatgaatgtgtgtgagtctctcaatataaatataggtctaggctgggcacagtggctcatgcctgtaatctcagcattttgggaggcagaaataagaggatcacttgaacccaggagtttgagaccagactgggtaacaaagtgagaccccatctttacaaaaactaaaaaattagccaggtgcagtagtctgtgcttgtagtcccatctacttgggaggctaaggcaggaggaccccttgagcccaggagttcaaggttatagtgaggtatgatcatgccactgtactccagcctgggtgacagagcaagaatctgtctaaaaaaaaaaaaaaaaaaaaagaccgggcacggtggctcacacctgtaatcccagcactttgggaggccgaggtgggtggatcacctcaggtcaggagttcaagaccagcctggccaacatggtgaaaccccatctctactaaaaatacaaaaattattcgggcatggtggtgtgtgcctgtaatcccagctactcaggaggctgaggcaggataatcgcttgaacatgggaggcagaggttgcagtgagctgagattgcaccactttactccagcctgggtgacagagtgagactccatctcaaaaaaaaaaaaaatacacagacacacacacacacacacacacacacacacacrcacacacagacacacacagctatatgattccaattgtatacaaattataaattatttagtaatycataaactcttgctgtatatttcaaagctatgttgttagatatgtaaactcgtgttataattttttggaaaagtattccttttatcagcatgaaaattatttttgctgatatttgccaggttttaaccaytttatttattcatgttttggaagcaccagggtccactaagacattttatttataggtatgtattacacccctagaaaaagaatcccaggattttccctcaaatgtgttattgtcttgctttttcttatggtccatgatgccagctgaggttgttagtacaatgaattgaaactggtgggatgaaagcaggttattctgccgtttttctagatctttgagttggacattgatatggtttggatgtgtgtcccgctccaaatctcatgttgaaatgtgatctgcagtgttgaaggtggggcccagtgggaggtgtttgagtcatgggggcagatgacttaagaatggcttggtgccctccttgccataaggagtgagttctggctctgagagttcatcgagatgggattgtttraaggagtgtggccccctccctccatcccttgcttccattcttgccatgtgatgtgcctgctcccacttcaccttgtgccatgagcggaagcttccygaggccttcaccagaagcagatgccggtgctatgcttcttgtacagsttgcagaactgtgagccaaaataaatctcttttctttatatattacccagcctcaagtatttctttatagcaatatgaaacggaccaacacacatcaaatctggggctgatcactccacacttgtttaacctgcctgtgaggttcactattttctcagctctgtgatcatcaatggtttcaaatcaccaatgtagccatgcttcatyatcacagttagaaactggatgatgactttggagaacggcctaataagaacctggcatttactcctcttctcagcattgttgatgctcttgagagcatcaaccaggacattcatgtgcaccattatggctgctgggtagcctcaccctcccaagctcccagtaaagccccagcaatgagaagctgcactgcccacctggccacaaatccccagtgctgcctgccccaggccaaggcactgtcttagttgctaagaggagccaggcactgcagtataagcctgggctaccgcctttctgggcggttgaaagttccagctctcaccagtgctgcagcctgcacttcatggacccgggtccccagaatgtggagcatggggtgtctggacatggctctcctctatgcctgtctagggccctgcaaggccaggattcctgcccagtggggcccagtgtccttgaagagcactgaacctgagccttagattgcaggatggtgccaatgactgatgatcttaaccattttgaagtgtaaagttcagtggcattaaatacatatgcattgttgcacagccattactaccatccatttccagaaagttttcatcttccccaactgaaactctgtacccattgaacgctaattccccattttccccctcctgccctcccaactgccattttactttttgtctctatgaatttcactaccacatatagatggaatcatacaatatttagcctttgtgcctggcttatttcacttcgcataatgtcttcaaggttcattcatgttgtagcatgtgtcagttcttcattttttttgctgaataatattctattgtaacattcttttctttaaaaaaacaacaggttgggctgggcgcggtggctcacacctgtaatcccagcactttgggaggccgaggcagggggatcacaaggtcaggagtttgagaccagcctgaccaacatggtgaaaccccgtctctactaaaaatacaaaaattagccaggcgtggtggtgcgtgcctgtaatctcagctactcgggaggctgaggcaggagaatcacttgaccctgggaggtggaggttgcagtgagttgagatcacaccactgcactccagcctgggcaaccgagcgagactccatctcaaacaaaaaaaaggtttattaagatacaattcacataccataaaattcacccttttaaagtatctaatgatggccaggcacaatggctcacacctgtaatcccagcactttaggaggccgagatgggcagatcacttgagcccaggagtttgagacccagcaacatggagaaaccccgtctctaccaaaaatacaaaaaaattagctgggtgtggtggtgtgcacctgtaatcccagctacttgggaggctgaggtgggaggattgcttgaacccataaggcagaggttgcaatgagccttgattgagccactgcactccaacctggataacagagtgaaaccctgtctcaaaaaaataaataaaatttaaaaattaagtatatattgggcattttttcatacatttacagagttgtccaaccattaccactatctaatttcaggacattttcatcacccctgcagccattagcagtcacttctcattttcccctccctccaggacctggcaatcattaacgtattttctgtctctgtggattttccccttctggacatttcatgtaaatggaatcatacacagctgggcatggtggtgtgcactggtggtcccagctgaggcaggcagattcttggagccccagaatttccaggctgtagagcgtgatgatcatgcctgtgaacagccactgcactccagccttggcaacatggtgagacactgtctctgaaataagtaaataaatagggtcgtacaatatatggcctgttgtgtttaacttgttttgcttataatattcccaaggtttacttgttatagcatgtatcagtacctcattcctttttattgttgaataatattccattgtatgagtataccacattttgtatatccatctaccagccaacggacattttagttgtttccaatttttagctattatgaatagtgctgctatgaacatttgtatacagatttttgtgtgaacatatgttttcacttttcttgggtatgtaccaggagtagaattgctggattatatagtaactctatgtttaacattttgaggaaccgccaaatagttttccaaagtggctgtactattttacaattccatcagcaatgtatgagggttccaatttttccacatccttgccaatactttttattgkctatcttttttattatagcaagcctggtgggtgtagtgaggtgcctcattgtggtttttatttgcatttccctaatgactaatgttgaattcttttcatgtgcttattaacattcatttttaatgcacatatgcaagtatattttaaagaactaattggtatctatgtcttcactgtcaaaagacaaaattacaacaaatttagtttaaacatcttaattggctttattcgcatttctagaatcaggcaacactttattccacaaaatagaataagtattctgatgagctgagcagaagaggttggtttttataggcagagaagagctgaagaaaccagaaacaaagaatgaaaagtggactggtaatttcacaaagttactttttttgtaaggcagggacagagagaaagaatagtggaaaggtaactgattggttaacttcaggttacttttttggtagggattaaagtggagggaacttcattatcagctgattgtaactggcctatttggggaattggctgttatctctctcctcttgttaccaaaaggtaacaggtctaggtccttggtctaggtcctgctgctcacagcacagaaagccaatgactgaggcaaaaagtgttgccaagaaagaaggatttaactgagagcttcagctgaggagaaaggagatcagtctcaaatccatctccctgattgactaaaattaggggtttatataacagggaagaaatgtaaccacaagtgggaaaacaggaacttggggtaaggacacaatcatgatgaatgaggggcctgtcatctcattgtctgaatactatgatctcttgagtttcatttatttgatacttcttgagaagccaggggtttctttcctgaagaaggaactaataaaacaaatgtacgtttcaagctttaagrccagaagtgtccatttctatgtttatcaaaaaaaatctatgggactgttgggtcggtttcatcctgatttctcagaaggtccgataacaacttactttctgtttggtgagatggaactttagcatgggtgactccattttggtttttagcctggcctgttgaggcctagggcaggagctttgttcaaaacaatggcctcccatcattatgttttaccatcacccaaacaaggcaaaaatattaacaggaagcttaatttcattacctccactttttgtggaatrttcctatgcatactcagtatgctaacctcaaattttagttccaggttgttataacttttcaggaagttatttagataaaaataagatttattcaatcattttaagaaattcacagctgagtgtggtggctcatgcctataatctcagcactttgggaggcygaggcaggaggattgcttgagtcagggagttcaagaccagcctggacaacatggtgagaccctgtttcaacaaaaaataaaaaatagctgggcatggtggtgcacacctgtggtcccaactacttgaaaggctcccagctacacccaggattgcttgagcccaggagttcaaggttgcagtgagccatgtttgtgccactatactctagtctgggccacagagagagaccttgactcaataaaagaaattcacctttggtttttgcatgccactgtttcctcttgggtttttttcttaactagagtacaacatctaattgcttttctttttccccaaaaaggatctggaagggaaggagtgagtaaatcttctgagtatttttatgtttgaaaatacctgtatttcatcctcacatttaaatataatttggctataaaataataaactgaaatatcccttactttagcattttgaaggtattgaatttatgttgctaaaaacatctgatattattcttttctagtgggtacatctaatttttttttctctgagcatttagaattttttctttatctttgatgttgtgcagtttcactatgatgagtccagatgtgggttaaaaaattattttattggtacctagtgaaacctttcaatytgagaacctactttttaaaaaatactggaaaatctctagttattatttctttaaatgatactttctccctgttatctctggcctgtaattctagaactcttattagatgaatattgaatctattcgctatatctttaccttttgtttctttttaaaatccatctctctwacttcgtgttgcattctgaaagaattcccataccacatcttccagttccctgattcaccctttaactgtgttcattctgctactagcccatgtattttttatttcaataattatatattttattacaaaatttctgtttcttgtttacaaccagctattcctgtatcatgaataaaatactttcttatctctctgatgatttataatcacatttatttttaagtctagttctggttttccctattaactctctttcttcaggtgtgcatttgtccatctgctggatctgtgatctcttttttatagtattgcactcctcatgcatttggtgatccttgactgtgtgcatttttgagttgcaatgtcttgttaggctgacagctgcctttggttgagctgcctgtgtatagagaagagcaaaacagttactgagcttgtgcctccatacaatgttgataggcaggacctgctgctaggtgggaagctcagcagctggtcttttaggcttggatgtttctcattcctcccagattttgacagccactcaatacatgaccccttctcattaatccaagtccttgccccctaaactcttacatgcagggtaggtggagaaatccaaggctgataggcctggctgctcctgctacaggtccccagttaattcccttgtcaatttcccyggagtatcttttgttccaactttcttccatcacctctggacatgggacatcttagtgttgctcctccttttgaggtggttcactgcagctactgtatcctggactagaagaaaaaaattttccttttgctataaagcatattattaggacaataatgagtttatgtctgtggattaagtaatggtgatatggtgtcatatcatcattaatttcctgattttgattattttcaggtttaaaaaaatctctatttttagaaaaaacacattaaaatattcagggataaacaaaccagaacacacacacacacacacatacatatttttatgccattaaaaactcttccataaacatccattgtaaggcctgcctaagactccactggctgggtacattataaattgcttaattatgaccttcattttgccatttctattatttctcatttgtctctatgacaagtaatcctgaaatgaacactcatatttaatactttgtctacatttcagattttcttcctttgaataaatccatagaaatgttaactactgcctaggggtatgaacattttaagattcttgggccaggtgtggtggctcacacctgtaatcctaacacattgggaggcctaggagggaggattgcttaagcccaggaatccgagacaggcctgggcaacatgatgacacctcacctccacaaaaaatacaaaaactagccaggtttggtggtgtatgcctgtggtcccagctactcaggaggctgaggtagtcggactggttgagcccaggaggttgaggctgcagtgagctgtcatcacaccactgcattcaagcctgggtgacagagtgagatttgtctcaaaaaaaaaaaaaaaaaaaaaaatccttaatacatacttgattaatgtgaattggaataactcaatcatgttcgtgcatattctcattcatttcatttaaaagttttgctaatttgaggaggaaaagggaaattatatttcatgtggttttaattggcatttcctttatccctagagggggtgattttttttctcttaaggtagtggattttgtaagtgtctgctcctggttcctgaggggatttgtgacagtcacatattcctctcagggttgggaacagcaaagctgtttgtaacttctaagaagtaatacatggtgattatcatactagaacatgcagtcaaatcacttgtgacatatccatattacagcacaagattaaatcgacaatttatttagactcctagaatgagaaaacacaatgtccccagggaaggataaagagtgggtgacagaaggaggtaatttctttgcctgcttgtttacctactcccctcttttcttcctcccatctctcttccttatattatatgcatatataatatattgtatatagatatacatctaatgtgtacattctcatatatattataattataatggaattataaatagtccacgataatataatatatgcatgacgtttccaggcatcaagaagatttacagctataaagccagctgtctttcctctggggcatatactgtagtgaaggcaagaagacacatgcctcaggattgcaatgcaagggggctaagcttggcttcagcacctttacaagcattctcaccttacctaccaacctgagctccaccttttctctgaaaccctccttgcttttcttgctcagccccttgctgtgcctggaattcccttatcttattacctctcatctaacctaattatccttcaagggctgctcagatgccacctcctccaggaagccttctctgatcccctactcttagatgcaaggctgtctctttctgcacgctccacctctccaatgggcttggcactttaaacttggcattgtggctgttgctgtacttgtcttgtgtcctcaattctaaactcctagagggcaggacctgatctgatgcagctctgtatccccatgttacatacctcagctcctagcatagaaaaggcaaactgtaaatcttctgataaaggagagaatgaacacatctatacagtgtccttcaatttcacagttttcccacattatctgcaatgtgtgccttgtgtgtaccaaatgggtaaatgttaaatgagcacccctcggtgactgcacagaggttggtccatgggcaagttcccaaaatgaaagcaggaactgggcatgtgagtgtagaatgggcacaggactgggaatcaggaaggtgccgggtttctaccccagctcggcctctacccagctgtgtgaccttggaagttcattgcctcccctctaggctttggtctacccatctgtagaatgggacttgggggtgacctccaatgcaagggtctttccttcttacacattcacccttctagcacagagtgtgtgtcaactgccctggcagcccctgaaggctcagtattcagaaaagagaaagtagctgggagataccagggctgacatgtgctstctgttttctagaaggctatggagcttccataaagatatatttcatgtgaaacctttccccttttagatttcataagttattttatttacatacacttatatacatgtggcctgtcttaaaaagttatcatgaatgaaaggcaaccctcaggcacagcccagaagattaactgtcaaaatgtaaagatgagttcattttctatggaaaaaaatgtaaatgcataagaaaggacagagaagtttccacacctaactaataataatggtctcctttggggaggtggggaggaaactgaggttaggggctccaaaaaaactttagttttatcaacattcaattttttaaggaggatatgcatataattttatgattaaaaattaaataatgaataagttaaaaggcccaagtggtatttaatgctgcactaatataattttgagtcttgatacctgtaagggtatttatctttatttttatttccccagttccctctctctctctctcctgtctaaatgtgaggattggaaatcatttctagcaagaagagcttgattaaataaaggtgcttgatatggtttgagtctgtgtccctacctaaatctcacgccaaattataatccccagtgttggaggtggggcctggtaggaggtgtgactggaccatgggggtgggtttcccatttggtgctgttcttgtgatagtgagttataagatctgttttttgttgttgttgtttgtttgtttatttgacacagggtctcactctgtcgcccaggctggagtgcagtggcacgatcttggctcactgcaacatccacctcccgggttcaagtgattctcatgcctcagcttcccaagtagctggattacaggcgtgcgccaccacacccagctaatttttgtgttttcagaagagatgggttcttgccatgttggccaggttggtctcgaactcctggcctcaagtgatcccaaagtgctgcaattagaggcatgagtcatcatgcccggccaagatctggttgtttaaaagtgtgtagcatctctaccgtctttttctttctcctgctccagccatgtaagatgtgcctgcttctccttcaccttcccttatcattgtaagtttcctgaggcctcccaagccatgctttctgtacagcctgtggaaccatgagtcaattaaacctcttttctttatgaattacccaatttcaggtatccctttatagcagcacgagaatggactaatacactgctttaatttacaagaacactttgcaagaattaggactcctatctcctaagattatatatttgcatggaaaagaagcaggttgcttgaagaaaagaatcaagaatcaaaactttgcaatgaaggataaacttgaagtaagaataataaaataaagaatgtggctgggcacagtggctcacacctgtaatcccagcactttgggaggccgaggtgggcggatcacaaggtcaggagatcgagaccatcctggctaccatggtgaaaccccgcctctgctaaaaatacaaaaacaaaattagccaggcgtggtggcaggtgcctgtggtcccagctacttgggagtctgaggtgggagaatggcgtaaacctgggaggtggagcttgcagtgagccaagatcgcaccactgcactccaattccagcctgggcaacagagcgaggctccatctcaaaaaaaaaaaaaaaaaaaaaaaaaaaatgcagttcaggaagaggaggttgcagacatacttacagaagaggtaccatgytttctgggactgggcatcaagcctgcttctgaaagtcctggcagccagggagggagaaagaaaaatgcgatttcttccataatgcttctcatcagaaagaagaatgcattataattatactgaggggcaaagcttgccatgatatgctaaaagaattttatgtaggtatcattattattgtcccacgaagaaactgaggctcagaatgatttagcatcttgcctaatatcccctagacagcaagtgggatggcaagatattaacgtggtgcttttccgttaattatctttttcaatcctagtgacagcagtaagaaataggcattattgtccctgttttagagataaggacatggtagcttccaaaggttgatgtgctcaagggcatatagggaaaaggcaaacttggatgcaggcccacatcttaggacttcagtgccaggagttcacaaaaggcctctgcagcacctcctctcccattatcatgccctctctacccctccaagccmctttgtccaaatactcaactgcttgctattctgcagacacacagtcctttttgcctacaattccccatcactggagtgcccgtcatcactgcccttcttggaaaagccttctcattcttcaacatctcaatcaaatttcattctttctttgctctcccttgtattcatgatcataacatcatttgagcacttctcagtatgcactgtagttttatattttaaaagtattgttagctgggggaggtagcttaggccttgtaatcccagcattttggaaggccaaggtgggaggactgtttgagcctaggagttcgaggctagcctgggcaacgtagcaagatcatccccatctttacaaaacatttaaaaataaaccaggtgtggtggtacatgcctgtggtcccagctgctctggaggctgaggtgggagtatcacttgagcctgggaggtaggggctgtagtgatctgtgatcacaccactgcactccagcctgggtgacagagcgagaccctatctcaaaaccattgtgctgctttttgagttgccatctgccatggaacaatcaccgaaatgcatattttcataaaaagttttacagagaagaccatccactcttgaggttgaaccctcagatatgatgaaacatgcaaaggtcaagatcaggagaaggaaggaattcctcctgatcagcctttgctgatctttgttggcaagcacctgggagattgtattcatccgttctcatgctgctgtaaggacatacctgagactgggtaatttataaatgaaagaggtttaactgactcacagttccacagggctagggaggccccaagaaacttacaatcatggcagaaggggaagcaaacacgtccttcttcaaatggcgcagcaaggagtacagagcaaagggtgggaaaagccccttaaaaaaccatcagatctcgtgagagttcactatcatgagaacggcatgaagttaaccacccccatgattcagttacctcccactgggtccctactatgacacgtggggattatcgagactacagttcaagatgagatttgggtggggtcacagccaaaccatatcagagattaacatgctttgtctgtctaccacatttgcaaagagtccactctccatcttgtgttgagatttcacaatggtgttaagaaaatgaagtcttgttggccgggcacggtggctcacgcctgtaatcccagcactttgggaggccgaggcgggcggatcacgaggtcaggagatcgagaccatcctggctaacacggtgaaaccccgtctctactaaaaatacaacagattagctgagtgtggtggtgggtgcctgtagtcccagctattcgggaggctgaggcaggagaatggcatgaacccgggaggtggagcttgcagtgagctgacatcatgggccactgcactccagcctgggcgacagagcgagactccctctccaaaaaaaaaaaaaaaaaaagaaaagaaaatgaagtcttatgcaactcccatggagaccaaagagaaagaaggttaagctggctgtcctgaaataccataaggtggatgagaatggcaaaattagctgtctttgtagggagtccccttcagataaatgtggtggtgacatttttaaggccagtcactttgacagacattattgtgggaaatgttgtctgacttattgcttcaacaaaccagaagacaagtaattgtgtatgagttaataaaagacatgaactaagaataaaacaaaataaataactcttgtcctctccagattctgagttctgtgaagatctggattttatctgaatcatctttatatgtccagtgcctagcattgtgtctggcacatagtaggtattcaataaatgtttgctgaatagatatgtaatatcaatgaaactgcccttgtcctggatggtgaaaggcacaccatgacatttgacagtatgcctatcccagaataatttataatttcattgaaaatatgagaagtgacacccatgaagaaattagagaacaaaataggtatagtcagatgccatattgtgtggtttaaattctgagtgctgagggggaaaagaaagatgacatctttggggtgctagagggggctttggggatgtgaacccccaaggtgtgggatgaagttcccccctgtagtaggttccatgatagctatgcaacagcattagttgctcaaataaattgaagaaaggctgtttctttgatacattgatgggcagagtgactctcaatgggaccatggaatcttagaccctttagtaagaaggataataaaaattgttttgccaaacaaaaaaggaaggggaagcccagagaaattcacctctgttgatttcaaccaatgttctttttgtaaaatttaatttgtgtaaaatgtttaaatgcatgatttaatttttaatgcatgatttaagttttaatgcatgatttaaattttaataattaataactttaatgtctatgattgaaggttaaaatttgataagcaatttaatttctaagcctgatatttctattttctcataaagtaaaatatgatgggattaaaggcaggacagactcacccttcctggtttgtgattgagaaggtcaccgatggtcataattgcctccttttttatgtgctgttgccctgctaagacatttcttgaaacacttcatactgtactcacccaaggtttctaaagctgtcaatgtcaattgcttttgttcttaccctaacacatgttgtcacatgagaaacataaagcctttcttgtgaagataaggtgagctattatgggtgcctaaaaagacttggagattaaggataccctctatgacagtcaggtcatggcaagaagcagaatgcaccctagatggatcaaatgaagacacttgaaagaaaaagatacttacacatgagccgataatagggcaccaacagtggatgttagggcactcagagactagcatctgagggatggggggagggaagctgttattacccttatatctgaaggaacaaggagagtaaatagtgttactggagcccagtatgagctgcaccaggaagaaaggaaccacccaagaggagctgtaggtatggggggtggcaaatactgccaaagacaggcatgacatcagggagacggagagggagaaaaagatttgatctcactctcttcctgtccccagtctcctgctaatgtcccctctggccatacccaaccagaaatgagctgtcaagggaggccaggaggtgcatccacagaggtcaggctttgtggcatggagcagggcagagaagagcagagaatagatctgagtagggtgtgtgtgtgtgttgccagggagcagggggtggccagccaggatgttctgagagcccaactagaaaaagccgcacatgatggatgccatcagctactctgaagcaactctagtcaggtaaccaaaggttgagcagacccaggattccactcacagtgctttggatattattcttgggaagcagaactggaatataatttcagttaaggaactctgattgaaaattaattgcattgtacccaatctgggagttgtaagaactctcggagtttggacagctggggtgagaaggctsrgagagcaagaatttggccatgtgtctccaacactatccaggggagaaggtaggctcactataaatccccttcaagccttcccccaaaggggagtgaatgcattagactgtcatagctcagtgatatctgccatgaagaccattcgtttcttctcatggctctgattccagagtccccagaagccttgtgtttygcatttgacttctcataaagctctgtgctgattagcccacaaagggttctgattctcttgacagctataactcattgtaaattaataaattggcgtctggtgtatctgatgaactagagcattctgaatcagggctttacatctcctcagtcacctcctgcttcatcttcagggaacagtcacacctagagtcaataactcagtgtctgaagctctgatgaggagtaccacattttgaagtgaggactttgcctttctgcacaacctcgccaggcagcctcaccagaacatgtctttacttcacytttccagctgtagtgggaagctcacagtacatactccacctgccttttcgatgcttgttcctaggaaagttgagaacccaaggttgtaaggggactgtgagactagccattccattcccctctatccccccgcccagatcattttttagaataggaaggagcatgatgagtggatgaatgcacgcatgaacggatgcctggatggatacagtgcatggatggagatatggctgcgtggctgcgcagatgaaggcgtggatgcacggatgtatggacggtgctgtggccagggctgctcttcaacacacactctgttcttgttgtggcagaggcttgggtgccctgtgccactgctgcagccatgttgttgtatatttccatgcatattattagtgccccacctcgggcatctcctttttctgcttcaggtcattctccaaagctgcagaaactcagcctaagtgcagagcaagcaggaagtgcagaggggtcaacatcctcaggggtaaccctcaacccatgatggatgaaaatccatgcttaaatgttccagcctcccatccttcaaaggaacaattctgagatacattctatatgattcctcagaggttcgccagcaggactgacctgtccacaacagtaaccaactcagcatcacgccctttactggcttttcctccttccctgcctcactctccccactccctcactcctgcttcctgggatcatctccccccaaatgctcaaatccttgtctaaggctctgcttccaggagaaatgaaacactggtcaaactggtctatttctcttcctctggaaggaagatgctggtatttattcatgcatatatgcattcctcctttccagatgagcaaatcaaggctgagaaagattaaggaactttcccaacttcacaagacaataagtgacattgctgagctaggtggataccaacctataggacaatccttagttatgggcctgcagaatctcacagctggaaggactgaggactcagaatcacctagtgcaatgtttctcaacctattatgaccttcccaaagagccttttaagacttttttttcctaattacccccatgacattttaatactaaaactgtattgcatatctaactatggacactctctctctctctctctctctctctctctctctctgtgtgtgtgtgtgtgtgtgtgtgtgtgtgtgtgtgtgcttagctagatattctttgtaatgttgacaattttaaataattttcagcagttgacataattactggtgggttgactcacttagaagaatgaaatagtaaaatataaattatttttatttatttctcaaggcttaagttacacacaaaagcactgaggatcaaacataagcaacacccacaaggcagctaatggcagccaataggcacacacaaaccagctgtcatgatggaactttctcatgcagcaagcaatgaaaagaaagtccccgcatcccaaccatctattcaccatagctttgcagcactgatcttgcatgcattttgcgtatctcccatgaacttaacatcgatgctgttcatttaatacccaagaaaatccaattagagaaataagcactaaggaataagatttttttgcctggtatggttgcactttggcaggctgtaaactattgtaatatctaagattttttttgcctccacaagaatcatgttttacccccttgggtgagctgagaatatatgatttagtccaacaccatcattttccagattagagggacactgaaggctaaaggtgcagtcacatgatgagacaaagccgaatggagtgaaaatcagatcttcagactccaggcacagagctcattttaaattacccaagaggcggagtgtggtggctcacgcctgtaatcccagcactttgggaggcctaggcaggcagatcacctgaggtcaggagtacaagaccagcttggccaacatggtgaaaccctgtctctactaaaaatacaaaaactagccaggcatggtggcgggcgcctgtaatcccagatacttgggaggctgaggcaggagaattgcttgaacctgggaggcagaggttgcagtgagctgagattgtgccactacccccaagcctgggcgacaagagcaaaactccatctcaaaataaataaataacccaagaaccttgctcaccagtcaatatgaattaggcctaggctcagctagtcttggtgctttccggccctcaatttttgttggggaataaaaaatcttcatttcactgtggaaggtatggtgagtattaagctgtgttatggtgtctccctgaccccatttccactggagcatacaaaagcagagagctaattatatgatagtaattacctggaagttgtatgtttattggttttccattagtggatactattttcgaactcttcgttgttatgctctagcgacaggagtcacactgtctctactccaaatgtcccctccaatctcatgattagcaggctttttacatggggccattgctggcagcatgagacacccccagggtagggaagggaggtttgactcagtccatacaggaggccccagaggtctccacccacattcacgggcacctcacttgaaaagagcctttaataataaagtactcaacatctggtctaaatgaagcatattcctccttgcccttggatactgagaatcgtatccaataggaaggggcctcccctgtcaccagatatatttatgtatccttcattatgtgccttggttaattgtccctttcctttttttttttttttccttgagaaggggtctcattctgtcacccaggctggagtgcagtggtgtgatcttggcttactgyaacctctgcctcccgggttcaagcaattcttttgcctcagcctcccaagtagctgggactacaggcgcgtcccaccatgcctggctaattcttgtatttttagtagagacgaggtttcaccatgttggccaagctggtstcgaactcctgaccttgtgatccacccaccttggcctcccaaagtgctgagattaccggcwtgagcccctgcagcctggcctaattgccccttttctaccagctcttcttacaacagagaaatcctgagcctcgcttgtaattatagtgaggaaatatttctatgagcttttaaaagggaagcctaaactgggtcaaaatgttgaaggtgataggtcagggagcaagggtcaatactagctttactctgatgagttgattgctaggggctttgagtgtcttttgccaaatttgagggccctctcctagaattccactatcagcacctcatcctattgttattattgttacaactgagattgatagacatctgtggaggattttacagtctgcaaagtgccttttacatgaagtacatcacttatcttcactgcaaatgctgagggcaagttagattacttggccctacttactgcactgttaaaatgcatctcttcactcctccagaagggccacagggcacttgtttccagtcatatttatgtttgttgtgggtaaaaagctagcttgggctgggcatggtggctcatgcctgtaatcccagcattttgggaggccaaggcgagaggccaggagtttgagaccagcctgatcccatctctatttaccaaaaaaaaaaaaaaaaaaaagctagcttacagtactagtagctcctgccttgttcataggaggatctcagcacctagcaaaatgcccaacacgtagaatacaggaaatgtttattgagagaaagaatgcatgcatctagcctaggagtttttttcctttttattttttatttcaatagcacttggggtacaagaggtttttggttacatggatgaattgcacagtggtgaaatctgagattttagtagcataggaattcaagtgactattgctcatttataggccctctccctgttcagtacattctcacatccatgcctttgcagattccacgtacttgaaactccctctaaaaatgtccatcagctttggcgtggatgctactaatttagagaccctcccggggctacggacccacagtgatcctttcttttctgaaatccttcagccctcctcacccaaatcatcagtgccactcagccttgacatcagattggaaccaattaattacctgctaaactacctcatgtaagaaacaggtctaaagatgtaaacagccttgcccagtgagtcagtggcaggcagggtcagacccagaatccaggtcttttattagctgcccagtgtacttcccattacatcaagaacaggaaataggtttcaccatgactatcacctttgatcaagctgtggtggccgcccagagtgatagactgagaatgcctgtgagagagcagcccaggatggtgggaaagagtgctgcratcgcttgatcatgtctgccaggctgtggaaatgaagagtttggtgtggagagtggctcacattgcaaaagttgggacccccatttaatctgacctgaatcctccactgtaaggatgttgttggctgtcccttcactctcccaactccaagagaattgattcagggcaactcccttttgctcacattaaaaagaaataataagcttttttttcttctyagacagagtctcgctctgtcacccaggctggagtgcagtggtgtgatcttggctcagtgcaacctctgccccctgggttcaagcaattctcctgcctcagcctcccaagtaactgggattacaggcacatgccaccatgcctgactaatttttgtatttttagtagagatggggtttcaccatgttggccaggctggtctcgaactcctgacctcaagtgatctgcttgcctcagcctcctaaaatggtgggattacaagcgtaagccaccacacctggccaagaaagcataatctgaaggtcagtcctggggttaggtcagaacttccctcctaccctgcttggagttaaggatatagtgcttgttacttgtcccccaactccagagtcagcttcaaagatttgactgtgtatttgtacaattagaagagtaatctctaggaaacaagcagctcagtaatgaaatgttacaatcccagcagggccaagcaagcctattgtggtgctttctaggcagaaggaggcttaaggaaaggatcaagcacattgctgctaagaatgtgcaataccaactccactgagagagaagcacggttgcaaactaggggacaattagatgttttccttctttgtggatttggaagagtggttgcaaacacagatgcctctaagggcaacacagataatataaataagtgaatcagcctgggtgtagggcagcagggagcagtggggactgtggctgagagtgcctgtcctacctaaaggatttccaattctcaggtatttttaaaaacgtagtactggccagccggacgcggtggctcacacctgtaatcccagcactttgggaggccgagataggcggatcatgaggtcaggagatcgagaccatcccggctaacacggtgaaaccccgtctctactaaaaatacaaaaaaattagccgggccgtggtggcgggcacctgtagtcccagctactcaggaggctgaggcaggagaatggcatgaacccaggaggtggagcttgcagtgagccgagatcacgccactgcactccagcctgggcgacagagcaagactcagtctcaaaaaaaacaaaaacaaaaccaaaaacaaaaaaaaactcataatactggccaaatagaagatgtttgcaggcttcgtttggttttaggactttagactgaaaacattacagatatgtgtgtatccaatctatctaatttatccattacttaatggcaaaaactgaaattacttttgcaccaacctaataaaagttatgcactggtggccgggcgtggtggctcacacctgtaatcccagcactttgggaggccgaggcaagcagatcacttgaggtcaggagttcaagactagtctggccaacatgatgaaaccctgtctctactaaaaatacaaaaattagccaggtgtgctggcacacacctgtaatcgcagctacttgggaggctgaggcaggagaatcacttgaactcgggaggcagcgcttgcagtgagctgtgattgtgtcactacactccagactgggtgacagagcaagactccatctcaaagtaaaataaaataaaataaaagttatgccctggttaatcagaaaaataaagaagcatacctgatcctccggatggtagttctgttttatggaacagtgtgcctctgctgactgtgatcagtcctgctgaccctggatatcatcccagactcaataactcagacttaaagaatggtattgaggagaaggagatgctttggggtaagatcaagccctagactttgaaggtgagatttcctgaaaagtgggagaagatttgcaagccagagtaaaaagatgtgcaagtcagatctgtaaggcagaagcacaaaggaggaagctttctcagagaagcctgaggctggggcacaggattagagactggtagggccccaggtaggactgagttgtgcaacatggcagccctggggagggtttaacttattgatgtgctccgtcaaactatgaaaaattatatagcacgcaagcttaaaatgtttcccactactacacagagattcccctagatatcttatcctcctagtttcgcctcatatgacattgctgtggagataaagaggtcaggcagaggaggagagtggcctctccctcctgtgagaaaaggcacttgctcccaacrggatcaggagtgaggactcagatggtcctcgcaagccatcagggggagcatgtggtgttgaagagaccctgccgttcaaacctccttgctggtagtgacactgagggactggaaccccttaaggggaagcagctgaggtttgggccagctcaggtgaagcaggctggctgccctctgccctaatcctctgaaggagctggaggtaagaaatgctctgactctctcacaggagggctggaagacccagttcagtgggaactgtaaaatgcttgggaaaacagagacccctattaatgcaaaatattattatgaaccctccctccccacatacttttcaacctcatgaggtgttgtctttaaggcccagtctggtttaaattataagatgaataaactcacctgacctgacaagcaaatgttctgctggacccacagagccttggaaagagcagcctttgcttctccgcccgtttaggaggagcaaccctgtgggcctgtgggaaatgcatggactgggtgtctggcaggtctgggtttgaagctcagcttcatgagcagtgggccttggccttgctgcgcctcatttycccccmctcacagggctgtcttgaggctgggtggagtagtcctctggaagccctgaaggtttgaccgttctaaagcagtgtttcaggtgaatttatacattgatgggaaggaaagaaagtctgttggatttttagacgatgcttatgctttggatacaatcaagctctttccccaagggccagaccagggacaaatgagctgtatccctagtaagctagctttcttttaatatgaggatgtattatttgccacaaaggacaaatgtgaaactacctcttgatcagtcacagactgtgggcctcttgggagtctgggaggtcacaggtcaaggcctagagaaatggctgtgtcctakgattagggacagtggaactgctttctctcctgaggcctctttggtgtggtcatggggtgctgctgatgtctgcagccctctgggcactctctcaaagctgccctgtagctggaacatctatctgcatccctactcagcgcagaggcagtgaaatggcagcaaacaactcccttctatttcctggtggcttgttctctgggacacggagaagagcatggtgactgccaggtttcaggcctayctagcagggcaatgagagctcctgggcacctgaggattcagaaccacttctttctttctttttaattttttttttttttttttttttttgagacaaagtcttgctctgtcgccaggctagagggcagtggtgcgatcttggctcattgcaacctccgcttcccaggttcaagcaattctcctgcctcagcctcctgagtagttgggattacagacacacacaaccatgcccagctaatttttgtatttttagtagagacggggtttcaccgtgttggccgggattgtctcgatctcttgacctcatgatccgcctgccttggcctcccaaagtgctgggattacaggcatgagccaccgtgcccggcccagaaccacttcttaattgaagagaacatcttccttctctttgtctatgggataaagtcctatacctgtaaccaaggccatacccaagggtcccccaaatagctcaactcaactggctgatgctcatgggtagccatgacccctccagcccattgcccagcctgtcacacgcttcctgcctttacacatgccactccctcacttcctatttctaccagatgaacacctgcctgtttatcagtgtctctgagaaaacatccccctttccccccaagagcaagggcaaggctctgccttcattgcatccttagccctccaagctagctgatctactctcacatcactcccctgaccagcatgtagaagcaatccacacagaagcaggcctggcatgaagtgtggtcctggggcccctgttgggccatcttaactcattggttgcttgatcatgaggtggggcccaaagaagtgacagggctgctgggactgagggaattactcaggcaattgatgctgactctacctttttgtgatcaatctggtctccttggttccaggatttggagctctgtgctccagcaatgcaagctgcctctgaaccatttgtcttgtcctcctgccctaggactttccttctgcctttgactttaattttctgcatggatcctggacatggttcaaacttctggttctagtggcccaactctctatgaagaagaattccctgtctcagccccagaatctcaggttttcacccagcttgctatcctcaagggataaatcagactctttcctctctgcatcccatctttttgttgtataacttattttgggttttgcttgtttgttttttgagacagggtctcgctgtgttgcccatgctggggtacagtagcatgatcacagctcactgtaggttcaattttctgggcttcagtaatccttctgccttagccttcccagtagctgggaccacaggtgtgtgccaccatactcggctaatgtatttttattttttgtagaggcaaggtctcactatgttgtccaggctggtcttgaactcctgggctcaagtgatccacctgccttggcctcccaaagggctgggattataggcatgagtcatcatgcctgacctaacttatcattttgtcttctaactatttgttttcatgactaagcccctccctggactgtgagctatttaagggcagagtggatgtcataacatatttcataaattaatgcatgaatcaatgatgatcagtgtctgtagtattacaatcacttgtaatgctacagatgatattatagccctatgaattacatagaaaatcatttttatcatccatgacttccatttcaagtctcccaagagggaggaaaaagaatctctgcctgtctggccccacgtggagtccaaggaatattatagttcttttccttgtatttttctaacgccactacattttggggggcttatccaccttagtacctactaagttcaaatttggactaagtctktagctcggttgtgcattttgaacttcatcttaaattggtcatggcccattgctactgcttcacatttcctccgtcgtgttttctcttttattgcttctataggttgtgagttaggataataaagtcaagataaaattgctccaagccatttgcagctctgggaagctggcacagggctgccaggagctggctgggtgccaccaagaggaaaaaatattcttccgtgttgccagccttatcaggactcctcacagtttcttgccaaaattttaggaaaacgatgatctactcccctgcagctattctgtatgtttctataggtggggagtctttcaacaaggattttcactaaaaatacctctcatgtttttcccctggtttaagactgtaacttgagctccatattgtgaaatactgacattgagatattaatcactgtgcatagttgaggcatcattgtcatcatcatcagccactcacactaactgaaagtttataagctatggaatcccactcaggacgtgctcatgaaagaataattggagattattttttaactgtgaaaaatgttcttttggaggaatgaggaattgggaaaataggaacagattatagaaagctggtaggaaatcacaattctattcttttattttctttctgtttgtttttccaagataaagggtctccttatggtgcccatgctggccttgaactgggctcaagtgatcctcccacctcagcctgccaaagtgctgggattataggcatgagccactctgcctagcctaaaattttcaatttttttatggaggtgtggtctcactatgttgtccaggctgttcttgaactcctccctcctcggcctcccaaagtgttgggattacaagcatgggccactgtgcccagcccacacaactctactcttttaaatatttgctctacatctgtttgatgccacaacaatgactcaattccgacaattcaatttatttatatgggtgtggcttttttttcttattcgatgggggagtttgtctatctggcatagacagacaagccaaatttcaaattcttgtttaagtgttgagaagatatggccataagcatgtctttactcagtcaatcaattgaacttcaatcaacagtgcctactgagcactaactatgtgcatgcccagtcctgtgtttggaaggatacagagaataaggtaccatttctcccttttctttattaatttatagtctagtcagaatttatagactagtcaggcagtcctgggctcaaatcccaatgctataacttagcagcaaagtggaattttggcaaatgatctaatatctctgcacttctgtctcctcctctgtcaaatggggtgatgataacacctaattcacagggctgctgtaggaatcaagggagattgtgggtgtattctgtggggtgtatctataagtattggctttcttccccttcccttagcctttagcctggggtaacctcagtggagaggattcctagaagccctgtgtaaaagccttcttcttaaggctaagggcaattacctccatggccacgtgaaaatgggcgcatagtggctggctttaagtgaaggctgcaaactggctgcccactggccaaagccagagttagacacttccaattagtcctatatgatgttaaaaaaaaaaaagtaatctgcgggcacagtggctcatgcctgtaataccagcactttgggacgctgagctggggggattacttaaagtcaggagtttgagaccagcctgattaatgtggtgaagcctcgtctccactaaaaacacaaaaattagcagggcatggtggtgcacgcctgtaatcccagttactcggaaggctgaggcaggagaattgtttgaatctgggaggtggaggttgcagtgagccaagatctcgccactgcactccagcctgggtgactcagtgagactccaactcaagaaaaagaaaaagaaatctgttgcgagcatttaaatatcaaaagctattcattaaaaccccaatttggggattctcttgaaaatcggaagattctggcttttgacatttggatggagctgaccacaagctactttctttggatgggtcaagcactctccagagtgcttgtgacttcccacagggagatcagatgtggtaaaaggacaccattagttcagatctagccaaagttcaaagcttaagaaaaagaaccaagccaagaatgatgagccagggcagccctgataggacccaccagaagagtaaaggcttagttcatttaacaaatattattgagcaccttgatgtgcaagtcactgcattgggtgcaagtgggaaagagaaagaacatgtgttgggagcctactatgtgtcaggctctgacatgagctcatctaatccatcaacttcttgaggtaggtattaagattttttttttttttttttgtaaatgagaaagtaggattaagtggctaaatggatcagctgctaagtgctggagtcaggatccctgtactctgagggcctaggtttgtcctctatacctcaagcctgcgagagcaggatggaatgcgtcatatgttcctctgtactgttccatgtgcaaactgggcacatgactgtggattgtgtgaattttctggtgaacgataggacagtttttcctctggctcctgctctcaagaagattctagaagcaaaggagacgatgattgccagacaatgaccaaccaaaggctgtggggctcaaggctctgggaggaggcagcgtgtgaactgggccttaaaagtcaggaagtttttgataggcggaggaggcaggaaaggatatgcaaggcatggggacagccccagcagagacacgaggagtaatctggagtatgtggggcacaaggtggtgcatggatggggcccaaaagtcaggatgcagtcaggtcctggatgaccctggtgcagctaaacaatccagacttcctccatttccttcctggggccattcctcaggcccatccttttctctgtccctcttgtccaccggatcyttctgctccctgccatggcttctggagcacaagagagatgagggaactcaagcaaatgtataaatgattgaaggcattgagagctcatggtatctaatagggatctgttttaaagaactaaataatatcattatataaagctgaccatctcatacgaaatgactctgaaatgttacccctggatatatattccagtctagagaaactcatgctcaaaactaattatggcagcatgatttgtaatagccaaaaagtaaaaacaacccgaatgcccaacaataggaaactggataaataaatggagtattgtcatagaatggwatgcttaacagctgtgaagataaatggattccagttacagcagtggttctcaaacaggggtgattttatcctccacccgggggacatttggcagtgtctggagacattttcagttgttacaactggagggatgttactagcacctaatgagtaaaggccagggatgctgttaaacatcctacaatgtactgcacagcccctcataacaaacgattatccagcccaaaatgtcatagcatccaggttaagaaaccttgagttacagtyattaaaatggatgaccctcataatgttgagcacagaaagcaagttgcagaagaatatatatacagtataatactattttttaaaattcaaaagtaagcaaaaaagaaagaatacattgtttaggaattacacatatacagtaaaattatgctgtgatttcagaatccacattgcaactatcctttaagraagtatcacttaatgagttttagtgtgatatcaaagaggaatatccacaattatttgaaaaagctgttaaaatactcctccttgtccctctacagatctgtgtgaggctggattgtcttcatgtacctcaatcaaaacaatatagggttgcaacagattgaatgcagaagcagataggagaattcagctatcttctgttagccaaacattgaagatatttgcaaaaatctaaaacaatgccactcttctatatttttgtggaaaatatagttattttccataaaatatgttatttatgttcaacatgtgatgagtttgttgtttttagaagaataaataataaatgttctgttttaatttctgatactgtaaatgttgacagatatagcccacgtaaacaaagtttctaggatcctcaataaattttaagagcttaaaaggatcctgagaccaaaattttcagaacagttgccctagtctaagacagatctatttcctttatctcctttcccattttgtacgctggaagagttccatttagtgagcgccatattgagtttgctttccattaataatacctcagttatggctcatttgtaagtaacatgaaacagttatgaaattcacatggcttggtacctcagcctttgactcctgggctctacctccagtaaataactaaaaagattttttccaaatttattttcttcctcctcctttctttgtatttttttgtcattccataaacatcatagaacaccctttaataatagataaaattagttaattttaatcaaatatttaccttaccaagacactgtactttatatgagttatgtcatttaagccctcaaaaaccacatgaggcagatattatttccactattttttttttaagagacataatcttgctctgtcacccaaggctggaatacggtggcgtaatcatagctcgctgcagccttgaactccagggcccaaacaatcctcctgtcccagccttttgagtagctagagctacaggcatgcaccagcatgcccggctaatttttaacattttttggtagaggcaaggtcccgctatattgaccaagctggtctcaaactcctggcctcaagcattgctctcacctcagctttccaaaatgctaggattacaggcatgagccaccacgcccagcatttattctcattttgcaagtgaaaaactgaaagttaaatgagtgaattgacttgctcaaggttgtgcaggtagcagtgatggaatcaagacgtggcccctggcatagtggactgcagacctggcgggtttagcccctatcccgcaatcatgatcatgcttgagagggatgtgaatacgttcataagatatattcactgttgtcaaggagcttatagtctagcagcaaggattaaacaattttgcaaacatttggtaatttaaaattcattttttatcctgtcttcttcaataaaaacaaatttttaatgaaactgatcagtaccaaagggaaaaacacatttttaagagctttagtgatttgtattcactaggagaatactgtctgattctcccaaggatttgagaatattatcaatcattcactaagggttgagcagagcattggaggaaaaaaaaaaaaacacaaaaataggcttagtactccaagagcctatgggtgggaggtggtgaagctcacaaatagctacaatattagggagaatgaggcgaattcaatacaagaggcataccgtctttaccagatggatagaacacatctgaatgcggcaactaggaaaggcttctcagaagaggtggtgtctgaagggtgggctggattggggcagaaagagatggtaggagatgggaaatctaggtgggcagaaggatatgttcaatttcctaagcttggcctctctggaagcagaccatgaggaagagtttattagggatcaacagccatgaaaggaaggagagaaaggaggatgaacaaaggaagaagtaaaattgcaatccaggcttgataaagcctgccaaccaggtggggaaatctgtgggaagtagtgcctggcagagttgttccagatcaggttaaaatgrtcaggccctgatatagtttggatatgtgtcccctctaaatttcatgctaaattgtaatccccagtgttggaggtggggcttggtgggaagtgattggatgatgggggtggatttccctggaatggtttagtaccatccatttggtgctgtccgcatggcggtgagtgaggtttctgttgttgttttttctttttggctttttgtttttttgttttttgttttttttttttgagacggagtcttgctctgttgcccaggctggagtgcagtggcacaatctcagctcactgcaagctctgcttcccgggtttacaccattctcctgcctcagcctcccgagtagctacgcccaccaccacgcctggctagttttttgtatttttatctttatttatttattttatttttttaaattttttggtatttttagtagagacagggtttcaccatgttagccaggatggtctcgatctcctgaccttgtgacccgcctgcctcggcctcccaaagtcctgggattacargtgtgagcccccatgcctggccaacagtgagtgagttcttacaagatctggttgtttaaaagtgtgtgccaccttcctccccaactctctcttgttcctgctctgctgtgtgacatgcctcctcctgttttgtcttctgccatgagaaaaagctctttgaggccttcccagaagctgagaagctgctggcatcatgcttcctgtatagcctgcagaagcatgagctgatgaaacttcttttctttataagttacccagtatcaggtatttctttatagcaacgcaagaatggcctaacacagtatattgatactaaggagtaaggtattgctataaagatacttgaaaatgtagaagcaactttggaactgggtatcaggcagaagttggaagagtttggagggctcagaagaagacaggaagatgaaggaaaatgaggaacttattgggaacaggagcaaaggtcacccttgctatgcctcagcaaagagattggctgcattctattcatggcctagggatctgtggaagtttgagcttcagaatgatgatttagggtacctggtggaagaaatttctaagcaacaaagtgttcaatatgtggcacggctgcttctaacaacctgtactcagattcaggaacaaagaaatgacttaaagttggaatatatatatatatattttaaagggaagcagagcataaaagtttggaaaatttctagcctggccatgtggcaaagtaagaaaaagctcttttaggggaggagttcaagcaggctgtggaactacttgctagagatatttgcctaactaaaagggagtcaagagctaatatccaagaaaatgggggaaaaggcctcaaaggcatttcagagatcttcatggcagcccctcctattacaggcccagagacctaggaaggaagaatgctttcacggactaggcccagggccccactgtcctgcacagccttggaacactgttccccaccttcagctccagccatggctcaaaggggcccaggtacagctcaggctaccactttgaataatgcaagctgtaagccttggtggcttccaagtggtgttaagcctgcagttgaacagagtgtgagagtggtggaggcttggtggcctctgcctagatttcagaggatgtatggaaaagcttgggcatccaggaagcagcctattgcaggagtggagccctcacagagaacctcttctagggcagtgtcaagaggaaatataggattggaggccccacacaaagtccctgctagggcactgactagtggaactgtgggaagagggccacagtcttctagaccccagaatggtagatccacccacagcttgcactctcagcttggaaaagccacaggcactcaactctagcccatgagagcagcctcggggctgaaccctgcaaagccacaggggcagagttgcccaaggccttgggggcttacccctcatatcagtgtgccctgtatgtagtacatagagtcaaaagagatgagtttggagctttaagatttaatgactgcccttctgygttctggacttgtgtggggcctgtagcccttttcttttgactgatttctcccctttggaatgggaatgtgttgcgggaagtcagggaccccaaatggagggactggctgaagccatggcagaagaacgtggattgtgaagatttcatggacatttattagttccccaaattaatacttttataatttcttatgcctgtctttactgcaatctctaaacataaattgtaaagatttcatggacacttatcacttccccaatcaatacccttctgatttcctatgcctgtctttactttaatctcttaatcctgtcagctgaggaagatgtatgtcaccccaggaccatgtgataattgcattaactgcacaaattgtatagcatgtgtgtttgagcaatatgaaatctgggcaccttgaaaaaagaacacgataacagcaattgttcagggaataagagagataaacttaaactctgaccaccagtgagccgggcggaacagagccatatttcttttctttcaaaagcaaatgggagaaatattgctgaattctttttctcagcaaggaacatccctgagaaagaatgcgcaccttggggtaggcctatgaacggcccccttgggcgtagccatctcttatggtcgagactgcaggggtgaaatagacccgtctcccatagtgctcccaggcttattaggaagaggaaattcctgcctaataaattttggtcagaccggttgctctcaaaaccttgtctcctgatgttatcaatgacaatggtgcccgaaacttcattagcaattttaatttcgcctcggtcctgtggtcctgtgatctcaccctgcctccacttgccttgtgatattctattaccttgtagagtacttgatgtctgtgacccacacctattcgcacactctctccctttttgaaaatccctaataaaaacttgctggtttttgcagcttgtggggcatcacagaacctactgacatgtgatgtctcccctggatgtccagctttaaaatttctctcttttgtactctgtccctttatttctcaagctcgctgacgtttaaggaaaatagaaaagaacctatgtgaatatcggggcagattccccgataggaatgtttacccaatgcctatatccccattgtatcttagaagtaaataacttgttttttttattttactggctcataggtagaagggacttgccttgtctcagatgagactttggactttggacttttgagttaatgctggaatgagttaagactttgggggactgttgggaaggcatgactgtattttacaacgtgaaaacaacatgagatttgaggggccagaggtggagtgatataatttgaatatgtgtccctctaaatttcatatcaaactgtaatccctaaggttgatggtgggcctgatgggaagtggttggatcacgaggccagatttctcttaaatgattaacaccatccccttggtgctgtccttcagacagtgagttctcatgagatctggttgtttaaaagtgtgtggcaccttcttcccgactctgtctcttactcctgctctggcatgtgagggtgcctgttcccacttcaccttccaccctaagtaaaagctccttgaggcctccccagaaatggagcagatgctgacatcattcttcctgtacagcctacagaactgtgaacctattaaatccagccaaaccatatcagttacccagtctcaggtatttcttgatagcaatgcaagtatggcctaacacaggctcttacccccatctcrctcagtttaaccatagggcacctataagccgccacagggcatgcccacagttgaggtgactctctgcagctgaggcaaggactctgctttgggaagaataaccctgtggcagcttgtaggagagatttgaggccaaaggtgtgtaggtttatccttgttttttgtttggttggttttttttgtttgtttgtttgktttttttttgtttgtttgtttttgtctagctcctcttctctaagaatggccctacctcttccacatggcaatgatgctcatacaggggtaggggactgacacaactgggcaagtcagagttccttgcatggggatttgtaattgagccaaggagatttcagcccctatcaggtctggtctcttgaatgcagatgtaaaactttatggagtaatggccatgttctctaccatggggtctgagtaacaggagaaagaggtacagactgaaatcactgaggacacagagagatgcaccaaaagagctggagtgactttcttgtccttgactccagcatttttttttgaagtttcataggtcatccctgaaatctttcaataaatctttctggccagtcttttttctttttctttctctcttttaaaaaaatttgtccatttccattactggcttctgtttccaaaaaggtcctgattgagagattagttgggaactatcagactaagaaatgccaggtgccttaacataggggccagcaatgggaatggaaggaggattgatttgagaagtatttagtttagcagcaaattgaatatggagggagcaaaaaagagaaaagaggaagagctttggtgccttgtgaatgtgaggatggcagtcctagaaactgaaagagggaagtccagaagaagagctggtttggaagtggggcggggcatggtgatttcagagtagcttctgctggtgggtgctccacaagtccctggcatcactccagccttcctcctgtctgaatacaatgcttcttcttctttttttttttttttttttgaggtggagtttcactcttgttgcccaggctggagtgcagtggtgcaatcttggctcaccgcaacctctgcctcctgggttcaagcgattctcctgcctcagcctcctgagtagctgggattacaggcatgcgccactgcactgggctaatttttaaatacaatgcttctaaacaacctccctacctccaatagactctatactgaatcccaaacttccataactccattctggtatacccaatcatctagcccaaggaaggatcttataacccttacagtctgagggaattgaagacaattctttccattcatgtatttaatcatttattccataacattcracaaacatttgtgtgccagatcctgggacacaaagaagatgaaggaaatgtccctggatcacaatctaacaagacagataaaccagctatgatagagtgatacacgaagactggttggaactctcaggagggacatctaactgggaggaatcagggcaggcttcatacagaaagtaaattttaaatcagattttaaagactaggaaagatttatccagttggagaagtaggaaatgacattccagatggaaggaagcatggaggaagcagttcagtgtggctagagctcaggatagatgagaggagggatgargcyggaaaggctctgttgggctaaggaggctggctttgatcttgtatgtggtgggaaaaagcaaatgattttttgatctggactatatcgtgatcagggacactttcattttaaagtaaacttttatttaaatatacagatggaaaactacacaaagcataacctacatcttgatgaattttcgcgaagtcaacgtatccacatacccaagaacccaaatcaagaaacagaacaaggccaacctcccagaagccccttttggtcgctgccccttcccaaggacacacatgtgtttgcaaaaatcttctctagtagcagcacaaaagatgggttggagaggtcagaactaaagacagaaatgttctaggaggcaacagcaatagcccacgtgaaagaggctgaggcctgatcccaggcagtgacggcagaaaaggagaacaaagggctgtgaatgtgatagaatgacaatatcccctcccaggaattcacaatatgcatttactcctccaggcaactgtgatctgaccctgagaatttccagtagcttcccttgtaatttaaaaatgcccaggacttggccgggcgtagtggctcatgcctgtaatcccaggactttgggaagccgaggtgggcagatcacctgaggtcaggagttcgagaccagccggrccaacatggtggaaccccgtctctactaaaaatacaaaaattagctgagcgtggtggtgcatttgtgtaatcccagctacttggggggctgagacaggagaactgcttgaatgcgggaggcagaggttgcagtgagccaagatgcagtcactgcactccagccagggtgaaagagcaagactccgtctcaaaaaaaataaaaataaaaatgcccaagacttgatatatacagccatgyatcactgagccaccaagatacattctgagaaaggtgtcagttagatgacttcgtccttgtgcaaacatcatagacaaacctagatggtatagcctactacgcacctagattagatggtctagcctattgcccctaggccacaaacctgtacagcatgttactgtactgaatattgtaggcaactgtaacacaatgataagtatttgtgtatctaaacatagaaacaggactgtaaaagtgtagttttttaattttaggggaccaccattgtataggtggtccattgttgactgaaacgtcattatgcagcatgtaactatataagtaaggggagctgcatgtcacagtgatgccacttttaaagggagtactttgggcaactttctggcattgtttaaaaacaacaacaaaaacccaactggaccttgtaatgagagactacaaatccttcctggggattgttagcctggaagagtctttttgcaggttggaactgctcactgaggcacactggcagagctatgtggcaccaactcaagtcgtttaacttcacgaacacccacacaatattagagggaaagaaattttaaaagcaaaaraaaaaaaaaatccggttaattgccatacatgtttttgcaatcctgacacagtaataacttgcctgtaaacacctcccttgaagaattggctaataggatgtacagtacatggcaaaggaaattgtttattcaacgaagactttcaaaaggggctgtcgattcttcttatgaatttgtgatgactctgtaagattggagaggataaagggacaattttctgtttgttttttgagatatagtcttgctctattgcccaggctggagtgcagtggtgcgatctcgccttactgcaacttccgcctcccaggttcaagtgattatcccgcctcagcctcctgagtagctgggattacaggcgagtgccaccacacccagctaatttttgtatttttagtagagatggggtttcatcatgttggccagtctggtctcggactcctgacctcaggtgatctgcccacctcagcctcccaaagtgctgggattacaggtgtgagccaccgtgcctggccaaagggacaactttctaagggtgtagagtggaatagatttatgtgaaatagaaatgtcctgtggctttggttgttttatctgtaaaatgaaggcactgggatagacctgtggttttttattttgtcctgtagaagtgggtccctagacctctcttgccactacatcctccctgctttaactagagtgcctctgctcgaacctcaccacagggttgccatgtaagttgttgtttgaaaagagggattgcataactgaaacaagattggaaaaccactggatgagatgacttccaaggtgccctattgctctaaaattgtaggaattcatctcttgtctgacttgtggaaggtgctgaagatacaaagatttaaaaaataactcctacccacaacaaattcatgagtgtaagatatgcatgttgattgggtggggggggtgggggtgtgaaacaacatctatagtatcagtgatagtaacatggcaagacctaaaatgaaggtatgactcaaacatttgggggagaagattttggaaggtttttggagaaggcgacatttaagtggatattaaatgaatagtaggagctccccaggtatagaaagagggaggaggaggtattggagacagagagatcagcataagcaaagtcacggaggctataagatggtgcatggttagggaattaactatattcattatgctcattatgttccctgcatacccatggagcrtagttagaagtggccaagagggatgctgaatgacactgaatagactagaggagcccctcccgaactcttgccttctaggagctctttgggggttgatgctggtttctgcaactatgtgaccaactaacaataagactgtttaatcattgactgcaccacaccytacttctattattttgtaactccactggggtaaataatcaaggaatgtgttgataagatgatgggtggggcctcaaggaaagcctagaataagaggagtcatagctacctgccctggtggccagagccagggccaggactctcctctaggccaagaggactgcttcaggctacaggccaggtgcccttccaccaataagactttgtgtttagctctcaagcccattgtctgggagagggaagacttccagtgatgatgagggagagtcagtttctccaagatagggaagggactgagtatttagaggtagtgggtccatgggtgttggattcctgaacatccattgacacgcaatgccccagactgagggtagctacgtgctgagcctaggaaaactggacctcagacgctgtggaatgaaagtgtgaatgaaagatctttgggccctgcttgagttggagggaatggagctgcctcacaagttggacaaggagcatctcggcagtgaccaacatggacccggaggggcgtttcctaaaccttctggcctttttgtcttcctgggattcctgtacaattctaggaaggaaaaccctcaataatctgctctcctgaaaaaatggatgctcaaaacccatttaatttgatttagaaagagaatgagatgtgatgtttcctgcatctaaatattgtggagcaaatgcttgccactataatggcttttcaatgggtgtcagacacaaccagacctgtattttggaaagatcactctggcagctgaaggaggatgtgctgcggggcagagactgactgtggggagacgagccacaaagccattatggcagtgcaggagaggcggggaaggagcaagggcagtagagacggagattcacagttggttggggacacattttggaggcagaatgcactggtcttggcaaccaattaaaataataaatgctaagagggagcatttatctagtctataacagtggtttgcaacttgacagtgcattagaattgcctgggaatcttttaaacctcccctccccacaaagcccaggccacacctcagaycaattaagtctgcatcactgcctgtggtacccagccacacatttcccttcccacatccccctactctgttgctcaggctggagtgcagcagagcaatcatggctcactgcagcctcaacctcccaaggtcaagcaatcctcccacctcagcctcctgagtagctggggatatatgcatgtgccactacacctggctaatttttttttttttttttggtagagtcatgttctcactatgttgcccaggcttgcatgtatttttgaatgaagccaagattgagaaccactgcactaagaggtcaaacttggtaagcagagtgaattgggatgctattaaatgagatagggaacaaatagttctttgtggttagggtgtaaaataggtagagaagcgggaggaagagcaagttcaggcaggaaataatgaattcagtttgggatgtactgactgcagttaaaggtctgaggtcctggaggggatagccaagagccacagatagggggttggggagaaggggcttggagagggtccggtcatcacttcctctgaagtaaggataggtaaagatttggagcagctgccatagggactgaaatggttctaagttaaggacaatagcataggaatgtatgcatcaagggctagcaatgaggggttaggtgagattgctctatattaactctagtattaaccctgtatttgaatttgaccaacaaacattcatctcaatcagtggtasgctggagccagcatgtaccagtttgcaaaagcagaggatcaaatttacaggaattttgccagacagttatgaaacacagtcattattaaaattgaattacacaaacgtaaatgtattaaaaataaaggtaataaataatcccttatttctcatcccccccttctttctttttttctgactacattctggctttctttgcttcccagacaaggtggcagaaatcaccattcccagatcctgagtttatgagttctgtctattaaccagccacacygaaactgtaatctctcagtcttgattccagattcccagggaaggagctcattggctcaggttgttctagatacccagctctagacttatcaaagatttttctataaaataaagatatgggagatatggaagccagaccaaaataaaaagcctacatctctaggtccatttttttcttagggcaaaagaatacatcatttgtgcccagaatgcactgggtattgaagagatgacaactgtcttctgccaccagccatccaaaactttataggagacctcttgttcttacttcagcctaagacaaaaaccagatagcgctcgtctctggcagagagatgaacagctccacagagtgtcaggcaaacaatatacattagcctaagtggcaatttataattttaatggcccagctgcttgtcatggtagggtggggtacattttaagttagtactgtttactgcgaataaggctaaatttcccccatcattcattgcaaaatgtccatggcccrgaggtctcatcaatgtttagggcagttgctggcttagggcttggctgacttcttagttcattaacttctcattgaccagcttgaggttaaaaaggggagcacaacacaaatctgtggaattgagcaaaagcgagggttaggattaggactggcacactgtttattatttcccttttctctctgtttttttttatttttttaatttttattttttaatagagacagcatctcactatgttgccaaggctggtcttgaactcaggggctcaagcagtcctcctgtcttggcatcccaagatgttgggattatgggagtgaaacacaaaacctgacccattattgcacatcattagactgtgagcaattgaaggcagggctctctagaatctagactccagattatcttggccatcccatagctccaggtatcaggcctcgggatgtggtttggatgtgtgtccctgtcaaatctcatgttgaaatgtaatccctggccgggcacggtggctcatgcctgtaatcccagcactttaggagatggaggcaggctgatcacttgcagtcaggagttcaagaccagcctggccaacatggcgaaacccatctctactgaaatacaaaaattagttgggggttgtgtgcacctgtaatcccagctacttgggaggctgaggcaggagaatcgtttgaacgcaagaggcagaggttgcagtgagccgagattatgccactacactccagcctgggcgatagagcgagactccatctccagaaaaagaaaaagagacataatcccaaatgttggaggtggggcctggtgggaggtgattggatcatggtgggggggggctctaattatttaacaccgtcccccttggttcccgtgagatctggttgtttaaaagtgtgtagcacttcctgcctctctctcttcctcctgctctggccatgtcaagtgctggctcctccttcaccttttgccatgattgtaagctccctgaggcctcccaggagcagatgccaccatgtttcctattcagcctgcagaaccgtgggccaattaaacatcttttctttataaattagccagtctcaggtattttcttatagcaatgtgagaacagactaatacacctcacatagactggtccttgatttttttattttttacttttttaaagtcagggtctcactcagccacccaggctggagagtagtcatgagatcatagaacactgtaactttgaactcctgggtccaaatcgtcctcctgcctcagcctcttgagtagctcggcctacagttgtgtgtcctagccaactacatctggctagttttaaaatttttttgtagaaataggtctcattgtgttgcccaggctgatcttgaactcctgggctcaagtgatcctccttcctcagcctcctgagtagctaggaccacagttgtgtgctaccacacccagataattttttaaatttttggtggatacaggagtctcactatttcccaggctggcctcgaactcctagctgtaacagaccacaggctctttgcctccccaagcaatgaaagttaacacggagcaagcagattttccagacaaggcttttatttcagggcttgtgctcaagcacaagggagacagtgaaagtggaaaggatctgtcagctgactaccagaaaacgctggtggggatttttttattagaccgagagtgggaatcacatcaggggtaaggtatgcaggctgggctgggcagtgcacatgatgggtacggtatgcaggtcaccatatctgatagtgatggttatcttgagtaatgggccacctgatcgyatggccagaggcaacaaggctgtaaatcaattgttcagcattcctgccctaggtgggacttggcgccaccttgatgagatatctgggtcttctgaggccagtttctagaattctttaagtaaaagaaatggttaaacatggaagcacagaagaatggctattttctttgtatgactaaagcctcagggttaggcggtatatcatcagtgagatagtggtgtgggttttgtgatcagtgggacaacagaagaaggaaaaagaaaaaaaggaggctgaggtgggaggattgcttgagcttgggaggctgaggctgcagtgaaccatgatcactccactgcactccagcctgagcaacagagcgagacccaatctcaaaaaaaaaggaagaagaaaaagaaactagctgggcgccatggctcacgcctgtaatcccaacactttgggggccaaggcgggtggatcacaagatcaggagttcgagaccagcctggccaatgtggtgaaaccccatctctactaaaaatacaaaaaaaattagctgggcatggaggcgagcgcctgtagtcccagccactcaagaggctgaggcagaagaatcccttgaacctgggaggcagaggttgcagtgagccgagatcrcgccactgcactccagcctgggtgacagagcaagataccatctcaaaaaagaaaaaaagaaagaaactattagagccatgaatgaatctgactttgatgactcagagagcataagaatatgtgaaggaagaactctgtcccattcctacatgacatcaagggatcctcccccctcggccttgctacatgctgggattacaggcgtgagccaccatgcctggcccttgatattttttcaagaggtaaagacttgttccttataaaatcctatattttattaaacaaataagactttaatgcagttaatttcatccccactctggtcaaggaaatatatattatgtttaccagttactcagcaaatgtttctcaagaactgtcttaggcccagtgaagccagtcaaagaattatcaagcccwttgaggagggcttgatcattcagtcatctacttgcaggtggttggtgcaagctatgttatatttaagctgtatttggattaccaattttcaggaaattaagacagaatgaaatatacttggcattgaaactattttgagccaggcatggtagctcatacctgtaatccaagcactttaggaggccatggtgggaagattgcttgagcctaggcgttcaagaccagcctgggcaacatgacaagatcctgtctctacaaaaaaaatgtttttctaattagccgggagtggtggtttgtgcctgtagtcctggttactcaggaggctgaggtgggaggattgctgagcctgggaagtcgaggctacagtgaactacaatcactccactgcactccaggctgagcaacagagtgagaagtccctgtcgaaagaaagagaaagaaagaaagaaaggagggagggagggaaggaaggaaaggaaggaaggaaggggagagaaagaaagagagaaagaaagagaaagagaaagaaaaggaaagaaaagaaagaaaaggaaagaaaaaactactagggccataaatgaatctgtctttgatgactcagagggcatattttttcctttcttcatttaacaaatattaaaatactgaatgtcccttatgtgtgaggtcctgttctagagcttagaaatataaccataaacaagacacagcccccaccttcaatgaggtctctagtgtagttgggggaagcccgtagcgggagagaagtgggctgatgggctggtgagtggggatttcagtgctcaaggagcagtgcatgtcaggattgcctagagaaggggtgtgttactcagatgtttgggtggggcatggcccaagaaggccctccagaggaggtgacatcttcttttgagaccagaagatcagtaggagtttgcaaagggaaagtagggaggggagggtgggacaacatgttccaggtaagggaacagactgtgcacaggctgggaccagagagcttagcctccaggaacgaaccacactcaaaggtccaacagggcctcagggctgtggttgaagtgctagttgttactgttcttcctgactgtattgctaaactgggacatttgtacattacagtttatttcttctccatcatctgcccaccatgagctctatgaggtgggtaggtgttgcacctccatttcacagacaaggaacctgaggcttggcattgctgtaaggttctgtgagtatggggaagtcttggggagttggaggttttgcctgcctaccctggcctctgtcactccacagctgccttagatgaaagatcacttgaaagggtatctgatctaccttcatacctctgggcaaaaaagtgtcatttgctcctctgggagctgatggaggtacgaaggcatagaatttctgcaatcctgcagcgtaattaaacacatggatgctaacacaggcagacctggcctagctctgccacttgttagtagccgtgtgccttgggcaaattacttaactgaggctcagcgatgcctccatccagctgagacttgatctgagttcttcccctcttcagcagcaggggtggtgcaacacagctccagggtctcacctagtgccaatatcactgttggggagagggatagtggggagtggcaacgtgctcctcatcagacatgtggtaccactgagacaaccgtcggccctgcccacatggtccctttgggcccagtaatgctgttatcttcatgtcatgtttgggattcaggcactgtttgtragtctgcttgtagtcacaagccagcamcgattccttcctggggacgtgccacctctcaggaagcagaaccatgctccctgctgatcagagaccctcaggcctctctcttcttyttccccaccaagatgctctatttttgtccctaaacaccaccaatacctgcaaaccagcttcttcccttcattccttagcaaactccctaattttccctcaggcttcttgggtttcccgcaaacaaaagccagaaagctttgcctccttctgccttctgctctgcctgagagctttttcaaggtttcatagttcagagataactctctgtttaaatgagaggaatggggaggagcaaatgagggagsrargcaacctatkaraatctcagtatataaaatctagctgcataggcaagaggcaactgaggttcccaaattcgggaagcaaggggtacatagaaggggatagatccaagggatgggcagaagagagaatcattgacacttatagaccrgttcaatgtgggagtctcaccatgcatgcctgaattagcactctgacccaggtcaatcaaacaaagcaatcaggaattgtcattttaagttgaccttcagttacctgcaagtaaatgagttgatttaccatctgttgactcctctcagtcaactgaacacrgtagaaataaacacgtatgttttaggttgattgggctggatgaagggtataaggggcttcatatgattttgtgtgtaaatgtttaaatttttgcatattaaaaatgtttaagtaaatccatttaaaagccaacttttatgatccatcaacttttacattataaaaagaaatagttggctgggcgcggtggctcacgcctgtaatcccagcactttgggaggccgaggtgggcggatcacgaggtcaggagatcgagaccatcctggctaacacagggaaaccctgtctctactaaaaatgcaaaaacaaaattagccaggcgtggtggcgggcacctgtagtcccagctacttgggaggctgaggcaggagaatggcatgaacctgggaggcgtagcttgcagtgagccaagttagcgcggctgcactccagcctgggggcaacagagcgagactctgtctcaaaaaaaaaaaaagaagtagttgagctaatatttcagactcaatgtgaacacttcatgctactactgagatgttctctataaccgttagttcagatctaatgaatgtttgaaacttgagaagatttcttgctaaagaataaaagaaacatgcagcgcaagagagcaagaaatgaggggaaaaccctaaggccataggagccatgtctgtattttctctttttttctttctttttttatttttttgagacagagttttactcttgttgcccaggctggagtgcaatgttgtgatctccgctcactgcaacctccacctcctgagttcaagcaattctcctgcctcagcctcccgagtagctgggattacagtcatgcgccaccacacttggctaattttgtatttttagtagagatggggtttctccatgttgatcaagctggtctcgaacttctgacctcaggtgatccacccacctcagcctcccaaagtgctgggattacaagtgtgagccaccgcgctcggcccatgtctgtattttcttagaggagaaactaaagccagaaaggaaaaggagagtatcacaacatgagtgaatttggccttaccctcagcatcctggattaacagggagagcaagggggctggagcctgcgggtacagagcaagagaagatgaccccacctcaaactacgccccagggcagccagcagaagtcaagacacagtgtccaaagaacttgttgtacttggagtcagacaggaggaagcacctttgttctaggtcaatttattcggaacaacgctgcagccagaagttggctgtttagagaacgttggccagttcctcaaagggagaggctgacaaatgtaggcagagtgtccctgtcactggtccaagggtcaagggaagtggagggacaagacagacacaaggcagatgcccagctctggtgcctggctgagtgtggtcctgaggctctttccagttggcaggaaggaaaaacaacttctcgttacttcagctgatgttcaggatacgttgagaaagtgacttgaccccgtctactttttttttctcatttttaatctgtggctcctgacctcggaatgacttctgtgagactgtagtgtctggtacctcatggcttttgctcaccgtcttctcagatggtctccaggcttcagcttccctgtctgctacacactgtcttaggatgaggcgcctctgaggcacctatttgtatgctggaagtttgctggggagaactctcaggatcaatgcctgtaaggagagagggatgagggcctcagccaaccttggggggaattctggagttgggatggcttttcagagttgcctccaatgaaggtaacgtaatcacctgatgggttcttttttttttttttttttgagacggagtcttactctgttgcccaggctggagtgcagtggtgcaatctcgcctcactgcaagctccacctcccaggttcatgccattctcctgcctcagcctcccatgtagctgggactacaggtgcccgccaccatgcccggctaatttttttgtatttttaatagagatggggtttcaccgtgttagccaggacggtctcaatctcctgacctcgtgatctgcccgcctcagcctcccaaagtgctgggattacaggcatgagccaccgcgcccggccccacctgatgggttctacctgcccgctgcacaaataaaaccaattcactgagaccatagtattgcagtaaagaaagagtttaattaatgcaagactggccaagtggaagatggagttattactcaaatcagtctccctgaagacttggaggttagggtttttcacagatggttgggtgtgccggggcccagggaatgagtgctgctgatttgttgaggatgcgatcacaggagtgtggaaaacgtccttgtgtgctgagtccacctctgggtgggggccgcaggaccggttgagtcatgagtcatgagttcaggtrgggtcagtcacttaccagaatgcaaaagtctgaaaaacatctcaaaagaccaatcttaggttctataacagtgatgttatctataggagcagttggggaagtcacaaatcttgtgacctctggccacatgactcctaagcagtaaaggatgatcaaaactatgcctacacttcagcagatttcaggcccttctcatagtcctaatcttacggcctttcatgagtcttacaaaggctgtttcagcctccaaatgaggaggggacccgttttagggaggcagtgttatcatctttgcttcaaagttaaaccataaattaaattcctcctgtggttagcttagcctatgcccaggaatgagcaaggacagccagactgtgaggctagaagcaagatggagtcagcyatgctagatttctcttgttttcataatctttgcaaagtctgtgacaatgatagcaaggagccagggctttgtcctcccgctaggcattggatactatctgcttcttggaaaggggtgtaacttggctgagggcaatcttcagagacagagacttagctatgggtagtcaatagccaataatgccaacagctgggcaaatagcacctgcatcctgaaagggatatggtggcacaactcagcatcccttacatcttctgtctgactcttttctaaagagtgactcttgtgggtcccactggtcactctgcaatagaggaggtgtccatttgtgagtgtttatcacgtccgttcaccctacaggcttccctcatttccatcctataaagatggccaccactggccaggcatggtggctcacgcttataatcccagcactttgggaggctgaggcaggcggatcatctaaggtcaggagtttgagaccagcctggtcattatggtgaaaccccatttctattaaaaatacaaaaattagccaggtgtcgtggtgggcgcctgtaatcccagctactctgagaggctgaggcagtgagcccaggaggcgaaggttgcaatgagccaagatcgcgtcactgcactccagcctggatgacagagtatgactccgtctcaaaaaaaaaagaaaaaaccgaacawacaaaaaacatggccatcattgacttgggcttgatcctctgtctaatcagttgggggataggttgcagaacctacaccactcagagcaagacaactttttcagaagggcctgtaaaaagaatgctgtcacatgatagctgtaacaaaggtgttggggaaatgtatgtctggtacccagaggcctcagcaagattgcagaagctcacttaatttcaaacccaactgcttgaaggatctgtggctgttaatactctctctaccagtgtcaatattggcctggagcctgtgtggagttgaggctgcccatggctggctggctggtctctagctgagagggcctaaggaggagataggtgctgacagagacaacatggtctttggcacataaaatcttcattcttcgggagatagagctatygtaggagtgaggagaacctaggcaacattgaactcagggttaagagacttgaatttgagttctgactctggaacttgctaattacraggaagtcactggcccaaggttagtcagtcagcaaatgtttagtgagcatctgtggccaggaactgtgtttagcactggagagtccctctctggcctcattgttcttctttgtaaaacaaaagtgtggaggctgagtgcaatggctcatgtctgtaatcccagcactttgggaggccgaggcgggcagatcacttgaggccagaagtttgagaccagcctgggaaacatggtgaaacctggtctctataaaaaaaaaacaaaaattagctgggtctggtggtgcaccctgtgatcccagctaattggaaggatgagatgggaggatcacttgagcctgggaggtggaggttgctgtgagccaagatcacaccactgcactctagcctaggcaacagagtgagaccctgtcgtatacacacacacacacacaaatgggtttgggagattatctcaatgaattaaagtgatggcaatactttcagaaacgaaaatccaaggtgcgtactctgccactaccagaatatttgatattgaggatacccccaggaagctcaggatgtaggatctcattatatacctacagagactctatttcccaatcccccacagttgtttcccccagacatattacatagagtgacttaatccttagaaccatggtgagaagggagaggtagatgttatataagttatatagtctcctatcttgctaattttttttttttttgaggtggagtctcgctctgtcgctcaggctggagtgcagtgacacgatcttggctcactgcaacctccacctcctacgttcaagcgattttcctgtctcagcctcctgagtagctgggactacaggtgcacacccccacacctggctaatttttgtactttcagtagaggtggggtttcccgtattggtcaggctggtcttgaaatcctgacctcaggtgatccacctgcctcagcctcccaaagtgctgggattacaggccagagccaccacacccagccttttgctagtctttaaaatcctctaagtgtttgccttgattttttgaattctttagaatttaaatggtctgagtttaaatagtcctgaacacatttctcaaacactgttatgtaaacaaagcccagccatggtgattacacagtcaggttttttccaacccctggagacttgtatcataatcttatcttagggtcaagcatcggtactgctgaagtggtttgcatttgaacagtctttcagaagttggtgccagattcagagttctctggatagcagatctggtaaggtaggtgtattagtctgttttcatgctgctgataaagacatatccgagactgggtaatttataaagaaaaagaggtttaatggawtcacagttccacktggctgtggaggcctcacaatcatggtggaaggcgaaaggcatgtcttacctgatggcaggcaagagagaatggaagctatacaaaagggaaaaccccttataaaaccatcagatctcatgagacttattcactaccacgagaacagtatgggggaaaacatccccatgattcaattatctcccactgggcccctcccacatcacatgggatttatgggagctacaattcaagatgagatttgggtgggggcacaaatcctaaccatatcagtggggtcactaaggtatataggtatatagtgtagtaagatggtgtcacctkaatcacatttacactctgccccggcacagaaccctgggagctgaatattgaggagcagagaggaacagggatcagaggcacaaaatttggcttgctcttgtagatagcaatagagatgggcacaaggcwgagtgaaatctcatcagagtagtgagtgcttagcacatataargcactgtccttagtgccgtaagagatawcaagagaaggtaagatagattaaaatgtattgtgtttgttttatgttactcactttatacatactagcagtcaatcaataataataacaatgataagtgctttgaagtacctactatgggccaggcaatgtgcttaatacttcatatcttcttttcttttatttcatgcactcattcaacacatttgtcttaagatctactaggtagtaagtgctgggagacactgatgaataaaaatctctgccctggaggacttttcattctgggaaagataggcccatagatgtagtaaacaagtgattaagtggagtgttagaagatgacaattactgtgaaaagaatagatctgggttaggtggatcaggagtgcctacatcgggggagcacagaaacggtttacaatattaaatagatggtccaggtgaagcaggacagttccctgaccccttcgtgggtgggaactggagtgcactggcactggcaggggcgaactccactcactctctgctccaccccacgtgggagtgggagcacaggtgagcaggtgcaggagccagggtgtgtgcttttaggtgccggcaagagcgaactccrtactggcccatggcagcatctaagggagggtgccggaagtccctgaagccacagaggaagtgttacagtgccctttacctttgctgtctgtagacagcttaacagctcagcagagggtcagtgtgacagccttttgtgcccacacttgaggcacackagtttttgtctggagtccaggaggaataaggtctcacaaacgaattgaaggtggtaaatgtgggggatttcattgccaatgaaagtggctctcagtgagaaagggagctggaaaggggacggaacaagaaggtaatcttcacctgagattctccagccatccctgccagactcctctcttcagaggatgataaaaactatatgcctacatttaggatgagtctctctctccgacatccaaccatactctccaacatccagctccttctcgtctctctcccaggtaagcctggggtttttatgcacacaggatgcgggttagggcaggcgccatagtggttttggaaaaggcaacatttgagtgggaaaacaggsatgtaagttcttgctttggaccactgttccaggctcaagggtggggtcctcgctggggacctgccctcccagaatttttctgcctcctgtccctatcacacatagtgctctgtgggaaggtgacgtttgagccaacattcaatggaaggtgatgaaggagttagctatgcagatacatggagaagagcgttccagggtaaaggagcagccaggggaaaggcctgaggccaagtgtaactggtatatggacagcagggaggccagagtgactaacgaggagatggcaagatgatgaagtgcttttgtcttttactctgagagagatgggaagccatcagaatgcttattgtttgtcctgctttgttaatctgtgtttcagagcagtgcttggcaaactttttctgcaaagggctagatagtaaatatttcaggctttgcttgccatgtggtctctgttgcaactatgtagtcctgccattgtaacacaagagtagccatcgacagtgcgtaaacaaagaagcatagctgtgttccaacaaaatttacttatggacactgtttgaatttcacataattttcatgggtcacaaaatattgttcctcttttgtttcttttttttaaccatctgaaagtgtgggaatcattctgagctcatgggctgtagttatcctgtgagccatagtttgtggacttccattttaaaggatagtcatgatccsactaagtttcaaccagagcaccctggctattgccttgagaagagtctggaggctgaaagcaggaaggccaggcagaagccgttgctgtaagccaagtgagagatgataatgattgctytgaccagaaagaccacaggattacattctgattgtatctccacccaacctttgaaataggtgtcgtaatgatccttcacaaacaggggaggaaattcaggctcagagacgtaaagtgactcgcgtaagaacacagagcacacaaatggtgaagtctggatatgaagcccaatccaaacttgaaggcttgttctcttttttatttttttctttttttttctaatttttttttttgagatgaagtctagctctgtcacccaggctggggtgcagtggagcgatcttggctcactgcagccttcacctcccacattcaagcgattctcctgcctcagcctccagagtggctgggattacaggcatgcaccaccactcctggctaatttttgtatttctagtagatacagggtttcaccatgttggccaggctgatctcaaactcctgacctcgggtgaaccacccacctcagccttccaaaatgttgggattacaggtgtgagccaccacgcccagctgaagccttgttcttcagtgttataactctgcagtcatgtcacatgggcctttttatcccaaattacagatgagaacactggggctccaagaagtcaaggaacttgcccaagatcaacaaggtcttgatgactccaaagcaactatccctattactaatctaggctaattctcaatttaaaatgggattactgcccactaggtgcytctattctaggtagcaggattctttatacaatcagtgcctctgaggtgtcaataaagagcctagggcattcaggctgggcgtggtggctcatgcctgtaatcccagcactttgggagggcgacggaggtggaccacctgaggtcaggagttcgagaccagcttggccaacatggtgatatgccatctctactaaaaatacaaaaattagctgggcatggtggcatactcctgtaatcccagctactcgtgaggttgaggcaggataatcgcttgaacgcgagaggaggaggttgcagtaagctgagatcacaccactgcactccagcctgggcaataagagtgaaactccatcaaggaaaaaaaaaaaaaaaaaaaagcttagggctttcagagaaggtggggtgacattcatctggagggacaaggagagattgtttgccatgggccttaaagaataactagctgcctctagctatttttgctgacaggctgattcttactgacataggattgcttggttcttctctcagatattttgttctattttgtctttggttttttttttttaagaaaatatttttatacatagataaagctatagattttttattagatatttaatattttaattataaagctaatatatttgtgacaagccaaacaatatagagatatatacaaaaaatttaacaatctcctcattactgtcctccagtttcaccagtctgtgataattaaggtgaatcaggaaaacagaaaatacatcgatatgttaacagagatcattttatctaggatggggtggaatattaaggacagctgccaaattctacccattgcgtatttttgtaactaaagctttaccagaatacygcatgctcattcatttctatcttgtctatggctccttatacgttacaacagcaaagttgagtggttgtgacagacactttatggcccacgaagcctaaaatatttactstctggtcctttacagaaaaagtttcccaagtcctgatcaaggggattggtggggtagggagaataataatctcccaaagatgtccatgtcctaattcctggaacctgtgaatgtgttaccttacatagctaaagggactttgcagatgtgattaagataaagatcttgagatgagagattatcctggattacccaggcaggaccaatgtagtcacccattgtagtctgtagtcacactctgtagtcctcagaggtgacaaagagaggcatgagaatcagagggagatttgaaggtgctatgctgccgtctttaaaggtggaggaagaggccacaaaccaacgaatgcaggcaatatttagaagccggaaaagacaaggaaaaagattctcctctaaagcctccagaaggaatgaagctctgctgacaccttgattttaatctcagtaaagcccgttttggatttatgacttcagaactggaagataatatgtttgtgttgttttaagccactaaatttgtggcaatctgttatagcagtgacagtaaatttatacagttagcttaccgttattgaaagattgagatgtcgaaaggggacactgaggtaagggaggagctacaggaggtggcttccacccctagggctgggagaaaasggaattagccaggctcatttgaacccagaaacgtggaggacagaccctgtggaactgggacccagacctctgaggagtgggcactggcatactggtgctctgaggagcaccctgaagctgattctgggaatatggagaatactggaaactgcaaccagctgctgctgccggggtgaaaaattactggagctactctgacaggaacaggaagcctttaggaagcaaacaggagatccctcctccaacttccctctctgcctccagtacccgctatgaacagagtgtaacaacagctgacaaagcagaaatgaggtttgtggagtctcagccccagcatcacaaagcagaatgccaagatttggagctgagactagtaacaagtatacaatgttaactatgtgtctgcatcattatgctttttactctatgctgacacaaatttacatttattctaggctttcccttctctttcctatttagtaaaaatgtggtcatatacactttactctgaaacttatttgtgttattaaacaatatatcatgcatacctttccatgaaagcatattagagcagtctcattttaaaaaaattacccagtaatatcccatccagacatcagaaaattgatccattcatttccagtgacaaagatcctttgcttgaccaaacttttagtcaggctcctgaacctcctcctaagcccatccatgcacttycttgtacaatccagtttcagcaaagaaccctgctaagtcaatttagcaagaaccccctaccctatccagtcaacctcagtatctgatctggtttcgtttcttatcctctgaagtctgatcaccctggcctgtcttcagatagaatcatgttaggttggtttctctagaatccttctactcctaatgccacttcttagtaattttctccccacctgcttccacctgctccttggctataaattcttcttgtccatgctgtattcagagttgagccccatctctcttccccactgcaaaaccctgttgcagtggtccctatacctatcatgatagtcctgaataaagccttctttaggccggacgkggtggctcatgcctgtaatctcagcactttgggaggccaaggcaggtggctcacttgaggtcaggagttcaagaccagcctggccaacatagtgaaatcccrtctctactraaaatataaaaattatccgattatggtggcacatgcctgtaatcccaggtactccagaggctgaggcaagagaagtgtttgaacccagggggcgggagttacagtgaaccgagatcgtgccactgcactccagcctgggagacagagcaagactctgtctcaaaataaagaaagaaagaaagttttctttactatgttttaacaaatgttacaaataattttttttttctttaacatcagacccagtgattggttcagggcttggcatgtgacttaattcagtctgggcaccccctagagctgagagtgtggtcaaacctacacaaatcacatgcctaagaatgtgagaagggcgttcccctatgggaaacctaggtgcttttggcaggagaaggaaaaacaatggtagagaagcaagcaaccaatgtccaccacaacttcctcatattctctgcccattgtttctactgggttattaaatatttgttgtcagtttattgatggcctttatatatagtcagtgttaaccctttgcatgtatatgtgttacaaatgttttgcccagcatataatttcttttaagtgtgttttactatacaaaaattaaaatttgtatgtaatctgatgtaagtttttttactttatggtttgtacattttttccctgcctaatagtttactctacaaaacaaaaataatgtcttactctacaaagattaaacatattagtcactagattgatcagaataggtgaggggtggcagaacactctactggccatagtcactgagggacccaggttgatggggactccacttcaagatgtgtttctatggtcacccagacagagggaagaggagaaaaaggaaatgatgagtgagcactggctcttaaagcttctgccccaaagtgacacacataatttcctttcacattttattgaccaaattcagccacatggtsaggattaatttcaaatggaataaggaagcacaatttcaccatgtgcttaggagagaacaaatacacacataaggactactgtaatccacacttctagtcaccaaacatctttcccacactcaaaataccttcacccrccccttcctaagggagtcaaccccaaggtcccattctggttggacctttattctgagaacacctcagcctgttcagagattttgaccatgaatgtgatggcaatagccttgattagatccttgctgtgaagctgagtctttattgttttatcttttagctaatctgtattgagaagaaacctgcctcccaaccctgccagtctctgaatttctggtctatcttttcctttcactcctacttgcaaactagctagccctcccctgaacccctatttattgtcaaatatattggctatctacaccattatgttttctagttgcttcttctagagctacaagtttgctaggcacatcaactaccttccaagtgactacccaacagctttaccaaatgtgtcaccattgtgtaacatggctcaccatccttgtcagtaccacctgaccactaagccaatgccacttttttaggtttttgtgctggcagcatcccatattagagatcggtcaagataaggtagattatgctataataacaaactccaaagtctcaatgactaaaaaatatgtcagttcatttcttgcctatattacatgtccagtgtgcatcagcaagggcatctgcttgttgtagtcactcaggaaccttggtgatgaaagctgtacttcaacatatgcttccacagttatcacagcaggaagaggacggacatggcacaaatccatagctctgcctagaagtgtcacatcttccccctgctaacgctttcttatttaaagcaaaaccaatgggtatgtctaacttcaaaagtggggaaagtgtcatcttatcatattcacagaaaagagaacctgggtatttgagaacaaactcagtgactatcacaggcatttttgttttgaggatatattgcagtgaaatagaatgaaggtaacaacaacagtaacaaccttggattatccatatcccaggatctatttttaactccaagcaggcttctgctaccctgattttatggccctgagggtagaccaccatattttgaccccattaattgaaatttaatgttgctttaaaactgaacaaaaaaatctaatccttgagattgcattccttccactaagccacactcacaataagatataattggaatatttccttattctctcctccttcgttacctaatgtttcttatttcttttctttctttcttctttcctttcttttctttctttccttctttctctcttttctttcctcttttctctctctttctttctctttctttttctccccttccttccttcctctctctcttcctccctttctccctttccttcctccctccctctctctttctccctttctgtctctctctttctctctttctttctctctctctttctctctctctctcctttctttctttctttccttctttctttcctttctttctttctttctttctttccttctttctttctttcttttttttgagacagggtctctgtcactcaagctggagggcaatggcaccatctcagctcactgtagccttgccttcccaggctcaagcagatcctcctacctcagcctcccaaggagctgggactacaagtgtcagacactgtgttcagctatcatgttttaatttttttgtagagactggatctccctatgttgcccaggctggctgggctgaaccgatcctccctcctctgtctcccaaagtgctgggaaaaannnnnnnnnnnnnnnnnnnnnnnnnatgcctgtaatcccaggcatatttcattctactattctactgaagactgaaaactacagttaataatgtggagttttttaatttttaaaagttactcatttgtgggattttttttttttgagacagggtctcattttattgcccagactagagtgcagcagcatgattatggctcacggcagcctcagcctcctgggctcaagtgatcctcccacctcagtttcccaagtagctaggactacagctgtgcaccattacacttggatttttttttttttttgacacagagtctcactatgttgcccaggcttgctttgaactcctgacctcaagtgatcctcctgtctcagcctccgaaagcattgggattattatccaggcattagccattgtgcctggatatgaatattcttaaagttataataccaagaatgttagtgagaaagaaaattgaactgctttttaatgactaaaaagttaagctttcattctgaaaatagatcctatcttcaatctagcctcactaaatggtggtttcttaatcattggtttaaaatgccctgactaggcaatctgcctagttaaacattaaagtgaagatagtgagaggcttcaagatggctgactagaggcatcttgtactcgcctcctcccctaagaagaaccaaaatagtgagtagataattacacttcgaatagatcatccaagagagaacactgaaattttacagaaacgtgacacgcaacgcttaaacaaggaaggaaagagaagcaagacagagcgcaaggaaaggtggcttagagacccccagcagaccaaatttccactgtgtacttctgcaatcctagcctcgggagagccccagagccttgagggcccagaaactaacacagggaagtgcctggagaagacgtgatggtattgatccagggagggagattgcgctgggtcacacactcctcctgagtcctaggcagctacaggaaggtgccattttgagatcccagccacaacagactgtgcactgtcctggggccccgtggtaccaggtccgaggcacaagcaaggagcaggctgttgctgccggggctgaggcacaagtgaggtatgggctgctgccaycggggctgaggaacaagcaaggcatgcattctccatttgccagcctaggttgccaccactaaaagcaaccatgccctccccagtggcagggccaacgtgtggccactgccactcctaacccaagcattccaccagaggcctggaagttgccccatctctgcctatcatgacagacacctgcacacaccactggggaaccctgaggacaaactcacatggcaccagcttcacctcacccttgccagagcatgcagttcagggcactgaagattacccagtccactaccattgacacctgaccactcctcccaggggcctacccaccctgccactaccacaacagcttgcaattacctgtgcatgtcacctgcaggcctggggactagctcacacagcccatcacagctaccaccaacascagtgtacactgtttatttttgaataaaatacaaaatacatttgaaagcttcaacaatagggtagatcaaggagaagaaagaatctcagaacttgaagaatggtcttttgaaataaaccagttagacaaaaataaaaaagaatgagcaaaccctaacttgacacataaaacaccataaagcaaccaaatattcaaacttttggagtcctagaaggcaaagagaaaagagttagaaaacctatttaatgaaataacagataaaaatttcccaagtctggcgagagatttagacatccagatacaagaggcttagagatccccaaatagatataatgcaaagttcttctccatgacatattatagtcaaactgtcaaaaacagagagagaattctaaaarcagcaagagaaaaacatctggttccctataaagggacccatatcagactaatagtggacttctcagcagaaactttacaggccaggagagtatagtatatgcaaagtgctgaaagaaaaaactgccaattaaggatgctatacccagcaagattatcctttataaatgaaggagaaataaagtctttcccagacaagcaaaaactgaggaaattcatcaccacccagaatcaaagccaacacatcctatgcaaccaaaccatagacacatattcaggataaagtcctcctctcccctctgctccctacaagaaatgcttaagggagtcctacagatggaagtgaaataacaaagaaatcagtaaaacaattcaagatatgaataaggaatttgccagagaaagaatgttatttaccattatgaaacatgtaagaatgtaagaacaactggtagagcaaatgcacaaacaaggaagagaaaagactcaaatgttatcactacagaagccaccaaaccacagtgttaaacaataataaagaaaaaaaacgactaaaggacttacaaaacacccaggaataatttactaaaatgataagaaaaagccatcacatatcaataataactttgcacgtaaatgaattaaactttccacttaaaagatgtagactggctgaatggattttttaaaagacccaattatttactgcctataayaaacagatatcatgtggaaagacacatatagactgaaagtaaaaagatggaaaaagatattccaagcaaayaaatcaaaagtgagcaggagtagctacacttagataacatgaacttgaagtaaaaaacaataaaaagagacaagatatattagtcagcattctctagagggacagaactaataggatatataaaggggagttccttaagtattaactcacaagggccatcaataggacccacaataggccatctgcaagctgaggagcaaggagagacagcatgagtcccaaaactgaaggacttggagtctgatgttcaagggcaggaagcatccagcatgggagaaagacgtaggctgggaggctaggccagtctatttacatttttttttctgcctgccttgtattctagctgtgctggcagctgattagatggtgcccagattaagggtgggtctgactcagtcccacccagtccactgactcaaatgttaatctcctttggcgacaccctcacagacacatccaggataaatactttccatccttcaattcaatcaagtttatactcagtattaaccatcacagaaggtcattgtataatgataaagggatcaatttagcaagaggatataacagttctaaatacatatgcacccaacactggagcacccagatatataaagcaaattttattagatttaaagggagagacagattccaataaaataatagttgggggcttcaacagcccactctcagcattaaacagatcatctagacagaaaattcacacagaaacactggatataaactccgcattagaccaaatgggtctgacagacatttatagaacatttcatccaacagctacagaacatacattattctcattggcacacacaacattctccaggatagaccatatattgggacacaaaatgtgtctcaacaagcttttgaaaattgatatgtcacaattttatcaaaccaccaaaaaccaagtcaataacaagaggaactgtggaaactgtacaaatacatgaaaattaaacaacatgctcctgaatgaccttgggtcaaggaagaaattaaggaagaaatgaaaaaaattcttgaaacaaatgaaaatcaaaacataacattccaaaatctacgggatacaacaaaagcagtgctgagaaggaagtttatagaaataagtgcctacatcaaaaaagtagaaagatttaaagtaaataatctaataatgcacttcaaggaacttaaaaagcaagatcaaaccaaaaccaaaattagtagaaggaaagaaataataaacatcaaggcagaactaaatgaaattgacactaaaaaaacaatayaaaggattagccaggtgcagtggctcacacctgtaatcccagcactttgggaggtcaaggcaagcagatcacaaggtcagaagattgagaccatcctggctaacatggtgaaaacccgtctctactaaaaatacaaaatattagctgggcgtggtggcatgcatctgtaatcccagctactcaggaggctgaggcaggagaatcacttgaacctgggaaggggaggttgcagtgagctgagactacgccactaccctccagcctgggcgacagagtgagactccatctcaaaataaataaataaataaataataaacaatacagaggatcaacaaaatgaagagttggctttttgaaaagaaccaaaattgataaaccacttgctagactaagcaaaaaaaaaagatccaaataaaatcagaaacgaaaaaggagacattataacagatactcagaaatacacaagatcatcagatactatcatgagcaactatatacagtaaactggaaaatctagagaaaatggaaarattcaatatatataacctaccaagattgaaccaggaagagagaaaacctaaacagtccagtaacaagtaatgagatcaaagaagtaataaaagtctcccaacaaagaaaagtccaggactagatggcttcactactgaattctaccaaactttcaaagaagagctaacaccaattgccaacaaacttttccaaaaaattgaagaggaggagattctccctaactcattctatgaggccagcattacccagatgccaaaaccagacaaggatgcaacaaaraagaaaactacagaccaatatacctgatgaacatagacacaaaaatcctcaaaaatactagcaaatcaaatccaacagcataccacaaagataatacaccatgatcaagtgggattcatcccagggatgcaaggatggtttgacatacgcaaatcagtaaacagcatccatcacattaacagaatgaaggaccaaaaccatatgatctctcaactcatgcagaaaaagtgtttaataaaactcaacatcccttcctgataaaaactctcaacaaactaggcagagaaggcatacctcaccataataaaggacatgtatgacaaacccacagctaacaccatactgaatggggaaaagctgaaagcctttcctctaagaactggaacaagacaaagatgcccactttcatgactcttattcaatataatactggaaatcctagccagagtgattaggcaagagaaagaaatatatggcatccaaattggaaaagaggaactcaaactgtccctctttgctgatgatatgatctgtgatcttatatctagaaaaacctaaagactccaccaaaaaactctttgttgagaaaataattcagtaaagttacaggatacaaaattaacatacaaaaatcagtagtgttattaataataaactagccaagagagaaataagaaaggtaattccatttacaatagtgacaaaaaaatatacctaggagtaatttaaccaaggaggtgaaagatctctgcaaggaaaactacaaagtactgataaaagaaattgaagagtacacaaccaaatggaaagacatcgcatctcatgactggaagaattagtatcattaaaatgaccatactctttaaagcaatctacaaatgcagtgcaatctctattaaaatatcaacatcattttttcacagaattagacaaagcaattttaaaatttgtatagaaccaggaaaaaaaaaaaacacctgaatagccaaagcaatcatgagcaaaaagaacaaagctagacgcagatatagtaaacaaaacaggatggtatttgtataaaaacaaacacatagaccaatgcaacagaatagagaatccagaaataaatttgcatgtttacagacaactgattttcaacaaaggcaccaaggtcatacattggggaaaggtcagtctctccaacaaattgtactagtaaaattggaaattcatatgcagaagaatgaaactggacccctatctctcaccatatagaaaaatcaacttaaaatagattaaagacttaaaggtaagatctgaaactattaaaatactagaaaaaatatagagaaaacacttcaggacactggtctaggcaaagatttcatggctaagaccttgaaagcacaggcaacaaaaagaaaaatagacaaatgggactttattagactaaaaaactttgacacagcaaagaaaactatcaacagagtgaagaaacagcctgttataagggaaaaaatatttgcaaactattcatttttctagagactaatatccagaatatacaaggaactcaaataacaatcaatcccattaaaaagtgggcaaaggctgggtgtggtggctcatacctgtaatcccagcactttgggaggccgaggcaggtggatcacaaggccaggagattgagaccatcctggctaacacagtgaaaccccatctgtactgaaaatacaaaaaattagctgggcatgatggcatgcacctgtagtcatggctactcaggaggctgaggcagaagaatcacttgaacccaggaggcagaggttgcaataagctgagattgcaccactgtactccagcctgggcgacagagcaagactatgtctcaaaaaaataaaaaataagaagtgggcaaaggacatgaagagccacttctcaaaagaagacatacaaaatgccctctgtctcaaaaaaaaaaaaaaaagttacttaaagtctgtgtctagtaagtctaacgtctgtgctgcctcagcgatggtttctgtcaatttatttttcccactgctttcctatttctttgtatgctttgtgggtttttgttgttgttgaaaactggacatttgactattataatgtgttatctctggaaaacaaatatttacattccctagagtttgctgttcttgattgttgatggcttaacttttgtacagccagggtttttaccgaaatttccctgaacatggggaacttaaaaaacaaacaaaaaactttttccaatctttgcatctgagtttttgcaggagcacccctttaacacttaataaggccatttgaaattcttcctcagcagtcatttcctggttgcactgagtctatatatcaaccagtggtggaatcttaggctgttctcagttctctgaacatgcatcctgtcccagacatgtgtgttgctttctaagttgccctatatacagagcacttttgaatttgaatgccctaatttcccaacaattctctctccctggcttttactcccaggctttaggaaagttattctatgtaccaacygtactcttcggccccaggcagttgcagtttgtttgtttgccttacaatgtttaaacaacgcctgctgcttttctacagtgggttacagtgtgaaaacagaaatgagcactttgtttcagtttttcaggtaacacccaggcaggttagaatagacatacctaataattgtgtataaagttggctctgctctctataaacaaggaccggagtcccaccctgggaaggtgggctgctgtcgctaagactgctattgagtcagggaagggttcataaagttttctttccattttcaagttgccttagaaaaaaaattggctgggcgtgttggcttaccctataatcagagcactttgggaggctaaggcaggaggattacttgagcccaggaattcaagaccagcctgggcaatgtgatgaaaccttgtctctaaaaacataaaaaatttaaaaggtaataaataattttttaaaatgagcatttgcttggttgctgtaaatctttaactatttcccaaagttctgataaagttgctctgacaatttctggttatttgttcaatatttctgtggcggtgtgaaagtttgtagctgcctatttctccattttgctgatgtccctctctccacaaattcggacatattgcatcttcattatgcacacacacacacacacacacacacacacacacacacacccctaaaaaagtaataataatgtaattatagagatggagaacaggctagtagttctctgggaattacggatgggtagagaggatgggtgttatcgatgtcaatgtttcaatatatgcaatatatgtatgtacatatatacatacacacatatatgtatacacacataaacacatacacatatgtatacttttcatatatgtacacatacagatgttcctcagcttaagatgggattacgttcagacaaacccatcataaactgaaactatctcaaattgaaaatgtatttaatccacctaatctaccaaacatcatagcctaccctagcctaccttaaatgtgctcagaacacttayattagcttacaattgggcaaagttgcctaacacaagcctattttatcataaagtgtttaatatcttatgtgttaatttattggatagtttttgaaagtgaaaacagaatggttgtataggtacttgaagtatggtttctactgaatgtgtattgcttttttttttttgagatggagtcttgctctgtcgcctgggctggagtgcagtggtgtgatttcagctcagtgcaacctccacctcctgggttcaagtaattctcctgcctcagcctccccagtagctgggattacaggcacatgccactgcgccaagctgaattttgtataaaaatactactaaaaagtagagacggggtttcaccatgttgcccaggctggtcttgaattccttatctcagatgatccacccacctcggcctcccaaagtgctgggattacaggcatgagccactgcgcctggccaaatgtgtattgcttttgcacggtggtaaagttttaaaattgtagatcaaaccattgtaagctggggacagtctatatacacctactttttattttgaaataattgtagagtcacctgcaagagaaatgtacagggaagtcacatgtacccttctctcagtctcctgcaatgttaacatcctatgcaactataatacaatatcacaaccaaaaaattgrcatcaatatcacccatcctttctacccttccctaatccccagagaatgactagcctgttctctatctcaataattatgttattattattattatttttagacacaggggtcttgctatgtcgcccaggttggtcttgaactcctaggctcaarcgatccacctgactcagcctcccaaagtgcagggagtatgggtgcragccaccaagcccagcctatgtctataattatgttattacatgattgttacataaaggcaataatgtactatgtattcttttgaaattattttttttaacccagcataatttcctagagatttatccaaggtgttgtattgttttttcattgctgattagtagtccatggtatgtatgtatcgcagttttagccatttattcatcaaaggagatttgggtagtttccagttttggactcataaatacagctgctatgaacattcttctacaaacttctgtgtgaaaatgtcatttctctgtctaagggtgcaaatgctgagttgtacaataagtacatcttgttttcaaaggaagtaccaaactattttccatagtggctgtacctttcctaccaacatgcatgttggtattcatatctaagtgtgtgatccatatctaagaagactatgtctaactcaataacatagggattttcatctaataattttttaattttaatttttaaattcaggtctatgattcattttgagttttttcattttttttttgtattggctgaaggccacaataatcttagggtcccatgaaaatgctttaaatcttttcaaataataagaacaaattaagtgcaattgatggcagcagcgggctgtccacggcggtcgctgtcatcaggtcagctgctgtggggagggtgccaggaggaggcagagctgggctggagtaatgctgtgctccacagagccagcaggagccagggtaagcgagagcccccccgccaagcctgccacgttgggtgccactgcaatggggctgagctgagccacctgccagcagggagcagcatggttgggcacagaggggtgggcagagaggggcccagtaaggacctggagctgcaaggaggcatggccagggctgcctgcatgctgctccacagagtaggcaggcgggagtcctaccctcccaggcacaggacctgggcatctctgcagtctgcacccttggggtcctgggaaagtccccctcccccctcaggcttggggggtgtctgctcctgctgcctggcctctccctgcccctggtgcctgctccaatctcagagcagggttggggctgagcccaggcactgttacagtctggccaggtgtgtgcacacttggagcagagctgacacaccagccccctgctgtcttggtcctttccggaatttgggccccaaggagctctggggggaagccgaggggcgcctgagggcaacccagcactggcctacaggtgcccttttgcacaagcagcctgggcaccatggatggtggcaggaggcagatcggctcctgggtggaagaggacaggttactggtgaagccccaccttcaggccaggctgctrgtactgctgactggagtgggaacttgtggtgccttttccaggccctcccatggccgcccacagaccaattggcagcacttcctcccatctgaggcccataaaagccctgggctcagccagagcactgcagatgatgagacgtccagctgcagagaggagctaccctctctgctgatagctgaacacttgtcaggatgactagctgcagaaggagctaccctctttgcttctagaactcaacacttgttgggatgacttgcctagcagagaggagccatccccatctcgccaccttgcaggcgaagaggaggaaagaagagctgtggcccttcggggagctcagacctgggagctcttcaagccagggctgtcactccctccttggagcccttcggttcctggtgtctccaagcttccaggcaccaccatgttccctggtgccaggaatggaagctgcttgcatgtgcctggtccagctgcagccttgcagagagccagcgtgcaagctggcacctagaattgctcaccctgctgaggcagccggcatgtctgactgcacagttggactccatgctcactcacacacccctcacccctcacccctcaccacttcatgcagtctccctcggcaggggagggatcctggttggtagtgtgagccgagcgcagcctgcaaagccaagtgggcagagtgagcccagcgggcctgagcaaaacttggacaaaggtgccactggccacagaggtttccagccaaaaaccaacaccccaaagatccactaacataatcagttgggattacatttgtatttatagcaacacagttttaaaacataattttttgggcttggtggcctgtgcctataatcccagctattgggaagctgaggtgggaggatcacttgaggtcaggaggtctagaccagcctgggcaacatatggagaccctctctttaaaaaaaaagtgaaatataggccaagcacagtggctcacgcctgtaatctcagcactttgggaagctgaggcaggcggatcacctgaggtcaggagttcgagaccagcctggctaacatggtgaaaccctgtttctactaaaaatacaaaaaattagctgggtgtggtggtgcgtgcctgtaatcccagctacttgggaggctgaggcaggagaatcatttgaacctgggaggcagaggttgcagtgagccgagattgtgccattgcactccagcttgggcaacaagagtgaaactctgtctcaaaagaaaaaaaagaaatatagttttttttttggcaggatgtggtggctcacgcctgtaatcccagcactttgggaggccgaggcgggcagatcacttgaggtcaggagtttgagatttcataacaagcctctttcaatcacacctaatgaggtgacatggagtggggcccctaaatggctttaggatgggtgctggtccccacaaaattagaaggtggggccggggatggcaagaccctgtctctactaaaaatacaaaaattagccaggcgtggtagtgcacacctataatcacagctactagggaggctgaggtaggagaattgcttgaacccaggggacgcagttgcagtgagccgagatggcaccactgcactccagcctggacgacagagtgagactctgtctcaacaaaaaacaaagaaacaaaaagagcaaatataattaaattttttaatagaagaatgtacctctgatgttcttcctgacactaaatacatggtgactttccacaccaattcttcaattctctgtcagcaactgggtggcctacaagtcatttcaattctgacgtcaactccaggagttagttcagatcccacaaattaatggctcagtcccacaaggataccctccttcagacaccagtcacaagttccttaggccacctgcactccgactgaccagctgtgaagtcaaggcttcctataattccytcctcatggtgaataattcactagaatgactcacagaactgaggaaaatgtgtttcttacatttactagtttattatgaaggatgccactcaaataactgaatggaagagatgcacagggcaatgtaaagggggactatgcagarcttccgtgccctgttgctcttccccacagtactctcgtgtgtttgccagtgcagaacctcttctatctcttgttgaagaatttataactcaatcaccagccccttcttctccctggaggtagggcatggggtgaggctgaaagttcccacttttcaattattttgggggtggaaggaggaggtctctctctgttacccagcctggtgttcaatggtgtgaacacagcctactgcagccctgacttcctgtgctcaagcgatcctcccaccttggcctcccaaagtactgggattacaggtgtgagccaccatacccagcccccttctaattttgtggggatcagcacccatcctgaagccatctaggggccccactccatgtcacctcattaggtgtgattgaaagaggcttgttatgaaaaacaaaagatactcctgttagaaaattccatgtgttttaggagctctgtctcaggaacgagggacaaagcccaaatacagttgatctttgcacaaccaggggattaggggagctgacccttcacacaatagaaaatttacgcataactwtcactccccaaaaacttaattattaatagcttactgttgacaagaagccttaccaataacataaacaattagtacatacattgtatattatatgtgttatgtattgcattcttagagtaagctagagaaaagaaaatgtgattacaaaagtcatacggaagattgttcattaagcagatgtggatcattataaagatcttcatccttgtcttcacattgagtaggctgagatggaggagaaagaccaggggttggtcttgctgtttcagaggtgtcacaggcagggaaaaaagccacctacgagtggatctgcgcagttcaaactcgtgttgttcaagcgtcaactgtatatacatttactgtagcatagaaaccaagaaagcaaaagtgcctagggccatggaagtcataacgtggccctttgagttaggcagttttaccagcagttttgagactatggcagcttggaatgggtccaaaaataagcatcagtggatgatggtagtggagatgcagtgaaatgaactggcttgggctttgatttagagtcagttggaccggctgatggattcatttgagaggtgaatgaaagagaaatcaggatgtctttacagcttttaaaatttgaggccagttatggtggcttacacttgtaatccctgcactttgggaggccaaggtgggtggatcgcttgagctcaggagttcaagaccagcctgggcaaaatgatgaaaccctgtctctacaaaatatacaaaaattagctgggcatggtggtggacacctgtaatcccagctacttaggaggctgaggcaagagaatcacttgaaccctggaggtggaggttgcagtgagccaagattgtgccactgcactccagcctgggtaaaagaacaagactgtgtctcaaaaaaaaaaaaagaaagaaaaagaaaaaagaaaaataaataaaattcgaaaccttgctggctctcttttaataggttttctttttcaatatttaaggaattttttttttcttttaagctgctgataacttacagcaatttggtaaggcatacttttgcaaccaaaaattcaaagatttgcttttccttcctacctaattcctccaaaatctggaaactattcatgaagattcttatttttatgacaatatggttatttgcataagttcaataagaagctcttctcttcaacaaaatacaactggaaatattggttatattaccaaagctttgactgcaatgtcatattgtattaatctgttctcaccctgctatgaagacatacctgagactgggtaatttataaagaaaagaggtttaattgactcacagttccacatgactgggaatgcctcaggaaacttacaatcatggtggaaggtacctcttcacggggtggcaggagagagaatggttgccgagcaaagggggaagccccttataaaaccatcagatctcgtgagaactcactattacaagcacagcatggcggaattccctcccaccccactgccagtgctgttccttcattcattcattatcaattgaattgatgccgattcaattatatccacctagtcctgcccttgacacttggggattattacaattcaaggtgacatttggttggggacacagacccaaaccatatcatatatatatatatacgtatatatatatattcatatatatatatacwatatatatattcatatatatatacatatatattcatatatatacatatatatatgaatatatatattcatatatatattcatatatatatgaatatatatatgaatatatatatatatagcaatgtcatattttaaaatgtgcatggaatcatagaatgccaattttcaagtgttctcagctttatagtgaataaaagtagtcacttccaggcaggcccagaagcctcaagatattagatattgcaggcaaagtctgatgtctgccttggtttgacttcctaacatcaagaggtttttaaaagtccaratttgttgtcacaatttccagcaaaataaatttaaaagaagcctatgtggttattcttgccgcacttatgtaaataatcaggtcaagtttgaaactaaattaattttaaaaataaattggtcttaccatgattatctttggtagaaatgggaatgactgtagagagaaaaattatgtttctgaagaaaaccatagtacacctgttactagattgcagctttgttcattgtttttgagtttttatcatctatctatagactagcctggatcctgagttcttgttgccttcaatatctgactgcaattctccaaccatgaacaaaaactgctaagctgaacaactcgatataaatttcaagggacaagtcccatgcttgatgagggagccacatagagagtttagcagaacacctgatgccacagccagagacatttaaactgcaaaccaggatgagaaattgctgacatcatgttgtggacagcgttttccaagactgtcagaataagactcgctaccatgataagactccttcccttcttaattttttcttgcttatgcccacctcttccacttggcaggataatgctgtagttaaaatttcacaattagtagtttttgtgggtaagttgataaagggtcaaacccaaacatttacaggacccaagagagcttttattccacctagtgggtaactttagcaacatccctaatgcaactgtttgttcaaattttactagtggcctcttttgtagagttagcactctttgctttaatttaacccatttctgagatgctagatgatagaattgctgcgtactaaccaaacggggaaatctgtgctgttgctgtcacttcttgttgtacataaataatctggtattgtagagactcagtttcaaaaagttagcaggctacttggttaaaacaggtagatttctcatctggctcattctttgatctatttgattttagttggtttggtttatggcaaccctagctaagaagcatactccgaactcttggcattgtcctcctgatagtcacaattctcaattatgttctctcaaaaagttttacatatttgcatacagccaattgttgaatgtcatatggtctctcttcagctgcaatgacagaaatacaaaatcatgaggacactgtaatctataaatgatgtgttgagactggaaacacagaatgatgttaaatgagggtagtgctaatgccctcagtcttagtcacaatttcacctaggttgttaaataaaaatcatgggatgccattgttttcaaccaaattcctgcatcaggcctccagatcagactaaaaatcaaaatggtgtcacccatgttcaccaaaacaaaactgagttatctggttttccaaaaaatggtaagagagatagccaattttccaaacagaagtttcaatctttaacaggcatgataatgaaatttcctgttttaatccttaaaatagaatacctgaagtaacccaatgttaaccaatcagttttctttctactgttctgtctccacgtctccaccttaaagaaaagtgactttgatataaccaatctgctttttgttgtttctgccttcttcagtctattttctgtctctaaagttaacatcctctgcttgattcattgcaacatttattctattttgtggaatgaagttttgtccaattctaggagtgcaataatgccaatgagatcttgaatctcaatttgttttacttttgtttcttgacaatggagaggtttaggctagagagcattttcaaagtcatgagcatatagacttcaagtcaaccagttagatgagatcacctggtgataaaatagagaagaatgcaaggaccgagccctggagcagtccaacatttaaagattgagccaaagaggagaaaccagcatatcaaaaaggaggcccagtgagggaacaggactatctgtgacgtgtaggtaagttcagggggaaaagtgtttcaaatcaaaggaaccatgtcaattattcgcgattctacagagaggtcaattgagatatggatagagaattggcaattgcctttggaaacaagatcattagtaatcttgataagtgatacagatgatggaagccaaagctcgatcagggtagactgagaagtgaatgtgaagtgagaggtaggaacaagcactattggagagatcttgaaaaacctttctaagaatttatgaagatagcagaaaaatagggcagttcctagaggcgattttggagtcaaaggaagtttattttagatgggagaaatttcaatatatttatatgctgataggagcaattcaattgagagggaaaaaactaacgatgctggagggtaggtaattgtaagagtaaaatccttaggaatgtgcgtgaaaaaaatccggtcactggtaaagggactggccttcctaggcgcagggacacttcattcatagcaacccaaatgttactatgcagataagggtggttttgatggtgagaagataagggagtttatttctgatatctttcattttttccatgagttatgaggcaaagttgattagtaaaagtgggggttggggaggaggtatatagaaggctttcagtagagacgaaaaggaatgaaataatccttccatcaagtctacttaaatgtcaatttagtggataaaaccctcccagaattaagtacatctcccaaaccctttctctctctcaatgaccttttgctcctttctggtactcactaacatttgcaattgtatctttgttcgttcacttctctgattccccattagagaactacagaagggcacggactttgatttcaaaatgtatatttagccgttagcacaaggcaagcagatggtcactaaataaatacttttttaaacaaaaatgttaatgaacaccttcaaaattttgtcttacgccacctcgttaaaatacttgtttgtgcaagtcacttttcctctctgagctttcatttctgaatctataccatgggaattatctcttccttgcctacctcccctcgttatcaagaggatctgagccaataatgatagaaatgcttcattaagggccccttaaatgtaatggatttctatttttagcccactggtagcctcgcaggtagcaggtgctgaaaaagccttgcttattgggggttgggggacagcattgtttctgtgaccgtaggcgtcgaagctatgcagaagcgttccgcggaccgcagagagatggggctcaggccagcatccctctcgctccggcccttcccgggaggagctggccgagctaggatggggggcagrgagaccgagggggcagtaactgtcaaacctcgccgcttggcgccattatttaaatggaacgtgcctgtctcgcagctgtacgtgcccggggcggggcttcgagcgccctgagcggggcggaggccagaggcgggctgggaaggtggaggggcgggccggggcggggccaggccggctagaggggcgggtctagcggcggcccccggcgaagttcactgcgcttgcgctgacagacgcaagatggcggacagtgcggaactaaaggtaaagcgcagctcgaattcacttctaatattcggccgcggagacggcgccgctgctgccaggggggatgggtccgaccctggggggcctctcgggcctgactccacccgggcctggagttgtagggagagaggcgcgcccggtctcagcagagggggcccgcctgcggcgggccgcgggccccgggtgcctcgggggcgctgacgggtcgtccccggcgtgttattgttgtgggcgcctctggcgggggtggcgggggaagagatagggagtccggaggtaggggctgcagctgtctcatgggctcggctttttcaccttccagttagcctccctgccccccatggggagctggggctgggggcagggtgctctcgtaggggggattgggaaagctccccgtggccgcttcctcttcctcctttgcagtcccgggctcctgtcaggcgctcttctcagacccccgggaacttggcttcggccgccccgcccctccgtggatcccagtagcccccgccccggactckgctttccccggctgctcgcttgtcaggaagcgcctggggtgccccgcttgtgggaagcgcgatcccggggcgatagggtggggatctgggggagaagctctggtaaagtttagcgagccccgggccggcgttggggttcggctgagaggtagtgagcgggacgttactctttctctctgattccgggcagccgaggggagaaaccccctcgaagagtgtgtctttggaagcagtgttgggagggggggatgcagctacctctctcccttcttttgccttagctggtgtggagggtgagaggagcctttgggggtctctgcacacaccatgatggcgatgctgtagctgatggaggtgaatggttcgtgtttatatccccccattgccttttgtttgtagggacatcttgctggccatgttgatttgaacgaaattctcccctcatgctactccaacccccgataaatagaacgttcctcttaacagtaccaattactcacgcctcacgaaattagatgaaagggtgcccccttttccccgcttttctcccaccccaatctttacctgatgatggcttctttaccgtagcagatataccactacacaagcagttgggggagggggtggtggaacccttatgactggattgtgacaaatggggctccgcttgaataattttggtttagtagcaggcagttcttaactaacgcgtattatttcgaggctctgaacgcgatcttctctgtggcttcctgtgtgtgtgaacccagcagctggttatgtctcgacccagagaactgacatctctgtcagagaggagatggggatatacaattgtaaatctttggggagagtcttctttttataataaataaaaattatttaattttttccccgttataatgaaacgacaacttctagaacaaccaaatgccagatttgattctgtagagtttttcctgtggaatatcctcaccgaaagagcttttctcctaataacttcacaatgtttacactccaagattcgtatgttaaggtattggctttgagtgtcattcttttaaaatgtacttctaattacaaatttactgaagggagagcagatttacaatggatggttttgatttttccccagtttcaaactattgactgaaatgagaaagccttaggaatttgaatatttggagataattaacccttgaaataaaaaaaagcacacaactttaagacatgttttctataatttttctcttagagtcactatgttgctgtgatctttgccttgtaatatttattttgttaggagttcttttgaatgatagctaatcagttgttatacatggaccatagaataaagctgaaaagcttgtgcagactatattgtcactcttgatgctgtccaaagaaactagtatggaaagcacatgctgagagatttccttctttgttctttctcattttaagaaagtgcctttggggatagatcagatccctggtgtgagtcttgttaggtaaagtttctctttacgaaaatgaaccagtatcagataaacaccaaacacttgaagaaatgttatttttctaaaattaatctcgttttttgtgctctcccaaatctactagagtttttccagaggaagttttttttttctactcttatgttcctgttgtataatttttcaaattataataactgttttgacatgttggtatgtcattgtgtgtgtctgagactttgaggagctgtgtgataaattgcttagctggtgatagcggcgttaaaaaaatttggttaatactttattgtggttagatttgctgttctttttttgaggggtggaggaggtgatctcaggaacgcctaccatagttatttgagaatgtgttaaaaaaaagagaatgtgtatatataattttctgtgcagtaaggtttggcagatactccttttggaaatgatattttctgaaggctttttgtttgtgattttttggaggtaaatatcatacattcctaatatgataggaaaaatcagagtaagaagaaaaaaatctagattttttgaaattttaaatgggaatagagtacttcaactgtgaagctttacataaaactcagtgacttttcattattttaggtttcagccccatacttcattttgctgtggattgtattcataattattttcctcatggcttttttagtgagtccttttaaatctataagaaatgtgcaaagatcagatgggaaaaacagatagatctttatcccctgtaggaattgtgcaagctgcaacacttcaagatattgccaataaaaattagattgtgagtcatacatatcaaaatgaattctctatgcacatttgtttatgaaaggtttaatttttcattaggggagtacccataaatgtcatttttaagaatgtggagggtattttgtcatctttaggaacttagaagcaggagggtgtgatggccagatgatcttggtagttaataagctgacagcttcatgaaactcctcttaaagtaatttaaaaaaaaatatgtgtttttttggagtaaaactcaaaccaagttatagtgccattttaatttacaggaagaagagtgggagagaagaagtccatcagcattttagtggagtaaataatgaaattaaatgggaagagaaaccrtaattataaaagttactatgagtgtgtcagtgaattctattgttattttctgcctctttattttcaagaaatagctacttaattttgatccttacgctgtaatttgtctgcttttatttcagatagagtcaagtacatctgatagtttattcatggatttgatttgaatctctataacttgcttttgtcaagtgccacatttagatggcttttgttttatgtcattatttttatcaacagtattttaaaaactctacagtatagtttataaaatactacgtatagtttctaagtatttcatatgattgttttgaaatacctccttcttttcatccaccgttttctcctgggcgatcccattgtctttttcttcaaagagtttcttgtaatccctgttgattgcggtagtgcttagtggcgagtccatagctgattaaccttgggtgtctcctggtgaactccatcagcatgctgctccagggttcttgctgaggcttttgagtttagtgtaatttgtacccttttttgctggtaaccagggataagaaaataaaatggccaatggttgtagcgggaactgggaaaaagtatccaagtctcagaaaaactgggtgtttatgatgagatgtagcctttcaaaacaacaaccaaaaacggattcattacttcatagaattgattgtggtgttttctgaagtgtttgactctggcatgaagcatcttgcttttttaatgtttgaataataatatcttacttatatagtactttgcagttcataatatattgcattatctcttttgatctttccaacagttctttgaggtaggaaaggcaagtaataactaaatcctttttatagatagagaaagtgagcccagaaagggtacgtgactattgcaaggtcatacaaataaaagtggcagggacttgagcctaggtcttgtgtagtcctccttaaaggtcctacagcagacctggagtcctctagggtgcccagttcacagatttctacttatgttgttgctgatactttcccttttggaaaagctctatgctagggtatttttggatattctagggcattttgcaagcttccttgcaaaaagtttggagtttgttagttggaatcatacacattaatttttgtaagtatcattttgcttgagaaaatttcagagaatctgagaagtaagcagaaaaataaacagtacctgtaatcccaacactcagagatatcatggttaacatctgggtatttatccacttaagactttctctctgtgagcatatgtatatgtatattcatcataaaaagatacaacactgttttttatttataatctgctattttcatgtctatccaggttagtaaatacaggtctatatgatcatttgaaaccttacattgtgttttattaaactagtccctgtcagattattctacttttttttttttttttttttttgagacggagtcttcctctgttgcccaggcagtagtgcagtggcgcgatctcggcgcactgcaagctccgcctcccgggttaacaccattctcctgcctcagccttcggtgtagctgggactacaggtgcccgccactacgccccgctaacttttttgtacgtttttagtagaaacggcgtttcaccgtgttagtcaggatggtctcgatctcctgaccttgtgatttgcccgtctcggcctcccaaagtgctgagattacaggcgtgagccaccaccgcgccaggcccagattattctcctttttttgcagtgtgtttgcagacatgtaccaaagtttgcagatgttttattttaactaaatatattgatatgacagatcttttttgtgctttagaaagcaatgcaggaccggatgccatggctcacacctgtaataccagcaccttgggaggctgaggtgggcggatcacgaggtcaggagttgaagaccagcctgaccaagatagtgaaaccccgtctctactaaaaatacaaaaaattagctgggcgtggtggtgggcgcctgtaatctcagctactcaggaggctgaggcaggagaatcgcttgaacctgggaggcagaggttgcagcgagattgcgccaccggactccagcctgggctacagtgtgagattccgtctcaaacaaaaaaaaaaaaaaaaaaaaagaaagcaatacaaatgtttattttatttttgtagagtcaggggtctcactgtgttgcccaggctggtctcaaattcctggcctcaaacagtgctgcctcggtttcccaaagtgttgggattacaggtgtgagacactgtgcctctgtgctcggtttttacaggtgtgaggtactgtgccactgcacccactctacaaaattagctaaaatgttgtcagtgaaataaattagtcattcttggtttgttcattgtcatacctttattgtttatgtttctgtaatatgtgagataagattattaaatgatggcagatacaggttttacaaaatgtaagcaaacattacttcagcatcagaatgtttgataaagtatgaaatcgattatgaagtagtattttataatctattcatactattctatgaatagtagaatttcaagtaggcaagtatgtttgattttggaaattatatcacagtgaccacatattgcaagtttttgtaccttatttagatgcttatcagttttttttgttttgctgggattacaggtgtgagccaccacgcccagctgatgcttatcagtttttaactggcattttaaaactatattgaacattgccagacgtggtaatcccagcactttgggagccaaggtggacagatcacgaggtcaggagttcgagaccagcctgaccaacatggtgaaaccctatctctactaaaaatacaaaaattagccgggcgtggtggtgcgcacctgtaatctcagctactcaggaggctgaggcaggagaattgcttgaacctgggaggcggaggttacagagagctgagaccgtgccactgtactccaggctgggcgacagagtgagactccgtctcaaaaacaaacaaacaaaaaatcccccaaaaaacaaacactatactgaacattaatatagagaaaatggaaataagacttcaccatatttttaatctcaaaacaaagtgttgccatttaaattgggaggtaacatagtttcaaggatccacaatctctgcctccggggttcaggcaattctcctgcctcagcctcccgagtagctgggattacaggcatgcgccactgcgcccagctaatttttgtatttttagtagagacagggtttcaccatgttggccaggttggtctctatctcttgacctcgtaatctgcccgccttggcctcccaaagttctgggattgtaggcgtgagccaccgtgcctggcccaggatctggttttagaaagataacataggcaatgaaagcatttttatttttagaaaaaacctttatgagttaaaccaattaataaatgcatatgtgaattaagaatgctatttgtgcaacatcygaaaagtagtgcatgtagaaggaacttgaaattgatcgtactctaaatttgattcgttcgactttggtcttcacctaaatctgtatttatgtaacgttttatcattaggatttctttgaaataggcagtagmgacaattttaaagtacttagttgtctttaaccatcaatttcagaagtagtattaattgccactgcactttttgctrgatgtttatgactatatttccccttccatgttaaaaattgtgcaactcctgttacttttgattccctctactcttggtttcagtagtgtcacatgaaaagaaaattccctagaacccttccttcagagttttctggtaagtcttcattcttagctatgaacttctaaaattcgtcaaaatgaagaaaccacctttttatttttcagcttttctttagatcaagcaaacaaaacaaacataaatcctttgaatattaactaatgatggagatatcagtaactctcataggactgttgtaaacgttcctatttttgaaaacttaatctcttttttaccttttttgctattcactgctttcagtttacccgctttggttgccgggttaatttcaccaaaacactcctttcattctgtcactcctatctataaaaactttgaatggctttctatcgaaaactggataaagwcttagttctcagtctagtattcaagattttctattgtctggccccattccactttgtgtgtgtgttttgtctcttcagctgtatagcaaaagcccttaacttaaagccagagctgttagtttgcgtctttttgttggctggtgttctgtttgtacaccccccattctcccatccctaccctgtggacacaataggtgtttttaatatacatgtgtcagatgaacaaattatgtttaagatttgtttctgtcagagactggggcctgatactcttgtctataagacaatctaaattgaaaatatttttagggtcatatcttcgctcttttttcttgctgctgcttagatgaacttgaataacattaaatccagaataatttatcaagggctgtttyagatttaccttttacattattttaagttatagagataataagtgactacacttctcattgtaatgatctaacagtaaatagggtaaaaatggaaagacctcatcatcttcattcttagagggaatcattttggtgtatatctgtgtattcttatttgggtgggcagggggaggtgacagctttattgagataaaattaacatatcccattacagttcacctcgttaaagtgcacagtcaggtagtttttggtatattcacaaagttgtgtaaccattaaccacaatcagttctagaatattttttcacctcgaaaagcaaccctacatccttttagcatcatccccttcccaaaccttacctcactcttagccctaggcgactgataatctattttgagtctctgtagacttgcctattttgggcatttaatataaatggaataaaaatatgtcactttttgtgtctggtcttgtattcatttttttctctgcatgggcatttaaatgtgtatgtctgtataatatttttaatttattgtgtgtgtgtatgtctagatgagaacaaaactaggcacatagaaggaacttaagtgaatgtacatgtacataaatatcttttctaaaactgtgagaccataccatatgtagcatcctacagtttgcttttttttacaatagatagtgaagatctttccatgacatgtccagacaatgagatggtctcattctttttaacagtgtgtaatatttcctatgtatgtttatagagatttacctcttgaatttatcagtgtatatggttaaaagttcttaacaacttgttttgatggttttgctatacactactggtttttttaaaaaaataattgccacatttaatgtaacctctgtagtattaatgctggagtttcacttaacaataggaatgaaaacatcacaggtaagggttgtatagcttgaggagaaatggaatgcagggtctttatgcagttctggcagtgctcagccaaagcaattcattttgtatttgggtttctgaatgtgagcaagcctgtttttaaaaaagctcatggcatagtgcttaaaatagaacttaacatgctatcttgtgctttatggtgaattttaagactttttcttgcagtcatgcaagtctaatcttaaagattggaaagatttcagagtaaatattttttctcatatgttaaaatcatcattctggtctatgggcttctgtaagttacccaagaaggggactgaagaggcacagaactggctcagaaactggcttatagtagattctcagtaattgttatttattaaagaattatttatcacattctgttatttattatatttttgggtatctgctgtgtatgaggtaccaggttattggtgattttaatatattatcacatatgtgtgtatatttatttaaatatttctgttatagcggaatgtttactaaaaattatctttttaaaaattatacaagtaatgcatcagttcttacagaggttttcaaagtctatttctcaggcctctggtggttccccgaagtttttctgagggttctccaggtcaaaatgattttcctaataataggcattatttacgtgctgacatttgcaaaatcagtggtgggtaaaactgccagcaccttggcacaaattaaggcattggtactaaattgtactagtagttgtgttcttcatcactgtgcacttggaattaaaaaaaaaaaatgccagttaaactttatgtccttgatgaagcaataaaacttactaattttattgtatctcaatccttgagtacatttaaaaatatattttgtatgatgaaatgaaaagtacctgtaaaacacttttattgaatatcaaatctgatggttaactcaaggaaaagaacttgtgcagttgagttgtgagctttttaaatggaataccatttttacttgaaaaaatggctggcaaagtatggttatacagactagggtatttggcatacattttcatgaaaataaacaaagtgtgcctgtcactacagggaaaacaactgacaatatttgttactaatgataaaatttaagctttcaaatgaaaatagaactttggaagacatgtatttgccactgtgagcttgacagtttcccaatacttgacttttttgataagatcagtgtgatattaatgaatgtgttatgttgaagttgcatagtgaaatatgtcaacatttggaagaactgcataactcagtgaactaatattttccaaataaccaatgcatgatattacaaaatcatgcctggataaaaagatccattggaaatggaagatagaccaatgaatttcagtttatcagagtgggaaatattcattgatacggtttcagattcctgcgttgcagcagcctttaagaacctgccatttgttgtgttttggtgaaggatcaaagaatatcgaaagttatctgaaaaggctagagcattttaataaaaatactctattttttcccaactctatagagcttcataaggctagatttcctttatattcttcatccaaaacaatctaatacacagattgaatggaaaagtagatgtgagaatcaagatgtctttattaagctagatgttaaagagatttgcaaaaatgtaaaaccatgatagtcttctaatttttattaaaaatattttttaaatatgagatttatgttaacaagtaatggattaattaattaatttgttttttgagatgggctttgccatgtcgcccaggctggtctcgaagtcgggggctccagtgatcgcctgcctcggcctcccaaagtgttaggattacggcgtgagacaccatgcccagctattatttttttttaaatgacaaatcttttaaagttttctgctttaactgcaaatacagtaaatattgatagatttaatcgacataaagtttttttgcgggggggatggtcctccactttcaagagtcccaagagcaaaaactttgaaaacttgatcttttttaaaatttaaaatttacagtacagcagtgcctaatttaaaatgggacgatccctttcaccttcccactcatggtattttttataacttaaaaggaaaaataaggctgggggcagtggctcacacctgtaattccagtgctttgggggagacctaggcaggcagagtgcttaagctcaggggttccagaccagcctggacaacatggcaaaaccacatctctaccaaaaatacaaaaaattagctgggcatgttgatgcgcacctgtggttccagctgcttgggaggctgaagtggtaggattttttgatcctgggagacagaggtagcagtgaactgagatccactgcactccaactgggtgacagagtgagaccctgtctcgagaaaaaaaaaaaaaaagaaaaaatttatttctagtgatctcttacaaggcagtttgctaagcagagttatttaattaaatcctgcatctctgtaagtaatgctaaacggtagtagcttgcattgcactgaacgaatgtgcttgaagtactttttttttttttttttttttggagacagggtctccctctcttgcccaggctggagtgcagtggtatgatcatggctcactgcagcttcgaactcctgggctcaaatgatccttccacctcagcctcctgagtagctaggacttcaggtgcttgccaccatgctcagctgactaaaagcttttttttttttttttttttttggagatagggtcttgctgtgttgcccaggctgctctcagactcatgtgatcctcatgcctcagcctcctaaaagtgttggaattcaaggtgttgagccactgcacctggcttgaagtacttgtaatcagtaatggtgtgggaaatatataacttaattttttcaaggttatgttttttcttttttcttttttttgagacagagtctcgctctgttgcccaggttggagtgcagtgacatgatctcggctcaccacaacctccgcctcctggattcaagcaattcttctgcttcagcctcccgagtaggatgcgcaccactgtgcccagctaatatttgtgtttttagtagagatgggctttcaccatgttggccaggctggtcttgaactgctgacctcagatcatccacctgcctcagcctcccaaagtgctgggattacaggtgtgagccaccatgcctggcctgattgctttttctgtagtaaaatataagaatcatatgaataaatgaaaaattccctaacttaatattagccaagaacttcctctccagcagagcttagctcttaccaaatatatatgattgatttgcattctacctattttgtttttttcctttcccttttgtgggataaacttgaaacaggacctagaaattgtaagactctgaatgcttttcagtttctttctgcatttctttagagtggtgtgtgaaaaacttcagcctctgttccttaaacatctttccccagggtgtcaaagtaagactggaaaaggaatatttttgtcccagaagttattctaatatgtgatttcaaaatcaggtagcatcttaaaggttaaagacctttaaaaaaaaagtatagtattttgtgtctaattgaatcataatcagggaaaagaacatgaattttagaattgccattagtcttcacctctgaatttagatagtcccaggaatgagattaatggtcttctaagtgtgagtaggtctggtctgtccattttttcccgagaggaattctataatctcttgttgaggctacttacctggctgataatgtttggggaacaaggcagkataaaggtgtcccacttatgagtatgcagactttgcttaatctccacttttagatttgtgcctcacccttgatcttagttccatgctggtctgagtctggagcctctctggttcagttgttccagtaatcctctggcctcttgtgttacgagaggctagtgggcatggtagggaagttgtctcatggatatttagttagaggagacctgagggtgtaaccatcctgtatgttcagattttctaacagcccccttgtaccttgccccctgtgtttttagatatgcttgcctttctttagtattcccctctctaggcatttgtaggttgtagcttcctcttctgatttagttaccactgcattgcctgcttttcatcatcaaaaagtttgttgaaatttctagttggttattttttttctttttgtccttgtggattaaagatttttctttttttcttccctcactgtcattttgtttctctttatggggggaatatggcagacatttgtatatggtgaattcatatttaactggaggtcattgtaaactttctgtgaagcttataatacaaactatattaatatataataatgattcttaaatagatgcctatgttgaattaagatttatattgagtggtagtagaaatcgtgttattttctaagagaaagctaggttgcttttttaaaaaaaattaaattatatacagcgtagtatgtataaccttatagaaaaatgtgtaacttatagaaaggtagtaaaacaaacatcaagcctaataaatagagcattctaaaaccttgaggccttcctttgtgcaccctcatcctctcttccccatttcttctaggtaacttgtatcaatagtgtattttaaaggtgaaaactaggagtgaaacagtagttttgtatattattatttgtaatgttgtcttaaaaccattgcatctaatattttatatcatagtcttgtaaatttccaaatttactgtagcattcttcaaagaggaggattccgtaggagaaggtggagaggaaagttttggagacctgaaaatatgtatagggtgaacgtggtggttcacatctgtagtcccagcactttgggaggctgaagtgtgcagattgcttgagtgcaggagtttgagaccagcctgggcgatatgacaaaaacctgtgtctacaaaaaaatacaaaaagtagctggctgaggcatgtgcctgtggcccagctacttgggaggctgaggtgggaggatcgcttgagccaggaggttgaggctgtagtgagctgtgatggcgccactgtactccagcctgaaggacagagcatggccaatatacgtgctcatagatttcagtaagtacatctggtgatgtttgtggaagaagggacttaagttaattaccacagtgatttacccggggttaagtctttttttttgagactgagtttgcactcctgtcacccaggttggagtacaatggcgctatctcggctcactgcaacctctgcctcctgggttcaagtgattctccaccctcagcctcccgagtagctgggattacgggtgtctgccaccatgcttggccaatttttgtatttttagtagagaagggattttgccctgttggccaggctggtctcgaactcatgacctcaggtgttccacccacctcagcctcccaaagtgctgggattacaggcatgagccaccgcccctgccctgggttaagtcttgaaaagtgctcaggcttatgtgtcaatgctctcatccacgaagaagttgaatcgtcagagttatgagaaaagtccagctttttggcaagaccattaaagtctgtgttacaccttaaatgtttttgtcctttttttttttttttttttgaggtggagtcttgctctgtcacccaggctggagtgcagtggcacaatattggctcactgcaacctccacctcctgggttcaagccattctcctggctcagctgccccagtagctgggattacaggtgcgcaccaccgtgcccagctaatttttgtatttttagtagagacggggtttcaccatgttggccaggctggtctcgaactccagacgtcgtgatccgcccacctcagcctcccaaagtgctgggattacaggcgtgagccaccgcacccggccttgtccattatttttttggatacatttaaaaaactcttagtaaaacataaaaatagttattcctttactgggcttataataagtattctttgtggctataggtattctctgctaaatcttgcaaacaagcattctcccttacgctcccctcctccttccttttgcccgtttgacctttggtatcacatttacttaaagcaaggttcttatccagtcattctatcaataaaaatgagtgctgatttatatgccaaatcagctgtgttaaatgctcacacatcatttgggaatgaaatagagtttttgcttttgtgaaattacattctaggctgggcacggtggctcatgcctgtaatcccagcactttgggaggctgaggcgggcggatgacaaggtcaggagatcgagaccatcccggctaacacggtgaaaccgcgtctctactaaaaatacaaaaaattagccgggcgtggtggcgcgggagcctgtagtcccagctacttgggaggctgaggcaggagaatggtgtgaacctgggaggcggagcttgcagtgagccgacattgtgccactgcactccagcctgggtgacagagcaagactccgtctcaaaaaaaaaaaaaaaaaaagaaattacattctagtactcctgtaactatatgaaaaatagtttggttctcttgtacctttccatatttgaatttttatagagagcagatgttttaataattaggaagaactttattttgggaaatgttttctggaatatgaattaacaatgttaaatgcattgttaaagtttaatagtcatttgttgtatatatgcttcctaaaggtagtttttggaggaaggagatgtgggaggagcaaggaaaagatatgaaagagttattgtaggaagtttgattgctggctcactggaaagtttagtgagatgcctgtgcccattgagattgacgactgtggatgtaaaataacatccatctgcatgagtgcatgcattcttttctcctacaaagtgggaactagttgaatgtgccaggcatggagggacaatggaattttgcaaagaaatgtttaggggctaatggatagggcatgacaacatcaatgaattagagatctttgtgaattgaattcttgaaatgaagcaagtaagaaaaggaggttgtagttggaaaatgaaatgttcgagttagtgattttgagggtggtgcaggttctgctggaaatgtctaagatgtggcctcggaagtgggtagctgagggtggaaagtaatgatgaggagttaagttggagcctgaatggccaaggcaggtactaaaactttacttcagtgaatgacaggatgacctagaagatggactgtccagtactatggccactagttctgtgtgggtattgagaacttgaaatatggttagtcctaattaagatttgctgtaagtgtaaaacatactggatttcgaagacatagtatgaaaaaaagaatggaaaatatctcattaatgattgatattgattgcatgttgaaataatattttgtttattggattaagtaaatatatatcattaaaattaatttcacctacttgtaattttttgaaatagagatgtggcctcactatgttggccaggctggtcttgaactcctgggctcaagtgattgtcctacctcagcctctgaaagcgttgggattacaggcatgagccactgtgcctggcctttttactttttaaaatgtggctagtagcacatttaaaattacgtgtgtgtctcaatatttgcagcttacattgtatttcctttgaacagcacttttctagagatattactgctcataagtagaatgggaattaggtgggaggacaattgtaggggtttgtagaacccagtggcagaatcctttgggagagggagtggacattgaggcttattttcattgagttgctggtgctttctcttctgctgttgtttgttcttggaattaatgaccttcttttcacccccgcccccccgcccctacctcccttccctccatggagtggctaaccccagggagtttgcttcattctttttttttttttttttgacagagtctcactctgtcrcccaggtttaagcaattctctgcttcagcctcctgagtagctgggattacaggtgcatgccaccatgcctggctaattttttgtatttttagtagagacggggtttcaccatgttggccaggctggtcttgaactcctgaccttgtgatccacctgcctcggcctcccaaagtgctgggattacaggcgtgagccactgcgcctggccagcttcattcttttgaggagaaaaataataaacgataatagaaagcagtaccaacaaaacaaataaccatgtaaatctaagtagttaacaatgtattcataagannnnnnnnnnnnnnnnnnnnaaaacagaaattagccatggggagtgacgtcaatctgtagtcccagctacttgggaggctgaggtgggagggctgcttgagcctgggaggtcaaggctgcagtgagccatgatcatgctactgcattccaacctgggtgacagagtgagaccctgtctttaaaaaaagaaaattaaaaaaggtgattactgggatattctttgaagcaagggtaacagcatgagcaaaggtaatgaggagagaaaacattgaggtatgtttgcggaacagctactagatccacatgtggatatctgtgtaagagagtaataagagttaatgggaagttggccgggcgcagtggttcatgcctgtaatcccagcgctttgggaggctgagatgggcggatcatgaggtcaggagatcgagaccatcctggctaacatggtgaaaccccgtctctactaaaaatccaaaaaaaattagctgggcgtggtggcgggcacctgtagtcccagctactcgggagtctgaggcaggagaatggcgtgaacccaggaggcggagcttgcagtgagctgaaatcaggccactgcactccagcctgggtgacagagcgagactccttctcaaaaaaaaaaaaaaaaaaaaaaaaaaaagagttatgggaagttggggccagattgttatgagaattttccacattgaaactatgtatggagtctgaaactatgttgaatgctataaaggaaagggacagaattctgtaagaacattaactaggaaacctgactgagttagtgtactcaaagaagtcttccctatttctgaaccatctgaactacagacttcctccacatccaagtcttttcaaatcttcttaatgttatgccttcctttccttctcagttgttaccgtcactatttcagactcttgtagtgtcaattttgtattcataaaacagcctctaaattggtatcatatcttacatcccttttcaaattatttactcttcaattagatttatttttttatgtccgtttcctccctttaacattttctgcaattgaaaatgtttttacaacttctcattctttgtaggattaagtataaacttcagttttgcccttaaaactaaaaaattattgtttgaacactagttgctgagtttggatgccagtatgctcagtaggcactgggtacatttatataatgtccttatttgtgagaggttatatgtataatttctttttttatttttttgagatggagtcttgctctgtcgcccaggctggagtgcagtggcgcaatctcggcccactgcaacctccgcctcctgggttcatgccattctcctgcctcagcctcctgagtagctgggactacaggtacctgccaccacgcccggctcatttttttgtattttttagtagagacggggtttcactgtattagccaggatggtctcgatctcctgacctcgtgatctacccatctcggcctcccgaagtgctgggattacaggtgtgagccaccgtgcccggcgaggttatatgtgtaatttctaatatatttgcattaccaatatggtttgtaataattgacaggtgccaaaccgttgttactcatatttattaatgatgaacaagacagtctctatagacagagcatgtattttggttaagaattgacaagtaaacagggcctctctacatatggcataagagcggtaaactgagttaaacaggagagcacataaaagcgtaaatttttttaatgttaggagtggattaaggaaaatatcccaaaggttgtgacatcaaaattgagaacttactgatttggagttagctagtaaaaggctgggataggaggggggagaagagcttctccttgaaagaacagcatatataaaagtcctggaagatggagagttggttaaaagattggttacggtggtcatgctaaggagatggggcctctgagtgcagtaggtgatcatggaaaagtttaagcacaagcgtgacatcattggatttatattttagaatgatcactggcaatagtgaggagaatgacttggagaggataatattggaggcagggagaaaagttaagagtctcttgcagactctgaattagagtggtaatagggactaagatattttaaggtgttaagattgacaggacttggtaaatagattggaggtgaacaagaagatggtgtagcagcttctggcattgacgggtgattaggtggatggaaggtttggagagagttgatgtgttagattcgaatatgttgagttgatgactcttgggatataaggagaggtgtttagcagatgtggatttggagtttaggagaccaaggttaggctggaaataaagatttggaaattgttaatttagagatagcgttttgaagttacgagtggatgagatcactcaggaagactgagctgagtgaaaggattactttagacttaggattcagtgatattgttcttcttctgtcatagagtttatctctacttttttttccttttttaaaaattaaatttaaaaaaattttatttttagacagggtcatgctcttccgcccaggctggaggcttgatctgctgggctcaagccatcctcccacctcagcctcctgagtagcctcccaaaatgctgggattacaggaagtaaaataacttttatttttaaacttttaagaacattggctgcattgagtatttggagaagtactctggwatttgattagctatatgttcaaggaatggtattaagaatgagttttcagtaattgttctttttgactgattatgataaacctcatattttatttcactttctaatgtccacaaaagataaaagactttttttataaaaccataaccacagatcatttcttcttttggctagtttatgaattgtcctttagacatggacaattaaactttttttttctttttgacagagtaagttgtagatagataaactttgtttttctctttttgtgcttttaaaaaaattgcttcttatctggaactttagcattcctttttttttttctttttgcttttttgtttaatgttttggatatgttaaaatggatgctaaaaagtatagtctgtttgggtttttagcctcagagttttgtgagtagctcattttccttttccataaatttcacgaagaatgtgtaatatgttttcatgagcctcaccttgaaaatgaatttttatgtacattaatggaatttttgaaagaaaataaaaacattttctttctttctttcttttttttttttttttttttttttttgaggcggagtctctcttttgcccaggctggagcgaagtggcgtgatcttggctcactgcaacctccgcccccacaggttcaagcaattctcctgcctcagcctcctgagtagctggaattacaggcacccaccaccacacctggctaatttttgtatttttagtaaagatggcggttcaccatgctggccaggctggtctcgaactcctgatctcaggtgatccgcccacctcggcctcccaaagtgctgggattacaggcgtgagccactgtgcccagccaaaacattttcttaaacttgcttttgctactgtagtaactttgtaaattttactttaaatcataaaacttaaattttaatcataataatctgttctgaagataatgatcataatgatctgtaagttttgtggaaagttagcagttttactttacatagactaaaggatgcttttgttgtgaaattatttctcttatctgtaactagtagaatattcaagtgaaagtcttccattctgtgtagaaaagaaagggtcgttattattaataggcttctgatggaattttaaaaaatatttaggcaagctgtcattgcaagacctgaataactttttgctgtaacctatttttttctttttaatatttctctgtgtagtttgtaaggaatcattcctagggcttttttttttttttttaagatggagttttactctgctgcgcaggctggagtgcaatgatgcgatcttggctcactacaacctcggccccccggggttcaagtgctattcctgcctcagcctctcaagtagctgggattacaggtgcccaggaccgtgcctggttcatttttatgtttttagtggagatggggttttaccatgttggccggtctggtcttgaactcctgacctcaggtgatctgcccgctgccgcctccccaaagtgttgagattacaggcgtgagccaccgctcctggccacctagggcttttagaacatttgtgtacgtctttttaaaaacttgtttctgtctaaaacttataaatcaggactgaaatatgataaccttaattttcttgtgcactctggaagatgtttatttttaccttaagataggggaatcaggctgggcgcggtggctcacgaatgtaatcctatcactttgggaggccgaggtgggtggatcatgtcaggagattgagaccatcctggctgacacggtgaaagcgcgtctttactaaaaatataaaagattagccaggcatggtggcatgcacctgtagtcccagctactcgggaggctgaggcaggagaatcacttgaacccaggaggcacaggttgccaagactgcgccactgcactccagccctgggcgacagagtgagactctgtctcaaaaaaagaaagaacaacaacaaaaaagattggggaatcctaggagaaaagagtcatcttaatcgcaaatagttgaataatcttcatttgtagccttaaattttattgttacttggaggataatctcttatgatatgctcagggccctagagagttgacactgtcatattccaagttcttaaggatgacttgggtgaatatttaagggcacaattctcagattttatatatgacacggaactggaaagggtgtgttaagattataaaaggaagaggaattcatatcatcatctgttgggcacttacttggtgtcattaactatacttgcataggggatatggagatgagtgtttacccttgaaaaactcaaaatctatgggaggacataaactggaaaatcagtgttttaccacatttcgtgataattgtacaatagaggggtgtaggatacaatttttcaaaaggggtttgaaaggctggaatgaagagctgaaaaacatgaagtttaatggcatgaaacattacgttctacttttaaattaaaaaaattgtattcgaggatgaggtggtttgactttatactgtagccatttatgtgaaaaagatagaataaaggttttagttaacataagcaacaggatgatgtggatgcagccccctccctgctgaaataaaagaataacacataccatacatcccctcttgtccaaataaaacaaacctaaaacgtgaatgacttgttaggttatattggtaaaaataccatgttcatattaagagggatagtaatactgctgtgttggagactagtcacaccatatctagattatttcattcacttctgagtactatggactgcagaatgcttgagaatgatcaggagtgggaaggggtctagctagttgaaggaaaagagtccttttaacacattttaagcattttaagagtcaattttggtataccaagaggacgaaattttagagccattgggcggactttaaagggaactttcaattcctagagcttttcgctaatgtgggcagcttttaaaggttgtgaactcttagaagtgttttagcagaggctgggggcccagtcaagaaagttggagtaaaacttcatatattagatggagttttagacaagaagatctttaagttctgtttttgatactctgttgctgttatttccaaaaacattttcatactatgtgatagtgtctgtagttgttattaccatgtagcattgtgtggacattggcatttgccttttgagtctgagctccactacttgctagctctgttaccttcagtaggttactcctgttactcggaaatagttcagtaccacccctctaggacttttccttaatctctatactaggacccagactgaaggctgtaatttagactctttagtttagaagatgcattcttgtcactttttgttttgttaatacgtgtttcttcttttaggcttttcagctttctctcagatagggtatactgttcattgtctcttgtcttatctgaaacttagatcatctaattgcaaatgcagtgttttgtttgtttttggtaaggggacagttaggaaagaataatcatcttttagaatttaatagacttaaaacttcttaaagccctacttagtatttttaaattctagattttatttgaaaagtgaatgatgattgttctcatgatcaagtacagtactaatttttaaaagacctacctgtttgtagaatattgaacatggcctgtastttttctttgcagtatttcttggtcctgtctcctgtatttccactgcacagttccttcttaccttacatgtagataaatcctgcgtgttgccatgtcttttagccagaaggtttatttcttagtttttttcttatttcagccatcctattggtggttacttcggtaacttccttaagcactatttcaattacatctttactgcctctaaaatatgcatttattccactgcctgctcatgttatactgtataaattccttgactgtcatttagtgcccccgtcacccatttcctgtccgtgtctcagtgtaacatatactcagctctggctgagcttgtgataagacattgtattagttatgaactctggaatcaggtcagatttgagccctatctccatcatgtagttactgtgtgattttagatgtaatgtcagttttcttatctatacagtgagaataataatgctctgtcttgtaggttcatatgaggattaaataagataatcatgcttactataattagtatgttactggtacattataagtatttaatacatattatgttttgtcatttttagtctgtcaacccatgtaaatgacgctaaaaattatgattgaaaacatttttaatatagaaagatttcactaactgtatgtattgtatttccccaactgtagaagagtagaagaatgagaagaaaatttcatttaatacagttacaatgttgaattttgaaattttaaggaatctttgagaacctctagttaatccctctttttttttttttttcaaagtgagaaaacagaacctgtaagattgtaatttggtaaattagtggccaagtcagtaccagaatccaaattctgtatttgccagtaccattatattgtattgcacatttattcagcatattttaggtattcagtaacttttgagaattgaattaatacgatgattacgcatgtttctgaagactagtttatttctatgtgttcattgttcctgtcttctcttcctatacatactcatttagggcctgtgcattgatccaaaaagcatttattgaacatctgtgtgcagagcagcctttttcttaaataagagccatattttcccacctctgcataagaagtctggcaatgtgttagaaatttrcactctaaattttaaaattaaactaagccctttaaaattttttttccttttttctttttgagacagtgtctcactctgttgcctagactggagtccagtggtgtgatcacagcttaccacagcctcgaactcctgggctcaagggatcctcctgcttcagtctcctgagttcctgggtctgtaggtgtgtgccaccaatgggcctggctaattattttttattttttatttttagtagagatgaggtattgctgtattgcccaggctggtctcaaactcctgggctcaagtgttcctcctgcctcagcctcccacagtgctgggattacaggtgtgagccacyacacctggcctaaactttttaggaaaaatattgtactccaatgttataacattctgagttggatttgttatttatttttttgagacagagtttcgctgttgttgcccaggctggagtacaatggtgcgatctcagctccctgcaaccttcacctcctgggctcaagcgattctcctgcctcagcctcccgagtagctaggattacaggcatgcaccaccatgcccggctaattttgtatttttagtagagatggggtttcaccatgttggtcaggctggtctcaaactcctgacctcaagtggtctgcctgtctcagcctcctaaagtgctgggattacaggcctgagccactgcgcctggctggatttgttatttttaatgttcaggttatcgtccagaaggagctttttgaaggatagaagtttcatgaaatgtggtagtatataaataaggatgatgtttaaattatctatcaaaaattaaagccatggtgtaccatttcaacagtgtttatactttgtttaaagaagaatgggatctctatttatgtataattgcaatattttgtcattttgtgggacctcaatgcagtcaataagatggacctggagaggtggaagataattaactagaggagtaggcactacaggtcattttccggttgtcttatgctgcaaaatagataaaagttgagaaattgggtgaaacaagattatggagaagtatgtaaccaacctgatttgctgctttgaatagaaactgtctaactaggttttctggttgaatggggcattgttgacagattgctaatagctgcttattaacaatttgtaatgagaagatttagaaatcatccaaaagtaagccccattgaatgaagaatctgactttgaaaataataaaatacttttgttgttgtgtgcaagctttaatgtgtgcagttacagaatttgtgattatgcatttgcttttgtggatgaaaggcaaaagtataaatgaaatattatgacattattaaatccctattttgtctgtctttggaattcattctggtttacaattcgttataaattgataccagataaagactcataatatagtctgcttaatgactaatcctgtaaaccactgcagtgggatgtgtgaacaagagtaattatgttgttcaacaagaagtacctaattcttatccacagtgtagatataaccttcaataatggaaggtcacagctaatgagacaataaaactggcactttctgtttagttgcaaaagcctgtttgcttgttgacgttgtttgagtattgtctgtatttatctttctcagaacatggcccctgcctctgtgtagttgggacagagtttgcgtacatatatatctgtgtttttgtaaagttttacatatctgaaaaggggattgaataaaatgttattgtcttgaatgtattgaacctcccattctgcactactctgcccttagaacactagaagccagccttataccaccaaagcaggagattgggttgttcctytctgtcaaaagtgatcagacaaaaggaagcaaagggaatccaaacaaaatagccaggttattgcccagtcattctagatgaagtaccctggtctgctcactcacatagattttcccatcatctttttagtatcttactcttaactatgtatgcacagcccaggattgtctctcatttaaggaaagcttcaggcatgaaaggcagataccagtgtagggagaagaagaaaacaacatcaacacccaatttatattctcaaaaaagaaaaataacaaaatgtagaggaaaaagaaaagagaaatgcagaaaattaaaagagttcatggaaattaaaaatttaatgtaagcgttaggagataaaattgaggaaaatcccagaagatagagcyaaaagacaagagatgtaaaaatgcacaaggaaaaagaaaatagagtaaaggaaaaatgagattatcagtctaggaagacctgtgtctgaataataagtgtataagaaagagaacacaaagacatggaaggaagattattgtaagaaaacttcccagaactgaaggggacatacatctctaagtttaaaaggatcgacagttatcagtttatgcaattaaaaaaaaaaaagaccaaccccaaggcacaacattgtaaaatttcagaacagattaagagaagctgctatgattccagatggggatatatagttgactatgaaggattatgggtcagattggtactaggcttcttaacactggaagccagaaaacaataaggaaaggccttcaaaatcttgacacaacatgatttcctgcccagcactctgtactgagccaaactcagtcgtaagggtaaatgaagattttaaaaatacaatgcaaggaataaaaacatcgtacctcacatgccccctttctcagaaagctgctagaggaaataccccactaaaaagagaaaaccaagaaaggggaagtagtggcataaggaaacgggatccagtataaaagagagacaagggaattcctgggataagctaaagggaaattccatgaccataattgtgcaccaggcttggagagcctacagtccaaattggaatatggtggagggctacaggaaagaaaactgatttacctgatgtatttgaatatattgagaagaaagttaatacttttagctgtttgcagatgaattagcagtaggtacctagaaacctaagcaaatggaaaaatggtgtagttattaactgtaaggaaagcaaagttatacagaaaagagtaatcatgatgtacttttggctcagctgtgaatattatttacagccatagtaataatgtaagtactgacaattgattcaaccaaaaattatgatagaaagatgagggagagaagatgtaacagagctaaaccattatattttataataggaagtcagtagagtcctcaaagaaaaaattaaacagctgcatagacctactacatagaatatagagaaaaaaatgccagaagaactagctaaaaagacttgaaagtggttgcctcggggatttgaaaattgtggggtatgttaaagggggaagggactgctgtttttcttgtaaaactttttggttttttaaattgtgttcacgtctgtcagattatgaaaattagttttaagaggttgctccttacagaatgctcttgcattcaaaatatatacagttctgaggcattctaaatcccctaggattctgagatctctatcaattgaggacgtagagtcagcagaatgctacaaaattgctgaggaagtaatgatttctaatagtagtagtggttgatgcaatccttagttgtaaatatttattttgttgtagtgctaacaaatggagatttttaaacaccttaaatgcagattaaaatatatttcatttcaacaactcagatgtgttagtgtttagttttcctcagtgttgtcaacacttttcattgtgaattgactgctttatgcttctttgcagcttttctgttgaaagatgcttcagtgtttcccgcccccttcttttatttcattttaaaaaatactgcatgcttatcacagtccttaagagtatgcaacagctgttccaataatagcaatagatagcacctgatttttcattatacctgattataagttgcaatggttaatttgaatccacattcttttcttatcttaatcgccagtttttaaaagccaaaatgttgaagcttgaaatggagattgagttaaataaattaatcttcaaataggtttttctgttatccaattaaaggcatgtggttcgtttcctcttaatgtcaacatattatagcatgaaagaaagtacatttggagtagaaccagttgcatgacattcaacacgtttcttaaccttgctaagtcttattttcccacctgaaaagtgagaacagtacctgcctgataattatgacaattgatgatgaatcctgtaaaaaaaaaaaaaaacacccagttactcaggaggccgaggcaggatcacttgagcctaggtgtttgagaacagtctgggcaacatagcaagaccctatctcttaaataacaaacaaaactaaaaagcttggcttgctgatagcagctactatttgagtacctactatgtaccaagtattgttattgctgctgctactctttgtttcagagagagacaaaaaatgtaattgagggcgctcaagtttattgttgtgtcataaacttttttggaccatcaagcaagagattttatgagaaatgtcaacatattcttctacaaaaataggaaaatgatacatctgcattgcatctgaatctttgtacctatggaataaagacaaaagctgtcatcaatgcagagtttacagtagtcactgaattttgctggtttgtttttgatttaggagaatggagttgaaatagttctcttcaaaatttgtactttttttttctgtaaaatgcagtacatttgacccatgccaacttaaatttatttttaacctctaatccttgaagtttcatgttatttatttaaaagcagtttacttattaatagtacatttcagtttgaagtccctgttcctttttaaataataaaagtctttagaagtattttgtactcttttggtgagtagggagaaattgatatcctgctgatattatagttagtaattgtttacaatctttgataacattaaaaagagaaaacatttctaagatttgggtggaatttgttaaggtttacgttatatctttgcatgcctctacagaacatgaatttgagcatttatttggataagttatcgctgtagatgctacctcccaccctttcttctggtgtcctttcttacttgtttatttgttcgttcattcattcactcattgattatgcaggcatttgaagagtttccactgttgtcaggccctagttgtagatgctgagggtaatatggttgtgtaccatggagaaccctggtttgcttaragaatcacttgtgtaaacagaaaattacaataaagcaaaataaatgctaaaatacagatgcgaaaagtggcctttgtaaaaatagtgagagtaaagatcatcctaccaaggctaatggccaaaggctaacaaaagctggaccttgaggaaagagttttccaagccagagaagtaaaggaaggactcatatttctttgattaaccagctatattgcttataaagctctttatatacttttctcctcagwattttattttttgcttaatggttttgccacctgcaaagaacccttagagaattggctggggttatcattgtgagtggtggtgagttagggaaggcagcataagcatagcttttgtgtatttggtatgaggtgaaggaattagttggagaaatagagagcaaatggtaagcttacatgtgtctttttatcctaatactccctgtcagtggtgatgcaatcttttaggattctgctaatagctgtgtgatcttgggtaagtgatttcttctctttggattccattttccaccactttaaaatgggaggwttggtatagatggtcatttcctattagtaggtggggaaaaaggagaaagggggactaaataagtttgcgaacataggtaaacaaagttaaatagattactgcagcctcatgcattatggcatatgaattgggttgctggacttctagcttggccttgcaagttaagtgagagtcagtaatatgagtccagctctgtctttttcctaatggtttagtggaaagagcatgggctttagaatcagacatatctgggtttgaatcctgactactccttagtagctttatggctttataagttatctaacctttctgaacttgtctcctcatgtataaatcaggcaggataataccttgcggagttgtaaagataatgacattccatgtgaaaatatcaaatagaatatctgatatataattggtcaaaaaaggtgtaacttaagtctacaaattccagagttagtacagaatgtaagtaacacttgataatagctattgatatcctgcctacatctggtgtttgagatggactgtttgttgtttcatatatacttataattcttccccaagaaaacaaaatattcttgagagcacatcattacgttttgccatctacatagcactcgacattctcctggagactcagtaagtgcttgataaatacctgacagtttcatcaaaacagtggaataaagtgaggtgtggttttccctggtgtatactttatcctatatttcttataaccaagggtagaagtcaatgaatttatgaatattaattttaaatttctttggttacttaacgttaaatgattaaatttgaagtttgaaataataggattataagtgagctggcctttatttgcttaagtaaaccataagaagggggttataataaagtgtcatwtaatagtgtaaattatattattggaatactaatgttttacattttgttttttctctaagcaaatggttatgagccttagagtttctgaactccaagtactgttgggctacgcygggagaaacaagcacggacgcaaacacgaacttctcacaaaagccctgcatttgctaaaggctggctgtagtcctgctgtgcaaatgaaaattaaggaactctataggcggcggttcccacagaaaatcatgacgcctgcagacttgtccatccccaaygtacattcaagtcctatgccagcaactttgtctccatctaccattccacaactcacttacgatggtcaccctgcatcatcgccattactccctgtttctcttctgggacctaaacatgaactggaactcccacatcttacatcagctcttcacccagtccatccggatataaaacttcaaaaattaccattttatgatttactggatgaactgataaaacccaccagtctaggtaagattattgtatgatagtatttggttacttttgcaggatgaattttcgttttaggcttttactttgacccagtttattattcataatgaaattttcatttgatagtaacagctggataataatgaagatctttcaaatttagataaaatcaaatatataaaagctgtctttcaggaaaaaaggtagtatagtgatggttactgacaaagtaaatattaaaaagtttcaagaatataaacttccaaagagtagtattttagaaggttgattaatattttataatatctcataaattaaattaaaaccaaatgaatcactacaagtctctgattagttcttaattttcaggggttgatgatctctaaaacaaatcactgactagttttgattatttaaatgagtgaatggttttaatgatcataaaaggagacttgagctttgatgtatgctagttaaatttcagctgatttttttcaagtggagaagtgcatgctttacaggcatgcacatgcacatgcacactcatgattrcggttatataatataagtgcttgaaatttattttactgtgttgttccatcatttgatttgtagtctagcatatagaattcaatatattaatcaacttgtaattttaattgctataatgctaccttatttatttaacgtagaataaaactcaactgttgtgacctctgatgcctttggtataatatatttaaaatatcagacttctaaatgctggtttgttggcatactacggctggcaagctaagtccagtctgtggcctgtttttatgtggttctgagctaagaaatctgaaaaatattcccaaagagttattaacaaaaaaggaaagaaacaaaaacaaagaatgtgtaacggagaccatgtgtgcctgtaaagcacaaaatatttacccgtatagtaaaagcttgtgaatccctgttacagatcattgaacatttcagtttgggggactggcaagtgttgagaacattttttgcgaatttttgagaacattttgaaaatgtttactgaaattctatctttgaaatatgaagtgtttgtttttaattatatttagcagaaattatctgaatacacgaagattataggagtcattttcaaacaacgtgagttttgtatcacattattttattttttaagtggccataataagaaaacattttttgagaatctactgtatgcttataaaactgacacatgctcattgtaaaaaatggaattgccaaagttccttccttgttagctgtttagtgtgtatgcatatatagtataagcaaattgtttcttgttttttacagaaggaatcatatacatagtattgtataacttcccttttttccccttaataatatatcataagcatcttttcttgtctgtctgattatgtgtgtgtatatatatatatatatatatatatatatatatatatatatatatcccattttaaattaaaggccatatctgtatctatccatatctctgtatatggtctgtgtacatgtatgtatgtgtacatatgtgttatgtattgatcagttgatgaaaacgttgtgaccaggggcttgcaggaacctaaccctatacttcccctggtagcagtgattatatattcgcaaattcagtgtttgtggtgattttatgaacataaatgtcacaaatagcaataattgactatatttgaagtatgatttgaatgccagttttcatgaataaatctgctgtttgtggtatgtattcacagaaagtcaccaaatgaataggtggtatagaattgcttagtgatatgtaaatagattttcagtatctcatcgttatagaattaaaaacaaaccaatttaatatgcataaaaagatctcaccacaaagtaatttgtggaagtttattggctcaataaatatttgttgaagggcaatgcttattgaatgtgaaaaatatttattgaaaaaagattttatgtaattagtcttcagggtgtargatgagtatattttaaggctctgtttttataaattctttaacattattaagactttttctgtacttcattaaatgaagtggctacatttgtcacataacttagtttcctaaatgattatttttgccggtagttcatttgttttaaatctaagaaaaccacgttttctggaaaattaaatagcttccagcattctcttcatttctaaacgtacatacatttaaaatcaagtttttgagaacatagtttcgaacaccagctggctagttgatcacaactatcactgagtccagaatgggacaggcacatttactttttcattttttcccttccattgtggccttaagcactagatttaaacagatyttaagatgttcaaatgtaaactgaatgtttttatgcatggttttgtatttctaactaaaatggaagacagtagttctgataattcccattttattaggtaattctcattcattcttacgatcattttgttatttctttaaaacaatttaaaataattttaaggmctttattttggagccataattaaagtattcttttcattgtccataattaactgtaagaattgagaggtgaagtaaaaggtggttgtaaagtaagatgtttaatttattgtttactttggcctctcattatctcaattctgtttgtttctatgaggcttatttcaaatgctttttttctttaacctttttcatttatctttctaggctgtcctcctttcatctgtacatttcttccccagccagaatcaatttcactttccctgcatgctctcataacatttattttttatttttatttttttgagacagagccccattctgtagcccaggctggagtgcagtggcacaatctaggctcactgcaacctccgccccactgggttcaagtgattttcatgcttcatcctcccaagtggctgagacttacaggcacgtgccaccatgcccgactaattttgtatttttagtagagatagggtttcaccatgttggccagggtggtcttgagctcctgacctcagttgatccgcccacctcggcctcccaaagtgctgggattacaggtgtgagccactgcacccggcctcataacatttattttttaaattttattttattttattatttgagacagggtcttgctctgttgcccaggctggagtgcactggcacaatctcagctcactgcaacctctgtctttccggctgaagcagttctgccacctcagcctccccagtagctcagactacagacacgtgccaccatgactggctaattttagtatttttagtagagtcagggtctcatcatgtcagccaggctggtctcgaactcctggactcaagtgatcttcccaccttggcctcccaaagtgctaggattacaggcgtcagccaccacacccaacttaaattgtatttaataataataataattattattattttttgagacagggtttcgctctgtcatccaggctggaatgtggcggcgagatcttggtttgctgtggccttaacctccccggctcatgcaattttcccaactcagcctcccaagtagttgagaccacaggcatgcaccaccacacctggctgatttttgtttttatgttttgtagagttgaggtctcattatgttgcccaggctgtcctaacatttaatttaccctttattaaatgtttttgttttgttcctcaaaatgataaggcttttgaggcatttatctataaatccctataatagctagatatgaacctgttacatggtagttcagtaaacatttattagctctccaactcgttttaatgcagtagatggaatcttttatttcattttaattcagtggattttaaccattttaccttgcaaacacaactgagccataccacactctgtaattacaaacagtggctatgatagggatgggaaatagagtagggaagaatggtattcttcctcttattgccctatcctgtcatctctgaggttaattgatgtctttgaaatttaatatactccatttaaaaaaaawtttccctaattacaaaaatgttatgtttaatgtagaatccatagaaattataattacttgcttactttacagataaacttttaaaatacttctgtggtattctttttgttagtcatttacrggtgtgtgtgtgtgtgtgtgtgtgtgtgtgtgtgtgtgtgtgtgtatttctggtttcattttgaaggagaggagaacctcactagctcacrtaacctggcagccgcatgtattattgatccatataaataatggaagaaaattttaatcttgataggaygttgagcacatgtgttaaggggtactttgtttgaaataccttattgcttagtgtgccaatattggtgttgatgaggtgtgaaatttacataattatgaaaataaaaggaaaaataattttggattaaaatatcttgtccattcagggacaagataattatttgatatttcctctcaatcctttaatattgttttgtttagaataatacctgtatcattcaaaatagtttataatattgtttatagttattgtttaaattggctttgttagaacataatggcaaaaacacagaatactttcatggtaaataaaataatagttctttaggatacagtatttgatttgattcagacttaagtataaacaaatctattaatagatttatatttgttactagtttagctatttatatcttccttgactcaggtaaattttcaaatagaaaatacatttttaacatagtgcttttaaatatttttaatatttttaattatttcaaaggccaacatgtatagaacagagagctttgcattcatttggactacagatactcctctggttatgtcccaataaatccatcataaattgaaaatatccaaagtcagaaatgcacttaatacacttaacctaccaaacatgataggttagcttaacctaccttaaatgtgtctaaaacacttacattagctgacataacatctaacacaagtcctgttttataattaagtattgaatagctcatgtaatttattgaatatcgtactgaagtgaaaaacagaatggttttgttaccaacagaatggttgtgtaggtactcgaagtaatttctactgaatacctattgttttcttaccaccgtgaagttggaaaattgttaagtcgagccatctgtagtcatataaaagtatggtgactcatcttgtttgctttatatgagattgaagtcaaattttaccttctcaggggatgtcttttcaagtttttaaatatctcaggcaatatatctgaataagttcacatcatatgtctttattgattagagatttctcattgattggtatgaggcataataattattgactatgagtgttacttattttttttctttttttttccgagatggtctcgctgtattgcccaggctggagtgcagtggcacattcttggctcactgcaacctccgcttcctggctcaagcgatcctcccacctcgcctcctgagtagctgggacgacaggcaggagcaaccatgcctggctcatttttgcattttttgtagagacggagttttgtcatgttggccaggcttgtcttgaacttctgatctcaaagcagtccgctcacctcagcctctcaaagtgctaggattacaggtgtgagccaccgcacccagctgactatgagtgttatttctaatgttctaattcaatgttcttctacttgattactgaaggatagaatatctccttgctgtggtcygaatgtgtccctcacaaattcaaatgttgaaacctaattcccaatgcaatagtgttaagaggtggggcctttagcaggtgattaggtaatgagggcgtggcccttatggatgagattaatgcctcttataaaagaggctccaaggagcttgtttgccccctttcatttgccccctttcaccctgtgaggacacagctaaaaggtgctgtctatgaggaataggcctcaccagacacaaaatctgcagatgccttgatcttggacttcccagcttccagaactgtgagaaataaatttctgttgtttataaattatccagtctgaggtattttgttatagctgcccaaatggattaagatactccttttagccaatctagttgaaaccagtagtgaattgataaaaagtgatacataagttaaacatcttactttaatgtatatttatttgccaatcttttgatgttggtcaaggccttttctttgacagtgatgacttcgcagttttagattattttagcaagaagacttaaaggcttttatgaagatatttgagtatagaatctgttgcgaatggggaaaaatcttttatagttggcttcattggcattttttaaatagcaacttggctttatcaggtctttcccagagcatttaacttagttttcatgaaaacagcaactttctttttagacttacattttagcagcttttgtaatatttaattcagttttgtaattacaattacaagtgcaactaacataagcaagtttgagaataaacctctggttcttggtaagcataccacatggtgtgagcagaattgtgcggaagcactgtagagttgtctactggccacaggcagttagcttggtagggcattggtctggatgttctataaagggaatggagagcatcagttaatcataatatcagttaagagggcttctactgaatttcttttgcgccattcttcttaaactccccaaaggcattgaaattagaagttcattttcttgcctgagaataatttaagtggtttattttgtgggggaacaacatggatcataattgtggttgagttttaaaagaaatcatttagctccctttacccctttgagagggttataatggggggaaggattgggaaaagtagagaagcaaattatgttttttatcatacagttgtatgttttcttttctcatcaagcacagtgacagtaaataatgagtataaaaatgaaataatttcctagtcatttttccttgtctgttttttcaccaaaaattatttaaaattttgaaattatctgtaaagatcactgccttttcttggtcctcctaaattctgaaagtatcctaatattgtttagaaagtgtttggacgctacagactgaagaatctgaaacattgagaaacacttaaattgaccacatgggtgtccttcaatttgtgattaaacaaactgtgttttatttttttcatttttaagcctgggaaggtggcttctatttaaattttgatgtttatgaaacaatcttttccattaaacaccaagaatgtctattttctgggctatatatatatttgaattttcctgtgcttttttaaaggtacagttgttcttacttgacatgggatagtataccaataattctggagaagaccggcaacctagatgtgctgggcgtatagtcttagtatttaagaaaactagattgaccctttttcctatttaaagtagaatatttctttggagatatttacacctcttttaggcttgagaagatgtagaaataatttatagaaaatatttgaaatatatatatatttatataaacttgggttttgctctaggcaaaaagggaacagatgctttaacactcctaaatagttaaaatgatccatcaggttttgtgcagtgtgggtaaggtttctgctacatcttaataacattggttaccagtgttttctgccaagggctcctctgacattggattatatttcacagttttcttcttttctcattttttataattgagttttcctttttccacattcttaatatccagtgcctggagatcaggtgatacaaattcaaggacgcaggctctgataactattagaaagggcattcaaaggttttatgattcattctactctacttttagataattcagcataaactgtgctcctctatacttgaattttgggaaatcaagagcactaatttttctgtaggtgggtttctttggaaatttttctccctaattggcagcactggtttctgaccttcaaaatgaagtctaacacttacctgctaagtcgtacattcctttatagataatattctgtctttttatctggtgattttaatgtaatagtcgtgtttgtatagttgtccagaattccccaaggcatccagtatttttgataaatggatgtctgtgtacttgagtgtgatcttgggaactaagaatgattggcttttttgggtttggaaaggaatcttaaccattagaatcagtgaaagaaccactctatacaattataattatgaaataattttttttaattgagagattaaggagccaaacacttagggtcagaagtaagtacagtttatcaaagaaatccaacatttaagatcttactgggatcgaatttaaagatcagacatctagtataatactgtatagtgtttgaaatgcagcatttcagaatttaacagcgaattctgccgtgcttcgctcagcctcctgtgcacaaattgggttgccatgagtttgcatggcagccagctggaggacttggttgtggtaatcatggggcatgtggtcatcatggggtagataggataatgtaacaaaagggagaatctaattttggcgatcatttctttctttcttttaaaaaaaagacgttttgttgacacatagctgggtgtttggaaaataattttaagacattcttttttttttttttttttctggagatggagtctcgctctgtcacccaggttggagtgcagtggcatgatctcggctcactgcaacttctgcctcccgggttcaagcaattctcctgcctcagcctcccaagtagctgggactacaggtgcccactgccacgcctggctcattttttgtattttcgtagagacagggtttcatcatgttgcccaggctggtcccaaaatcttgagctcaggcagtctgcccacctcggcctcccaaagtgctgggattacaagcgtgagccaccacgcctggcccattctttttcttcattcctgacagtgcttgcagcagaccccaatagctctgggcagagattagttattgtaattctttggcactactcttggctaaatttattaaaactgaaatgtaaataagctttagatgtgccaaagatggagatattacagtacaaaagaaaccgaatgttggatgtagtattataattaaatcactttaagataggtaaaaataaaaagcctgaattgttgaaaaaacaaataaattagtttattatctctatatgtcctttcaagataatctgcagttcctagaattttatttaaatgtttattttgaaactatatgtttgaataaaaactgaagactgtcctttttccattgtgtggttttgacagccttgtcagagatcatttggctatgtatgtgtgagggtttgtttctgggctcactattctgttccattggtctgtatgtctttatgtcaagaccacactgttttgattactgtagctttgtaatacgttttgaaataaggaagtgtgaggcttgcagttttgttctttttcaagattgtttttgcttttgggagtcccttgagattttatatcaactttaggattttttttttttttactatttttgcaaaagataccattgagattttgataaagattacattaaatctgtagattgctttgagtattatggacatttaaacaatattgtttttgattcatgagcattatccttttttttatatttttaatttctttcagaaatgttttgtagttttcagtgtacatgtcttttgcctctttggtcaagtttattcctaagtattttatccttcttgatgctactgaaaattgaattgttaagttccttttcagtgtgttcattgtttgtgtatggaaacaggactcattttttgtgtgtcgattttgtatcctgcagttttcctgtttgtttcttagttctaatattttttttcttttgcatgaaacttttagagttttctacatacgtcatgtcatctgtgaacagagattaattttacttctttttaaatttgaatgcctttcatttttttgtgtgtgtgtaattgctctggctagtacttctagtactatgttgagtagaagtggcaagaattgccttgttcctgatcttagaggaaaagctttcagtcattcaccattgaatgtgatgttagtggtgggtttttcatatatggtcttcattatgttgagatagtttccttccattcctagttgagtgttttttatcatgaaatgttgttgaaacttgtcaaatgtcttttctacatccattcagatgatcatgtagtttttttcattctgttaatgtggtgtattatattgaatttcatacactgaaccatccttgcattccaggaataaaccccacttgatcattatgtaaaaccsttttcatatgctattgaatttgaagtgtagatattcttttcttgttccttaagaaaagcatcttgtctttcaccattaagtataatgttagctgtggattctttcatagatgcccttcctgttgagttttttaattataaaagcatgttgtaattaattaattaattwatttatttatttttgagacggagttttactcttgtcacccaggctggartgcaatggcatgatctcagttcactgcaacctctgcctcctcagttcaagtgattcttctgcctcagcctcccaagtagctgggactacaggcacgcaccaccacgcccatctaatttttgtatttttattaaatgcggggtttccccacattggccaggctggtgtcgaactcctgagctcaggtgatctacctgcctcggcctcccaaagtgctgggattacaggtgtgagccaccgtgcccagcctgcatgttgtaatttattaaatgctttttcaacatctgatgagatgattgtatagtttttcccattattctattaatatggtgtctaacactgattgcttttcatatattaaaccagtagctgttggattttgtctgattccagatgacctatgctacctcctagaggagtaaataacattttccacttctgacatttgtggggttttttaatcaattctgaattttatttttgtttacatgagtatagggctctaattttatttttttcccaaaacttcctttgaatattattctagatcttactctgttccactggtctaattgtatacttttctgctaacatggaattattgtatagttgacccttgaacaacaaggggattgggatgccacctttgcaacacacacagtcaaaaattcacatgtaacttttgactcctccaaaactttactataacctattgtttaccagaagccttaccaataacataaacagttgattaacacgtattttgtatatgtatgtattgtgtactgtattcttacagcaaagtaagctagagaaaagaaactgttactaagaaaatcataaggaaagaaaatatatttactattaagtggatcattataaaggttttcatacttgttatgtttgcattaagtaggctaaaggggaggagtaataggaggattttcatcttgctgtctaagaggtgacagaggtggaagaaaatctgtgtataaatggacccacacagttaaaatctgtgttgttcaagggtcaattgtacttaattttttgattgtttttaaatttttaaatagataatacattgatgtacaaaactcaaaagttacaaaagggtttgcaatgaaaaggaagtccctctttcacccttatttcagtcacaggtgttgctttcagttctttttatatttttactggggtagctgctgcacctacaaacaaacatatttgcctcattcttttttagcagctacttagtaggcaattgattcgttggattctgtgttattaaatattcccctgttggtcaacatttgggtagtttcttgctgttgaaaacattgctgtagagaatattctgtgatatatatcactatgcacttgtctaaatatagccagtagttttataattcctagaaatagaaagtgcatctaaatattttttgtagatgttgccaaatttccctctagagaaaggtgtgtttgctaatttataatcttacaggctctgtaagagactgttttttcctcctgtgccttcaacgataccatgtgttattaaactttttgatcattccaaattaacagcgaaaatttataactcattatagttttaacttgcacttctcttatgggtgagggtgaagtttgttgttgttgttgttgttgtttttaaaaatatattttttaaattataaaagcacatcgttatttatttatgagcggagttttactctcgtcactcaggctgggtgactatatatgtatatatatttcttttttttttttttactcttcaaagttccttgagctttttattttgaaatttggtggttgggctttttacccttttttatagacttaagaaatttagcactttgtgatataagttgtgactactttttccattgtgattgtcttttgagttttttttatgattggtgttgcacattagccatcagttcttttttattgctaagtaatgattcatggtatggatatatcacaatttctctaactattcgaattatttaagagcattttggttgtttacagtttctggctatcataaataatgttatcctgagtattcatgtacaggtgcttgtatggacataagttttcttttctccaaatacatgcccaggaatggaattgctgggtcatatgtgtaagtatatgggtttttgggggttttttttttgggagaaaataccaagttgtcttcctgagtggctgtaccactttctgtttcttctggtattgtatgagaggtccagtttttctctgtctttgccagcatatttgttattgtcactttttttatttttagatgtttaagtatgtatgtagcgataactcattttggttttaatttacattttcctaatgactaatgatgttgaacatctttccacatacttatttgccatctgtcgacatacttatactctttggtgaaatgtctgtgcatatttttctcattctttaattgaattacttgtttttatrttattgacttttgagagttcctttgcatattgtagatactagttttagtcagagatgtagtttgcaaatgttttcttccagtctgtagcttgtatttcttcgggaaaaaaaaaaaaaacaccttttgatcttgaaataattacagatttgtaggaagttgagaaatgtataggaacatcctgtgtactcttaacctagccttctccattgttaacatctttcttaatatagtgcagtatccaaactaggacataacattggtacaatacacagagcttttcagattttattagttgtatttgcagtcatgtgtatttgtagctctgtgcagatttatcacatgtaactaccaccacaataaaagatacctaactgtcctgtcacccacaagactccctcttgctaactttttgataacctcacccactctctctagccccagtggttcatccaagttgctgtgtatatcactagtttgttccttttaaggggcggggaggggggcgctgagaagtattctatcatataatgtagtttcatttgtttaaacatttaccagctgaagaacattagtgtagttttctgtgtttggctgttaatgaataaaattactatgaatattcatatacaatttcctgtgcaaaaataaatttttatatctctggtaaatgcccaagggttatcagttgctgggctgtatggtagttttagttttagttttaaaaggtctgcaaaattattttccagactgactgtatcattttacattcctagcagccatgaatgaatgatccagtgtttctgcatccttgtcagcatttgatgctatcactattttttagttttgccattttgataggagtatagtgatatctcattgtgttttgktgktgkttttgttttgttttttttttttgagataaggtctcgctctgtcacccagggtggagggcagtggcatgatcatggttccctgcagcctcaacctccctggctcaggtgatcctcccgcctctcaagcctcccaggtagtcaggactacaggcacacgccaccacacctggctaattctttgtattttctgtagagacagggtttcaccatgttggccaggctggtctcaaactcctggagtcaagtgatcttctcccctcaacctcccaaagtgctaggattacaggtgtgagccaccgtggctggccttcatggtggttttagtttgcatttccctaatagctaatgatgttgaacatccttttatttgtttatttgccatctgaatatcctcttcagtgaaatatctttttatgtcttttgkcttttctaattgcagtgtttttttttttttttaacttatgagttttcagagttctttctagattctagattctagtccttcgttgggtttgtggtttgcagatcttttctcctgtggtgtaacttgtctttttttttgtttgtttccttgtttgtttttgacatgggatctcactgtgttgctcaggctgcagtgcagtggctgttcacaagagtgattatagtttaccttaatctcaaattcctgggctcgagcagccctcctgcctcagcctcctgagtagctgggactacagatgcatgccactgcgcctggcttgtcttcttaataggatctttttacatagaacaaaatgtttaattttgaggaagtctcatttactgatttgtttctttgttagatttgtgttttaggtttctagtctaacaaccccacttgcacacccaccccacttttttgacttgctctgtcacccaggctggaatgcagtggcatgtgatcatagctcactgcagccttgaactgctgggctcaggcaatcctcctgcctcagccttctgagtagttgagactacaggtgtgtgccatcgcgcccaactaatttattttttactttttgtagagacgggatctggtctcatactcctggcctcaagtgatcctcccaccccagcctaccaaaacactgagattatgggcgtgagccacagtgcctagccaagtcaaaaacctctctgcctgactttagatttggagatttttttttcctcgaaagtttttatttttacattttacatttaaatctgtgatccatttgttactactttttataaggtgtgagattgagattgagcttcatttatggagatctaactgttcttagacccctgttgcaaaggccgtcctcctccattgaattacttttgcatctttatcaacaatcattgtctgtacctatgtgggtctctttctgggtcctctgttctgttccattgatcagtgtttctgtctcccaccattaccacatggtcttgattactatgtcagactatgtaataagtcataaaattaggtagagtaattgcttttactttgtttaaatattcttctagttcttttgcctttccacacaaattttagaattatcttctcgctctacaaatagtcttgctgggattttgataggaattgcattaaacctgcatatcaatttagggatgattaataatttttctattttgagccttccagtatatgaacatggtatgttgccatttgtttagatcttttttaaaattttattcatcagcattttatagttttcagtatatagttcccacacttgttttgttagacctgtacttaaatattttgtttttttctgagtgattatatcttgtgaccttgctgagttcacttatagttctaggaagttttttgtaaatttgaggggtatttcttcatagactaccttgttttctgcaaacagggacagtttttatttcttaaccatctgcctgctgccttccatttatttactttgccttattgctttatggctctaatagagtgttgaataatagtggtgacagtgaacatccttctttgatttttatttcttttttttttgagacagggtctcattctgttgcccaggctggagtatagtagcacagtctcggctcactgcaacatccgcctcctggactcaagtgatcttcctgcctcagccttctgagtagctgggactataggtgcgcaccaccacacccagataattttcgtattttagtagagatggggtttcactatgttggctaggctggtctcgaactcctggcctcaagtgatctgcccgcctcgcccacccaaagagctaggattacaggtgtgagccactctgcctgacccttctttgattttgatcttagggggaaagcttcaagataaaatgatattttttttttctgtgtttaggcttttgcccttgaatctaccatgttttgtattattatccttttttttttttaagcttttcgttagcatttgtctgacataaactttgttcttttgttttcaaccttttgtggtgtttatttttgggttctttttgattttttgttttaaaatagctttattgacatataattcatataccacaaaatatattcctttaaagtgtacaattcattggttttactatatccacagagttgtgcagccaccatcactatcaattttagaacattttcatcacccagaaaagagcctctctacccattatcaatcactctttagtgccacctctcccatcccctgaaactactaatacggcatctgtctttatagattttcctgttttggacatctcatatgaatggaatcgtatggtrtatgaccttccgtgactggctgttttcatttagaatgatgttttcaagttcataaagttgtatrtgccgaaactttgttctttttaatggccaagtaatattccgttatatggatataccacattttgtttatacattcatcagttgatgggcatctgagttgtttccactttttggctaatatgaatattcgtgtataattttttgtgtggaaatatgttttcaattcttttggttaaatacctagaactagaaatgctggctcatatggtaactttgtttaacctttgaagaactgccagactgttttctaaagcagctgtaycatttatattcccaccagtgatttatgaggattcgcatttctctccacatccttaccaacacttgttattatatgccttttttaatatagtcatcctagtgggtgtgaagtgacatctcattgtagtagatttctctcttacaaatagcatgtacctggctttttaaaaactcagtcttaaaatttaacttactctcattttatgctaacgttgttacatttggtctttgttctgccatcttaatttgttgtctgtcatttttttctgacctctgtgatatgaattatactttgtttctcttttattttstaatggtttgggagttctgccttctatttctgtaggtagttactattgaaattttacccaacacatttaagcctaaattttactaccaacatcaacaacttttaagagtaattactgtgtcttgcctcttctcctcttcactaatttattctatcagacatgtattcatagttgtttcttcaaaattcatattaaccacagagagacaaatatttcgtgttctcacttatatgtgggagctaaaaacaattgatctcatggaggtagtgatgatggtggttaccagagggagactgtagttaataagaatttattatgtatttcaaaatagccagaagagaagatatgatgtgttcctagcacaaagaaatgataaatgtttgaggtgatggatatcctagttaccctaatttaatcattgcacattgtatgcatgtacaaaaatacatattccataaatatgtacagcaattatgtaacaaagtttacataagggtctctgacagaagaagcattttcccacattgcatagtgacagccaaaatcttaataggtacaataattaaagttatgaaagaattgctattgaatgaagaaaatatttgtctttagtgctttactttagattattttgagaggactatagtgtatagctaagaagcaatcattcaactcagggtaggtgggttaggtttaagaaaatctgatgactccattgagaattgtattaaagctcagccaagagagctgagctgtaacaatatttaatttgccacattgcagtttcatccatctagaagtgtaggaaattcaggttttcaggttcactcaggatatgaattgttaacttcctcttagcagagataatatattactatttaccagataatcttaatactctaacttatatttttacttcagaagtttttctagaatttatctaggttacttttagataagtaaatcaggccatttgtttgtatttattattggtatatttctgtataatttccttatgcctgtgtagatcgtggagttcttttgaagtcaatttcaagtcaagattatatttatgtacatgatttttttctcatatttctcactttcccaccatatgatctaggtttgctacatcagaattggagagtgacatttaacttagtgtttccggaataaagaatctggagcttttactaccccataagtaatctattttagcctttctaagtctgcagcttcctttcactttgctttccaatctagcatttcacctctagttttaccccagttatgctttatagattaaacctctgaaatgtgtttaatctgtatgaaatgaaattatagctgggcacagtggtgcacacctgtagtcccagctacttgggaggctgagcatgagagtcggttgagcccaggagttccaaaccagcctgggcaacatagcaaaacgccatctctaaaaaaaattttttttaaataaataactaacagtaaccttaaaatgaaattatggttcttaatgatagtggcttgttacatctcttatagccccacataggttagatttttcaatataaaattagaggataggcacattctttctttttagatgcttaagaaattacctcacataaacattttaccatttaaaaaatgatgtttaccagtccatttcagttcttcaactgaggtccattataaaatatactacttttgctgtataccaagctacagttgtagatattgattcaagtaaaggtgatacttcctcttccagttgatttttatactcttaatttgtgtatacatacattttcacacatgaatatgtgtgtgtaagagacagagtgcattcatttgcacccagggttggaggaaagaagagaaagaaatgagaatatgtatattggagatacttggctatttgtacctcacctgcccatgaaggctaaaaatggatggttaaacacctgtctctgtgctcatgatgaaaatgacctttgcaaaaaaaaaaaaaaaaaaaagaataaacaaaagaaacacaaacaaaaaaactttagaaaataacctttgcttctagaccttctaaatttttctgaatggagagttttgtggtttccaaaagtgaaatagtagaagcaggaagaaaatattctcttacctaggtgcaaaactggcccaggccaaattctaatagacacttgcctttggcagtctcccagttgtctctcttcatgtttcccccacctttgtctgcccsctccttagttgtgtgttgagctcctcactgtgccattttcctcaggtctgtagacatgcctcttcttatrccccacaaaatcccctccagtttcctcctaatattatctataaagcagaagaaaatagcctgatctgtagagtgaagggggattaggctctaacgtcagtgtattagccctactgctgaaaattcctgaaattcttaatcgattacaatagtgttccatacttaaatacagcacagcaagcttttctccagcattgtgttggatcgctgtttctttggttgaacacagatgatgttgggttatatttaggggccacatagtttgaaaataattcatgagtgtttaaaagactagcatattcagcatggtaagatgcactcgtgaggagatgggaccctttgtacttcctagagtacaaagaaacactgacctagagaaccatattctaagaagtctacttttgtttaagcatttttctgggtcagctccagtaaatgaatcttgctattcataatatttcttcttctgaacctataggtttttaacttagggatgagagtccaggatagtagctatttgtacatgtttgcttattttcaatttatgtgtttgttagggattgtccattaacttacagctgttttcactctgatcattgttcctagcaagtatgcttaggtatggtctcacttcctatcacctcactctaatgagtcctcttaatccttatcagaaggaaattccatttcttcttaggggaaagtgaccataatagtgtgtaagattgagttaccttaagttgtatatttcagaagtataaatcaatatttactcaaatgcctggaacttctggttcatctgttgtgaatataaaaccacttatgggcaaatgttaagtgtctagtatttataccagatatttatagtctttggagcctttcctaggatcatgaatttaggctgctactcaatttttaatactttacccttatactttcatttgaaaaagaaatgattgtttagaatggatttgaaagtgtctattaaactatatctaagagcaattataaaactaataatgtgtgatgaaagataagatggtcatcagttataaacaggaaaaaagctgatggtaaatacttatgcttatacttagctagataaaacacacatttaagaaaaaaaaaaactctaaatatacagttactttgttcctatatataccaccagtaaatacgatacatggtttgtaggtagtgaaatattattttaaatgatttttctttctagaattagagtatagccagaaactattaactaatcttgtacaagaaaactactagaaaatcaacagtgaggaagagttagaattaattaaaatctacctaaaactagcataagcataaaagctaatccatcaatttatataaccaaagattaaggagcttgatgcagagctcaatgaacatcaccataatctttttcttgactctccatttctcttgccagcccctgccacattgcttggatcctcagcgtggcaaaattccatagataagttttctgtagtcactgtctccagttccttacctttcattctcctgtaagtctactccagtcatgcttttgcttcattcaatccactgaaacttctcttgtcaagaacacctgtgatgccaaaccccatgatctgttcyyagtctccaggttccttgatctrttagtactwgacacagttgatgaggttctcctgcttgtgcactttgtcacttgacttccaggattccacactctcttgattttcctcctatcatgctagtcatttcttcttagatgtctttcctcgttcttcctcttctcttctcacactcactcccttgatgatttgaactagtctcaaggccttaaatagtaattaaacactgaggaccctaaatttatatctcaagacctctctcatgagttctggagtttcatccgactgcctgctttatatcaccattcatatagctatctcacacttaacctgtctaaaacaactttttttcttcttccaaaatgaagtctaccctcagtattctcccttttggttaagagtatcttcatcctttttgttgctcaagtcaaaaactctggagttatcctgactcttctcttttgttatgttccagtttcattagttaggatgttttattggctccacccttaaagtatatctagaatctgaccattctcatgacctttactgctactatgcttatctgagccaccattatctctcacctggattattatgttaatctctgtgcctacctttgttccctgtataatattctgaatttagtagccagagtgatacttttaaataaaagctaatcatgttactcctctgtttaaaactctccatttgcctggccatctttgttacctgtctgatatcatcatctataactattctttctgttaccttgactctaacaacactggtctacttgctgtttctcagatactgtgtatgctcttgtcttgggccttggcatgagtgttttctttacctggaatactcatcccacaaacattcacgtggccatctccttcatcttcttctagtcaaggtattaatatktctgatgagacacctaccctgactaccctattctttccaattcccattacactgccctattatttccataacattgtcagcatctgacatactttactatgtgtattatttattttctttctcttctcattacagtgtaaatgccataagggcagtggtttgggtctcttgtttattgaagtatgctaagcacctagaatattattttacatatactaggtactcagtaaatattagttgagtaaatatttgtagaacagattcatttcatattctccattttgtggttctgcttcctttatgtcaagaccatgtttaggcattatatgggtcccagaagttcctgaaaaccctccagattcaaatctagccagaaagaggataaatctttgtcctagcattcccaggaaaaagactgaggttcactaaactattttaaaatgccttattcagcccttgaccagtcagccctggccaggagaaacgcaaaactctttttggcctagacttgaaagttggtcatatgttccaagtctgaaactagaggtaaagatacaaacaaaaatgtctattcagggaattagaagctactgaataagcacacaagaaatgtctactcacttttrtataccattggtttacaactgtgatccttggttactggctgcatgggatgttagtaggtgctctttgaccatgccccattaagttaaaaaacttaaatttaaacaatttttactcctgtggaatttctcaatttttaatatggtaatgtattttgtgaatctctaagccagatatattttatgcatcagtttccccaaattctttgaacatgaaaccgtttttcctccagaatatctcaaggtatattctcatgcagctcactatgagaaatattggtatgtccgctaagaattagaaaattgaagaaaaatctcatgcaacaataaaaaagaaaacaaaagaatacttttcaaatgtacaggacctatttgaagaaaaaattttttacaggcccccaaatattttaatatatagaaagacagtcctttgaaagatacttacggctgggtgcagtggttcacgcctgtaatcccagcactttgggaggccgaggtgggtggatcacctgaaggtcaggagttcgagaccagcccagccaacatggtgaaaccccatctttactaaaaataaaaaaattagcccggtgtggtggcgggtacctgtaatcccagctactcaggaggctgaggcaggagaattgcttgaaactgggaggcagaggttgcagtgaggcaagatcgcaccattgcactccagcctgggcaacaacagtgaaacttcttctccaaaaagaaaaaaaaattagctgggcatggtggtgcgtgcctgtagtcccacctactcaagaggctgaggtgcaaggatcacttgagcctggggagatcaaggctgcactccagtctgggtgatagagtgggaccctgtctccagaaaaaaaaaaggtatttattctcaataaattctatgtagttgcagtttaaaatctagtttagtagagaggggtgtgacgggaagaggagaacttaatcaaatgattctaaagtttcattttgttgtagactgtttttattgcaagaaagcataatacctcaggttacctaagaaaagtttattgtattgaatatatagggtttaaaaccagtatcagacagttatgatatgtactttctctggttggctgtgtgcttttttctctccctctgtggcatccgtatatatttgtaagcatctgttttgtttgcttatggttatctgctcttagtccccatactccatactccaaatcttgaattaaactgctttgggttgattttagttaatctgtcrctaatggatggatccttttaggccttctcattttattgattgtccagaagccagtagatgggctatccctgggaaaattatgctccctgatcctgtcagcatctgctcaatcctacttctgtggtcagaggtaagggttggcaagatttaactagaaggcgaagttgggtgtgttaggcatcatgactaaaataatctagaagaaaaaataagaatagccagaggaattctgaaaagagagtatctctatatattgcaggggtgtagtaatttaagctgtggaactggtgcctgaataagcagttaataaagtagaaatacaattttcaaataacataaaagtgaaattactaattagaggtatgaattggatgttaaattgttcaggagtacctaattggccgttaaaaagtaaaattcctatcctgcaatttaacactaatatcaaaatggtttaaagatttaaatgcttaaaaatgaaatagtatcagaggaaagtacaggttgcgttgaaataaatgcatagataatatttaaataatattgaggtgaggaaggaattttccctagcgtaaaactactgagagttcattaagattttattgtggagattcaaaaagaaaggtttattatactaaacgggaaaatgaataaactaagggggaatatttgaaatatgaccatagtacatattttaatatagaaaggactgttagaaacaatttgtgtgtggattgggggtgcttaatcctacctggccatcatacagtattaccctagtccatacactctccatacactttcttaggtgacttttstatcttattctcttactacatacttccaacaactgttgttgagccgtaactctttggtgattactttgygttttatttcttcctcactgagaaaatggaaccaatcagaagataacttataaaggcttccaccaatatataccttatgcccatgtgcctacatctctgtccgtttaccgtatatgttttcttctgtaactgagggtgaatgctctggtatctgtactgagaccagattctacacttgcacattagatcctactcacttgcttattcaaggatattgcttagtaattctttctctgctacattatcaattttttgcctctttactagctcagtcccccatcttaaaaaaactacttttctcctaatttccctccagctacatccctattttcttttccttcaccacaaattcctttccagagatgtctcaatttactgtctttgatttctttcctcctttctctcatgaaccctttccaggtaggtttttgactagctcatgccaaagaaactgttgttatctaggtcrtcagtgaccattataccaccaaaaaaaagtagtcatttcccagtttggaagaattaaatctttttaaaaaatgtaaagaatgcctactacagcctaatagggtggttcacaatacagaaaaaggccaataagggtatgaaaagtagtcaatttctagaaagtcaaagaaatgcaaatttaagacaataagatgtttcttattcactgtccagtgtcggcaaggaaatctagaactctcatataccatttggttatgcaaatgaaaattggtacatttctggaagcaatttgacaatttttacragagctttaarattgtgttcgtcttttgacttgcccattctgtttctaagagtatgtctcagggaaataacacacaaatgcatgatgcatccacccacatacaaccagggagggaaggattcatcaaggcattaattctggaagggaaacatgaaaatgacctaagtgtttgacaataggagattggttaaagtatgctacatctatatggtagaataccaagtagctacttaaaatgatgacattggtttgtttatttatttgaaattattttaaacttttttcacatcaagttgccattaaagatatgtttattaacatggaaagactttaatatgttttaagaagtgtattcaatgcaaattttgtggggaacaaagtatattacatgcatgtggttatatgtgtgcacatacataggtacatatcaatgtatgtataggaaaatgcctagaagattgtataccaaaatgtttttcagctgctgtcaagtagtacaattttagatgttcttttaaaacttggaatgcttgcattaacaacaacaaaaaaagaaaatgaaagttttgcaaaagaaagaaaatcaatatcccaattatagtctgcttactttttctggttttacattcaaacattgatcattagacttggttcatagctggctggcttgaactgacccagtcctgtttcataaccctgctggacttaaaacagcctaatggtctgccagctgtgagagaatagatgagccagataaagtgtatttaccatacttttaactcctgagctgcttgggagtctttatagactcctttgattaagtctaccaggagaccagctactaactcagtaaactaatctgaggaataatgtaaagttagaataactrggataggtagagttaaactccagagaaaaaaggtgatgaaaagtataaggcaagcttattaaggatgggcttattaggaacctgataaaaggatgtgataaaaatgaaatcaaagggttttacagtgctaaagtttaatagtattacatgttggaattgtttcctgtttcttagtataggtaatttctgtatgaatggaaaattcatgtgtaatttttgttgtactccaaagaactttagccacaatttattgtgaaatatttgcaaccttgaaaattcagaaatctagcaataggatctctctctgtctctctcttgctctagcaaacgactgcatatatttcatmcacacacacacacacacacacacacacacwyatatacatgtatagtatattggttttgtataaggtataaaaagcaaattattataaaaacaatacatatgctcaatgtgaagaattttgtaaataaaagttacaaaggagtcaatttttgctgcctttttcaatctttcaacgcataatatgtaaatttgcttatttatgctctatacttcatgtttatatcttgtctttttcacttaatattttatgactgtattctcatatcattaagtattctttcctttaaaaattcccatttaaagatagtcaaagcaatatgaatttgttaatgatttagtatatgaattggagaaaacatattttctgcagtcttctttcttaatgggagctgacagcctaatgatgaaactatatcattccagctatattttaaaaaattacatagttgtcaagtttttgtttgactaagtcagagggttcattaaagattgtaaggctgacattcgtagataggaactttagtttcactttccctaagacagcaagaaatattctataacagaaagatgactatttttagcttttctttctgctggtgaggtggaatagcaaatatttttagagcaattgaaagtacagcctcttagattagctcagtgtttctatcatcagaatctcaattattttatgtatctagattttttttttacttccaatgttttgagtttatgtaaattgcaacatgattcgtctttttatttttgatctagttcgtttctctgtggaacaatataaaagatgaaatttctaaaaccttaacttttctttctgcactttttatgtattttgagttgtaattatattctgcttattgtgggcagttctcttctttcttggagatgaaactttgataattratacttacggggagatggtgttacaaatcttctctcataataggctcttaatattcacaagagagatcccccatgaccattgtaagtacccttaattatgaacaccactagaacatttcatctttccccaaaacgatgccataggataagtgaaaatttgagggacttctgtttttacccttaatgaaggacatcttggttgcttccaggttttggcagtataaataaaggtgctgtaagcatccatgtggagggctttatgtggacatatgttttcagctcctttaggtaaatactaaggagtgtgattgtgggactatatggtaagagtatgtttagctttgtaagaaactgtcaaactctcttccacagtacatggtgctatactgtaaatggtattttttttatttcagtttctgattgtttgctgttattatatggaaatacgactggtttttgtatagcatcttcaccttgctaaattcgattgttctagaagcgttttgtagattctattgaattttctacataggtcatattttctatgaatagacagttttactcttttccagtcttgatgcatttttcttgctttattgtgctggcaagaaccttcagtataatgttgaatagaaatggtaagagtggatgtcactgcctcattcctaatttttgagggaaaacattgattctttcacgtctcagtaaagtgtttcctgtaaattttcatagctgtctattatcgatttgaagatgtttacttctattcctggtttctggagagtgtttattaggaatggttgttgggtttttgtcaaatgcgttttcctcatctattgagctgttaatatggtgtttcttttttagtgcgttaatatggtgacttgatttttgaatggtgaaccagccttgtatttttgcaacaaatctcccttagttatgataaattattgyttttccatatggttggattttatttgctaaagttttattaagagtgtttgcatttatgttcatgacaggtaaatggttggtaattttttgtctaataaggtcttggtctcattttggtaccaaagtagtactggcttcatagaatgagttaagcatttctttcttttccatttttttttggcgaggatggggaagagtttgtgtagaatcaatattttttcttgtcaggtagaattcttcagtgttttgaaaacatttatgtagggttggtattatttttttcttaagtatttggtagaagtcccccgagaatacacatgggcctagagttttctttcagagaagttatcaaattacaaattcagattcttgtagggctattcaggttatcttttttcttaagtaaactttggtagttttttgtcttaagacatttgtccattcttgctgagttataagtttttgtcataaaggtacgccaaatattaataatattctcttcacatccatagaatatgtagtgatataacctcttattcctgatatcgacaatctatgtcttttcttctttgttctcttgattagtcttgctagagatttcattttgattttcaagaagaaaccagcttttggtgtcactgatttttctatatttttgtttttcaatttgattattttctgctctgatctttattattttctttctcctgattcctttgggtttcatttctcttctctttttttagtttcttaaggtataaactgaaaccattgatttaagaccttttttttctaatataggcattttagagctgtaaatttctctctaaatactgctttagctgtatcccacaacttgtgatattttttgttttcgttttcattcagttcaaaatattttgtagttttccttttgatatctttgacccaggggttatttagaagtgtaatagtttccaaatatttgggcattttcctgatatagttcttgttttttaaactaacacataaaaattgtacatatttatggcgtacaatgtgatgtttcagtacatgtataaattgtgtagtgttcaggtcagaataatttgcatgaggccttaaacattcattgtctgtttgtgatgaggacattgaaaaacctcccttctagcgtttttttgttgttgtttttgtttttttgttgctgtttcgtttcttgagacaaagtctcattctgtcttgcccaggctggagtacagtggcatgatactgtttcactgcagcctctgcctcccgggttcaagtatttctcctccctcagcctcccgagtagctgggactacaggtgtgcgccaccacacctggctaatttgtatttttagtagagttggggtttcaccatgttggccaggctggtctcgaactcctgacctcaggtgatccacctgccttggcctcccagagtgctgggattacaggtgtgagctgccatgcctggccccttcttgctattttgaaatatgcaatacattattgttaactctagttatgctaccatgcgttagaacacgagaatttatctatctaactgtagctttgtacttgtggaccaatctctgcctatttctcttccctctgtcctccccagagttctcgtacccctattctattctctacttctgtgagaacagcctttcagattccacatgtggatgaaatcgtgagatatttgtcttactatgcatggcctatttcacttaatgtcttccaggtttatccgtgttgccacaaaagacaggattttattctttttgtggctgaatagtattctatcatgtctccataccacattttcttcatccattcgtctctctgtggacatttaggttgatttcatatcttgcgattgtgagtagtgccacaataaacatagttcagatatctttttcacatgctgatttcatttcctttgggtgtatatccagtagtgggattgctagatcatatggtagttctatttttaattttttgagaaacctccatactgttttcagtaatgactgtactaattaacattcccaccatcattatgttaagggttccctgttctccttatccttaccaacacttgtcttctggttttgtgtagagtcagagtaggccaggtgcagtggctcacgcctgtaatcccagcactttgggaggccgaggagcggggcagatcacctgaggtcaggagtttgggaccagcttggtcaacatggtgaaatcctgcctctacaaaaattagccagatgtggtggtgtgcacctgtagtcccagctactctggaggctaagacatgagaatcacttgaacctgggaggtgaaagttgcagtgagccaagattgcgccactacaccccagcctggatgacagaacgagtgtctgtctcaaaaaaaaaaaaawaataataataaataaataaagagtcacagtcttgctctgtctccgaggctagagtgcggtggcacaatcatagctcactgcagccttgacctcctgggctgaagtgatcctcctgccttagcctcccaagttgctgagactataggcatgcaccaccatgccctgctaagtcttttaatttttttcttttggaaatgggttgtcactatgttctgcaagctggtctctaactcctcgcctcaagcgatcctcccacctcagtctcctgagtcactggaattacaagtgtgatccactgtgcccagctgtcttgattttttgacagtagccattctaactggagtgaggtgatttctcactgtagttttgattgatttgcatttcccttattattagtgatgttgaacattttttcatatatctgctagccgtatgtatgtcttcttttaagaaatatctaaattcaaagtgaattagagatttaaatgtaagatcggaaactatgaaaatagtaggaaaaaaacataggagaaaagctctgtgacattggtctagacaaggcttaaaccttgaaagcacagagaacaaaagcaactatagacacatggcattaaattaaactaaaaagcttctgcacagcaaaggaaacaatcaagagagcacaacaacctacagaatgggagaatatatttgcaacctatacatctgataaggggttaatatataaagaactcaaacaactcagcagcaacaaaccaaataacccaattaaaaactgggcaggccgggcatggtggctcacacctgtaatcccagcatttcgggaggccgaggtgggtggatcacttgaggtcaggagtttgagaccagcctggccaacatggtgaaaccccatctctaccaaaaaaaaaaaaaaaaaaaaaaaaaaaaagtatatatatatgtacacatacacacacacatactccagacgtggtggcgcacacctgtaatcccagctacttgggaggctgaggcaggagaattgcttgaacccgggaggctgaggttgcagtgagccaagatcatgccactgcactccagyctgggcaacagagcaaaactccataaaaaaaaaaagtaaatgggcaaaagacctgaatagacattcctaatatatttctgttatttagtttaattgaattctactgtgggacagtatactttgtatgacttgaatcctcttaagttaattgagatttgtttttgactcagaatatggtctatcttggtaaatgttctgtgtgcatttgaaaaaatacacattctgctgttgttgagtggagtgttctataaatttcaaagatcagattggttggtaatattgttcaaagtcttctgtattcttccaatttcctgtccagttgttctatcacttattgagagagggatgttaaaatctttgctcataattgtggatttgtttatttctcattgtagttctatcagtttttgcttcatgtatttggaagctctactattatgtacatgtcctcttgacccctttgtcactatacagtgactctctctatccctagtaatattttttgttctgaaatctactttctctgacagctttggtttttgttgtttgctttttgcttttgtttttattttttaaagatggggtctactgtgttgcccaggctggattcagactcctgggctgaagcgatccttctgcctcagtgtcctgagtaggtgggactacaggcccatgccaccatgcccaggtcatccagctttgttttggtcatggtatatcttatccttctttgttaccatgatgtatcttttctatacttttactttcaaccaatttgtgttcttatacttaaagtggatttcttaaaaacaggttatagttgtctttttttttttaactctctcatatctgccagtctgataatatcagccttttaattgggttatttagactatttacattttatgctattgttgatatggttgcttttaaatttaccatcttggtatttattttctttttgtcttatctgttattttattcctctttcccctttttcatatgccttctctaggatgattttttaatgattcaatttttgtctcctttgttggcttattaactataactctttgttgtgttattttagtggatgctttaggttttgtagtatacgtctttaattcgtcacgaccctacttcaggtgacattttaccactttacaacagttcatttttattttccccctcctggtctttgtgctattcttgtcatacattttacgtccatgtaagtttgttgttgttgttgtttgaaacagagtcttactgtgttgcccagactggagtgcagtggcgtgatctcagctcactgcaacctccacctcccgaattcaagtgattctcctgcctcagactcccaagtagctgggattacaggcacccgccaccacgcctggctaatttttgtatttttagtagagacaacttttcaccatgttgaccaggctggtcttgaactcctgactcggcctcgcaaagtgctgggattacaggcatgagccaccgggcctgacctacttctataaaagttttaaactgcagtatgttgttgttatttttgctttaaacaatcagttctcttttgtggatacttaaataaacaattctttatatttatcgatgttgtttccatttctgatattgttcattcttttgtgtatatccagattctaatctggtgttgttttcctattccttgaaggactttctttaccatttctttaaaatgtaaggactgtggtgaattcttttaccttttgtatgtctcagagtttttattttacctttgtttttgtaagatgtttttgctgagtaaagtgttaacagttgacatgtttttttgtttttttttttcttttggcacttcaaaaattttactccacttcttactctgttttctgcttgcattatttttgacaagaaatctgctgttatctgtatgctgttctatatatttcctttgtcttttttcttctggctgctttgaagattttgttttcactgggtcttaagcaatttggttatgatttgctttggtgttgctttattcttgtttttttgtgcatagggtttattgattgccctgcctcagcactcctatttcttttaaattctctcttctcttgctttttcttctgtatttctggccacctcttatcttacttaacctttaaatattggtggtcctagggattctgttgtgttttgattccacagggtattctcaggtcatctcattcactcccataacttaatctgctctctgtatgagagatttcctaattgtttatctctacccagacctctctctaagcttcaggttagtatttctttacagccatctctacttaaatccaaagaagccctattgaacgtatttggaatgaatagacctggaggacagctcactaaaaaacttcaagaggctgggcatggtggctcacacctgtaatcccagcactttgggaggccaaggcgggcagattgcttgagtccaagtgtttgagaccagcctgggtgatrtggcgaaactctgtctctacaaaaaatacaaaaaattagccagatgtggtggcacacacctgtagtcccagctacttaggaggctgaggcaggaggatcacttgagcctggaagatggaggttgcagtgagccaagatcgagccactgcactcctgcctgggtaacagagcaagaccctgtctcaaaacaaacaccaaataaactttaagggcaaaggataatctcagagtacttgggcaagttgctagaaaacagtattctcaggggaagcatcaaaggggaaaatggccaagttgatatggtagttgacttcattgtagttccaccagaaagacaaaaaataaacaaacaaaacccttatatctgacagtcgcaggtaacatagcgttgaatactgtggtgaacaagaaattgaaactatagttctcaagggagttaggccctagaagaatcacttgtgagccagaagggaggaataaggacaagggagtcctaggtggcaactattggatggtttagaactctgccaagctaaaaggataatgtgagatttacctgaactcatgaagtgaaatgcaatcctagaggctagtragttgctgctaggaaataacaatgaaaaaaatcctttcacagtggttctaaaacactttataaatcctatttcttttaattatttaatcattttattttggttggttttataggaagaaaatgaaatgctattagcttaatttgattgccacaccaagatgagtagactctcttcataaagtggggaacaaatgaaaatctttgaaacagaagtgatatgatcagcactgtgcttattatatatacccaaaatacatttttggaagagtaatagtcactattttttcaaaacttagcaatgcagtatctgcagtgattccctttcatttagtttctcatccaactaaataagccaactagaggaaccctaagaaaatagaattttattttctttcttgggaagtatctgcaagaattgagaagcttggaaacatttcttgtaaggtaaaagctgtttttttttttttaagcctaaatctcagagtgttatacatacaaaattctttttatttttttctttttctttttgagagagaaggtctcattctgtctcccaggctggaatgcagtggtacaagcgtagctcactgcaacctcaaactcctaggctaaagtggtcctcctgcctcatcctcccaagtagctaggacctactggtgtgagccaccatrcctggcacatttttaaaactttttgtagagagtgtcttgtagtgttactcaggctggtctcaaactcctggcgtcaagcagtcctcctgccttggccacccagagtgctgggattacaggtgtgagccaccacacctgtcccaaaattcttatatgcaattctacataccctcttacacacagagacacacaaagttatgagtttactgttctggggcattttttaaatgttaaaattgcaactactacttagtctcattttcttgtctataagtcttggcatatgtcatgtatctattttagaaaagtaattttaaagttagtagattaagaaacaacatggttgtactaaaaagtgccttatatataaaaaaatctttccatggaataccatggagactatttttccttatgttaaataacatggaggagtctgcactataggaaacaatttgcttagaaactaatttaaaattactcagagccacatctagaaatgtaagtgaactcacaggagtagtacctaattaagtatattctgtgatattatagaaaccttatttataaaaggaaacttgtataatttctgtcttcagggcatttattgataaaatagatgtaccttcactactgctatgcttcattgtaaatgataatgttgatctgtatttgtaccatgtccaaacataattataggcggaaaacacaggcaacaaagatgtggacataatataaacctaaatataggtatatgtatacatatgtgtgaatatacacacacacacacacgtatacatatatgtacacatacgtgtgtacatatgtatacacatgcacaaaaagatctgagaaagtatatgctagtaatacctttatctctctgtgtctgtattgtctgaatttttataattgtgtaatctttattgataatgatggtgggaggttatttttattttgaaatgaaaaaataacatgggtattccagagaatttgaatcagggtattactcttgcattcttcaactactgrtggctataactatgtaaagaagtaaaacatttcctgtaaagacagtcagaagttaggaagatctcatctttatcctgtggacatacagatattttttctttggcccatttaccacagtcgtgacttccactatttcttgggttgtggttttttttgttgttgttttttgttttttttttttcattcaaagttataaatgaacagccaggtgtggtggttcactcctgtaatcccagcactttgggaggccgaggctggcggatcacttaaggtcaggagcttgagaccagtctggccaacatggtgaaaccccatctctactaaaaatacaaaattagccgggtgtggtggtgcatgcctgtaatcccagctacttgggaggctgaggcatgagaatctcttgaaccgggaggcagatgttgttgtgagctgaggttgcaccactgcactccggcctgagcaacagagagagactctggctcaaacaaacaaacaaacaaataaacaaaacccaaaagttataaatgaatatagtttaaaatgtcaaataggctcattttaaaaatcccatgttctcatattctatcatttctgtctttctaggggcaagtattttgatctcttttggcttttaaaaaaatgtataagtaatatgcttgcattgcaaattgttgcattttcagttttaggcattgtatattgatttcccaccatgggagataagatttggcttatttgccactcctaccgtataatctgtttgtcgccctgtcttgattatattgtaattttgtttggatcatcccatttatactttattatgactatgtaaacactatttgtaagtgagcaatgtagtgaactatttttcatttcttgaatacctttttattttcyctgttctggtcattttcttttctttttttttccccctgtgtacttatttctcattcattgccaaaatttttttgccactgtgtaaatctccagatggataagatgaatgtctaaattcatgtgcatgaggtaattctgtcaatttcatgttctatgagaattccctaccagagccttctgaactgatactctgctaaacccaaacacaggatactctgtcatcttgaggtcttctttcattacatctcagatattattttgcctcttgcctgtgttaatcttgtatttcataggcccatgtcctgttctttcttagttttctccctctttttagtgtggcatatctcttagtagttcataggaaaaagctgcatggaaggtaattttttaaataaagcatgcctgaaaatgttttattctatacccatactttatttgataatttggctgggtgtagacttcaacataagaataattttcctttagaattttgaaggcattaatttttccattgccttctaattatagtgttgttgaaaagttcaaagttaggctggtttccgattttttttttctcctttttagagacagggtctcactgtgttacccaggctggagtacagtggcatgattatcgctcactgcagcctcaaactcctgagcttaagccatcctcctgcctcagcrtcctgagtagccaagtctaaggcctgtgttatcatgcctggctaattttgttattttttgtagagacaggtttgctatgctgatctaagctgacctcaaattcctggcctcaagcaatcctcctgccctagcctcccaaagtgctgggattacaggcatgagccactgcgccccagaccagtttctgatctttttctgtaacctgttcttgccccacctctccagaaacatgtaggattctttttatgtgcagtgttctgaaattttattgccatatgaaccaattttagccattatattgggaatacagtggtaatctggaaacttgttctttacttgtaggaacttgtcttgaattatttcattaattatttcttatttccttccttctgttttctctgttctctctttggaactcctattcccagactaaccctctaattttcaaacctgttttcttcctccttgtctttttgctttactttctgggagatatcctgaactttattgtccagcctgyctattgagcttttcctttgtgcatcgtatttttaccctccaagaactttgtgtatacatataaaatacagatgtttcttttttttaaacaataactagttaattgtttttgtttctgtttttgagacaaggctggctctcacccaggctggagtacagtgttggaatcttggctcactgcaacctccacctcccggattcaagtgattcttatgcctcagccttcccaggagctgggattgcaggcgtgtcccaccacgcccagccaatttttgtatttttagtagaggcggggtttcaccatgttggcctgacctcaagtgatccacccgcctcagcatcccaaaatgctgtaattacaggcatgagccaccgcgcctggccttggttaattgttttatagttgtaccatggttataaatgatagcttttttcagagcctttggaaatttatctaattgttgcataatctctgcctgttcccagctaccttttttttttttggtcattttggtcaccattattccacattgaaggctttcctctgatacttggtcgtgctggcatgtctgttcattttttttgacttattttaattaatttatttattttgagatgaaatcttgctctgtcacccaatctggagtgcagtggcatgatttcagctcactgcaacctctcctgggttcaagtgattctcctgcctcaggctcccgagtagctgggactacaggcgcaccatgctgggctaatttttgtatgtttagtagggatggggtttcactatgttggccaggctggtcttgaactcttgaccttgtgmtctgcccgccttgacctccgaaagtgctgcgattacaggcttgagccaccgcgcctggtcattttttaaacctgaatgtgacatcaagctttatagacccagttccagttttgaatttctttttttttgagcagttctatctgacttttgcaggatgaaggaagggcagttgtcyagctaactagagaggatgaawggacctggggatctgataacttcataagcaggttttcaagaaattccccttgctttagctatattctgttagccccacttgtacaggtattttgcattataaattagatcagttctcctatttcactcagcttcactgctagttgaggatgcgtttttctttggtaactttgttaccactcatatatttgctttccagtttctacactttttgttgccctcctatttctttctcctcatttgggtttattcttttacaacacaaaaacaaaacaggcaagcaaagaaaaatctttactgaccttttattggaattttaggatagagtaaaagaagatgatgtgctaagctagcaatctctaccaagaccacttttttccttttgttttcattttattttatttatgtatttatttatttttgagatggagtctcgctctattgcccaggctggagtacagtagtgtgacctcagctcgctgcaacctcctcctgcagggttcaagcaattctcctgcttcagcctcccaagtagctaggattacaggtgcacgccaccacgcccagctaattattttgtatttttagtagagatggggtttcaccatgtcagccaggctggtttcgaactcctgacttcaagtgatctgtgtgcctcagcctcctaaagtgctaggattacaggcgtgagctaccatgcctggcctttttctccctttagatcttttgtttaggcagttcaacttagcagtctagaatgggaattttcaaatatggctgcccatttagaatcacctggaaaactttattatttacttattttttgagatagggactcactctgccgcccatactagagtgcagtggcccaatcacagctcattgcagtctcaacctcccaaggctcaggtgatcctcctgcctcagcctcctgagtaacttgggttactggcgtgtgccacgacgaccagctaatttttgtacttttagtagggacagggttttgccttgttgcccaggcttaaatgatccacctgcctcggcctcccaaagtgctgggattacaggtgtgagccactgctcctggccaacctggaaaacctttaagaaatattatatstggatctcacaattagtgggattggttgttggctagggtgtggttttagttctccaagttattctgttgtatagctggatttgagaattytgatctaaaaaaaawttttttttggaacaaatgagaaaaagcagcagattctaaaaatatgactgttttttattagaacatcatctgttaaaacattccagattctgctagaagtaataacctttctcagtggtattaggaattgagaatgagtttctctgaagggtctgttcctgtttgcattccaacaaatggacgcagtatccaaaattaagtcttcattggaagtgagaaatagtattgtagaaaatcaaattagtagaacagaggacaaacttgagaagcagtcacagaatgtacaataaataaatgttagaaaagataaacattgataatgaaaatctaaaatagaaataattttttttctcttggaaaactaaaagacatggataaacagcagtaatcagtgataaacagaaaaaaacttttaatatataatgtgttatataacatgtatttcttaaactttgtaacttataaatattagaggatacagtgtattactattttttagagacagggtctctctgtcactctggctggaatgcagtggtacgatcatttttcactgtaacctcgaactacagggctcaagcagcccttcccacctcaccctcctgagtaactaggactgtaggcacataccaccacacctggctgatattttaaagttattttttgtagagacagggtctcactatattgcccaggctgctstcaaattcctggcctcaagtgatccttctgcctcagccacccaaagcactgggttgacagacctgagccactgcacctggcccagttacttttcaagtgtctgcaatatttataaagctatatatatacttgaccgtaaacataatagctaattcaaaacagcagaaactataaaagttgttgttgtgagtatactaaaacaaagatttttaaaatgacattaaaaaaataaattatgaaaataaggcattaatgaaaagccaaaagaaaacactgcatgcttttatgatttaaaaagatgaagaaccaagaatttagtataaaatttaagaaaaatagaagtagtatattaaagataaaggtaaaaattatttttaaattgtgtttatatagtggatactttgcagacgttgaagtggattagataatttatgtatatgttgaaatgaaaacatgtcctcaaaacttaaaatcttaatgaaaaagcagattgcaaaataattgtatttacacacacacacacacacacacacacacacacacactcttacatagatttatgtgtgcttataagtccctatagttgtataccaaatttttcataatgttcaggggttttcttcatcctgtagggaagcagctagattatggggtagacttttattttgtaatctcttgtggttttaatttttgttttttacagtgagtattgcatattttctataattggaaataaaaaagatatgttcattttgagggggggaagcaatatttcaccatacgaaactagaaaaaatagtttattacgcattgcatgcctgtatcaaaatatttcatataccccataaatatatacacctgtatacccacaaaaattaaaaataaagattttttaaaaataggaaaaaaggtggaattaataaataaaccttaaaagaaaaaggcttatgaaagaggcaaaatatataagcttcttgcagatctgattaaacaaaatcaaccatagaaagtagatttaaatcacatagaagaaatatatgtatataaatattaggagcaatacatttacacagttatatgttaataaatttcagaaacctctatgaagtttccagatatattaaacattccaaatgtttttttctacatgtawatgcagtgaaaataatgtataaaatgtgatatactgataacttgacaatattatcaaagaactactttttaaaaaaagaaaaactctgggtttgatacatttgctggtaaattcttcagaactttttttgaggaataaacaatttctgtatactacaaaatgttctcagttattaaaaagtaagcaggccaaagaggaatacaaagaaacaaaggtaacacttaaaaaaaaaaaaaaaaaagctatcattcagtttcactttttgaatatagttgtgttccttaaaatattaactggtagaatttatcagaatattggaggaataataagatttaaattaggctaagtctactggactaaaaccttgatagagatatatatcctctatccagaagtcataaatagttcagtattaagaaatatattaattcatcagatgtaataatagctaacatttattgactgcttactttgggttaggtaggcactgttataagcggttttatatttttatttagttatcaaaataattctaaggtttctctagggttatattacctagatgaagaaattgaagcatggaaatgtcagacagtgtgcccaaggtcacacaattactgaatgacagaactggggtaagcacgcggacttctgactccaagaatccattagcttatttggagtttaaatagaaactttaaaaggtttcataaaattaaatgcccattaataatttttttaaaaagaagtagaaaaagtgttctttaacattatagggaatctttatagtcaacagacagctttatatttatttattgaaaaattatagatgtatatatttatggggcacagagtgatgttacgatcttcgactaccatgtgaaatgcttaaatcaactaatgtatcaagctgatatgttaatcaatttccacaactattttacattttttaggtgatgagaacatttgaaatttactcttagcaattttaaaatgttactagctatgttcactgtgttgtgcaataagatcttattaaaaaaaaaaacttatttctcctatcttctaaccatatctggtaaccaccattctactctttgtttctatgagtttgattgttttagattccacatataagtgagagcatgcagtatttgtctttctgtatttggctaatttcacttaataagcatagtattgtctaattccattcatgtttgtcacaaatgacagaatctctctctgttttaaggctgaatgcttttccattatgtatacttatttaggaccacattttctttatccattcatctgttgatgaacacttaggttgattccgtacttggtattttgaatagtgctgcaatgaacatgggagtgtagacatctctttgacatactgttttcgaatcttttgggtaaatacctagaagtgggattgctgggtatttatttattagtttaaaaaaaaaatcctaggctgggcgtggtggctcatacctgtaatcccagcactttgggaagccaaggcaagtggattgtctgagttcaggagtttgagaccagcctgggcaatgtggcaaaacctcctytaaaaaaaaaaaaaaagaaaagaaaagaaaaaaagaaagaagaaccctagaggtagttactaataatggaggtgcatcagaattattcccagtgggggctaaactcccagacatgtatgttttgaagcagctttgtgggtgattgttaaaaactacagtgttggccgggcatggtggctcacacctgtaatcccagcactttgggaggctgaggcgggcggatcacgaggtcaggagattgagatcatccttgctaacacgrtgatactccgtctctactaaaaatacaaaaaatcagggcgtggtggccctcacctgtagtctcagctactcgggaggctgaggcaggagaatcacttgaacctgggaggtggaggttgcagtgagccgagatggcaccactgcactccagcctgggtgacagagtgagactctgtctctaaaaaaaaaaggaaactacaatgttaaaggtacatcaaattttacagcaaagaagtcaccctggaagatctacaaatattcttgtaaaagttctggcctatacaataagacatgaattagaactagaggtataaatgttagaaaggaaaattaaatttttccttacttatggttaagggaaggtttatctgcaaatcctaaggaattggctataaaactagggttaagttcaatttgagtggcaaaatagagcttagaagaacaaaaaccgaaattatgtaataaccactttgaataacaaccaaagtragagtccacgcaaaatataaatattaaaaagttagaaatactcatttttgctcagttttatcttttgaatttgatttaaacgtaaaaattaactagaaaactattaaaattcttcctatttcttatcccattctctgtctctyataggtaatcatttttaattaatttcagtttwtccttctggttttcttttcttttctttttttttttccgaaaaaagccagtagctttatgtattattacttcctctcttacacagaaagtagtagcatactgtatttttttaatattgtcgttgtcactttaatgatgtatcttagagagatcactcccataccaacacatagaaatcatcttcattctttctttggttttagggtattctatgaatgtttattcaatcattcttctattggtaggtattttactaagaatgacattaatgggaacagtgtaactaatctatgatagaaataaaaccttgaagatatgaataaatggacacaggtgcaatagtccaagacaggaaggttaaagatgtaaatatatcagctctcaaaataattcataggtttattgtaattctattcaaaatactattgagctttaaaaatcataacaaaaagatttggaaattcatctagatgaattaaaaaaaatggatagagaaaaacctaactataagataatgaaacagtgaagctataacaaaaaatagagtaccagcaccaggataaaaaagataattgggaacgtggtccagaatgaaacatacaggacataaggatttaatatatgataaaagaagcacacatatccatagggaagggaaagtttatttaacaaatggtgttagtgtaacagtaagcaatttggagtactgaaatttagatttttaaaatatgaactaaaattccagatatattaaataattacatagaaacaataagccaaaaaattaattgtgtatttattgaatttatgcaaaggaacagctaagttcagaattagcagaagaatttaaaaggagattgttgacagattggaccacataaaaatcttttatatcatctaaaaatatagcccaaatgaaatttaaaaaattgtagcagactggaggaaatatttgtagcaaatttccagggttttaatattcttgtatatgaaacccttatgcaaatacataaataggcataggacaaggctggacaattagttaaataggaaattcagcaaataacaaaacatggaaatattttagatgtgaattaaacttctcaagagttaccaggatccattcattaaattagcagcaactcccatgctggccagagtgtaatcactagatgcataaattgctgatggtcttatatgtaaaacaaccatttgaaaagcactcttgcgatgtgtcaggattcataaaaatcttcatactttttgaccctgaaatctcacacctgggaattgatccaaataaaataataacctgccccccttccaaaaaacaaacctttaagcccaaagatatccacagagttatttcaaatagtgaaaaattagaaataacctaaatgactaatcaggggagtaattaaaatgttcatatgtcccctgagagaatacaataattaaaaatggtaatagagactgcaattgaaaatgtaataagggtaatttttttaaagcaagctttcatattgtatctatagtttgatatgagaatgactggaaggaaatagataaaagtcataagcagttacaataagaggataataggtaattcttttccgattttctgtgatccagtgtaatgcaaggctgcactggtaggagtacagcaccgagatcaagagagctaataaacctatgttatgagaggaacacggactttggaggcaggagatgtacagattgagttccagttctgagttttctacttacaaatttgaaggcttgacaagttagtaattactctgaacctcaatttcttcatctgaaaaatggtctgataacattgtcttcatgattattgtatggattaactactagaaagtagttaatgaaagtagtgttctactgacatcacatctggaagaatatatcaatcaacttagaagcaaccttagatctcaatggctaacaactattagaaacaactaaagaagatttgggcatgtaatcccaggactttgggaggccaaggtgggaggattcttgaggccaggcattccagttcagcctgggcaacacagcaatacctcatctctacaaaataaaaaataaaaaaaattagtcgggcatggtggcacccactattgtagtgccagctactgtagagactgaggcaggaggattgcttgagcacaggagtttgaggctgcagtgagctatgatcatgccactgcactctagcgtgggaacagggcaagaccctgtctctaaaaaagaaagaaaaaataaccaaagaaataaagcttctttcccacttatgttatttaactagctgtagactgtgactctgctatatgttttgtttgctctgggatcaaggcagaggggaaacaaagacagtaaagccttaggtgcctcttgaactgcttgaaagtggtacactaccactcctatttcattgaccaagggtaatgtccatggccctgaacattatcctcccattgggataggccaatacagaagggcaacacatattttgaacaaatgatatgtgctgtgacagtgctgtccagttctgtcactttatttatttatttatgaatgaatgaatgagacggagtttcactcttgttgcccaggctggagtgcagtgcggcgatctcggctcactgcaacctctgcctcccaggttcaaactattctcctgcctcagcctcccaggtagctgggattacaggcgcatgccaccacacctggctaatgtttgtatttttggtagagacagggtttcaccatgttggcctggctggtcttgaactcctgacctcagatgatctgcccgcctcagtctcccaaagtgctgggattacaggcgtgagccaccatgcccagccagttctgtcactttaataagggtgtaacaacctggggtacgtctggaggaggaagatttggacagtgagtaattctgaaatctttactaaaatacagtgggaagagtcattggaaagggaggggcatattaagtctcttcaaatatttgaagaatggctgtcactggatggtgagattagttcagtgctgtgtggcatcagtgggtggaagttacggcctcatatattttgactcagtatagtggtaaggagaaaagtgagaagaaaaggaaattattggttgttttcaatatgttactcatttacattcttcaaaataatcctaacagagcgtgtatgtttctgtgtttaaatattggaagaaagactcagagtgaatgaatacccaaggtcacatggcacgtaagtggcaaaaccggtttggaatccaggtctgtgtaatcttgtccctttctacaatattctactactctctgttgggctgcaagcatttttacaattaaactgttcatcaccagtcatcatctgcctgacaaagtaaaggccacatctcacacatgtctaaaagggttcaaacagagaatgaatggaaaggttgaaaggaaggttgaactctagatcaatgatctgcaaacttatttgatcataagtacctcttagcaaagtacttgtacatactatatatgtagcttatacataaactattgtactcatatgttgtaaagcatataggacattcccagtacraagaaatggtaaacatttgggatgatgtgtgtgctaattcccttgatctgatcgctatatactgtatgtgtcaaaacatcaccgtgaaccccattaatatgtataattattatttgtcagttaatttttttaacctataggaaaaataagagtttaaaaagattaagattttatataacatttyagtttttttataaattagatttcaggttttatgtaaaatctcatctttataaaactttgttttgcagatagatacttttttctgtatccctgtggaytgtcttttgtacccatggaaatgtatacccccaacattggaggtcattgttttggatgattttgtaagactcatttcagtatgaagattctgtaattctttttgtccagaatttttttgaaagggctaatggtagcttacttcactttcagaaaggtttttaaatagttttatctaaaaccaaaactatagacttcactgtcatttgtaacagcaattaagcccaaaaactacaaagtgtgaaaggtgctattctagataaacagtagcaaccccatgagcattacaatgtatatataaatggagatggaagtgtaggggctattattaagtaagaaacctgatttttatttgtgacataagaaatagccttgttattttagttatatcttctctttctaaacctatatatatccaaaacttactgtagtcatatattctaaaatgcatctgaaattttgcctagagagtaatatgaatttttggacttgagaaattattttagcactttttaaaaatagagccaacgatttaaattaggctaagtctactggactaaaatcttgatagagatacatcctctaagaagcaaagaagttagttacttgcattgcctgacagagggaaatgttagctggttttctrcattctgggccttagttattggcattgccaggttgatgtttcacaattaagacaactttttctgttagtgactgctccttggtgatagattctttaagaaaaagccatcctagaacacataaagcagaaagcaaacctagccttttaaagatactgttaatgttgagatagaattctagatcaacaagtgctcttttctatttctttctcttaatgatacgtttggtatcgactttttgcgtgacatattgcagtttggttggaagttgtaaaggaagtgtttcttgcaagtatgatcaaactcagtttaagcaagagattgaaacagccaacttcagctgcttattcagcacaggccttaagtgccccagaagccgatagtttcttaataataactcttagtgatcattttcttctagaaaattaccctggaaaagtagtataaatagtttaatctgctatttcttaaaattttgtattcctttactcattcaacaaataaatagtattcagtgcttctttgtgccaagcactgagggctcattagtgagcaaaagggatattaaccactgttttaaaaaaaaaatgtatctaacatgtactaaaagccaatggatgtggtgatgcatgcctatagtcctacctacttagaagggtgaggcaggaggatcactttgagcccaggggtttgagtttgtgctataatggtgccactgtactccagcctgggcaacagagcaagaccctgtctcttaaaaaagcaaacaaaaagcctttaatggaactattgttgctcataacggcatactttagaacccctggtctagtctgactgtgcttacctacctgcttgcatgcgtttctctttcttcccacctctcttcccctcccttccttcctttcttaattctcttctgttttttacaactcttttccttctttgagttagtgacaataagcaaattttgaactcatctaagattaggagaaaaactgtatgtgatatttattgtataaaacttgcatggtagagttaaacaggagatgataaaattcttaatttactttataaaccaaatgtcatctcacctgtctagctctcaaggtgggtatgtttgttacttcttccagaaaccatgtctctttaaatgggtttatatcattctattttaaataaaattcgtatgtttttatacaagtgtgctctttagatgcaaacatttatatgattagataaattttccttagtctttctttgattatgtattgtctgaatttgaatcctgatgtgttattctggaattagccatttttgtttctatttctgtttgttatgttacaattagtgtatttcttatttttcagtgctttaattgccttgttatctaaactctagaatatataccagttaattaaagacatgtgtgttttttttttttgcttttgtctttactggcgaatttaaaggtaattgaaagtataattcttgtcktctttagcatcagacaacagtcagcgctttcgagaaacctgttttgcatttgccttgacaccacaacaagtgcagcaaatcagtagttccatgtaagttgtcgtcaagtgtaacttgaagtttgacctttgaatccagtagtctataataaatgattttaaaaaacagtgattggtgagttagtatttgtgtgatgcaaatattagtaatgaaagtatagtgtgttagttactgtaagaacagttatatttatgataatttgaaaaacttttctggagtaacaaggtctttgaatgaactttcatgcaaatactttaaaagtaattgtaattcctattctgtctcttctagggatatttctgggaccaaatgtgacttcacagtacaggtccagttaaggtacagtgctgactataggatatattcaaagtttaaaagataatattccttttcacagtacgggtccagttaaggtacagtgctgactgtaggatatattcaaagtttaaaagataatattccttatcaggaaggggaaatggaaaaaaaattttaaggaataagaggaaatctacctgatttttcaataagtgtattgaaaatattaggtttagatatttgggtgagggaaaacattctcctgttatgagatattctaattttcatccaatttagatttttcccctgcccgcccaccccccagtttagatttcaatatagcaagtcatgttctatatatctaaccatatttgattgccctcagttggttgagaagctccagctaatgatatcttacaatatcatatcaagttttatgaaagcatgggccttatctccataagaggcaaagtactgtggataaggaattagtacttaagtctacagtatgtcatggactaacaaacatcaaaatattctaatttgttttgttctgtattttaaataatttaaatatgctctaatttaggatccatttgagacatctcttaaaaatgttcaaagactaatgggaaattttccaacatggattcacaaccccttattgagtttcttttcttagcccattcatttgtcttagaatatctaagaaatattttgtattatttctctcccttatatatctcccttttatatacatatatatatatatctcccttatataaaccatcatattatgctttattattcgatttaccaacttaaatgtccacactgttggaatagggatggaagagaaaatataagacagttgttttcctcagtaagctgttttccctataattgtcaggaggataaatcaaacagttagccttgtctcaataatcagatactaagttgtatgtacaagttacaaatacactaggaggctaaaaaagggattaatctaaaacgcctgttcagcacttcatggaaccatgtgaaaacctctcatctaagctttgaaataataaggtaaaaacagtgagaaagcagagttgaagtcgaaagttgagttgaagattctaaagaggatatgactatacttaataacttttataccataaaacagtatgacaggaccttactgcagtagactagtgataatctaagtttcagttttggaaggcactgctaaagatgattctgtataaaaggtatattttatgtcggccagattgtgataatgactgaagaaattaaaggacaaaaataagatgtctccatagttaattatgtattgctgtagtcttctttacttcctgcctcaacagtttacattttgcttgtgctgatacttgacattatcctttaaatcagtggttttcaaacttgttgcatggagccacccttaggggttcatactcttctgccatcctcctcttctctcctaaacacatacacagtctgaaccaaagtggggcttcttttatctcttttatctgttttgcatgtttgactctgggttaatttttgcttaaagacagggtcccaagactaaaataaagtttaaaaaccgtagctttagaataaaagatctagttactaagtattttgtattaatatacatacattctttaaagcagcaacaggtgtggtccacattttgaagtaaggttgtctagatagatgagctataattcagagattccaagggtatcttgatgactgctattttaattgaaatgtatctccaggacttggaaaaaaaaaaaaaaaagaaccatgttgtgttatatttggtaattgttaggtggttctttgtgttttaataaaacagttcatctctctccctgccccacgttgctaggtctgcaaccctagtgtattatttaagttaggagtgtatgcctatctgctatcctaattagaaatgtttatctaaagcataaaaataattagttgagaattaggatccaagttttctttattagacacctagtctgttttcatttatgttgtgcctccctgctccactccctcctctctgccccatgaaccacttcacagaaactttctgctattcctttttttcttttttctcttcagttcattagggtgatttagattagttgaatagacactgtcttgtcatttaaattactcttttcctataggaaagggttcaggcagccagggtccatgttttaaattgatcactgcattggaataattatttaaaaactgtgacatccttttaactattgcagcctaaagaattagcctgtaatggaaggttctgctggggttaggagtggtcctgtgagctttgacatctgtttgctaagtatatttctagaaaatctttgtagatcagtaaatcttaacttttttatggatccctgatmcctttgagaatttgatagaagctgtgaatggtttccctataaaactgaacatgtatatgtactcaaaataatttacatataaaattgttttatattgtgcacgatccccgtactcagatttcatggccagcaggttaagaccccataccgcaggtgttgagaggagttgttggcacatgaggaatatttcacagatttcggagatagggttctccctactatgtaactcaggggtgctattagcattctataacagtgcaatgagccttaggtgtatattgagaataggtactaataaagaataaatgccttaaatagcaaaatagtaataagagtgaatagactgagaatttatgaattatgtatctttccttgatttttccaaaagactgcatttaatttagaaatatttttataagtttctaaaatagtattctaaatttatgtggctataacacaaataatattcaatatcttcagttctcaaaaaataaggagtactttggcttactgatcctggggatggacttaaaagcattctcagtattttctgctaagaaccagaaaagtgtttcataggcaaataaatttggaaaatactgcatacaggtggtaggtcttcctcttagagatttataatgcttattagcctattaaaagctctgaaaagttctgtattaaggaagcttaatttaattgttttgattcagaatttcttaattttatttgactaacgagtctttttttcttttaacatctgttaatcactgaagaaactagtgcttctcagaacatgcttaaccaaataattggcagtatcacgaagacaactacagggtgatagtcatgattaccacaactctacattgacagaattatttattttaaacctatttacatatacttattaatagggtgaaaagtccagtttttatagttttcccttttggttgtttttaaatttaccatcttttaaatttatctatttaacaataatactaatgaagtcatcctttaataaaggaaattaaacttgtcctttattgtttaggttttgtttatcagaaaccagttgtccacaagaagatcacttcccacccaatctttgtgtgaaagtgaatacaaaaccttgcagccttccagtaagtcctaagagctgttttttaaaattcattgccaacataactatcaaataagtcatcacaactgttgttaaatcatagtttttccttaagaaaacatttttattttggatatatattcattgactgggtgaaacacttgtaccaactatgtacagttagcagcagtgacattagctttggggacataggatttggagttgggtatggtagctttagtgttgtactggattttggggcgaagttttttcaacaaaatctcagctgtgttcatgtgagtctataagcctatggtagaatggagatttgaagaatgctatgtcttaaacaggaggtaagggtgaggactgtttttggtgcccttgaaatactactactcatgtacctatctaagcttgttatgaattcatcctgatttttaaatttaagagattttgaattttcatcactaatagttttctcaggtttactataaggagagtataaggttgtttggaaaaataataacacaagaaacttgtaaatgtttgcttctctactttttaatgaaaacattcatattttctagtatgcagtttgtarggggttttttcttaaggaatggaagtcaaaatgattgtggaaataataagtataaataaattacatttcatttttagggttaccttccacctacaaaaaatggcgtggaaccaaagcgacccagccgaccaattaatatcacctcacttgtccgactgtccacaacagtaccaaacacgattgttgtttcttggactgcagaaattggaagagtaagtaaatttttgtttctaccagatttttgtattataaggaggggttaatcaccatgcctatctgaatttatatgtaaattatgtaaaatgagctgcaaaaggatttatttttgtctcacaatgaattttcaacatgtttccatttgaaaaatgggattatgaagtatccagtgttttataacctggcccttttactccacaattgatcataaatgtcctcctgtatcatcacatgttcttctgcattattttaagtgatgatatcatattccaatatgagtatgccataaatttgcctgttccctactattgagcgtgttacttgatttattgattgattcattggtatgtcaaagaacattttgaagaccatcttagtagctataactttgcatgcatatgataatttccttagggtaaattctcagaagtgggattgctgagtcaaagagcctacagaattttaagaaattttgtgtacattgacagattaccttctccaaaggtgttgtacaaatttattctctgactttcagtgttatttgcgtgctcgttaacactattatcttctttgaaatttttaccaattctgttaggtaaataatgccaccactgtgttttaattagtacttttttcattattactgagattgaatatgttttatatttgtgattacattttaaaactgtatccgtgtctgtttctctattgctgtttttgttattgattatgagatcttcatatagtaaaacttaactctgtttcatgttacaaatatttgtttccagtttgttggccttttatttttatgttatttaatatgcagaatattattaatattatttatattggctacacaaagttttcgtatagccaaaacttaaccagttatttcctttatatagtcttttctcgtctccatcatgctttgcctatctgcccttcccaagctatggaattatttgtttattttcttctagacttcyaaggtttcatattttacctttaaatatttagttcatattaaatatatgtgtgatgtgaggtaaaaattgctttctttcactttttaaatagctggttctaacactgttaactaaataaatgttgattctgaagccaccattgttatatatttaacttttacatatcctgagtgtgtttctgatctttttctatgttgtttcttagtctaacattctttttttgggacaattttcatgatatgaactcatatgtatccaccagttcatttgaaatttattgaatgcttaccatgtgtcatctactatactcaaaactggcagtaccatagggagggaaaaaagttcattttcatgaggcctgtgatgtaggggcctggtggacacatacaaagaatgtgaacttacttataagtactataaaagagaagcacatggtgattttacagtgtatcaaagggcactttgaacgagagagagcagtcagggagggcttccctgaggaagcagtgactgagccaagagctgagaaaagagttgcaatcaggtgaaaggttcagaggaaactacccacacaacagcccagtggtaggagtgagcctggtttttacaagaagctgagagggattcactgactagagtgcagagaatggggaagagtggtatatgagatgtggctagaggggtaagataggactaaaccattcagggcattgtaggtaatgttaaagttaaggattttctttttctttttctttttttgagacagagtctcactcttggccaggctggagtacagtggcacaatctcggctcattgtaacctccatcccctgggttcaagcgattctcctgccacagcctcccgagtagctgggattacaggcacctgccactgcacctggctaatttttgtatttttagtagagatggggtttcaccatcttggccaggctggtcttgaactcctgaccttgtgatccacctgccgtggcctccccaagtgtgggattacaggcatgagccactgtgcctggccaggattttctctttttaagcagaaagtttatagtgctgtatttctttttagaaaagatcactccttggagtggtaaatagtttaaatggaggccagaatcgtgcagaaggacatctcttaggagccagctcttgtggaagtattagtgaaatggtatctttgtctagagtggtggcgatagaaatggaggtaagtaggggcatctgcaggattgagtgatgaattgaaagtcgagggctaagagaaagggagatgtgactgatgagtccttggtttctgggtggggggctaggcaaatgatattgctgctgagatagaggaaacactggaaaaggactgagtgtgggtgtgttttgttttgtttttgttttgttttgttttactttgaagaatgggcattggaggacaagatggagaaaatyatgaatttacttttgaaacttttgagtttgaaatgcctgtgagacatcctgaataggcagtggggcagataggcttaaaggatacatttgggctagagggaaaaaatgtgtgagtcatctgcatattggtggttattggaaccacactggcagggctgacattgattctcctgcattactttttttttttttttttttaaacattctttcttccagataaagtagaattactttatcatatttcttttcctcgctcctgtaccccatttgcacatctttctgagaatttggatgagatttctttaaagttatagattaagttagggagaatttatttacaatatttaatataaccattctaggaactgtattttcaaatcttcttttatgttcctcagcaatttaatgggtttcctacaattcctgcatattttttgctaattcccatgttggttgttattattactgctattataaaaagagatctttttttctgttatattttcaaagtatttattgttggtttacttaaaaactagttatttttaatatttatttcatagctaaattcatatattggttctattagctttttagatgatttattggtatttctatgttgacagttttgagttttaggtatgtcatataaattatattaccctaatacttttgtcatttatttcttgttctactacctagaactttgtaaacagcgttaaacaatgcaggcactagtggacatatttgacttgctccttatgttaatgagaatactgctactgttataacattattataatgttgctattaattttgatagaatattatatcaatgatgtatttctatatttctcttactggatttttttttagaaatggattttgaattatatcaaaattctttttgacatctctcagggttatatttttttcctttaactcatatgtcaccattaggtttttaaaatccttttaaatattttatttctagtgtaccttggagttccctttttcctcctttttggggaaagttttgaaaatgttttgtttttgtgtatgaaaagaatagctcaccaaggaagaaggggagtgtttttggtgaaataggaaagaagtctgaaactgtaggagaggaggggaatatggccgctgataaaaagcactagaggaggggggaaatactcttccataggaaggcttccagctacaaagatttgaagacatttttctggggaagtaaaacactaaatcagcattattttccaaagcccagaaaataacttaatagattgtttttaaattactgttttaattcagcttgtgaagatattctgaatagttcatgtagaatatcttactattttgcagatacttttgtataaatagttgccagtgagaaatgttgcaactgtgtcttttcaaatgaagtaaataggagagctagtatagcgcctgaaagaagtaagtgagttatattgtaacttcttgctctacctcagggtaagcactccttttagcatttattaaactctcattatttgtagagaaattatttagatgtaggttgagtattcctaatctgaaaatctgaaacacaagatgctctaaaattcaaaacaggatgctcaaaggagatacttgtttgagcatttcagacttcagattttcagattagggatgctgaactggtaagtataatgcagatattccaaaatctggaagaaaaaaaaaattcagagtccaaaatacttatagtcccaagcatttcggatcagggatactcaacttgtactagtgtaaggggcacataatgaatagagtatatttcaattacagagaaattatctcatgaacttgacaaataatttttaagacttttgaaaaagcaataaacaaaactatcagtataatataatataatatagtataatatatatcagtagttggaattagtatttgaaggattagcaggaacaataaaatactgtctacctagaaaagaatctctgtcactattaagctttggyggggttttttttgctgctgaacctctttcatatgatgtaaaaatttcattttatattaccagtacaagtggcatttgttagtaccacattctttttgctgcttttattttatttttctatttgcttacatgtttcaactagagtgagcataccttttcactgaacttgttgcagtttctgcttgatctcttcttaaatatttatataaagccttagggtaattccaagttctgaagattcaagttgtcaatacatagtttcacattgttaattagcatttctccagtttctgtcatacttgaagcattaagcaagtaaataataatggtgaataagatttttttctaaaagaagctttccagttgggcctggtgactcatgcctgtaatccaagcactttgggaggctgaggcaggcggatcacttgaggtcaggagttcaagaccagcctagccaacatggtgaaaccccatctctactaaaaacaaaaaaaacaaaaaaacaaaacacacacacacacacacacacacacacacacacaaaaattagctagatatggtggtgcacacttgtagtcccagttacttgggatgctgaggcaggagaatcacttgaacccgggaggtggaggttgcagggagccgagattgcgccactgcactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctcctgccccaggctcccaagtagctgggactacaggcacgtgctaccacacccggctagttttttgtatttttagtagagacggggttttaccacgttagccaggatggtcccgatctcctgacctcgtgacctacccacctcagcctcccaaagtgctgggattacagtcatgagcccctgctcccggctgggaaagttttaatgttacttgttcctcattaatgtgaaatttattaatgaaggtaaattcgcttttttgacacttctttttcctccctctcagaaaatgtgtagcatgtaaacacagatagctttccgaactttaaataaaaatatgaccttccagagagtattgtagtatattttctgtcaaaagaggggagtgcattaagttccatgtcttaatattcccaccctttccctttggtttctagtgtctgctctgtcatcaagcagttgcctaatcatgagcagattgcataatctttttgtgcctcagtttcatcagcccttcacttagaaaaatacctatcctacctgtgtcttaataggccttgtgcaaagtttaaatgaagtaggcagcgtatgttaagaatgctttgaaaaatgtgtgtagctataaaatacaagatggcagcaattatttttccttttacttcttttcaagtctcttgatcttcctcttgatcccagcaccaaatagaaactgatccttctcatttagatctccttcctacccttcgtgaacctcagccgtcttttctttctcttacccaaccatgtacccttcacttagtcttagcttgttgattaactgtttttttttggttttggcttttcttttttttttttttttttggtccccttctacctctgtcatctctgggtagtctgtctgctggtaatggatattcatctgttcatttgccaaaccagcagcttctgtttgaaaaccttctttaatattccctctgcttgttgtgataatggcccaagtataatcttttcaagagctacttgaaggcatagagaaaggttaaaaggtataaattaggaagcccatctcatttgtcatttaaaaaaaatagatactattttagatatatctgttacctactaaatatggtttatagctttgacatcttattgtctttggcttatacttagtcttaacagtattctttcatgtaagtgccttaaattcattagcttcaagtataggtaatattaaatccaagacagacctgggtttaaattctaggtttgttacttgaaaattgcaraattagggcaagttcttttacttctctgtacttcagtatcctcatccataaaaacaggtttatgatcatctcrgcagctttttggtcaggattaaatgaattactgttcatgaaaacacctaagactgcttgacacacagtaggtgttttaagaagtgttagttttctttccctatcatggtgagattaaaatagatgtactatttacttacatatgttgtttgttttctacatctttttttttccagaactattccatggcagtatatcttgtaaaacagttgtcctcaacagttcttcttcagaggttacgagcaaagggaataaggaatccggatcattctagagctttaagtacgtatgataaacttatttcacttattcagctattttgttaaaggttagagtagtattttctcaactcaagaaattttagaatttgtttattcactggagcctgttgtgtagttcttagagtagttctgatatctttgtcatgagctatattttataatctatattttactaatcttaaaattaactttgtgaagtcagtgcacaaacatggaagaatattattctacaacttcataaaatcaatgtttaaggaattctgggaaatgggaagggcatcttggcataaatttcaagaaagttattttagattggtggtttatccaggaaaaatgtacagaattatatcatggcctcaccccctgcatttacaaagtgaagagagccagtggggtggtagaaataataattctgccattaatcaattatatgactgtggacaagtaacgctgctcctgagtttcatcttcctcatctgtaacaagaagtttatgccgtctgatttctaatgcttctgcgaagtctgggttcatacgtgtgaattactggatggtttgttttgatacgttgaatttgagattcaaggtcttcaaatggggctgtgctgacctctgtttttaagggttaaggtcagagggtttggcctttccaaagaggtgaactaagttcttcgtttattcttttatttgtgagagccgggggctgcgtggatttaggagtgagggctggggacttagaaacaaaacttttataggcaggtgttagatagctatcctttaaggacttttgatgtgaactgattaatgaagcccattatcagatttgtacttaggaacactctggtggaaagaactaagataatagcagctttccttttgtagcatagctattacccctttctgtaacttatttctgtggcagagtaaaagatcccactacccctgaatatcaatatacccttaatagttcattgaagaatttttctgtattaaaatggtcctttaaaaatgcagctaatcctgaatcaatgggagcacactttggctaatgcctctgtaggcatgcattgacagatgatggagacctagaagggcagcactgatttgggatctgcgggagtggtggcaccatttggcagggataagaagatggtagggatcctgaaagaaaagacagacatctgccttgaaggagagtataagataacttgtcttctatcacaatcttgctgaagttattcctggtcattctactgagaatcttcgtatttgcctcacaatactagaatctcagccagtcagaaagcaaagaattatgtgagcctgtatggaagagggaataccaagaaataaggcagatgaagttattttatttaatagtaacagcaacaacaacaataaggccaactgtctttgctcaagctgttaactcttctccgcttgtagctatagcaccacctggagggagagtgggaacgtgagtctggaattgaattattttattttctccgagaaaccactattagctaccattaagcagcaaaaactgtttaattcaaaagctatttctagtctgatatactgatggatgtggagaataattgtacactggatgagatttttgtggaaattgataccttaccttacttattggccagggaagccaatggaatattaatttggatcccaccagtaagaaatttgttgtaatttactaaaaaacaggttatctacctttacctgtatgctgcctgtaaaaaaaaaaaaaaaamaaaaaaccaaaaactttcccaacaaattatgtaattaaaattctgtttacaataacttgacaaaaggaaatgtcaggtattttaaaagagtcaaatcagttacaaatatgttctttgtaagtcattcttaataaaataagtacttctagcaaagttttagtagtcaagccagacactcttatgttcttgaaagaataaagttggtattatttagacttttcacagagaactccattctctgaatcatttgatktagtaggattttgtcttgcagtttctgcctttgtgtagagttgtcccctcacaactatgaaaaacagtcttttaccaactcttaatcaagtttctttctcctcttccttctcccttcagcagttatttcaagccttagccataatctaatcaaacactatccccctctctcagcactctgccaatgcatgaaaattggggctacaagacatgaattacctaaaccacccatttcttccttaatctcagtgccaccataattacttttttagcttatctacatttgtgcccagtcctcgctttattttgttcagtgtcaagaggaaatctccctttccctgcttattcatttattcttttcattcaagaaattgtgttaagagtctactgtgttccaggaacaggagaatataacattaaacaagacacataccatctctgcatcccccagaagtttgcagtctggtaagaaagacaggcattaaataattgcacaagtcattaatgagttaaagttttgacatgtgccttgaagaagatagacagggaactctgtagaggtacaataggggaacgtagtcctctctgatactgtgatacttaaggcaagattataagtatgaggagaagttaagctccaagatgggaacagagtatgccaggrgaaaaggccagtgcagctggaatagagagagccaagaagggctgggtgcagtggctcacccttgtaatcccagcacattggaaggccgaggcgggtagatcacttgagtgaggtcaggagttccagaccagcctgaccaacatggtgaaaccctgtctctactaaaaatacaaaaaaattatcctggcatggtggcatgtgcctgtagtcccagctactcggaaggctgaggcacgagaatcgcttgaacccgggaggcagaagttgcagtgagctgagatcgcaccactgcactccagcttgggcaacagagagagacactgtctttaaaaaaaaaaaaaaaaaaaagagagagagagagagagcgccaagaaggagggtgaccagagagttggacaggtataagttgacatagacgatatgaagatagatgatagaaaaccattaaaagatttttaagcagaggagtaaatgacacgattacatttagacaatctgattctcactttgaagacgaatcaaaggaaggcaaggctaatgcagtgaggccagttgagaacctgtttgtaatagtatacgtaagagatgataatgtcttgaactaaggtgatagtggtagatagaagttgacagttttgagaagcattgaaatggcattgactgtgtgtgtggagtgatgagtccaaggaggagtgctaagcttcttactcaagcactaggtaacatggtaatgccatttactgaaacagaaaactgtgttgaaaagatcagattgcaggggggagatcagagtggactgttagacttgtggtgtttgagatgggatgagacatccaggtagagatgcttggtaacagtattatgagacctggctccctcatatatctgctctttgtcctgtgttttcagttcctctctgtctgcaggctttttctgtcactctgtgctgtcaagactcttttatcttttaaaaaataggaaaacaagctcctctatggatagagctctgtgttcctcccattgttctcatcckaatttttgtgagagtagtctacacttgmtctttttacctcctcactgcatctcattatggtctttaaccctctatcattccactgaaattgctctttcagatgtcacaaatgatgatctgattgctaaatttaaagtgtatattttcagttttcatcctgaatacttctgctgcatttgatatgaaccactttctccttgaaattctctcctttcttctctgaccatatcttctcaatcacctgccttcaatggattctcttaagggaagcattctaaatgtggctgttcttggagttttatcttgggtgcacttttctacgcacccttatggtttaaaactaacacccaccccaaaatacatgtcttcatctcagacctctcccctgcgtttcagacttatatagctaactaccttcacctaagcatttcactggttcctcaaattcaagtatttaaaactgaactcaccaactcctgtcaaacttactccctaaatatttctcaaatgtgccttctgtctatcatgctatcattgcccttgtttaagctctcatatcctgcttttattttaaaaaccattcttagataaaacatccctctccttgacgcctttttctatctcctctggtagcctcctaagtgatttatacagatctaaaatcttaccattctcattcccttgcatttcatggcttcttaacaccaagggaataaaaactccaagtatgttagcatgacacacaaactttccatcatgtggcacctgcttattactttccagggtcgcctgtattcactctgctttttaaactttccatgacgtggcacctgcttattactttccagggtcgcctgtatttactcttcttttcatacttcacattccattccaaaaatatggaactctttagtctttcttcagtgctttagttttgtgctctatgcctcaaaactcccctgctgccttctctgcctaatgtcattatcctttgtttcacttttttccaggagacatcccagaacccccaaaattgatgagttgacttttggttagcttcctgaacatactccatcagagtgcattagagatgatctcactgaacatctttaccctctactagattatgagttctttggaggaggaatttaatcttattttttttcttgaattcctattgctcagcacagtgccacatacatagtagatctgcatatttttgaagtaaactgatgaaaagacagctacagaaaaaaatcaggtcttggtgcctgtttctttgcttataaaatgaaatattgatcttaatatgtttgattgttttcggccttaaaattttaaaaggctgaattaaaataacctgatattaatgaaggatagaaattatcttgaaataataacaaccccagaacaccagtaatagaacaatctgtgataatggaagtgttctctatctgcactgtcccatatggtagccaccagcaacatgtggctattgagcacttaaaatgtggctagtttaacggatgagctgaatttttatttaaatttaaatacagcgtcatgtgagtagtggctaactcctgtagctcatgacaacagggattaaaaacaagattaattctgctccccaaatcgacttattgggtaaaacaagattaattttaaatgtgactagctgtaactttattatagtcatataataaaatactgttagcactgcagatcactgtaacaatgtgaaaactttaactcccagagaacttcccacatgttgactgattactgcaggacaaatattatatgtcttatttttattttttattcccttgctcacaagtaataagtgcttctacttttactttattttttcttcatactttcttatgattaaatatagcatagtgcttttcccctccgttttctctctttcttttgagaaagttttttaaagtataacttataggcaataaaaattcctttgacagatgtatacaatcatgaaccactgccacaatcaaaatatagaacatcctttaccccagaaagttcatctgtggccttttgcattccatcccatccttttaccattgatgtgatttctgctctgtagttttgtcttttccagaatgtcaggtaaatgcaatcctacaatatgtagccttttgcgtctggcttctttcacttagtataatgcttttgaagttcatccatgtagtttgttctttattgctgcgtagtatttcatttatgtactataatttatccatttgataaatgatggacatttatccatctgataaattgatggacatttggattatttccagttttgcagcaatatgaataaagctgctgtaaacatttacattttgcatatggatacctcagttttgtagacatatgttttcatttctcttgggtaaatacctaggagtgggattgctgggtcatatgataagtatatatggaaaacagtttggcaatttcttttaaagtaaatataccatttttgcattcccactaacaatgtgtgagatttcaagtggctccacatccttaccagcatatggtatcatcaggctgctttattgtagccatcgtgattggtatgtagtggtatttctttgtgcatttttctgatgtctaaggatgttaagcatcttctcaggtgcttatttgccattcttatagcttctttgatgaagtatctgccaaattttttgcccattttttaatgtcatgcttttgatatattatgaartctttgcctaaatgaaagtcacaaacactctcttctatttttcttctagaaattttattgtttgagctcttggatctaggtctgtgattcattttgagttaatttttgtatatgcaaggtgagagtagagattcattttttcccccacatagatatcgaaatattccaacagcatttgttgaaaagactgtctttccttccatttcattaccttggcacctttatcaaaaaccarttgaccatagatgtataaatctatttccggacgttattcttttccattgacctgtatgtctatccttatgccaaacgagtcttaattaccgtagcttgatagtaagtcttgaaatcagttagaattctccaattttgtttttctttttcagaattgttttgaatgttgttaagtccagtaggtgaaacaatacatggtgaccaaacagaatttatttctgtaatacgaagttggtttcagcattcaaatgctgaaatataattcaccttctcaacaaactaaaaatgaaaaatcatatgatcatctccagagatgcagaaaaagcacttggccaaattcaacatccattcatgataaaactgtcagcaaaatcgagaagggagctgcctcagtgtaataaagagtatttacaaaaagtctacactacagctgatatcatcactaatggtctaaaacttgaatgcttcactcctaagattgagaacaaggcaaggatatctgcccctagcgttgccctagagatcctagacagcacaataagacaaggaaaagttttaaaaaagaaaccaacacacaggttagaaatgaagaaataattatagtctttatttacaaatgaccttatggtctgcatagaaaaagatcccaaagaatctccaaaaaagctactagaaatactatgtgagtttagcagagttagagaatgcatggtcaatatacaaaaacaaattgtatttctgttagtaatgaacaattggaaattgaaattcaaaaaagattttacagtaacatccaaaaatatgaaacacgtggggatacatcacacaaactatgtgcaagatttgtatgccgaaaactacaaagcatggttgagaaaaactgaaagaagacctgcataaacggagagatatatcttgctaagagattgaaagattctattgttgtatgtcagttctccaaattaatctgtagaattaatccagtctaatcaagatcccggtaggaccttaaaaaatatctttacaagaataaaaggactaggattgggtctgtaatggcaaaagagaaggcataggtttttttttttttttaatagaaattggcaaacattctaaaataatttcagaaaattctcccacctctgagagaaagtgaatatataaatcgtgttttattttaagtaacaatagctaatatttatygagaataatattaggctattttaaaactttttttgttgccagcatggtggctatgcccatattcccaatactttgggaggccaaagtgggcagataacctgaggttgggagtttgagaccagcctggccaatatggtgaaaccctgtctctgctaaatacaaaaattagctgagccatggtggtgcacacctctaatcccagctacttgggaggctgaggcaggagaatcacttgaacctgggatgcagaggctgcagtcaaccaagatctcaccactgcactccagcgtgggtggcagaaccaaactnnnnnnnnnnnnnnnnnnnntggcagcaatttcagctcactgcaacctctgcctcccaggctcaagtgtattttgaaactttttatgcatattaactcaatccttaaaacagttctgtgaggtactattattgttcccatttaccggatgatgtaacaggcatagagaggttaagtgatttaactgagactaaattctaagctaggctatccctaggtcctatgctcttaaccactactttatgttgcctctcttatttcaatttattttctaagcactaaacactgagctttgttttgtataaggttgatactatgatctataatattgcttcatttaagtggaaatttaaatatgcaaagttcaaagtcagttactatgcccattgcttgctatgtctataaagggtgctggtgggatggttggtgaaggcatgtagagtggttattagtcagggttctccggagaaactctaggaggggaaggagagggagagaggaaaaggagagagagagatgagagagagtgagttaagaggagatgtattaggggaattggctcacatgactatgaaggctgagaatgcccacaatagataggccatcagcaagctggagaaccagcgaagccagtaatgtgactattgaagtccaagggccacagatccaggaagccaactctcaatctaaggccaaaggcctaagaggggtgaggagaagggctgatatggtggtacaaatcccagagtcccaagcccagagaacctggaattctttctttttaaagatggggtcttactgtgttgcccagactggtctcaaactcctggcctcaagcaatcctcctacctcaggctcccaagtagctgggatcacagaagtccaaaggcaggagaagaagggtatcccagctcaaggaaaaagagaaagtgaatttattttcctttcctctgcctttttgttctttccatgccctccagctgatttgatggtgtccgccaagattgagggcacatcttcctcactcatccacagactgacacaccagtctcctttggaaacacactygcagacactttcagaaattatgccttgccagctatgtaggtagcccttcgtttagttagttgacacctaaaattagccaacacagtgagtaatcacattagaattctatttgcatgtttatttcatatggcgattatttgttgcctttaacaaagatactactttktaaaatcatatttataagaaaggattgactaagatttggtgtataatgacaaaggcatactttttgtaatttatatatggtattcattagcatagtgttacaactatattttccaaactaaaaaccagaagttgtatgccttttttgtgtgtcaggagacagcctgtgaaatatattaagactttgaaaatttggaatttccaggccatgaaatgactttttagtctggcattagaatcatatctggagcttttaaaaaactaccaattggtgtccctcttttcattctgattcaggaagctctgtaggtaggtctgatgtgcaccttacttgagatccactaatttatggaaatagttggataggatctccaggatttggaccatctaaaaaaatccagactaaaatccaggggactgtgtttaataaaggtaggatttctcataaatggttatcagaacagtagactctgaaattgtaacttacccgagtacttctccctctcttcgttttcttttctatatggtgtcttatctggtcacacttagttgtaccacagctcagaacttctgttgactgtgtatacagctacccaacttacggcccctttgtacaatatagactttaaagttattatgggacagtttctaaaattgttggaatattacatatatgtatttcctgtctcaccccctataatgttttttcttgttactgttattgaagttttcagaggtaacagctaaggtttccagatgagaagtataaagagtctttcatatcagactgaaagagaatgaaagaacagccttggaaaagtaaaattactagtgtctcctcccttaagaaccataagaagtttgaagtgaaaagacttaaagattatctagtgtgggttccarttttactacaagtaaaattaagctgagaaaggaggattgacttgcctaagagggcacaagtattttatagagaaatagattaaaattcaaataattgtatagttaaaaaaaagaaataggactcttttcataatttgaagtttgaattaagctgttttacagtaaatatttttattttctgagctttcaaaaatgtataaatgttattcttattattaatgtcctcgaaagtagaagagcccaagtaatattagtcatagtttaaaagaaagaaaaccttgatccaatatcttagagttataaaagaaaaagggtctaccattagttgaatatgtcaacatattagagaaatttctctcatattgctgcaggtttttgtcccctgagtgagaaataggaaatttataggaaacatagtcattctacagataaacaattgttttccatcctttgcttatagaattaaaagccatatggttgtttttatctttccattcaattgattgggaaataattgaacagatttgtttaagctttttattctttatagtaatgctccagtaatgtatctttaataaaactctgtttgctttttttcttcttcttcaatgaatatcagttaaagagaagttgactgcggatccagacagtgaaatagctacaaccagcctaagggtttctctactatgtccagtaagtgttaactattacttgctttccagaaagtttaacatacattttctctttttattaagtatttttactatttgagaaattctgtttgcttctaaaatatgtccaccattgttacagtttatgaaaagtggaaagacatctaggcattgcatttggaatctaaacaagtctttaaaaatgatctactcttagtaagacatatctaaatatggcctgtgattaatgaccatctctcaggctcaagtgtaaaatctcaaaataagaaatgtttattgtctcagtgtatttataaaaattttacattatttatttttattattgttatttttttgagatggagtttcgctcttgttgcccaggctggagtgcartggtgccatctcggctcaccacaacctctgcctcccgggttcaggcgattctcctgcctcagcctcctgagtagctgggattataggcatgcgccaccacacctggctaattttgtatttttagtagagatggggtttctccatgttggtcaggctggtctcgaactcctgacctcaggtgatccacccgccttggactcccaaagtgctgggactataggtgtgacccaccgcacctggccaaaaattttacttaagatagtacctttctgagtaaaaatctagccatgattacccacacatctcatttaaccattttgctaacaatgaccacattataacaattcaccaattaaaaacttctgttcagcctaaatgctgaatttgttatacatataaaaaaaccttgagatattttaagccagaaaatgaggtcagaatcaatcattttcatgaaataaatatatggtcccaagacttagccaaattattaaacctgtaagggaaaaggtctcaaaaaaatgttatactaatctgatgttaggctctttggtaggggtggtggttgaatatggccatatgaaaatatgtgaaaaatttaataattaattacsttgacattttggttactttttgttctataattaatcaaactaatcatattttaaattkgggagaaagaatgaaaggacatgtctgtttcctgatttgtctgattgttcagacaggcctgatattgaaagcttttgatactgagatcctattaatctcagatgatgatgaagttactgtattcttaaagaaacaaagaatttaaatagaaattaaatgttatttgtaattacaaatattagtcttttgtaatttatgaaacttcaaacatgaaaaaattagatcatgaattagtttctgtaagttatagaaaaaaatacaatgaagttaattaaaatcatcaaattgtatcattgtgtatatatctttctattcctgtaacgtttatttttattcctttttataataaagccaatttttttcttgtgaaaaatattttgactccaggctttttatattagtgttaaaaattctttaagtaaccaggtaaatgttataacagcctaggttgtaaaggagactggtgtgggtttttgtgtgtgtggtttttttgtttttttattttttttttcttttcatgcttagaaaaatgattcacagactggggaagtagagggtgagaaaaagacaaattttttttttaaagaaaaaggtaaaaaggtgtatatttattctaccctctttctccgaaaccctgatttatccattcccccatctgttgttctttgccgcctcattttgttgtaaaacaccaattcagaaaatacgtttagaaaagtacatacacttcattttccatttaaatcactggaaaaagtattgtttttctgcaatctcacttaaaagtgtttatagttgtactaatatatatgatgctttatgtttaacacatatatgaagcatttattcgtataaataagcacagtaatataaatctttgaagttttatttgtggaactgtgtttcaattctgtagtgcaggtgctcatctctgtattactagaaactattaatcacattttgctctttgcacctttatttattttcttttttgagacggggtttcactttgtcacccaggttggagtgcagtgctgccatctcaggtcactgcagcctccacctcccaggttcatgcagtgctcctgcttcaaccccccaagtagctgggactaccggcatgtgccaccacacccggctgatttttgcatttttttgtagagacaaggtcttgatatgttgcccaggctggtcatggactcctggcctcaagcaatcctcctgccttggcctcccttgggattacaggcgtgagccaccacacctggccagcagttcattttaaattgacatctgctttaaaaattcagattataaaacaaaacaactatatatgtatattgtgtgtgtgtgtgtgtgtgtgtatgtgtaaaatgtataattataatactttcatgggtttctatttggctaaagggataatcccttacagttattctgaaatagtaagatcatgtattttaggtatgtttttactcaaaaataaaatttaataatacctatatatcaaatttatgggataataaaagagatttgtgctctttgaaatatgtaaatatgatgtctcactgtgcattacagttgcccttgtgatgtacagagctcaaaataaatgagtttcttttgtttctgtgccatttagctaaaggcaacaaaaataattaaaaatgtttttactctttgggaattttatggttctgatttattaaaaatagaggtggaggaatctttgaaaagctgctttgtaaacccaaatacaaataacgtggaattgatagaagaaaagaagataaactctggaaatgtatttatgaaatatttattattgtgaaaaaaacttgtgaaattattctttttgttttgttttgtttttgagacagagttttgctctgtcacccaggctggagtacagtggccagatcttggctcactgcaacctccacctcccaggttcaagcaattcctctgcttcagcctcccaagtagctagaactacaggtgcacgccaccacgcctggctaattttttgtatttttagtagagatggggtttcaccatgttggccaggctggtctcaaactcctgacctcaggtgatctgcytgccttagcttcccaaaatgctgggattacaggtgtgagccaccactcccagcctttttaaaattttattttttgagacagagtcttgttctgttgcccaggctggagtgcagtggtgtgatctcagctcactgcaacctccacttcctgggttcaagcaattctcctgcctcaacctcctgagtagctggtattacaggcgcctgtcaccacgcccggctaatttttgtattttcagtggagatgaggtttcaccatgttggctaggctagtctggaactcctgacctcaagtgatccgcttgcctcagcctcccaaagtgatgggattacaggtgtgagccactgtgcccagctgaaattatttttaatgtcacactttttcctttccttttgcaaggaaaaagcacgttttattgacatttttagggctttttaaaaatataagttggttaaaacttttatctagaatgttttctcttgcagcatcatcagttactaatatagatagcactattattgtaaagttagtggcgttagaaaacacatttgggagttaaagtgcttatttgcaaataatgcaaacataatttgtgtcctataaagggaaaggaagaatttgtaatcacaagatgaagacgttcaaagctcagcttctctcttgttaccaagttagagaaaatcgatatctgtttttcagataattatttagaatttagtgatttttttwaaaaaaatcaggaatatgagaattatcacataatagttattttatgattctaaggcatttgtgtggcagctaataatgcatttgaaagcgagcttttgctttcacatacccatttatgtctgtcttgtaccatttctgtgtcagcgttccttaaaaactctgtaggtcaccttgtcagtatagctgaagataaaggcttgagagttgctctcttgcctaaaagatatgaactgacagctggagatcatggggtaaaggtatgtgagatgaaggcctttggaaaacagctgcttttcagagtataaatttcatggcctgtagcttggattctgaaacaatctttatttcttatcatcttatctgttgttttcataaacgatcagaagtagtctgatagttctacagttcataaaccttgtgtactattactgtatttctctagaatttttagtctgtggtttctctacttagtattaaggcaatagcaaaagtaccttataaaataggaatttgtatttcatagataagctaaggtctgacataagatctaaaaacgtaacttggcaccaccaaccagattgctatttggaaaatgtttctgaactaatgcaacatggtatcttgcctaatggtaatttttctgttataataactactttgttcttttggcctttttatcaggtgcttatgtaaatcaaatcataaaaaattggctgggcatgtcgctcacgcctataatgccagcactttgggaggccaaggtgtgcagatcacttgatgccaggagtttgagaccggtgtggccaacatggcgaaccctgtctctactaaaaatgcaaaaattagccaggcatggtggcacctgcctgtaatcccagctacttgggaggctgagacaggagaattgcttgygagactgtttctcaaaaaatacaaagattaaaattgagtagaaatgcagtaagggagtctaatgaagctgtttaatactttgtgagcccagagtaaaagaatgactactaagctgaggtttgggtgggtctcctagtgtacaaagtgatttttaaagcaaatatgtttctgtactttaattaatactactgttatttattgaaaagttactatgtgtcaggtactgtgtagtaaacgtaattgaatccccacaatcatattgtgtagatcccatttttatccccattttacaaaactgagcctctgagtgattaagtaaaataacattcagaattcacacagtaggtaggtagtggggccaggattcattctaacaccagaactcatactcaggctgcactataaatgactgagtatgacctgcataccttccatgagtggtgcctcctggaattgcccatcatgcagaactgaagccttatcagtgcacaggactgtcttactgctgtatatttccaagtatgggaacaaggaaattagtccaacctgtttctagtaggaggagacacacataaataaataacaatcagttttgcatgccttaatgatagggataccttttgagaaatgcactattaggggattttgttgttattcaacaaaagcatcataggtgtgcttacacaaacctagatggtatagcttactatgtaccttggcctattgctcctagtttgcaaaactgtacagcatgttacaaaactgaatactgtaggcagttgtaacacaatgctaagtatttgtgtacctaaacatagaaaaggtacagtaaaaagtataaaagatgaaaaatggtacacctgtatggggcacttactatgaatggagcttacgggactggaagttactccaaataagtcagtgagtggtgagcaaatgtgaaggtctaggacatcactttacatcactgtagactttataaacactgtacactttggctacaataaatttaaaatatttttctttcttcagtaataaaccttagcttactgtaactttttttttgagacagagtctccctctgtcacccaggccggagtgcactggtgtgatcttggctcacggtaacctctgcctcccaggctcaagcgattctcctgcctcagcctcccaagtagctgggatcccagacgtgtgccaccatgcctggctaatttttgtatttttagtagagacggagttgcgccatgttggccaggctggtctcaaactcctgatctcaggtgattctccctcctcggcctcccaaagggctgggattactggtgtgagccaccacacctggccactgtaacttttttattttataagctttttattttttttaacttttgactcttgtaataacaacacttagcttaaaacacaagcacattgtacagctgtacaaaaatattttctttctttatatccttattctataagcttttttctatttttaacattttttacttttattttctactttttaaacttttttgttaaaaacaaagacacaaacacacattagcctaggcctgcacagggtccggatcatcagtatcactactttccacctccacatcttttcccactggaacgtcttcagtggcagtaacagacatggagctgttctctcttatggtaacagtgccttcttctggaatacctcctgaaggacctgcctgaggctgttttacagttaacttttaaaatatatataagtaaagggagtacactccaaaataatgataaaaagtatagtaaatacagaaaccagtaacatggctgtcttaatttgaagacctctatcgtatatgcggttcagtgttgaccaaaatgttatgtggtgcttgattgtaatcatatgcaggagtgtagagttgggagtacacagaagggagttaccagtttttactctaggtccctccaggttatacttctgatactgtaaactggcattgctctagtctcagtaagtttatagcatgttcagtgttctatttttattcatcatggctacatctggttgaagtaaggaggaaatagtgttaatttagagaaagtaaaagaggcccagaaaggctaaatgcctttcttagagacacagtaaatcatcggtatcaaagcaattattttgggccccaaatgacagttaatttcctggtagactaggaaatttcacatttccctgaaattgatctaagtaagccaagaatcttttcctcatttaactcatattcttttcaagcctttatatttttctttcatatatatttttttcttttatatgttttatatatatataaaatactttaagttctatggtacatgtgcacaacgtgcaggtatacatgtgccatattggtttgctgcacccgttaactcatcatttacattaggtatttttcctaatgctatccctcccccagccccccaccccaagacaggccctggtgtgtgatgttccccgccctgtgtccaagtgttctcattgttcagttcccacctatgagtgagaacatgtgatgtttggttttctgtccttgtgatactttgctcagaatgatggtttccagcttcatccatgtccctgcaaaggacatgaactcatccttttttatggctgcatagtattccatggtatatatgtgccacattttcttaattcagtctatcattgatggacatttggggtggttccaagtctttgctattgtgaatagtgctgcaataaacatacgtgtccagtgtgtctttataagtagcatgatttataataatcctttgggtatatacccagtaatgggattgctgggtcaaatggtatttctagttccagatccttgaggaattgccacactgtgttccacaatggtgaactagtttacagtcccaccaacagtgtaaaagcattcctatttctccacatcctctccagcacaagcgtttatatttttcaagttcacaaatcttttcctggtacttggcaaataatgtggttattgaaagtagataacttctctgctatatggtggccattgtgggatctggggactctacagtggtacaagctggcttccagggaatgagatagtgatgtggtacctccctgtgcaggtttctgcgtggcttttctgccttgggctaaagctagcagctcagggaccagatgaagcagatttcctcttcctggatagactcaacccgtgttagctgaagcaatatttgcagggcaagaagtctcctgacatgctggagatgctagaggtccagggctgtaggctgaattgctcgtgatggttcccagtgaggaagcaatgcagagtgtgtgcacctgccttcctcctcagagctgccacttggcaattatgccaaacatcatggggaatgatcactattgattcagttttgtcctgtgaactactttcattcatagataagactgatagcaaatatcaatgcatctctgtattgtgcagtatttaatagggcattctttattttccctaatccctagtaaggtggttcttaaattttttttggatcaaggactgctttaagaatttgagaaaagccgggcacagtggtgtgcgcctgtatccccagctactctggaggctgaggcaggaggattgcttgagcccaggagtttgaggctgtagtgtgctacgattgtgcctgtgaataagagttggcacttcagcctgggcaatatagcaagaccccatctgtttaaaaaaaaaaaactggtgaaagcactctctccagaaaaatgcacacacgaaattttgaatgtaattcaaggggtttatgaccctctccaccaaaagctgatctgtgagctgtggattttagtaaataacccttgttgtagactttccatagtcattttgtttgatagccaaagaaatactgtcattttttaacctatggatatttcacaggaaatgtgtttaatgttcttctacattgatgaaaagtcaacactgtatgctttaaatcagcatgcctacctgttgtgttctaggaaatttttgtyaaagcttaaatgttgaatagcaattatctaatatttactttttctccctttttaaagcttggtaaaatgcggctgacaattccgtgtcgggcccttacatgttctcatctacaatgttttgacgcaactctttacattcagatgaatgagaaaaaaccaacctgggtttgtcctgtctgtgataagaaggctccatatgaacaccttattattgatgggtatgttactttaagtgtttttggtaccttgaaatgaccatatattatctgggtttgttacacatcagatttgggatgaaaattctaagttatatatttgtaggatttttgtgagtctgcaaaccaatattttcaaagtaatttatttcmaattagtgttakgaatattttatctttttaaattgatgttcccttggtttgaaaatgcgtgtgttactgtcagtgcctcctggcatttgtcgttgaaagcactggtgcttttaagcagggtgtgcttataccttttccttttcctgtcattagtccatccatccctagatatgcagaccatattggaacaagaatgtatggggaaatttgggttaactcaggttcatccaaaattgggcttttcaatagaagttagcctatttctggagattagatccaccttcagtcatggtcttctttttcttttttgtcttgcccacctatagcatcacaaaaccaattattgcttttaacacctctttgttttatctatcctaccagacatcttggaatgttcctctaaattttcttctattctgcagcccccttttcctcctgctttttgccactaaacaaaaacaaattgtgaaaaggaggacatctccttgatttttttggggatggggggttagagacagagtcttgccattttgcccaggctgctctcgaattcctgggctcaagtgatcctcctgccttggcctcccaaagtactgagattacaggcatgtgagccaccacacccagcctctacttaatatttcctgtactttctagcaaaacacttaaggcaacttacctgtagtatttaagaaaacataggagcctaaaggtggtaatatcagaaattaagtatatttagcaatacaagtataacctggagcttgaaagatgtcagaccagtcatgggaaacaaacaaacaaacaacatgtaacttaaatgttttatgtttaatttttcagaaatgtcggtgatcacttactagtaaatcagaattaaatagtgatattttccaactttatatgttacatagctttaggttctcccatttcttgttataaaagccatgtacacacatactcttttaaagaaaaattggaaaacacaggaaaataaaaagcttttttcggtatatgattttctgatttttgtctttccataattgtgattgtacactgttaataatttttgtcctttggtttcatttaacattataacctaagaatttggccgtaattaattttatgctttctttatacatgtttttaaatgtctgtcacggtattttatcaaagagatttaacctttgattacatatttgtatatgttttgctttagtttatcaaataagacatgcttattgtgggcaatttagaatatgcaaaaaagtataaagaagaaaaataaatactcatgaaggtatcacccagaggtaactactgtctatatactaytcacacagaattttatttttgaaatgaagctttcttttgttgacsttttctcactttttgtgaacattttcccatatgattaaaaatctttgaaaatgtcatttttcatggtcacatgatattttcttacataaatgtgacataaattaggcagctatattcctagttagtactagattttaagaataaatataacttaagttgttcaacctttatgttcatttaaaatatattctaaggatgaattgttttcttatagcttgtttatggaaatcctaaagtactgtacagactgtgatgaaatacaatttaaggaggatggcacttgggcaccgatgagatcaaaaaaggaagtacaggaagtttctgcctcttacaatggagtcgatggtgagtagttcttcacaaggaagaggcagtctccctactgctctaagtctggttttcaatattaaaatccatatatttttaaaaatcactgagcagtttgtggatagcttaataattcctattaacttattgattaaatgttcagaagtaatagaactccttttaaattcacttttttgccagctttaaaaaatttactgatataagatttcaaagtaatgtaatataattagtcatttgtaaactcatacttttgaaactgtaccctttttaaatttttaacagatttgatacagagtagtaaaggttcttttttcatttatttattttttcctggcttttagtatgtttttgctgtaaagacactatgagttttgaaaatgctatcatcgtatttaagtatgtcagatactatacagacaaaaattaatataccgtctgctctcaaattacttttcttctgaagtggacatatgacacattttgattgtttgctctaattcagtaatttattattttgaaaaataatttactattattaaataatagttttaaacttagaagaacagagccactgttggttttctacyctctggctccaacaatattgtgaatctaaactgtaactgataaactgtagtgacactgagaaaagagagatgtcatagctcttcccttgccttgtattttaatcattcccatataggatgcttgagctccacattggagcatcaggtagcgtctcaccaccagtcctcaaataaaaacaagaaagtagaagtgattgacctaaccatagacagttcatctgatgaagaggaagaagagccatctgccaagaggacctgtccttccctatctcccacatcaccactaaataataaagggtaagtgctgagacatttaaaaaaaaaagtaatcatgaaaattaacttggcaaatagggattaaagacttgccaaataaaatgattcttgattgtgaaacttaacttagcaatcaaagaatagtttgaatttttcccaggtttgtaatactctggagggattggggtaatgcaccaaaagggtacttggatatagtattcttcatatcaaaagatcattctagtaccgtggttctcaaactgtggtgtacgtacatcagaattacctgagagcttaataaaatgcatacattgcgcccccatgtctgagtcaggagtagagactaagaaaatttgtctttctaggccaggcgtcatgtctcatacctgtaatcctaggactttgggaggctgaggcaggtggattgtccaagctcaggagtttgagaccagcctgggcaacatggtgaaacctcatctctactaaaatacaaaaattagccaagcgtggtggcatgcgcctgtaatctcagctactctggagggtgaggcaggagaatcgcttgaacccaggaggtggaggttgcagtgagccaagatcgtgccattgcactccagcctgggcaacagagcgagactttgtctcaaaaaaaaaaaaaaaaaaagaaagaaaaaatttgtatttctagttaagttcccaggtgatcctgctcctgctcacaggatgtagaacatttgttcaaactggaatgtatgctgtaaaattcaccccaagttgagtgtttcaagtggaaagcagaggaagaccaatgatttaaatctgcttcagaatgtgaatgaggctggtagtgaatgacttctgttgcagcacacaacatttcccactttgcagagttttctcccatattttccattagtcttatatcaataacagtgtacctaggttatacttcagttcatgaaacattgttatctactttgtataaaacaccctcagctaagcatggatgataataaaatgagtaagtacagtcttaaccttaaacagcttagcactttctggggggtggtaaaacaagtagcatactccaactatactctcaaaacaggctgttagtcctgtagacacatcagggattctgagcaagatttctaattgtgctgaagcacaattgtagcacactaattgtaaatctagaaatagatgtgtccctttttaggtataaagcaggagaatcacatggcctgttgcaactgaatagaagctaaccagaaactcttccagcaagcattagggactaaagaaagaatgtaggagagagaaggaagtccatagatggcattgttacaacaccagatcaagagcaggcatttctgtgcctggagtcaaatcattttcaggtttgacattgtatgatgagattaaagatttctatcagtttgagaccagcctgggcaacatggtaaaaccctgtctctaccaaaaaattagctgggtatggcactgtgtgcctgttgtcccaactactcggagggctgatgggggaggatcacttgaacctgggaggtggaggttgcagtgagctaagatcgtgccactgcactccaacctgggtgacagaatgagaccccatctcaaaaaaaaataagatttcagtcaaacatttcacacatcggtattttcattctacagtagtccatcttggcatacagacagaaacaaagacattaaaaacagtatcatcattctaaacaaagtgaataatttaagcacaaatcctactgttatgaacatgacctctgataaaagcctatcttgatggctataacccagcaagcctgaccttgttattacaccaatgtattttatgtctgagtaggagaaaaggaaaagtcacattacctaaagttagaacaagtatctatagaatttcaattccaagatattttgtaaatatcaaaccatagtatgaccaaatacacattgtcatgtgatttttttaagtgccataatcacaattttaaaagatatttcataaacctctggatatataaatacttttgggctaaatgcatcrtaatatatatatttgttctgttctttagactattaatagtaatatgtatttatgtaaactatgcaatagtattactgactatatattttttctttaaagaaaacatttgagtgtttaggaatctaatatttcttctttggatatttactttgctctttctccaaaaatatttggagaaaataaaataaataatgtttattatgtttggaaaattacattaaatgcattaagtacttcctgaatttcccagtgactaattgaacccagctatagtatttgcaaatgccagacatttctctctctatttgcagataaaaacaagaaacttgaaagtttacatccttagaaggagaataacacaccatagtcaacactagtagccattttataataatgactagttggtaactggaaacctcagtacagcatattgtgtttgttattgtgcagtataaaggttgaaatgcatttcaaaacattatcacaaattgaaagaaaagcatgcagccaggaattagaggcaaacactaaatgtaaaacattttgttgtctttagccactgagtgcttaatgttcatccagaaattgtctatgctgtttgagatgttttcaaagactagcattttaaatcctctcttataatctcttagacattgtgagaagactcagctaatggtaaatggtactttttctagatataagaggtttaacaaagtttccattagatgaaacatttttatgaggcagacgagagtgtgttttatgcttcatatcccattcattaaaatgtggtagatggtcataactggaactctattcctagaaatccaaccttgtcatctcgtgaaatgttctttttttttttttttttttttttttgagacagagtttcactcttatctcccaggctggagtgcagtggcaccatcttggctcaccacaccctccgcctcctgggttcaagtgattctcctgcctcagcctcccgagtagctgggattacaggcatgcaccaccatgcctggctaattttttgtattttttagtagagacagggtttctccctgttggtgaggctggtctcaaactcccaacctcaggtgatccatgcgccttggcctcccaaagtgctgggattacaggtgtgagccaccacgcccggccctcttttgaaatattctataccactgaaattgcatccccatgccccaggtactttacatgaagcattaaaagcaaaagacagcctctttattgcttcctttctctttattttctataacacatacaccttcagcctcttgtattgttggggtaacatataacccttatgtttccttctaagagggctactataattgtttttcttttcaaaattagctttgtttttgtttttgttttgttttgagacaggctcttgctctgtcacccaggcttgagtgcagtggtgcaatcacggctcatgcagcctcgaccccccaggctcaagcaatcctctcatctatctcccaagtagctgggactacagatacgtgccaccaggcctggctaagctttttaatttttcgtagagacagggtctccctatgttgcccaggctgggcaacttctgggctgaaactatccttctgcctcagcctcccgaagtatggggattacaggaatgagccaccatgcctggccccaaagttagttaaattattattttttccttcttctccttttttcctttcccttaattgttagtaaattttaaaaaaaaagctacttagctatttaaacttttcactgttttttagagtcctaattcttgttttatgttttctttttccagttatactgttctctctttaaaaactctccactacctattcgttttggagtatttcttcttgtttcactacattagattcagcagggcttttatgcaaacaatgtgctgataactgtactgggcattgggtatactaaacaatacccagtttttgccctcctaaagattacaatctgaggggccagctggtaactccgaaccactcagattgcttcattccctctgtcttattatatgtattttctttgctagggcatacgtatgcttcttaatagccaatactctggtgttgttttaaaagggtttccgactttcatttgatgtaggtatctttcactcatatcccgttaaagtggctcaactgtacctttctcttgcattttgaaagcataggtgatgatattccaaaggcaatgtgaggtttgtgaatgttggataccattgcatctgtccacttcttcctgtggcctctgttaaatgctattatgtatacaaattattttctcataattgtgtataatctaaattatacattgctttgcttggttttgttcttatttccagcactaaaccgagggttcattgtgagatacaacccctttttttgttaaccttgagagtttaactggctaatgaaaactatgccaatctttccttcttccagcattttaagtcttccacatcaagcatctccagtatcccgcaccccaagccttcctgctgtagacacaagctacattaatacctccctcatccaagactataggcatcctttccacatgacacccatgccttacgacttacaaggtgagtcactggttcttctacattgtcacatagcattatgaatgcctttgatctatataattctcttctaggtgaatctaaggaagaactggaagactgagccaacagggccttggacccagggaactgagagaaataatatgccgttgttataaatactgacccagttcgttgattgtactgtcatcagtagccagtgttttactcccagtggtaaaactagtgcaataatctttagtttttgtgagctcctgagtactctgcaaattgtttttgaatgactgctagtatgtgggtttgaattttggtatttatgaacattatttttttttgccgtggggaacggagtcttgctctgttgcctgggctggagtgcggtggcacgatctcagctcactacaacctccgcctcccaggttcaaacaattctcctgcctcagcttcccgaccgagtagctgggattataggcgcccactaccacaccaggctaatgttttatatttttagtagagacagggtttcactattttggtcaggctggtcctgacctcgtggtcctcctgcctcggcctcccaaagtgctaggattacaggcgtgagccaccacgcccagccctgtgaacattatttattgtaccctgactttagttgtaatgcaacaggcattgtgggtaactatgttgtattatgttttagataatggtgagttgagacatttgaaagttttagtttttattctaatgaatttgatccttcttaaaaattttttttttaattttgtgggtacatactaggtgtatacatttatctgatccttctttttaaaagctgtttgaaatgtcagtatactcatttatatattttgagttcataataatcatttatattatcaaaaagaattgtttttatatctttgtagcataataatttgaatattagtcatataatctaagaacttttttttattaaaaaagccatatatgctcattgtagaaaattcaacacagaaacataaagtgaaagtttccctctacctatcccccaaccccattcccgggaagttacagctagtgtgtgtgtgtgtgtgtgtgtgtgtgtgtgtgtgtcggagttttgctcttattgctcaggctgcgtgtgtgtgtgtgtgtgtgtgtgtgtcggagttttgctcttattgctcaggctggagtgcaatggcgcgacaggcatgtgccaccacgcctggctaattttgtatttttagtagagacggggtttcaccatgttggtcaggctggtctcaaactcccgacctcaggtgattcgcctgccttcgcttcccaaagtgctgggattacaggcgtgagccactacggccagccagttacagctgctcttaacggttagatatctttctatacctttttttctacatgtatgaaacgcactgtcactatcaagaacaacagtgctatgcattttgtaagccttcgtgttgtaatcggttataatgtagacagtgagtagatgcccagagtatctgtggtgttgtaatatatttatctatagctgcgtgttttacctttccccaagtttagatatcataatgaagcatttaattcatgcttgttcacttgctcttcatcgcattacacactgggtgatctagaaaagaatgttaattggaaggggcctccttgcagtgaatcctcagcagccaggtagcagaactactccttcttatgtaatagtagccagtttgcaggcactcaaacctcttctcccctcatgccactgcagtctgtcagttgaatctgatagcaaatgagcaaatttaagaaagaaaaatcagtactacaacttacttaacctaactctttcaacttcaaactttctcacctgcaaaatgagggcaaaactaattacatacctcatgaagtgcttgtgaggagtaacttagagcagattgaaagtttccttaagaggagtccagagcatttgttaaaagtactatgcccgtttaaggatcagtgttagatctgacagagtagtaatggccccagtcccccaaatggggtcacggagaagacaaatcattgccaaagcttagttttcagccttagtaatctaaagaaaggagagacgtaaaacgtttagctcaactcttcatgtttaaataaaattctgagtgacatagcatataagacttgtatttgtttttgaagtattggggcatttggaagagtttttccttcttttttttttaaactgaaataattttttcttccacaggattagatttctttcctttcttatcaggagacaatcaggtatgttatgaaaaatttactattattttaattgtacattaaaaatacagtcatgcgccacataatgacattttggtcaatgacaggccatatatgcattccataagattataatggagctgaaaaatccctacatcaattatagccatggtaacattgtagcacaaggcattactcacatgtttgtggtgttgctggtgtgaacaaacctatgctgtcagtcatgtaaaagtatcacacgtataattatgtacaatataacgataataaacaactctgttactggtttatgcatttactatattttttattgttattttagagtgtacctctactttttttttttttaagtttgctgtaaaacagtgtgccatgttattccaggacagcctcatacatcccagtttgccacatctcttgattgcatcatttcctcttgtgcttgatgaaaatcttgtcttgttttgttcatcatggcccctaagcatacaaaatccacagctaatgttgccagtaagaggccacatcgagtgactgacatggaaaaaaattaagtgattaaggacgatgaaagtggaagatcagtgatagttattgctcaccagtcaggcagtcccattctaccatagctacagtcttaaagaacaagaacaaagtgatagaagctgttaaaggatctgctttgttcaaggcaacaagactaacaaaaatttgagaagggcctgtatcagatatggagaaacttgttagtgacctggattgaagaccagacacagaaacatatccctctcagcaccataatgatcatggccaaagcaaaaagtttgtttgcaatgcttaaagaaaagactggacccaactacagtgttaaatgtactgctagctccgggtggtttaaacgattgaagaatcattattcattatgtaatatcaaagtgagtggagagtctgcaaatgcagatgtgaaggcaactgaagaatttttggaaactctagataagctgattatgaaggaagattacttgccagacaaattttcaatacgcatgaaacctccctattctggaaataaatggctgaaaggactttcatccataaagaagccaagtcaatgctagatttcaaggcttttaaggacaagataacagtcttgcttggggccatattgcaggctacaaattgaaaccctttgtgatctggcacagtgagaactccagagccttcaagcatgtcagcaagcacacactgcccgtgtactacaggagcaataagaagtcatcgatgacccagcttttcttccaggatgtcctcccgaattgctgtgccagcaaaatggagaagtactgttgagagagtaacatacttttcaagatgatgatttttgttgataatgctcccacacatcctcatttcattggtgatcttcatcccaatatcaaagtgttgtgtctccttccatataccacctctttgatccaaccaatgaatcaaggagttgtagcagtttttaaggcctattaaaagatcctaaggaggatctttgcccaggctattgctgcaactgaaaaacaccgagaggacactgatgcaattctggaaggtttacaacagctatgactgcatcaagaaccttgcttgggcatggactgatgtcaccaaggagtatgtgaatgacatctagaagacactgaagaagtttgttcatgacttcaaagaatctgctaaggatgaagaggttgcagaaatggacaaggctgtggttgacatggcaaacaactttaacctagatgtagatgaggatgacattgagaagctcctagatgtggttcctgaggaattgactaatgagctgttggaactggaacaggaacacgcagctgaagaaggtgcaagagaaaaggaaactgcaggagacaaaaaggaagaacctccaagaaaattcacagtgaaaggtttagcagaagcttttgcagacctcaacaagctccttaaaaaatttaaaaacatgggccctggctgggcgctgtggcttacacctataatcccagcactttgggaggccaaagcgggtagatcatgaggtcaggagttcgagaccagcctgaccaacatggtgaaaccccgtctctactaaaaatacaaaaattagctgggcgtggtgctacacgcctgtaatcccagctactcgggaggctgaggcagaagaatcacttgaacctgggaggcggaggttgcagtgagccgagattgcgtgcaccactctactccaacctgggtggcagagcgagactccatctcaaaaacaaaacaaacaaaaaaaacatgggccctaacaatgaaaggttttcattaatagagaggaatgtttatggtacattatctacttacaagcaaacctatgataaaaaagaaaccaagccaaacaccatggacatatttctgaaaagagtgacacctccttaagaagagcctcaggcaggtccttcagtgggtgttccagaagattgttgtcatagcaaatgacagctccatgcatgctattttccctgaagaccatgcagtgggacaagctgtgcagatggaagacagtgacatcgatgaccctgacctccctgtgtaggcctaggctaatgtgttgtgtgtgtcatttttaacaaaaaagttaaaaagtaaaaaatattttaaaatgttaaaaatagagacttacagaataaggatataaagaaggaaatatttttgttcagctgtacaatgtacttgtgttttaaattaagtgttacaagagtcaaagttttaaaaaatcagtttataaagtaaaattagttagctaatgttaatttattattgaagaaagaaaaatatttttaacacatttagtgtggccatagtgtacagtgtttataaagtctacagtagtgtacaataatgtcctaagcctcacattcactcaccattcactcactggctcacccagagcaacttccagtactgcaggctccattcatggtaagtgccctatacaggtgtatcatttttttatcttttataccatatttttactgtaccttttctatgttgagatatacacatacttagcattgtgttacagttgcctacggcattcagcacagtaacatgctgtacaggtttgtagcctgggagcagtaggccagaccacacagcctaggtgtgtagcaggctctactgtctaggtttgtgcaagcacactgtgatgtttgcacagccacaaaacygcctaatgatgcatttctcaaaacacatccgtgtcattaagcgacgcatgactgtatttaaaagtataatgtgtagccaagagaaagataaatttccttggaaaacttagagtaatcatacccattatcattatggctttaaaatttaaataaaaattctaactttcagtggtgcctgagtgtataataagaacagtgtctgttggtttccagtactgttttataaagaaacagggcagtgagtcatattgactgatagatttcttggctaagtatctccttactagcaagagcatggactgtctgcccctcctgctgcttctgagcatatgcttcttgggaaatagaattggtaattgcttgcaatacaaactaaaacaaaaaacaataaaatttatattttgtttttcctccagtttcagatacaaaaatgtcttctcaagatcaatgctccagtccttacataaggccatttgattttgcaaaatgtcttagtaaatatttcagaaaccctagatactcaggctatcttaaatttagggctgtgtcccgctgaggagaaaatatattaatttggaagtataattaacatttttgtgtcttttgtttcccctccctagcattacaacacctccttgcttgccgctgcagcagcagcagtttcagatgatcaagacctcctacactcgtctcggtttttcccgtatacctcctcacagatgtttcttgatcagttaagtgcaggaggcagtacttctctgccaaccaccaatggaagcagtagtggcagtaacagcagcctggtttcttccaacagcctaagggaaagccatagccacaccgtcacaaacaggagcagcacggacacggcatycatctttggcatcataccagacattatttcattggactgattcccaggccctgctgctcccatccccaccccagatcgaatgaacttggcagaaagaagagaactttgtgctctgttttaccttactctgtttagaaaagtatacaagcgtgttttttttcctttttttagggaaaaaattaaaagaaatgtacagagaacaaaactatattttcagttttacttttgtatataaatctaagactgcctgtgtgataaaacacttgtttaaaaaaaaaaaggaaagaaaagaaaaaagaaaaacaagcacccacaaaccaccttcagttcatttttttctggattctgaagatttttcattatttgtcctatggttttggttttatttgacttcgatggcattattttatttgcaataacagaaaaggaattgcatgtatgaagttttcaatcgtgggcttttctttgttgtggggagggggtcgggggatagtttgatttccattttctgaaaacgacagacttggattctgtttgtgtgtgcatattttatccagccttaagttataaagctcatctgtcccgctgcattccctgtgtattttcaggacatggctcgtgggtgtgtgtgttcattgtgtgcgtctgtatgtatttttctgtcatcactgttccctctcctcccgagtgtgcattcagttaatataatcagttgcttgcttctttcaaagtgctttgaaggtcttgaactcaygtgtgagcatctttatcaactatcccaattgcatgttctccatcacatattctcttatttgctctgtaccccctgagaatatgttttagagatattggaataaagctgtctgggtaaggagtaggcttagccgacctatgaataatacactttagtctagttctttattctaaatctggattgccagtattgtgtatttaaaccaagtctgtgaatacctgctttttttggccacagagtaacaagttttcatgtaagatcttcataccaaagtaggaagtaaaaatagcttagaaagctctgtcaggtgttttgtgcagctgacagaggtaatgttacatcacctaaaaaagaaagatacacggtcagttatcctaaaaataaattgtttggaaagtacaatgcaccacatttttgtagaagtctactatttgataaacagttgaaattcaagatgtgtttgacccttagtcatttttactctttggttctgagtatacctattttcttagcgtatctgccytgtttatctttttcttcaccttttaacaagtatgacataggaaagtcatttttttttagaattcatggatcagtctgatctactcttattcataatggaacatgtaaatatactgaaaactgtttttcaggagagaaatatgagttggagggaaggaaaagtggttctactwatgttccaaaatcctcatcagagaaggtatgatgttctcaggtgtggaaaatattttttagttgattgagaatgcaggtttaacagaagagataaggggcataatgactgctggttttccagactggattttcctaccgcaactattaatgttctcagagttgatgaggaccacctttgtgtatacacttgtagttttaaaccttgcattggtaacaaaatgatcaactttaatccaggtagaattcaagatggctgtacttcagttgtatgataaaattaatggttctcatgacttgtgtggcatctaaaaataatgtttttatagcatctctctgccacyaaattgttgacttgaattttgggaaaaaaaaaagttggtgttgatatgtatatgtgtgtgtgtatatatgtatttataaacaagtgtgtttgagtaacaagtgagtttcatagtcttcccctacgcatgtgtattccacacacaaatggctgagttatagtcataaaacaatttgcaataaaaaaaaaaccaaaacagattgtcagttaaccaggaaacagttaatgttttttaatgaatctggcattatagtgagcaaatgtcgtattaatttaggctaatttctaatactaccataatttgtgtctaaatttctgttggggtagaaattactaaaattgtggggagttttttctgatttttacattgctttaggaaacatttttactaattcagctgtcttaggtaaaatgaatagttttcttcctgtttttttatgtgtcattgttagtggtctcagaattctgatcagtaactttgtgtatgatgctgaattacaaaccgtttgaatgatccagttgaaaacgtatccctctactttcttcagttgtagaaaaggttaatttccctcagtgtcccacattataccaacctaagagaagaacaggtaatagggagaaataaacatacggtggtttcagtggttttggtcatgtgtccacaggagaaactaaccattcagttgtcttaattttagttcgttctaccctgtgaggagtttgtttccatcagttgttgactttccaaaatgttgcattaagtaatagttgtcactctgttggtctcatggtcaatatcaatcagactttcatgatctctactaattattagtagagtcctgtactatgtctgtaactactaagtttaaagaaaagcacatagtcacttcatctctttttttcttagcctacgctcactccccaacccatcccaacattgacatgctatctgtggacaaatagcagttctcagaatctagtcaagttgccatcatcccccttgccttggccgttcatagtaggtatgcatatgtttgtttctgtacagtactgtgtgtgtgtgtgtatatatatatacatctgtatgcacacatctttgataaaatagctatttgactagcagggttaaagtggcttttaattacttcgtgagtgttattggatacatcttaaaaaaaaaaaatctgaaccagaaccatgccatacttggttgactattttgagcattaaaattgctttactaattatttagacatgatcacaattctgtatctttactgaggaaagattcacgtaagctctgaaaaatcggattctttggcagattttcctttgagtcaagtgtctgaaatggagtgaaaatatatcctaactaaattaatgtggaaagagcatttttttagacaatttcaattttaaacacataaaactttcaagatcttcaggactttttaaagcacatttgaaattattttagtaagaattttgttttatcaatagatgttgaattctgttttttaattaaatacaaagcttagatttcagaaagagagggaaaatagctggtggtcccagagtgtgctgctgttaattgtttaacaaaggggaaaatgtacataaacagataaagttaccataaattccatgaacttaaatctgtgattcattgccttaaaactttctctcttagaatttccataccgcatgccaaaccagtaaaatggcttttaaaaatgtatagtagacaatgtcagtttgtataaaagtaccaagtgaaaatatttattacatgcattggaaaaaaattgtttacctattgaatgttacctgtttatgtagagctctttagatgtaataaaagaaaagccttcagttaatttgtcttctgtaaaataacactgctggatgttcaaggggacaatccctatgagacaagtgataatggtttgtgcttccaaagcacctttcatccagagatttcaaagcatgacaagtaactaactaattttcttgcagcatgctttgaggtaagtaatgaatatagccatcatttccctttcttgttgaaatatggctaactctttaataaatcacagcatctgtttagtatctgcagtttgaatgctaagagcaccgtggccttcttgtaaacaacactaggtgctagagaaaccagctggaatttcaggaatgagcttgaaaccaggaccaggagtaaggtaacagcccttcctcgggtagaggtttgaatcaaacacttaataggatcttagactctggaccactgaatcccttaatgagcagggagtccgtgaagaggagccccaggttctaatgaccattccacaccaactgtgtgtttttggcaagttatatttcagattcctgttaggcaaatgagattcataaaacttgctttaaaaccatactgggactattcagtgataaatatagacatagaaaagctttgacggaaagtaccctcatttattatatccagaacttgctcttcctgtgccatctaaatcattggtatctatctcccatctaatctttggtattccaggttggctgtgcaggatttacttcctaatgtccatgactggagctcaaaagaactgtgggcctaggacctttgagctttgcctgaaagtgacagcagttctctcggcggggccagcatctaaccggccctctggtggatttaccatgaaggtaatgaagtttaagcaccaggacccttcacttgttctggtcctaggagcagccccagaaattctgcatttctgtttttgtattcttaaggcagccaaatctcgtaaacctcagaccccacaaaacatctgctcctacactgtgtggacctgggcttcccagccagatggtcacaacttcacctagttggcatttgggccatttatttaccctcaccccacaaaactctttggctcctaggaattcctcctctccttgcagttatgcttggggaaatgagagtctccttcctcagggccttgtttgggtctgaagccacacagcatcgttgagacagttgcactaacactacaactcttgttccctgcagttttccctgtgcccggtgcctagtgaaagatttgtgtcttgtacatcctcccaaaagacacatcccatttgatttggttttcttctactttagccactgtggtactactagacaaagccacagcccagagaacccacttttgatacatacatggatgcaaatctttgtacttgaagccctgcacccctacctgtgttggtgtggtactccagcccttttaggactgtgctggcactacgaatgatccagatttgacaagtgtatggcacctctgaatctctggcagcaccaacctggcaccttctagctgtgtaactcactcaaagccactccagctggatggactcccagaaagcctagtgctcctactactgttttccagggctgttgtaccctggccattgctggttacatccccttatttctctccgtaagtcctggggaggtggcttaaggcaatgaccagtgtgggccacttgagcagaccatcccggaacctctctgcctgttaacagagcccagggaacagctcggaattctcacagcattggaagcccccttcttgagctctgcaaggccagtcaatttagcagctcacatctggtttcctttggtgtggggtgtaaagtagatcgctcttcctgctctcagctgatgctgcctcattgtagcatgtgttttcactctagtgttttcactctacactctgtgtttatgaatgaatagcctgagctatgtcactatatctgttgagatggaaatgagaatttgtaaatgggcctctggcactgcaagaattgttgtcataagtgttacagctttctgttcattgctgcttctcagctagcactggcttcatcttggaaaatcttggaaatatggaagatggttctagcccccaaatacagaataagtctcttggtagattgcccttaagtcatcagctcaatccttcctcaacaggctccatgaggtaagaagtgggaatccagcttgtgtgggggggctttgaggagtgaaatgatttgcccaaagtcacagtgggaagcagcagagccaggactggaacccaggccagactccaaaccgcaggctccttccatgcttgaaagggccggactcacggtagttaataaaatcaatacaaatcttttattaaagatctactcataccatggctgaaatcatctattattgttgctagttagcctctcttctatagttgggtaatgttgtcttgccactgtgtttgccatctctcccaagtgaaaagaacactttttaaaaaaaattaattgctccaagttttcaggcccaggggaggctctcccattctcctccttcaatagtcccgtccaggaagggtgatcttgtggataaattcatcatacttcactttgccattgggttcgatatctgcttccctgaagagatcatccactgcaataaatcacatttaatttttcagtttggctttagtgttccattataaaacagtgagttttttggggactggagctcccctaaggtcttccctgagcgtgcagttgactattcctgtagaccaggaagtaaaccagtgaacagaaagggacaacccatccctgcactcctgagacccttattccattttgagctaatcgggctttctgcaggggcagggagtagggaggtgtactggtaaggattcggtcactgatgccaccgtgtgcttttttttttttttttttaaaacagtttcgctcttgttgcccaggctggagtgcagtggcacaatctcagctcactgcaacctccgcctcccaggttcaagcgattctcctgcctcaggctcctgagtagctgagcttacaggcaagtgccaccatgcccggctaatttttgtatttttagtagagacggggtttcaccatgttggccaggctggtcttgaactcctgacctcaggtgagccatccacctcagcctcccaaagtgctgggattacaggcatgagccactgtgcccggcccaccctgtgcttttatttttattttttcatgaaaatatgacccctgtgcccatatttctagaatcctttggcctggagtttttaccttccgcagctcagcctgcaaacagagcgaacatcctccacagtcccaggcttcggcctgctcctcacttgcctgccttttcccctaagccggtgctcctcaccacctctgcccccaccccaagagaggacttagtgacaagcactgtctgctaccatcacctctaaaaaaaaaaaaaaatgtttgggggatggggtttatatgagagaaaaataaatccaactctgttgagagctcacagtatacaaaacaaaactgccattgttctccatcactccaaaaaaaaaaaaaaaatcacttcatttgcttgtttcttctggttctggattcctgggataaaataatagcttgtcccaggcgttggcaagagccatttcagcttgtattctccacaatggcctcttggggtcaacctaccatggctctttagcctgtcctcatctcactgccctgtgtcaacttcccaggcctggataccttccacacacacacctccggtcgtcagttagaaaatatcctgtgattctctgcttaactatccttctcgaaagtataatcaccatgccttggcctaagctgatagtagttctgagtatttattgggagaatgttgaggacagtataattcatctcattttgtggagaagtttccacaatcagccaggtggctaaaaccatcctgggggataggccaacatcagctccagggccagtcactgcagcctcttcccatctgggcgagggacagcacttagccaggtgccaagtctgaggacacctgagtagaacagcctttcactccatctcacttcaaagacccatagaaagccaaagtgctaaagtcagcccatcccaggcctcaggagaaggcttcacccacagccattccaaggatgctttttaaactgaaaattgtctttcgatcacccagaaaaaggattcctgctgctggtatcattcttcccatctcccgtggcaagtgggagggaaatcggtgtccctgcttgtctggaacacagcagtttctgtgaaacagtcctctgctggttattagagatgtatgtgagtctggggccatggcattgcttaggacagagatcattaaccacaaaaagaaggccctgctccctctgctgactccacctgctgtctagagggccgggcagtgtcctggggggagtctgggagggaaggatgacccatgtcttccctatccatgtgaaaacagccacgagaggtgaacctggaaaagctgggtatggagacccagcctgctgttgggcgattatttatttatggagataaagtctcattctgtcacccaagctggagtgtagtggcgcaagctcggctcactgcaacctccgcctcccagattcaagtgatcctcctgcctcagcctcccgagtagctggggctacaggcgcccgccaccacgcctggctaatttttgtatgtcaggcaatttttaaactctgcagcaatttttaaactctctgcactgtgccttaatggcagtagctaaaatctgagcagagtgatttgtagagtggtagctcagagggacctgaggggtcacctactgtaccctcatttccagcaaggaaagcgaggtgggagaaaggtctcctggcacccaggattcaaaccacagcctcaaagctctcctccagtggtttattgtgatttaaccagagacggaaagtccgtcatattgaagcctctttccagcacccacttgtggccaagcccagctctcctgtccaaaccacaggcaagcagggcagcctacctagaaaccccaggctctaaggtcggggtccctggcctcgggcagaggcagagctggctggctggctgctgcgaacatggcagggctaggcaggagggtccgcaggctggaagaacaaaggctgtaaatggccttggcgtggggatccccttgacagtgtacaaagggctttcctagaagaccccaggcctcgtcctgctctgaggcaggacagcctgctaggctgcaggaaggtgcaaagcaaagacccctttctcgtggggctctggaaccaggaaccctgcctgtctcggcagttctccaactgtcctggcaaagttccctctggagcccctttctggaagagcttagagcagcctgagttggaaagggagcaaagcagcacctcaattcggaaactcgacctcagcagcaactgcagagactgctgtgatgggaaaaagggcagggatgtctagacctgccttcgctcctgcgccgctgcttgggagccgctcactccccctgcttctttatcagtaggagcaggcatttgtgctcccaggggtgtcatgcactagatgaagccccacagtgagagcttgaacacagggggagaccagactgcacgctccagctgccctgccttgtgggttccgagctgggtttcccctaggctgtcccttcaccctggcagacctccctgcgcccttccagcccctctagttcttccccaggctccagtccagcacccacctagtgtggcatctgctcacagtctcctgcgcgcgcatcaacagaggtggtctgtaccaccctggtggcatcagctaggctttggtgccctccttccaactccctaaccccctccaactgttgggagacaggacccaggctgttaccttccttgtgggtgagcttctcccccagactcgtgagttttgaccgcaggtcggacgccatgacgtaacctttcttctccttgtccaccatcaacatggctagaagaatttctttctttgggtcttcttgttttatttgcatgtgcataatggtcagaaaagtggagaaatccagctctccatttccgtctaggaaacccgcaaacacagcagagtgagcagagggaaaaagactcctaggaagccagctggcctcctgctggacctgcacagccggttcaaggtcaactgaccagggaatgccaggatgtggcagtggtcacagtgaagaggatgcatcccctcccaccgagttcccacgacaggcccctcactggactggacattcttcatttcagcaacgtcctcagtgacgatgcttatcatcaccccaaagctcaagaaagtgggttcccaaccacagatggaggactgggctcctctgctcccttctagcgcttccctcctgccctgaactggagggaaacaggtccatgtgtgcattccacctttgacagccaccacagtacatcttaccaggatggatcagcacccccacctggggtctcaagcctcagtcgcaggctgggctgctcacctgccttcccctcactgcagtctccatcccagcccctcctccacgggccctggctgggatgtaactgcaggaaatcaaaacttccctggactacaacttcctgtttggaggggacagaaatcaaggaaaccaccacccctttggagctggacatgggggatctcaggtatcagaccactgagcaacccaccgccaggctgcaggctttcagaggcccacctgggcccagcgtggcctgccccagggtgggctcccagcgcaactgcaggcatcctctagtggggcctctggtaaccctagcagatggtggtgacccccctgagatgaggaagctggtgacctgagactgagcagcagcctatgggctccgggtcaagtgctattcccagcggatgcccttcccctgcgccagtccctccttcctgagtgtccagcccccaatgcaaacagcaaccccaggctctgaaactactttttttcttagaaaaagcaaaacaaaacataaaacttgtttctgattatgaaaagctgtatgtgttctcattgttgaaaatacaggaaacaataaaaggaacaaaaatcacccataatcccattaccagagagaaccacttggtaacatcttggatgggttttctttcagcattttttttctagcaatagtttttctaaaaactattgcatagtttttaggtcagtctttgatatcagaagaattgggtactaatcctgatgccatcattggctcaagaacttaatggatgtaaaccttgatctttgcttgtaaaatggagttaggagaaagctgggcgcagtggctcaggcctctaaccccagcactttgggaggccgaggcaggcagatcacctgaggtcaggagttcaagaccagcctggccaacatggcaaaaccccatctctactaaaaatgcaaaaattagctaggcgtggtggcaggcacctgtaatcccagctacttgggaggctgaggcaggagaatcacttgaacctgggaggcagaggttgcagtgagccgagatctcaccactgcacgtcagcttctcggtgacagagcaagactctgtcccccctcaaaaaaaaaaggttaggagaatgcctacttcatagggtttttggagctaagcacatgacaaatactcaacaaagggaaatgttcctataaagcaacatgggatcgctgtcagcgcgatttttctctgggtttggtaagtctgttggaacgcctagatcccgaggtctgtgagatggggtatcactggttgctatgaggattccaggaagcccaagtgaggtacggcactcctggtctggggctgccacagctggatccccaggaggcctccctgccacctgcccctcaaactgctgagcttttcacacctctactgtctgcacccacctgctgggcccctcccctctccccgttgttcccaccaccactcacctatcccgtgggtctgcaggtgccgctgcacctcccctggcgtcgggctggcccccaggcacctcatggccaccatgaggtcggtggcttttatcttccccctctgctgcttgtcatacagggagaagcattccttgtactctgcacacggccca

SEQ ID NO: 12334 - DNA, 25999 bp, Homo sapiens
tccaaaatctgaaatttgaaacatttcagataagggatgctcagcctgtatcaccatttactatcaccatcattttgtattgaagaaagatacttcaaatctccagaagtaggaggggtataatcccagaactccggtgtgttttcagttaaacagtggcatttcagaagcacctgcccccatccctgacattttcttcatgtttgctgggaccactcagaaatcagaaggtgccttcagcaggctgggccagccacccagggacacagccagggacagtgggagggctgggcctgagcctggactcctgcactgaaggctgggctgtcccctccagcctacagctcatgtgtgactttgggaaaggagttgggccctctggtctttttgctccctgggtaaagtcagcggggggtgctgctccacattccctccggggttcataggggtcacgggaggatctggaggctgggctggcctgctaaagggaccagccactttttggagtgacattccagctggaagcgtccatcccaccccaggtgtgaggggggaagcagagggtgtcacatactgtgacagaggtggggtcatgctgccaaccccactctgaaccccagctcatcgagcggtccccccgcaccctgccacgctccatcacgtacgtgagcatcatcatcttcatcatggrtgccagcatccacctggtgggtgactctgtcaaccaccgcctgctcttcagtggctaccagcaccacctgtctgtccgtgagaaccccatcatcaagaatctcaagccggagacgctggtgaggccacctcctgctccctgcctgtaagccctaggagcacagtctgtyctgggaggctgaagaaatggcccccacccctcgccgcacctgtcctttcaccaaaggcattctgctaggtgagggcactgtcgcctgccccaagctaggatgctcaagtgttcttaggaagtggtgcacagactgcctcccacctgggcccctgtaacagaaggcgaggccccgggtagggaataaggcagtgggggaggcctgggactgggagaagggtggtcagaggggatgcttggggccccagcacctccctggactgacatcgacatcccccgactctgccctgcccgttcctccctcagatcgactcctttgagctgctctactattatgatgagtacctgggtcactgcatgtggtgagtgatgggcccatctgtctatcccaggggccccaactaccggctagccctgtcactggctcagggacacactgagcaaggctgtctgggctgcgggtctccatgtgttgagtctcatcccctgtaaaggcactgtgagctcaacctccagtgaagttgtccccgaggttgcccgggagacccagctgctgtcccaggctccaggccccggcttccagccagcatccccccagcatcgccacccccgcccagccctcagtgcccgctgtggccagcagagggcagcgagtggctttggtccttcctcgccaagcctgagccctgagggtgggggaggaggacgcgtccctgataaacaacccccagatggtgatggcagggggtgggggcacagccagggacccccacccgtgtcgggcctgctctttgggagtggaggaagctgcggggagccagctggatcaggctggggaggggcgtgctgtttgcgctcccccctcttcagaactcccagaggggcaccttttcctacctaccccgtccctcagtcgggggagacctcagaaatgtggtctcagcctcaggagatcccgggcccaggctgggaggcttcatctgttccaccctcccatcttacccaggagaaactgaggccagagggaggagggctccgaaggctgcagctgggaggtgagggccagccctggacccggctcactcctgagttggtgctcacagcacacgcaccctgcacgggcatttccagggtgtttcgggccctgcgatgtcaatcctcctggctcagctggtccagggtccctggacaggcctcctgccatctttccctggcctttgccagagcctcttcccacagaaggttggggaagggtggaggggctaggaacagagagctggagccccagcaggaagggggtgtgggtgagaagaggcaggcgggtatactggtgaaagcacaggtgggagaaagggagctggtgtgtggagaggggagagggtagtattttggggtgaggtgtctgaggtgggggtggggctgtgtgctgagagtgggtgcagtgcttcaccaagaggcccctgcaggtgctgttctcttttttaacatgtggacctccatcctcagcccgggaggtgcctctgtctccaggctagtgtggtgctgggctgctggtgtctgcggtgcatgagacagacaaccccccagacaccccttacccccacggagtgagtgaggtgccctgggcggtgtggatgcctctgggcctctgactcacacgtgcgttgccttcctgtttctgtttctgtcccacctttgacgcccagcacaggcaaggttgggtggagaggagcgcctctcacccaggctaggcgttttgtaaactgtgacgtggcactccatgagaccccatgggagtggttgcagaggttgtggggaagagggccgctgagcaggcctctaagacactggccttcctgtcacaggtacatccccttcttcctcatcctcttcatgtacttcagcggctgctttactgcctctaaagctgagagcttgattccagggcctgccctgctcctggtggcacccagtggcctgtactactggtgagtggacatcagcatgggggcagaggcaggggcactgagagagccacggcagcaaaattctgcacttgccaatggacctgctgtgtggccccagggagactggccctctttgggcccgtgcttcttcttgtgtctagtggggactgtgacaatgccctgtggtggcctctttgtttccatgaagcccaggcctgggtgtggcagggaggtgggaggagagggcgaggttgcacagtctgtctccatcctcaagcccctctcactctgtgccccatctcaagaaccccagtgttgccctggggccggtacaatccacctccgacaccaagccctgtagtgggctgcggtttccacctctgtgaagtggggatgatggtacctgcctgtctgcctctcagatgatgaggatgctgaggacagagaggggctttgtcaaatgtaaagcactatggcgaggccagactggggggtttcatggcgtaggggcttctggccttgggtctttgttccctctggctctctcttcttcccattgcagaggacttaggcctcagccagtctcctagccctcgtctgtcacttctgccctggagacaggtcaccctgggattgtgggtatcatgggaaggacagggtcggggcaggactggacccttctctgatgggaggcctccctcaaaatgaaaagggcctcctttcctgggccagctctagatcctctccccggcctgtcccctatgtggctgagatggcccactggggctcatctgtatgctctctggggattaaaaagaatgggtggcagctacagtgagcgggaaagacgttaggggagcgcttcctgctggttcttaccccggcatcctgccgcgggggtggctgccgtcgtaatggcaattgtttgttgctttctcctctagtcagtttttgttgtgtggaagtataaacttaatgtgaccagagaagccagaaatatacatttgtaggtattctgttatttaaatattggcaacaaactcaacatttaaaaaacagtaactataccagctaaatcaatatgctgcccatgggctgtggcttagagcggcatagttctctgagccctggcaccagaggactcttctgcctgcctggagggcagcctggctctcgcacacaggaagggatgccaggcaggacggggttgccacggcagctgcctcactcacccctggcctttccaggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtcttgtatatgtgtgcgcagagtgcatcattttcagactctactatttccgtcaagtttctgtttgatttggatcatctcaggatcggattctgttttagagtgtttctgggccaggatccgggcccctgccctcctctgcacctgaccacactccctactcagggctagtctgttcttcccggacatcttctggtagccgtgcaggagagggctgggtggggcagaggccaggaggggacctggtgtgtcacctgcccaccacctggctcatccctcaggcccaccctgaccctacattacataggttacgtcagcctactgtggctgttgagcaaagcatttctcctttctgggcctcatttgcactagatgggcctgtggtcccaaagtaggtcagtaggttggggttgctgacaccccttgggtgcagctttgggacagatgagtggctctgtcctgtcactgccctctccctgcctgggggctatgtgcactccagacccctgcccaggctcaggcccatgaggtatggagacaccctggcccccaggagctggaggcaccgcccactcccctggcattccagctttgcaggtgaccctcctctacccaaagctctgtccccctgctcccactccagaagaactgcggcacgygcttcgggcagcctagccacaggctttgagcgcctgcattcctgggggctggagggtggggtgccaaaggccctgagcaaaagccagagctcctctcatcaaagcctttacaaggtgctgggcccagaggctttgccttgacagagtggcccagggtttcaagggaggaggaacctccccctacctaggacccttcctgtggggggtctacagagtcagggacagaagggaagggacccacaggaagtcacagtggtgcccagggatgtgtcagcccccagccacggggacgcgggattcaagaatgaagtaaatacagtcacagccccaagtggtgttagaggtgttttttgtcttttctccctttcgtgctgaggtgtagcacacacggtgcgccctacagcatggtgagttgctgtatcgtgaaccctcacgcagccattgccccacgctggtgttttccatctgtgcgtcacccccggagacacctacacacataaggagggagttggccggggcaccccagcacacactggcctaactccaaggaggcacctcatctcttctggagccccttcccacaggcaaggggattcagagggagcatgttggcctggccgccttcaggcttccagagtcccaagtgactttccttgatgtccttctctccatcctctgcacagaggcagccttccctcctcttatccctgccatggggtttgggagggggagcctcaaactctgacagggaggagtcggagtccccagctaaaattctctgggtctagaaacaggtgtaaagcgattctggggatgtgatttgggagaaaagcacactttccacacagaggcggtcaggaaaggagcggggaggggagagtggggcacaggcagcgcctcccgtctatgcgcctgtgtgcaaagtggcacaatgccccccttcctattggcagtgcagcccctggccagcaaccactcgcacctgggctgggggcctttgtgtagggcacacctgtgcagccacacctacttgtagagcctcatagactcagctgtggacaaaagcctcacgccccaaacagggaaatgggatctcaaggggaagaagctggggaggcctcacaccctgcccccatttcctcctatgtgggggaggggagcagcacgaactcctgaagacttgggagcgtcagcagcttctgcggaaggggtggggctgagggtggagagaggaagggaaggaagaaaaggggagccttcctggccagggtaaccggcactaagaggcctcactccaagcccccgaggagcctgtggtggggctggagacccggctcaggcccctccaccacccttaaagtcctcagaaggtgggaactgaactggcacaggmtgggaaccggctgtgcgctggccacttgattttgccagctgccctgtaattcagctggtgaggaaactgaggcacagactgaggtagaatgattcgccagtcactcagcaagtcagcagacggggaggactgaatcccagcctgagagcaccgaagcttgtatccctgcaataccgagccccaagcctgcgagccccggtgcccatctctgagttrggccgtcttggaagggttcccttcctcctacaagatggtgtgtgaggagccttcaatacgacccggggtgtaaagtgtccaactctagtaggggcctgatggcatccccgccgagtcccaggagagagagagaagaccccttcctggagtccagggctcccgggaagaaacactggcatttgtccctttgcttcggcttctggaggcagagactctgagcccagggagagccttctgcagccccatttcctcaaaaatccaacctgcccaggtggcgggtcatgagctgtgctcaggaagctggaatctgaccctggtggcgtcgggcccagtctccatggcagccgagcatttattacccgggcctccacccagcttggcagactttagacttgaggctggaggaaagggaactgaacgcggttctgggagcagcaagcccacgggtagcagcygaggccccagaatggtgagtgtgagggtctgtgtcggcctggccagggctgggggcgtgaacctcaggtggagccctcccctgactgttttcctttctctgctgcaggccaagtttctttcccaagaccaaattaatggtaggttgggtttgttctttgattagcaactcagcaaaatatgggtctcattaggcaatttgctctgctcatgttttcttggtgggaaggaaggtggctgtgggagagctgggcccacccagggccaagagctgcggggaggctgctgttggcggggtgggggttgggggtaagcctccaaaatagacatgtggctttatacttgtcagtgtgacttacaagccagggcgctaagacagaacttactaggtttccctccagaacctgaccagttggatttggggactgaggggactggggatggagagagagaccattaaaggtatggctggcagcagggaaagaggaggggctttgtaattgagacagaacagaggccaggtctgcactctctggcaggatgcgtctactctctgcgcctcagtctccctatctgtaaaatggagggtccactgagccccctttgccctggcatcaagcctggtttgggcgtgagcactttattccctgggtcccctactctgccagccctcgaccaggcttcagtttcacaccgtgcagggttctatttccagaaggccaagagcaaagagttgcgttacaaagaacttgggggcccagacctgagccaggggagcctcatggctgcagcccccctgcacctggcaggagaggcccaggaggcacagccagctgctgcttgaggttgtgaccctgaaacctgtcccaacagtggacgtcaatgggcctgagagtcccccgaggcatcccattcctccaggtctttgctgaaacatcgccttctcagtgagtccttcgctgaccactggagataaaattacaggcaccttgggcccttgtgatccagggtagggtcctgagagcccagccaagtggggttagggttacctgggcaggagttccagagttctgggtattctgagcttggtccagaggggcaggaattgtgagctccaggtgggcacctccacgtagaaccctggaactctttatcccaagaggagggccagggcaggagcagggacttttaaaacacagggcccggggcagtgccctcttgtccaggtctaacggtgataatgaatggtggactgagggctggagtccagccttcagcctcagcatcctcccacccatgcctggttttgaggctcactgaccctccctcctgggatagccaaagctcccagaagggaagaaggtaaattgtctttgtatcccagtatctgacaccaagaaagtggccaccagtgtttaatgagtgtgtgaaagactggatggggtggcctagcgaagtgggaagaacaggggctttggaggcagcagacctgaagcctaatcacccttgagcctcggttttctcacctatgaagtaggatatgccaccttaccaggctgctgcgagccacggacagaggggaataatgtcagttacatgctggacgctgggccaggcatagccaggtgtcacccacatgtgggctggggctggctcactacagctagcaagagccatagttttaggaattttgcaagcaggatgttaaagccagccattattaaataatgtaggatcaaacagtgtktcaatccctacatctatctgtacaaaaagttaaaaagacagccctattgtgatcagtggagatggagatttgaaagaagtttcaatttaatgaatgtrtttggtaaaagggtgagaaatagtttaacagtagatcacatcaggtttaatgaccattcattcattggaaaaagaatcgcactcattggcgcgcagcttcatttgtcaaatcatggttgaatcgaaactataggttggcaatggatataagagttggcaaaacttgggcygagtgcagtggctcacgtctgtaatcccagcactttgggaggccgaggcatgtggatcacctgatgtcaggggtttgaaaccagcctggccaacatggtgaaaccccatctctactaaaaatacaaaactggccaggtgcagtggctcatgcctgtaatcccagcactttgagagaccgagggaggcagatcacctgaggtcaggagtttgagaccagcctggccaacatggtgaaaccctatctctactaaaagtacaaaaattagcctggtgtgctggcaggcacctgtaattccagctactcaggaggctgaggcaggagaatcacttgaacccaggaggcggaggttgcagtgaaccgagattgagccactacactccagcctgggcaacaagagcgagactctgtctcaaaaaaaaaaaaaaaaaaaaaaaagccggtcatggtggcacatgcctataatcccagcttcttgggaggctgaggcaggagaatcacttgaacctgggaggtggaggctgcagtgagctgaaattgtgccattgcactctagcctgggcaacaagagcaaaactctctcaaaaaaaaaaaaaaaaaargttggcaaaactcatttgtggtaatcaagtggctagatggaatttatttatttgagacagagtcttgctctgtgcaatggcatgatctccgctcatttcaaccttcaccacccagactcaagggattctcccacctctgtctcctgagtagctgggactacaggcatgcaccaccacacacaaaacatttgtaaatattttgtagacatgaggtcttactatattgtccaggctggtctcgaactcctgggcccaagcgatactcctgtctcaccctcccaaagtgctgggattacaggcgtgagccactgcacccagccctagatggaatttataataaagaatagtgtacatttctgtattatttgtaaattgtgtgctacacatcctttatgtttgtacagtgcagaggacacaagtacatttatgatcagagctggtggttaaacatccagcacagctggtgttatcctaggccttgcacaggtctctttcttgtcctgggggatttgcattttcaaagagaagacttaaaggggatttttaatccaattcatttaacccaattaatcctttcattcaacaaatgtttgtgtcccttctttgtgcctggagctacatacaacagtgaactcaaagacaaaaatcccttcctcacagggggtcaccatcgagggaggggaacgtggtgaaatatatgtgctagtatgttagagggccgacctgtcaggagaaaaagcaggaaggagagccaggaggtgaggagggagagtgaagagatggtggaggaaggggccagcaggaagcccagctgggtctccagcaccctgttgtcttgttccagtgcaggaatgcaaagttcagatgtggccttccaggtctttaaaggcgtctgaggcagggagacagcacgtatctgatgtgaaggtttgtgaggaggtgggcctctatttgagccctggccctgctgctggcaaggaccacaggcccccagtgactgacagggcttgtcggggagtagtgaagtgcccccatctgcagatccaggctgattctggaccccaagggtgtgatgagcaccttccagcacaggtcaggcagggagagcagtgggccttgggcccaccctcacccaagggcaaacccagacagaaagacaaggtgagggtggccatgagaggtccccaggggtaccccctgtagtgctaaggttaagctctgtgattggggcagycctctctctgtccccmtgacgtgaggtgatggcattgtcccctctggcactgggccctcttgcaggcaattgggttttatgggaactaaacctggggtcttaggccaggctctggccctgcttcccctgggcctttttggcccctgccacctggtcctgactttggtttgccccttcggaagctcaggctctggaatgttctgaaagggcagttgtgcggggctggggctttcctctcagtctctccacaaaggccgcgaatttgtctctaaatggtacatggcgatctgcctgtctttagtgacccccctgaaatcctaccagggaggcctgagtgccttcattagggaatatgaagggacccctggtctgggctggggatttggggggctccttctgcatcctctccctcaccctactgctctcagtggtgtctgccctggaaccgaaggcagtgtggcctggtgggcagagctgcccacagccaggctctcagtgttccagccctcaatgtcctgtccgcacatgggaatatgagggggcgcatcacagggttgtggggatgaagcgagggcctgggggtggagtgctcagcaacgtgaattgtcattgttgctgtcatcagctaaggggctattattgtccaggcctctaaggacctacctgggtggtgtgagaagcaggagagagaacagagccctgagccccagcctgggagggccagcgccaggccactgtgtttccacggctccacccacaggcccgggtgcctcgtctgggctggacgagaatctccctgtcctgatggcagccccacctacccctaaatcagatgctcagtcagtgcrgttcagggacttttcctgaactcccagctggccttcctgggcctcccagggccgggagcccgtgggatggctgtgtcaggccgggagtctgtgggtttaggggagctagctccggctgccttccacctccaccaagtaccgaaggagaaagggcttcagaccctgggagaatttcccagcaggaccctttgaagtctctaagaacaggaccagggcccgagtccaaggacagcttgagggtttagcagcctggaggccagggcaggggcaataggctcagaaatgccccagctctgatgatgatgataatatcatcatatgaaggccactctctggcaggcctsctgggatttctggctctcacagtaatcctgaggccttattattcccattgtccagaaaagttgtgtttgcagaggtcccctgggggtctggacgccttgctgtgggttcctgctctcccctgtgggccctggaggggcactgtcctgggagttccagtcctgtgggttggcggggagggggagggagaaggaagggagggagtagggagaaagggaaggggagccagataaaatacaggacacccagttaaattagaatttcagacaaacaacaaatacttttccaatagaagyatatgtcctatgcaaaatttggggcatacaataaaagtatattcagtgtttatctgaattcggtttaacttggcagtcctgtattttcatttgctgtatctagcacccttgggaggggagagagggatggagggagtaggcaaaaggaaggggaaaagagggagaagagactaaggatggggagggcggcatgggcggagagtgaccagacgctgctgaccctccctctgggcygtgtgcagagtacaaggaatgcttctccctgtatgacaagcagcagagggggaagataaaagccaccgacctcatggtggccatgaggtgcctgggggccagcccgacgccaggggaggtgcagcggcacctgcagacccacgggataggtgagtggtggtgggaacaacggggagaggggaggggcccagcaggtgggtgcagacagtagaggtgtgaaaagctcagcagtttgaggggcaggtggcagggaggcctcctggggatycagctgtggcagccccagaccaggagtgccgtacctcacttgggcttcctggaatcctcatagcaaccagtgataccccatctcacagacctcgggatctaggcgttccaacagacttaccaaacccagagaaaaatcgcgctgacagcgatcccatgttgctttataggaacatttccctttgttgagtatttgtcatgtgcttagctccaaaaaccctatgaagtaggcattctcctaaccttttttttttgaggggggacagagtcttgctctgtcaccgagaagctgacgtgcagtggtgagatctcggctcactgcaacctctgcctcccaggttcaagtgattctcctgcctcagcctcccaagtagctgggattacaggtgcctgccaccacgcctagctaatttttgcatttttagtagagatggggttttgccatgttggccaggctggtcttgaactcctgacctcaggtgatctgcctgcctcggcctcccaaagtgctggggttagaggcctgagccactgcgcccagctttctcctaactccattttacaagcaaagatcaaggtttacatccattaagttcttgagccaatgatggcatcaggattagtacccaattcttctgatatcaaagactgacctaaaaactatgcaatagtttttagaaaaactattgctagaaaaaaaatgctgaaagaaaacccatccaagatgttaccaagtggttctctctggtaatgggattatgggtgatttttgttccttttattgtttcctgtattttcaacaaygagaacacatacagcttttcataatcagaaacaagttttatgttttgttttgctttttctaagaaaaaaagtagtttcagagcctggggttgctgtttgcattgggggctggacactcaggaaggagggactggcgcaggggaagggcatccgctgggaatagcacttgacccggagcccataggctgctgctcagtctcaggtcaccagcttcctcatctcaggggggtcaccaccatctgctagggttaccagaggccccactagaggatgcctgcagttgcgctgggagcccaccctggggcaggccacgctgggcccaggtgggcctctgaaagcctgcagcctggcggtgggttgctcagtggtctgatacctgagatcccccatgtccagctccaaaggggtggtggtttccttgatttctgtcccctccaaacaggaagttgtagtccagggaakttttgatttcctgcagttacatcccagccagggcccgtggaggaggggctgggatggagactgcagtgaggggaaggcaggtgagcagcccagcctgcgactgaggcttgagaccccaggtgggggtgctgatccatcctggtaagatgtactgtggtggctgtcaaaggtggaatgcacacatggayctgtttccctccagttcagggcaggagggaagcgctagaagggagcagaggagcccagtcctccatctgtggttgggaacccactttcttgagctttggggtgatgataagcatcgtcactgaggacgttgctgaaatgaagaatgtccagtccagtgaggggcctgtcgtgggaactcggtgggaggggatgcatcctcttcactgtgaccactgccacatcctggcattccctggtcagttgaccttgaaccggctgtgcaggtccagcaggaggccagctggcttcctaggagtctttttccctctgctcactctgctgtgtttgcgggtttcctagacggaaatggagagctggatttctccacttttctgaccattatgcacatgcaaataaaacaagaagacccaaagaaagaaattcttctagccatgttgatggtggacaaggagaagaaaggttacgtcatggcgtccgacctgcggtcaaaactcamgagtctgggggagaagctcacccacaaggaaggtaacagcctgggtcctgtctcccaacagytggagggggttagggagttggaaggagggcaccaaagcctagctgatgccaccagggtggtacagaccacctctgttgatgcgcgcgcaggagactgtgagcagatgccacactaggtgggtgctggactggagcctggggaagaactagaggggctggaagggcgcagggaggtctgccagggtgaagggacagcctaggggaaacccagctcggaacccacaaggcagggcagctggagcgtgcagtctggtctccccctgtgttcaagctctcactgtggggcttcatytagtgcatgacacccctgggagcacaaatgcctgctcctactgataaagaagcagggggagtgagcggctcccaagcagcggcgcaggagcgaaggcaggtctagacatccctgccctttttcccatcacagcagtctctgcagttgctgctgaggtcgagtttccgaattgaggtgctgctttgctccctttccaactcaggctgctctaagctcttccagaaaggggctccagagggaactttgccaggacagttggagaactgccgagacaggcagggttcctggttccagagccccacgagaaaggggtctttgctttgcaccttcctgcagcctagcaggctgtcctgcctcagagcaggacgaggcctggggtcttctaggaaagccctttgtacactgtcaaggggatccccacgccaaggccatttacagcctttgttcttccagcctgcggaccctcctgcctagccctgccatgttcgcagcagccagccagccagctctgcctctgcccgaggccagggaccccgaccttagagcctggggtttctaggtaggctgccctgcttgcctgtggtttggacaggagagctgggcttggccacaagtgggtgctggaaagaggcttcaatatgacggactttccgtctctggttaaatcacaataaaccactggaggagagctttgaggctgtggtttgaatcctgggtgccaggagacctttctcccacctcgctttccttgctggaaatgagggtacagtaggtgacccctcaggtccctctgagctaccactctacaaatcactctgctcagattttagctactgccattaaggcacagtgcagagagtttaaaaattgctgcagagtttaaaaattgcctgacatacaaaaattagccaggcgtggtggcgggcgcctgtagccccagctactcgggaggctgaggcaggaggatcacttgaatctgggaggcggaggttgcagtgagccgagcttgcgccactacactccagcttgggtgacagaatgagactttatctccataaataaataatcgcccaacagcaggctgggtctccatacccagcttttccaggttcacctctcgtggctgttttcacatggatagggaagacatgggtcatccttccctcccagactccccccaggacactgcccggccctctagacagcaggtggagtcagcagagggagcagggccttctttttgtggttaatgatctctgtcctaagcaatgccatggccccagactcacatacatctctaataaccagcagaggactgtttcacagaaactgctgtgttccagacaagcagggacaccgatttccctcccacttgccacgggagatgggaagaatgataccagcagcaggaatcctttttctgggtgatcgaaagacaattttcagtttaaaaagcatccttggaatggctgtgggtgaagccttctcctgaggcctgggatgggctgactttagcactttggctttctatgggtctttgaagtgagatggagtgaaaggctgttctactcaggtgtcctcagacttggcacctggctaagtgctgtccctcgcccagatgggaagaggctgcagtgactggccctggagctgatgttggcctatcccccaggatggttttagccacctggctgattgtggaaacttctccacaaaatgagatgaattatactgtcctcaacattctcccaataaatactcagaaytactatcagcttaggccaaggcatggtgattatactttcgagaaggatagttaagcagagaatcacaggatattttctaactgacgaccggaggtgtgtgtgtggaaggtatccaggcctgggaagttgacacagggcagtgagatgaggacaggctaaagagccatggtaggttgaccccaagaggccattgtggagaatacaagctgaaatggctcttgccaacgcctgggacaagctattattttatcccaggaatccagaaccagaagaaacaagcaaatgaagtgattttttttttttttttggagtgatggagaacaatggcagttttgttttgtatactgtgagctctcaacagagttggatttatttttctctcatataaaccccatcccccaaacatttttttttttttttagaggtgatggtagcagacagtgcttgtcactaagtcctctcttggggtgggggcagaggtggtgaggagcaccggcttaggggaaaaggcaggcaagtgaggagcaggccgaagcctgggactgtggaggatgttcgctctgtttgcaggctgagctgcggaaggtaaaaactccaggccaaaggattctagaaatatgggcacaggggtcatattttcatgaaaaaataaaaataaaagcacagggtgggccgggcacagtggctcatgcctgtaatcccagcactttgggaggctgaggtggatggctcacctgaggtcaggagttcaagaccagcctggccaacatggtgaaaccccgtctctactaaaaatacaaaaattagccgggcatggtggcacttgcctgtaagctcagctactcaggagcctgaggcaggagaatcgcttgaacctgggaggcggaggttgcagtgagctgagattgtgccactgcactccagcctgggcaacaagagcgaaactgttttwaaaaaaaaaaaaaaaaagcacacggtggcatcagtgaccgaatccttaccagtacacctccctactccctgcccctgcagaaagcccgattagctcaaaatggaataagggtctcaggagtgcagggatgggttgtccctttctgttcactggtttacttcctggtctacaggaatagtcaactgcacgctcagggaagaccttaggggagctccagtccccaaaaaactcactgttttataatggaacactaaagccaaactgaaaaattaaatgtgatttattgcagtggatgatctcttcagggaagcagatatcgaacccaatggcaaagtgaagtatgatgaatttatccacaagatcacccttcctggacgggactattgaaggaggagaatgggagagcctcccctgggcctgaaaacttggagcaattaattttttttaaaaagtgttcttttcacttgggagagatggcaaacacagtggcaagacaacattacccaactatagaagagaggctaactagcaacaataatagatgatttcagccatggtatgagtagatctttaataaaagatttgtaytgattttattaactaccgtgagtccggccctttcaagcatggaaggagcctgcggtttggagtctggcctgggttccagtcctggctctgctgcttcccactgtgactttgggcaaatcatttcactcctcaaagcccccccacacaygctggattcccacttcttacctcatggagcctgttgaggaaggattgagctgatgacttaagggcaatctaccaagagacttattctgtatttgggggctagaaccatcttccatatttccaagattttccaagatgaagccagtgctagctgagaagcagcaatgaacagaaagctgtaacacttatgacaacaattcttgcagtgccagaggcccatttacaaattctcatttccatctcaacagatatagtgacatagctcaggctattcattcataaacacagagtgtagagtgaaaacactagagtgaaaacacatgctacaatgaggcagcatcagctgagagcaggaagagcgatctactttacaccccacaccaaaggaaaccagatgtgagctgctaaattgactggccttgcagagctcaagaagggggcttccaatgctgtgagaattccgagctgttccctgggctctgttaacaggcagagaggttccgggatggtctgctcaagtggcccacactggtcattgccttaagccacctccccaggacttacggagagaaataaggggatgtaaccagcaatggccagggtacaacagccctggaaaacagtagtaggagcactaggctttctgggagtccatccagctggagtggctttgagtgagttacacagctagaaggtgccaggttggtgctgccagagattcagaggtgccatacacttgtcaaatctggatcattcgtagtgccagcacagtcctaaaagggctggagtaccacaccaacacaggtaggggtgcagggcttcaagtacaaagatttgcatccatgtatgtatcaaaagtgggttctctgggctgtggctttgtctagtagtaccacagtggctaaagtagaagaaaaccaaatcaaatgggatgtgtcttttgggaggatgtacaagacacaaatctttcactaggcaccgggcacagggaaaactgcagggaacaagagttgtagtgttagtgcaactgtctcaacgatgctgtgtggcttcagacccaaacaaggccctgaggaaggagactctcatttccccaagcataactgcaaggagaggaggaattcctaggagccaaagagttttgtggggtgagggtaaataaatggcccaaatgccaactaggtgaagttgtgaccatctggctgggaagcccaggtccacacagtgtaggagcagatgttttgtggggtctgaggtttacgagatttggctgccttaagaatacaaaaacagaaatgcagaatttctggggctgctcctaggaccagaacaagtgaagggtcctggtgcttaaacttcattaccttcatggtaaatccaccagagggccggttagatgctggccccgccgagagaactgctgtcactttcaggcaaagctcaaaggtcctaggcccacagttcttttgagctccagtcatggacattaggaagtaaatcctgcacagccaacctggaataccaaagattagatgggagatagataccaatgatttagatggcacaggaagagcaagttctggatataataaatgagggtactttccgtcaaagcttttctatgtctatatttatcactgaatagtcccagtatggttttaaagcaagttttatgaatctcatttgcctaacaggaatctgaaatataacttgccaaaaacacacagttggtgtggaatggtcattagaacctggggctcctcttcacggactccctgctcattaagggattcagtggtccagagtctaagatcctattaagtgtttgattcaaacctctacccgaggaagggctgttaccttactcctggtcctggtttcaagctcattcctgaaattccagctggtttctctagcacctagtgttgtttacaagaaggccacggtgctcttagcattcaaactgcagatactaaacagatgctgtgatttattaaagagttagccatatttcaacaagaaagggaaatgatggctatattcattacttacctcaaagcatgctgcaagaaaattagttagttacttgtcatgctttgaaatctctggatgaaaggtgctttggaagcacaaaccattatcacttgtctcatagggattgtccccttgaacatccagcagtgttattttacagaagacaaattaactgaaggcttttcttttattacatctaaagagctctacataaacaggtaacattcaataggtaaacaatttttttccaatgcatgtaataaatattttcacttggtacttttatacaaactgacattgtctactatacatttttaaaagccattttactggtttggcatgcggtatggaaattctaagagagaaagttttaaggcaatgaatcacagatttaagttcatggaatttatggtaactttatctgtttatgtacattttcccctttgttaaacaattaacagcagcacactctgggaccaccagctattttccctctctttctgaaatctaagctttgtatttaattaaaaaacagaattcaacatctattgataaaacaaaattcttactaaaataatttcaaatgtgctttaaaaagtcctgaagatcttgaaagttttatgtgtttaaaattgaaattgtctaaaaaaatgctctttccacattaatttagttaggatatattttcactccatttcagacacttgactcaaaggaaaatctgccaaagaatccgatttttcagagcttacgtgaatctttcctcagtaaagatacagaattgtgatcatgtctaaataattagtaaagcaattttaatgctcaaaatagtcaaccaagtatggcatggttctggttcagattttttttttttaagatgtatccaataacactcacgaagtaattaaaagccactttaaccctgctagtcaaatagctattttatcaaagatgtgtgcatacagatgtatatatatatacacacacacacacagtactgtacagaaacaaacatatgcatacctactatgaacggccaaggcaagggggatgatggcaacttgactagattctgagaactgctatttgtccacagatagcatgtcaatgttgggatgggttggggagtgagcgtaggctaagaaaaaaagagatgaagtgactatgtgcttttctttaaacttagtagttacagacatagtacaggactctactaataattagtagagatcatgaaagtctgattgatattgaccatgagaccaacagagtgacaactattacttaatgcaacattttggaaagtcaacaactgatggaaacaaactcctcacagggtagaacgaactaaaattaagacaactgaatggttagtttctcctgtggacacatgaccaaaaccactgaaaccaccgtatgtttatttctccctattacctgttcttctcttaggttggtataatgtgggacactgagggaaattaaccttttctacaactgaagaaagtagagggatacgttttcaactggatcattcaaacggtttgtaattcagcatcatacacaaagttactgatcagaattctgagaccactaacaatgacacataaaaaaacaggaagaaaactattcattttacctaagacagctgaattagtaaaaatgtttcctaaagcaatgtaaaaatcagaaaaaactccccacaattttagtaatttctaccccaacagaaatttagacacaaattatggtagtattagaaattagcctaaattaatacgacatttgctcactataatgccagattcattaaaaaacattaactgtttcctggttaactgacaatctgttttggttttttttttattgcaaattgttttatgactataactcagccatttgtgtgtggaatacacatgcgtaggggaagactatgaaactcacttgttactcaaacacacttgtttataaatacatatatacacacacacatatacatatcaacaccaacttttttttttcccaaaattcaagtcaacaatttrgtggcagagagatgctataaaaacattatttttagatgccacacaagtcatgagaaccattaattttatcatacaactgaagtacagccatcttgaattctacctggattaaagttgatcattttgttaccaatgcaaggtttaaaactacaagtgtatacacaaaggtggtcctcatcaactctgagaacattaatagttgcggtaggaaaatccagtctggaaaaccagcagtcattatgccccttatctcttctgttaaacctgcattctcaatcaactaaaaaatattttccacacctgagaacatcataccttctctgatgaggattttggaacattagtagaaccacttttccttccctccaactcatatttctctcctgaaaaacagttttcagtatatttacatgttccattatgaataagagtagatcagactgatccatgaattctaaaaaaaaatgactttcctatgtcatacttgttaaaaggtgaagaaaaagataaacaaggcagatacgctaagaaaataggtatactcagaaccaaagagtaaaaatgactaagggtcaaacacatcttgaatttcaactgtttatcaaatagtagacttctacaaaaatgtggtgcattgtactttccaaacaatttatttttaggataactgaccgtgtatctttcttttttaggtgatgtaacattacctctgtcagctgcacaaaacacctgacagagctttctaagctatttttacttcctactttggtatgaagatcttacatgaaaacttgttactctgtggccaaaaaaagcaggtattcacagacttggtttaaatacacaatactggcaatccagatttagaataaagaactagactaaagtgtattattcataggtcggctaagcctactccttacccagacagctttattccaatatctctaaaacatattctcagggggtacagagcaaataagagaatatgtgatggagaacatgcaattgggatagttgataaagatgctcacacrtgagttcaagaccttcaaagcactttgaaagaagcaagcaactgattatattaactgaatgcacactcgggaggagagggaacagtgatgacagaaaaatacatacagacgcacacaatgaacacacacacccacgagccatgtcctgaaaatacacagggaatgcagcgggacagatgagctttataacttaaggctggataaaatatgcacacacaaacagaatccaagtctgtcgttttcagaaaatggaaatcaaactatcccccgaccccctccccacaacaaagaaaagcccacgattgaaaacttcatacatgcaattccttttctgttattgcaaataaaataatgccatcgaagtcaaataaaaccaaaaccataggacaaataatgaaaaatcttcagaatccagaaaaaaatgaactgaaggtggtttgtgggtgcttgtttttcttttttcttttctttcctttttttttttaaacaagtgttttatcacacaggcagtcttagatttatatacaaaagtaaaactgaaaatatagttttgttctctgtacatttcttttaattttttccctaaaaaaaggaaaaaaaacacgcttgtatacttttctaaacagagtaaggtaaaacagagcacaaagttctcttctttctgccaagttcattcgatctggggtggggatgggagcagcagggcctgggaatcagtccaatgaaataatgtctggtatgatgccaaagatgratgccgtgtccgtgctgctcctgtttgtgacggtgtggctatggctttcccttaggctgttggaagaaaccaggctgctgttactgccactactgcttccattggtggttggcagagaagtactgcctcctgcacttaactgatcaagaaacatctgtgaggaggtatacgggaaaaaccgagacgagtgtaggaggtcttgatcatctgaaactgctgctgctgcagcggcaagcaaggaggtgttgtaatgctagggaggggaaacaaaagacacaaaaatgttaattatacttccaaattaatatattttctcctcagcgggacacagccctaaatttaagatagcctgagtatctagggtttctgaaatatttactaagacattttgcaaaatcaaatggccttatgtaaggactggagcattgatcttgagaagacatttttgtatctgaaactggaggaaaaacaaaatataaattttattgttttttgttttagtttgtattgcaagcaattaccaattctatttcccaagaagcatatgctcagaagcagcaggaggggcagacagtccatgctcttgctagtaaggagatacttagccaagaaatctatcagtcaatatgactcactgccctgtttctttataaaacagtactggaaaccaacagacactgttcttattatacactcaggcaccactgaaagttagaatttttatttaaattttaaagccataatgataatgggtatgattactctaagttttccaaggaaatttatctttctcttggctacacattatacttttaaatacagtcatgcgtcgcttaatgacacggatgtgttttgagaaatgcatcattaggcggttttgtggctgtgcaaacatcacagtgtgcttgcacaaacctagacagtagagcctgctacacacctaggctgtgtggtctggcctactgctcccaggctacaaacctgtacagcatgttactgtgctgaatgccgtaggcaactgtaacacaatgctaagtatgtgtatatctcaacatagaaaaggtacagtaaaaatatggtataaaagataaaaaaatgatacacctgtatagggcacttaccatgaatggagcctgcagtactggaagttgctctgggtgagccagtgagtgaatggtgagtgaatgtgaggcttaggacattattgtacactactgtagactttataaacactgtacactatggccacactaaatgtgttaaaaatatttttctttcttcaataataaattaacattagctaactaattttact

SEQ ID NO: 12335 - DNA, 24678 bp, Homo sapiens
  misc_feature (1)...(24678): n = A,T,C or G, or insertion/deletion polymorphism (see Tables 1-2)
gggtgaggtgaggtagggagcgccctccttctcccgcctctgcgcccctggatcgcgtcgcagggactcaggtcttccccaccccttcccaagccttctagcgcagggcctgcggcccagacgtccagggagccggcccctccccggcagcaggccggggcggagcaggagcgggcgggcctgcagggacgcccctgcctagcagccttcgcggaactcccggcagtgttagacgcgttgtgggtcggggagaggggcggacggcggcaccccctccctcgggttgcttctggggcctcagtcggagccgccctcctaccctcgcctcgcatcctctgccaaatccgaattcttccagcccagcttcccgggctctgtcctccatatcgaataataatgacacatatcgaatcgcatggacttatccgacctcctcagaccccgcttccgccctgccccgggcccccacccccccccccgtaccccaggcattcgtgttggaggacggattcccggggccggcaggcaggcctgggcgctgccctctacacacctctgtcttcgctttgcgggtaaagccccctgggggggttgcggacgcgtcgggtttctttttctgtatttgtacgttttatttatgaacggattgcactcgggtcagggagggggcgctgaacccccatcttgcccgccgacgccgggggcctgggatgtccgggattactttccacgccccgaggcccgcccctagctgggagcctctagggagcctcaggccccgcctctccgaggcaggcccctcccctgagacccaggccccgccccygagacccaggccccgcccccactcggttgccaactttcgcccgtctatgccaaagcctcggcggcgaccccgccccaagggcccgccccattggccgccgcctttgtgacgtcactgcatgcagccccacccctcctcccgatcctacccggggctgcccgctccccctccctcttaggtagtccgaagccgactatagagcaataatgcgcactgcatgcgaagctgccgccgcctctagagttactgagaatcaggtatcccctcgccctacccaccccataggcccctagatcagggacgctgcgcggggccggccgcgcatactttctccccacccctccccgacccccacggcagagcccggcggctgtaatggttccatgggcgggggtggggtggttgcccccaagacccctccttcaggcattaatcattcactgaccgttcattgagcacctmctatgtgccaggccaattgctgagtccgccaggagcgcagccacctgctgggaggtgtgtttgcaggacaggggtccaaccggcttgggtgggccagggaagaacggcagatgcagagagaccaggtccctaggttcacatgccccctacactcctccccacctcaaccagtccctgctgggcacaactgggctctacctttgagttaggccttttgactccagctgagggggacagatccagggctcctgggcccccacacaggtggccacttctctgatcctctggccaacacacatctgccatgtccagccaggggcagagccatggctggagaagaaggtgccagctgtagcctatggtgtggccagcctcacccccagcagcaagcgtggctgcccccacaaggatgacccaccgctctgcacagcagtgcccacatccaaacaccctacacaaccaggtgtggtgcctgcacagctcccaagctggggcctgcccacctgtgccgcatgcacacgcacacacaggcgcccccacctcaccccaccccatactcctgtctacctacctaaggagaaagctggagggctgtgggcccgtcagggtctcctgcttccccctacaccccgccgccgtggaaagccatgggccccctccctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgcatgtgccccgccgccttgtacatattcccacccggaataggccgggatttttactcgggccgtgcccctcttccgcccccatttggggccaggccggccggacagacggacggacggacagacctccttcctaagcacaatagcaccagctccccggagcaccgcacctccacaaggagaataaatgccactcttgatagaatttggagtgtcgggctgatgtgtcctgggctgggcccacgctgttgggtggctgggagggtcttcccagtctggcagtacctcagaggctggtgctgcaagggtcagcctgaggcctttcacaagacggccctcttcttccactggggaggacaggcttggcaggcccaaccacaggagcatcaggtctgaaggcaaagtagttggcatttcccctggggtaggtggatctgctccacaccaggaacaggagcactaaggggttccagtctaaagtcaggccaagcccacggttggaccagagtgggcagggtaggtatagtaggagctgctgttccccagcctgggtgccttcgctcttctctccctgaaggagctttatgctgtgatggaaggcctgatagccacctcaagccctctgagatgctgttgcaggaaatggggacagtggagagttcgaggtctggcccttttcctgtggcctgctgcccacattctgacccccaggcttcccagatatgctcccccagtgtctgcggatgcctccatggatagctgggttggaccggttccagggaggaggtgcccagggggcagagaggcttctgcaaccatcgcccaagggctctagacagaatgagtagtggaggagataagggacagggaccctttgcccagcaatgtcccctggtaaccaggtaggcaggcatgagccgagaggcccaaagtcttcgggcacatacattcaaaccaggtcagtcctagatccagggccagcaaagctgcccacaccctagcagggacaggggacagacctgcccagactccactagggtggagagcaggggaaccaggtctgcagcatgtcatggcctgtgtgcctggcacttggaggagctgtggtgcaggtgggtgctctctttgggagagcactaccagcaatgacaatggcagacagcaatggccaggaggaaggctcctagcctcactccttccaaaggactccaacagcgactggctgtttctacttctccaggattctgatgcgtagagtgggtggaaggatggaggtggcctccctgaggcctgggatgagctcgaccccccagttcctcccagccacagacacaagtttccctctgaatgagcagcacaggccatagaccaccactggctgtgaactctcctgggacccttgcttctcacaggccttcttggcccacccatggcccctaggccctgggatcagcctgaggccccaacccacttccagccctttattccactagccctggaaggcaactcgcttcgggcttgggccccctcatttgttgctgcccccagcagggtgatctgcatcatgctttcctcgatgacccagccatacacacccttgtccccaaccaacctcacctaccctgaccattcccctcaccctagatcccagggtatagggcctgtctgggcagggcttcacccacctctggagctgctgccccgccacgcccccacccccggtggcaaagcccttccttaatggcccgcccacagccagtgctttccccattggctccaagcctggctctgctcaccaggcccgacccatcctccctggtggtccagtccaccctcccattgtctttctcctgtggccacttgccggctttgagttgggacgcgaccacaggttgagtcgttgatctcctctgcctagcatgaggtgctccgtggccaggtccagacctctctgagcttgctgtcagtccatactcagacaggtctgggcctacctggccacagagtgtgtctgccagcgactgcattcaacaaatgaatattctgagagactgggtaggagatggggctggtcctgaccgaccaaggcccatgtgtgaggggctcttgggtccagtgagggcggccccactcggcaggctacacaaagggcatctgccaggtagctccagcctgcctgatacctggttggcagcaacccacagcggcctgtggtgacaagaatatgtcaccaggggggcaaccaagggggcagccctgctggccactgttggtggaggtggtggaagaggacggagctcagaggcgaggctgtgaccagcccacgggagaggaccccacctcaggaggagcacctgtttgcttccagagaagtgctgcttgcccctgctcaccccagaggaatgaaggtgtttctagagtcagagtcctcagtgaaccctggcatcctgagatccaggatgttctcactccatgccctgtgcaatatgcacaccaagccaaggtgggccgcaactgtggctgttacagttgattagttgcttcatttaacatacaagatgtctggggcagtggctcatacctgtaatcccagcaccttcagaggccgaggtgggaggattgcgtgaggccaggagttcgagaccagcctgggcagaatagcgagacccccatctttagaaaaaataacaacaggccaggcgcggtggcttgcgcctataatcccagcactttgggaggccgaggtgggcggatcacgaggtcaggagatcgagaccagcctggccaatatggtgaaagcccgtctctactaaaaacagaaaaattagctgggcgtggtggcacgcgcctgtagtcctggctactcgggaggctgaggcaggagaatcgcttgaacccaggaggtggaggttgcagtgagacgagatcgcgctactgcactccagcctggcgacagagtgagactgtctcaaaaaaagaaaaaagaaaacaaaaaacaacagggcggttgcacaggccgtgcaaatgcacagaagcctcttgagtcccggcgatccagcggcccagacttctgacatcctggagaggctggcccacgttggaaactgggaggccctgagagttgagggacgtggagctccttgtggagagagtgggtgggctgagaagacaccaccaaggggcctgcgccctcgccctcgccctcgccctcctctcgccgggctctgcaggcccggaggtggagagcctgggagtcgcgtgcaaggcaggcgtcccggtgacgcagggcctggtgcatttctccagcttggtcttctgacctggcccttgtctgacgtccccctaaggcgaagaaaagcaggttcctgccggggtaaccagagggctcgcggagcagaagcgcgccagggacgttactgtaagctgcgtgcgcagaaaccaacgcgctgggtggcgggcgacgcgagccgccgcggacaccggcccggacagctggaccgtggcgcactaggcgcttcctaaatgattgcccggagtgactcgccgagaccccgtgtgtacacaagtgggacgaggggcgggcgcacagcggccaggaagtcggggcccagcgcacccctcagcggaccatcccgctccgtggggccggacaggaccccgggaccacgcgggagcgatgcaaggtccgttcccgctgcgcgcacttgcggcccgcagccccggccctgggagctgccacggctcccagggtgttctgcgccggtgcggccgcggcgactacgactcccagggtgctctgcgccggcgcgcccgcggcgactacgactcccagggtgccctgcgccccgtcagcctctccaggccccgcctcaggtcggccgcggactacaaatggacgagagaggcggccgtccattagttagcggctccggagcaacgcagccgttgtccttgaggccgacgggccygacgcgggcgggttgaacgcgctggtgaggcggtcacccgggctacggcggccggcagggggcagtggcggccgttgtctagggcccggaggtggggccgcgcgcctcgggcgctacgaacccggcaggcccacgcttggctgcggccgggtgcgggctgaggccatgggcgaccgcggcagctcccggcgccggaggacagggtcgcggccctcgagccacggcggcggcgggcctgcggcggcggaagaggaggtgcgggacgccgctgcgggccccgacgtgggagccgcgggggacgcgccagccccggcccccaacaaggacggagacgccggcgtgggcagcggccactgggagctgaggtagcggagcgcctgaccccctaacctctgacccaagggccccgcgactttccggggttggccgaagcgcgagctccgagtccgagaacatgggccctgggctaagcggggatcggtgtgccctatgggccctgtggggaaactgaggcttggggagagtcacctgacaaggtcactgggtaggggctctggagctggccttggccaggcagaggggagccggcaggtgtcccgcatccagatcctcttgggtctgtgcatcctcaggggctcctgaggagcttttcgaggggcgggctggtgggggcccggccctggacagtgtccccttatatggaaggagtcagataagatctgggcagtttgtggtgataggttccttcttggtgctatgagcggtgccttgcgggtaggaaaggctcccagaggagggctggcctgccagggagggggccagaggagcccaggcctgtccgaggacaggggaatcagcagctgccccggacaaggggcagtgttagaggcgttcttgtccttgcagacccttctgagagtggctgcgtggcccattcattgctccagtggttaggctggcctggagccctgccgatgttgccagagccagcgtctgttgtagggacagagagttgggttctgtgttgggacttccatcctccaggtggggagtggggtatgggggtggtggacacacctgcaggcgtgtgccctgctcagctggatgactgacagagaggggtggagggagagaaccatggccgatgggaaggacttggccagcctgggcattggcttcctccaccaagctggccttgagcaatccccttgccaccctccatcccccctttatggcctttaccctggcccaggggccctcagggctttgttttagagagcagctgagggcctagaggttatcaaggcagaagtgggctgattttggacatgtagttggcaatgatttgctctctcagtgagcaagaacagagctttccttcacggggcaccatggggagggggttgggggagggcaggcactgtcgtggccctcagggtgctcagttcatctgggagataagataacctcagcaagagtcaggcatggagcaacatggacaaaggtcgggcacggaggccttgaaggggccgtggggaggagggtggccctcctgagaggggtgcttgcctgctgtgggcctggggtgctggtgagggaggctggcctaggcacctcctacctgaaaaggaggtgtggctcctggagttaccctctctccaggaggcagggggatggctacatgacctgtggaggacgtgggaattgagatttctttttttttcttttctttttttttgagactagttttgctcttgttgcccaggctggagtaaaatggcacattcttggctcactgcaacctctgcctcccaggttcaagtgattctcctgcctcagcctccagagtagctgggattagaggcgcccaccacacccggctaattttgtatttttagtaaagatggggtttctccatgttggtcaggctggtctcgaactcctgaactcaggtgatccacctgccttggcctcccaaagtgctgggattacaggtgtgagccaccgcgcccggccgggaattgagattttttttagtgtgagatgagggtagtcccagctttgggccaagccgccacctgggggtaggcaggggagagcagtcaccttcttgctttgcaaaccagcaaggctttcctgtacttctgctggtgtgggatgggtgcagagctcgtgggagaggcctggtgagtccctgtccctgccgtggaggtcgggtctccttgggaagaggggcagtagatggagaggtgaggccttcatggggctggaggctgagaccaaaagtctatctgctcctgggtctccaggacttgcaggctatgtgtgcttgtccctcagacctagggatgcagcagggctcggccactggctgtggacactgggctcttctccctgctgtctgcgtcaggccttgctctgcctgccctcctgggacttggcctctagcgcacccccttgtcagcctcacagcctcccctccctccagcttcctgctgctcttggcccagcccagcctttcctctcccgcttcctcattactccttgagctcgggcctcctcccctcacggacacttcctgctcacctagggctgggctctgggtgtgagctcctttcttccggccccgtggcaaggtgaggctgtgaggcaggcaggagagggcacccctttctgctctgcttgtggctcactcctgccaggctctttgcacacacccaccagccctctgctcacaggcaccccagtyggggccatccggtttctggcttctcccagggtgttttgtccctgaggtgtcctttctgactctccctttctctctccagcagggtctgcgaggtgcagggagcctgccccaaccatcttgaacccaggcccagcccagaggccagagtggaggaggcggcagtgagcagagctggactctgccccctcctcattgtgcttggccctggagctgcactgtgtgggccccaagtgtgggactcactgggacctgtgcctttgggcacactttgaacctggagacagggtggcgggtgggcatgtgccaaggtctcagtgttgccgtgagactgagaggatcctgctggctgggtgggcctgggggctgcaggagggagggcaggctgctccgagtcttcttggactagggagtgggtgtagggacagctggaaggtgcagaggcttgggcagatcctccagtcagtgagagggtgataaaggtgctctaggcacaggggcagatcccacctccccatgccgttccatgcagcctgccctgtagcccacatgctgctggccgcactgactgcttggagctctgtgggcactggtggactggggcttcctcctcatgggggcctgtgaggggtaggggtagcgcagtgggggtgctgcctctgggtggggctggtcaggcctgtgaagggcctgaggtgaggctgtggctgggttgaggaaggccttggaagcctgtcaaggggcccctgagaaagcttgtgtaggattgtctgcagtgagctttgggaagcaccaccctttcccgactcctgttttcatcttggagatgggcatggataaagccagcatggtgtccttggtggctcaaagggggcaggggtcatactgctgtgaaacagctgtggttggtaggtcgtggtacaagaaggccaaccctgaggcttgggattgttctgctgaaaacaaatgggctcgaacttggggaagagggggcagtggagaggcccccagacagacagcccagagaggctgctgggcagttgggcctcgtgcccctgctcccgtcacggtgctggggctctggcggtgtctacacccagcctcctggttgtgggcaggcagtgagtggagtaggctggggagatgagccaagggcggtggtcagttgggaagacagctgccaacttggggaggagggaggctctggtggagaccacagcctcactgcatggcccaggatggacctggtgggtggatgcagggcgctcaggctggagctgggagaggcaggggctgggtggagctgcctgcccctgtgttccagtctagatgggcagagggaaaggtgtgagcatcctccctgcctgggggtcttggggactagtgtagacttgtccaggaactgtgtaggtgtagatggggcatgtgttgcaccaaccttggtcttggggagcaaaggttgggcttgttggcattgcctctcggcctccctggccctttgcctcctgggcagggccgtctgactgccgaccccaatcctagccagcttgccttgggtgccctgagggcgtctgcctcatggggctcctgccatggctctcaggcccactctccctgcctaggggctctgaggggcagatgtgcgtgtgcgggagggaaagggaggctctggcctctcctctyacaaagttgaggacttgctcaatgctgtgtgtggtgtcccagtggcacggcagatggggggtgaggcgggcctgcagctagtgtatrtgagccagcactgcttcctaggacgtgtrggggcctggccaagctcttgctgtccttgtcctagctatatggcagtccctctattgggctgggtgccctcttccacctgtgcagtatgctgaggaccaggcagggtctgcctgtgcccctccagcgctggttgggagatcatgggtgggtgcctgcctctgttggaagcytctcagccagcaggcacctagccccgggtgggttcctttcagccccctcagcctgggcacacatcacaaacaagtggaggctacaccggcacacgagggctggatccctgcctctgggaaagtgcatgtcaggctggtgtgtggctggcgcctggcctgcctttgccagtttgagcctgcacgtccaagtgtggggacccctyagytcccgggtgctgggatgggccaactgaatakggtggactcaaccctcaccacttggtccccacagtgctgggcagtgccccctggtccatccccaggttggaccctgcttgtggccccagtgctagtccacagccagagtacatggcagtggccagaggcctctggagagtgaggcctggagtgtccaagctccatgtaggtccagtccgggcagggccagctgggcttgcttctgaccctgacatgctcgtcccgctgcctggaggtgcaggctctgggggtccggagagctttgcccactgtaggtcttgaggccacagtgtggctctgcctggcttctcctcctggttgtaaataaggagtggggcctgagggcagacgaggacactggggtgggggcctggatcctgcgggggtggcgctgccctgctggtgcccactcagggggtgcttgtgttgtgctctgtcaggtgccatcgcctgcaggattctttattcagctctgacagtggcttcagcaactaccgtggcatcctgaactggtgtgtggtgatgctggtgagtgggacatggtgtcgggagcgggtctaggtccaggtggggctctgtcccaggctggcctttgcctgagaacaggctctgtcacccagggtgtccaggctggagcccctstgggctggggtgtgtggagcaggctgcacctccatgtggctgccagcactggactgttggggaggggagtggcagtggctgcccctgctgtggtcacttgggtgcccatgcaccacatacttgctgcttcccattggatcccaggagagycctgcwgatgtggtgtgggcgtggggasgccgaacartgcctggctggarcctgtgtgttgtgagctgggcctgaggggtgcagggcctccagggagggcagggtggagggggtcttgccctgggctggtgggagagtggactgcatgctctgtggacacaaggcctctctggcaggggatgtgagaagagcttcctgtgctacgccacatggcctctgtgggtatggagccctgcaggcctggccaccactctgcagtcctcctggnnnnnnnnnnnnnnnnnnnnaccccagaagtagttggagtctagggctcaaaggggcacctgcagggcaggtcggggacaagggctatctgggcccagcctccccaactcagggctgatgtggctcgaggcctttgaccttcacccaggcgtgtctatctctggccttgggtgctgctcctgtggctacccacgtggaaggggctccacgcacatccacatcccccaccgcccatggtcctagaaggttccctgggggtggccagctgtggaggcccacgagtcctggtggctgagaagctggccaggcaggaggacagtgggcccagcgccagcccagcactcaggagacgcagcccattcctggcccaggttgggccttgtccagcccaggcagcactgtgtattctccccaaccccttgggcctgcctggccctttggcccagccctgaagccttttccctgctttggctcccccatgcccccaccccaggcatgtatcccgctctgggctgcttgttgcattccttctgtggcctgggcctggaggtgggtaccgtccattggcagctttggcttctgcctgctgtcagccctcgggagaggccagtgacagtgtgggccacgtgtccatgcagaaggcctgtgtgtcagccctgcggccgggggaggcggggcagtagcccttgtgtctctgaagcagtcttctctctcatgaagccttccctgaccacccaggcaagacaccctcagtgttcccttgccagcgacccttttccccagcaccagttcactaccgcatgaggcccgagctccgggtggtcagccaggtctgcggcattggggcccagcttaatggaggtgttggtagtgcttgtaagatggaggaggaggttcctgtccttgcagagggaggccaagcacccaactccaggctcgtcccaagagccttattccatgggggctcagtcctgggaagttgctttggagccaagtgtccaaggcttagagggcggcaggaagcagaagaggcaggcggggcacaagccctgggaagcactccaggcccagccccccttgcgacacagctggacactgctcctgcagagaaagagtagacaactccccctcttcagccttggccaccagtagggactggttccttggggctcagccgtgggcaggcctccctgggcaggcctgtattctggggctgtctctggggtgtggttggctgtgggagccttgggtccctcactggctcggctcagcaggagggatgtgagcagatcagcagctggtctttctgctcctgaagacccaggcgtctggcagggttggttggtctggccggttggttccctccatgtgggaccgtctggtgtgatggggacagggagggacttccccttacccagcactggtgttggctgaggtgggtgctgagtctcagagcttggcatggagaccagacagggctgggtctgcaagcctgaggctgccgccctgagctcgggctgggacgtgcccagaggtgttgggaggatctggggtgagtaccctgtggccaggactaaaggggctgcaccctcctgtccatccctcgcagatcttgagcaatgcccggttatttctggagaacctcatcaagtgagtgcctttgccaggtcccacccctgccccacccatggcctgtccaggccccgccccacagccccacctgccacccactcagacccccatccctccacccccaggtatggcatcctggtggaccccatccaggtggtttctctgttcctgaaggatccctatagctggcccgccccatgcctggttattggtgagctgggctctgaggagggcctcgggtggggatcaggctgacgtggccctaaacctgccccttggtgcttctgtccacagcggccaatgtctttgctgtggctgcattccaggttgagargcgcctggcggtggtaagcagtgcccctcacctccgtgtgtgctcaccctgctgtgtgyrctcctgggaggagctgctccccaggcctggcagccctctcccaggcaatgggagccctggttgagtgctctgctccccactccagggtgccctgacggagcaggcgggactgctgctgcacgtggccaacctggccaccattctgtgtttcccagcggctgtggtcttactggttgagtctatcactccaggtgcgcccccatcccaccctgcccatctgtctcgggccagccacgggcatggcctccggctgtggcgctgtggaggcctgagtccacctctcctgcagtgggctccctgctggcgctgatggcgcacaccatcctcttcctcaagctcttctcctaccgcgacgtcaactcatggtgccgcagggccagggccaaggctggtgaggggctgccaggggctggggctgcctgctggggggctgggcagcagcagggccccaccagccccctcccactctgctgtgctcgtagcctctgcagggaagaaggccagcagtgctgctgccccgcacaccgtgagctacccggacaatctgacctaccgcggtgaggacctctgtgggcctgaggtgcgggggacaggctgggcctgttctggtaccaaccccccattcccattccagatctctactacttcctcttcgcccccaccttgtgctacgagctcaactttccccgctctccccgcatccggaagcgctttctgctgcgacggatccttgagatggtgaggttgggggctgggggcagccactggaggctagggggccttctggctagccagggcctcagctggctgctctctgtttcccccccagctgttcttcacccagctccaggtggggctgatccagcaggtaagtggggtagggcagggttgggtgtagctgggcatggctgggagctgacgtggtgccctcctttgcagtggatggtccccaccatccagaactccatgaagcccttcaaggtgagtggctcaggtgctcttgcagctggggtggctggggagtgaccaggagcatggctagctgaagggcttgtttctgcaggacatggactactcacgcatcatcgagcgcctcctgaagctggcggtgagtgcggacaggtggcgcatgcrcaggacaggaggggacagtggcatgtgggggaaggttctagaacttggtgcccacccccacctccctgccaggtccccaatcacctcatctggctcatcttcttctactggctcttccactcctgcctgaatgccgtggctgagctcatgcagtttggagaccgggagttctaccgggactggtggtgagtgtccctggggtgtccctgggggctgggatgggccatggtgtgctctgatccccctgtggtctcttggcccccaggaactccgagtctgtcacctacttctggcagaactggaasatccctgtgcacaagtggtgcatcaggtaggtggggtgtgtgtgtgtgtgatgtggaacatggctgtgaacctgaaccgctttccatgccccctcctctgcagacacttctacaagcccatgcttcgacggggcagcagcaagtggatggccaggacaggggtgttcctggcctcggccttcttccacgaggtcagtgctctggggggcatcttgcctcatccctgggcaggggtatgcccacagcagggacggctgacaccccactccctggcatcctctctccctcccatctcagtacctggtgagcgtccctctgcgaatgttccgcctctgggcgttcacgggcatgatggctcaggtgagtgacccccacgtggcctcctcactcgcccagttaccccgcacctgaacccctcggctgaccctccccatgcccagggaccctgaagcccccagccctgtggtcaccatggccgactgacttggcccctcactccctagatcccactggcctggttcgtgggccgctttttccagggcaactatggcaacgcagctgtgtggctgtcgctcatcatcggacagccaatwgccgtcctcatgtacgtccacgactactacgtgctcaactatgaggccccagcggcagaggcctgagctgcacctgagggcctggcttctcactgccacctcamacccgctgccagagcccacctctcctcctaggcctcgagtgctggggatgggcctggctgcacagcatcctcctctggtcccagggaggcctctctgcccctatggggctctgtcctgcacccctcagggatggcgacagcaggccagacacagtctgatgccagctgggagtcttgctgaccctgccccgggtccgagggtgtcaataaagtgctgtccagtgacctcttcagcctgccaggggcctggggcctggtggggggtatggccacacccacaagggcgagtgccagagctgtgtggacagctgtcccaggacctgccggggagcagcagctccactgcagcagggcgggcatggccggtagggggagtgcaaggccaggcagacgcccccattccccacactcccctacctagaaaagctcagctcaggcgtcctctcctggtgctactcctgctgggtgtgcgggaatcggcactctggccctcagtgcaggatggtcaacttgcacccaccgtgctcagcttcagcttgggaagaggtcggccctgggtttgcgggaagtgggctccagccaggatggcccagggatgggcagtccacagggcctttctggtgtgggtctggtgagccgaggggctacggtacacaatggctatgtccatggctattcgccttggggcagggctcggtttggcagcctctttccttcacttggaacctgggcagccaggtgggctggtggctctcagctgccctccacgaggttggggcacccctgatccccaggcctgccttgccctctgctcttctggcaccaggctgggcagtgcagacagcgcagccctgcagccttcaggacaccttgttcccaggccctgcaatccaccaagctggatagatggggccccccttgatggtagcgggaggtcaggggtaaccccagggccctgctgctgccttaccttgctggggtgactgcttgattaaagaccccaagactggaccaggccctggtgtccccagacctgcagctatggcccaacaaggcaggtgtttgaggaggccctgcacagggtcccaggactgcaccaggggcctcatcagcaacctgctgaactggtggtgtgaggggagggtgggctcccttggtggtatcctccctctaccccagtgggggctggtgggccctgagatggaggcatctccttgggccctgctgaggatggcagtagtgggtgagctcctggtgggggratgggtgtggggccgactcctccatcccacatgggctcctgtgcctctccctatcagttggccagtggagctcgagaacaaactgttgctgccagataaagcagcaaagcctgctccactgcccagcgcargcccccttcccttcctccaccaggctgagtggagaaccctaaagctacgggacaggctcccgttccccgtgcctacacagggtgctggctctggcagaaagacagtgtgcccgccccgcatcacctgtccgagtgcgaacaccttgggaagggggttcctggtggtcctgtgacaaccagagacccccagggccaaggtgaggcgcccacccctggtccctcaataaagaactgcaagcacatgctggtcctggggagtcgggcaggcacggagctagctgcaagcatccgtcttcccccaggaggccactgcagccyggcccttctgtgccctgggcccctcctcattgcagcaccacccaccgcaccaccctgggacagaggaaacacatggaggccatagcatagagcctgtctgtttatagatctctgcctgtcttgtccgtccatccactgkgtgtatatatctgtgtatctctgtggagcggggaacgggacagttgtgtaaaaatccaaaatacaattctgactatgaacaacctgcagggtcagtccaggtgtggctgtgaagccccaaccaaaccacaggacacggggttgggggaaggcagactggcaggccagggtgaccctcctgaccagaggtgctgcccagacccgagcccgtttgtcctactggggctatggcggccgacccaccagtgcccaagaccgcgaggctgccctgcctccccaagaccagccctgcactgggggtgggggtgggcggctggcccagctcctccggggcctctaggagacagtggggtccttggctttgggaggctccgagcctgtcagcagggagatggtggggtcctcggcgaagccgtccccttcggagaagtaggagccctctcccagctcaaacagcaccggcaggtcgttgctcccggtgtccacggagccggggtccagcaggaacagcggctgcgctgtgtagtgcaccagctgcttccctgcgggggtgggggtgtcaaggcggtggggggttgggggcagaggtggggccggtgggacttggctcacctgaatccgggctgctgttctctgcctcgggaggcctggggggctcctggggagacaggagctcttggatctgtggggtggagacggtattgtgagcactcccgctggtctcgttccccctcaccccccgcccgcctacgcacactggccaggctgctgtcaaggtcaggcaggctcatgtcgggcacggtcaccgaggggctgaacagctgcggaggagggagggaagtcagaacagcacccgggggcggggcggggaagcggggaggcggggaggcggcgcggggaggcggggaggcggcgcggggaggcggggaggcggcgcggggaggcggggaggcggcgaggcgaggcggggaggcggggaggcgcggggaggcggggcggggaggcggggcggcggggctccactcacgtccagcagggcactggtgtccacgctgaagccgtggctgctcagcatggtctgcaggttatccaggttggagtccatagcatccaagtggtcactgagctcattcctggcccgggataaggcggtacctgaaccagtgccccaggccccacaccccaatgccctcctgtgggagaagggctccccttgactgtaccccccaggctgcacccccgtgtacgcctgcacaggctggagggggcagcgcattcgaggacggcctggaaggcagtggaggctctgtgccctgcaggggtgcggctgggcctatgctgggcatccctttgccatgagggcctgggggccttggtggcagtggacccaggagacaaggggcgtattcagctccagcacaaggatcagggatttcagtgttcagggttggtgaggtttcccgttgcactgggaaaacaggtggggctctgctcagtgtgtgggtggctcagtccctgccctggtgctgctgtggggatgagacccacggtctggtggctgtgaccaagaaagccctaggccacagggcacacctgggctatgggacggacagccaggctgggtcccagaggtgccctggagaccctgcctgacaggaagtgcagtcagcaccgcagtctggatcctgccaacaccagaggccgtgccagagcagggaggcctgtccctgtcatccctgtcacaggcaatgaccacaggcccgtggccaggggagccatgacgacactgagcccccgccacagaggggtctcggctgctgccgcccaggcccgacgctcatgcccggccaggctgggtctggtccacggctgtgtgggagggcccgagcgctggcagagccctcctccctccccagtggggtcagcgctaaccctggctggacttggccatgcggagaggaagaggggcaggggaagaggcgggcgaccctagacatctgtggagtgcgagccaaactgcaagatacaaaaacaagagcccccattgcaggcaggggctgggggtgtggaggccggccctgctcaccatctcctgccatgtgtctgggcagcacgacctgccagggcccgtggcctgtggcgagggtggcggcagcaggaggggtggctgagagcagggcccggcagcctgtccggacatgcccgtggcttctgtggcgtttgggactgtggggtgatctggctggcacctgtctccctccccagccccgagccccgaggttgggggtagggtcctgcctcgccagctgccctgctcagtccactgggacagtcggggctgaagcccagggctgtgcgtccaggcgctgtgggtggggccaggggtgggcggcactcacttgtccaggcaggctacgctgaggcacttttcaggggtggaggtgggcgggggggagggaggccggccctcggtgtccgtgtggcccctggcgtccgtgagggctgtgacggaggcgggggcaggttcactctcccgcaggatggagtcaatgagggcggtcggggacaagagggtgtccacggaagatgggcgcccgggactcgcctcctctacccgggggctctgaggcgggctggggggctcctccttgacacgcaccagggggctgctggataggggcctgcacacgaggggggccaggtgagctggcgtctcggccagccccacctcatccccaactctgccctgggcccacaggggctcgcctcattgggggacaggatggctggggtgatgcggcccccacctctcgtctatgctcccgccgggggaggccatggggctggcaggagccagctcggtgatgtcggagatgatgggtccagagctggccacagcatcaggggcgtagaggctggagctgctgtaggctggggagggggcctgcaatcaaaggcaggaggtccatgcagtgccggcaggggcaacccaccccactgccgcctgcatgcctgggcgggtgccctgtctccggcactcaccgagtaggggcccgagccgtggacgtgctccagggagaactgccggctatacttgggcatggaatgtgctgagccactgtcgttcagcatcagggggctgtggggaagggtgcaggtcagccaccaccccccacctcggggtacccggggcacagctgacagagaagggggacagccctgggccccgggtggtggatgcaggcatccccaaaacctcacatctttctcttcacccccaggatccggtttgactgcaccagtgagatcaggaactgaatgagctgtggagagagaggacacagttaccccggcccttgtggggcccccgccggccctctggccctgcccccaccttgttgacgactttctgttgctgggcatgcttctgccgaaggctggccacctcccgccacagagcctcattctcactgcaacagaccaggctgggtcagtggggcccaatcccatgagccccagggctgagggagccccacagaccctccctgtcccccatgcaggagcaggggtaagtgtgaccatgtctggcctggcccaccccaggatgagaacttgtgtgtggagggactgggggccagggccagggcttgctggtcccactgcccctccctgccggggacacctggtgtcacgtagggtgttggggatggatccatgcgagccaggtgcacccggatcctggcatccatcctggcaaacacctggagggctgccttggacacaggccaggagcagacccttgggccgcccttccaaggcctgagcagccaggttaagggaggacggttcttcaggctgcgacactggctgtcccatgtcctgtaggtgctcagggccctcgccaggcctggaggtggctcaggggtggggaagagctgtccccagccaggtgagcagggccatgaccgcgctcctgctgctctgggaggctgggccctgtcaagcctgtgagtcttcttggtaggccaggtccacgtggccggactccaggaatcacaaagccggtggctcctgctagaccccatgcaggagagtctgaggccaaggcctcctccatgacgtgggggtcaagagcgcctgctgcacggagccgaggaagccgtactggcattggggttcccgcatgcctggagccccaaagtggacgtgagacctgagctggccttccgaggtgggcttgcctcagtttctcaggtgccaccgtgtgttaggctcctgctaaggtttccccagagccgcagggtcccggtgaggaggggctgggggctagctccatgggcccaggcgagtgtgggacagcggttccaggaagggcctgaggtgggtctgaccccaggcccgaggcgggtgggacgggtctgctgtgcaaggcttgtcctcaaaagtaggctggtgggtcccgccaagctcggagccaggcagaagccaatggcccagagggcgctggggatgtgcagagcaggggaccctcccaacccccttctgcacatggaaaacggctggccccagagctgttgcagcagccacgggcggcggggctggggcagaggcccagggtagatgtgcgtggagcgggagggtggagctgagcacctggccccggtcagggccctgcccccacagcacccggggcctcttggtgggcgccaggacccgctgtggcccataatgctggtgtgggacctactgcttcatggccaggagcttggagtccatgcactcctgcttccccttcatcagctgcacgtccgtcagcagcttggtgacgctgtcctggcggatctttatgtcttcactcttcagggtggacacctggattcccgagagggacaggagtcactggagcagcctaggagcttggcaggctcaggctcgtccactgcagccaggtccctcaggaaggggcaggctggggtgggagccctcagggaggggcgggcggggagagctgtggcaggtgagaccgggcaagggtgcagggccggcactcacactggtcactttcctcttgatgttctcaaggagctgctcctggccacgcaggaagcatgggtgctggaactccgtgtcgtctctctctggcttgaccaggccgccctgctcgatgtggaccactttccggaagccatctgcacataacagggaagggggcagctctgcctcagggcgggaccagaacccctgaagagcggccactgctccaggaggctgctgcggggcttggccatggtcagaccctgccctgccccctcagagcccatgcctgggtggccgagtggccttggtctaagggagaccctgtgtccccacagggctccctgcgcccgacacacgtggagtacagctccggcttcacggttcttccatggggaccccaggttcatacccacaaggaccctcccccatggaagaggcggctgctccccggcccccaggcttgcagggtcccacgccatgcccttggccagcacaggacgccccgtccttcatcacagggtcctcctgctggggtcccgccatctgcaggtctgcctcccgcacccctgcgctgcctggaggcagcactcacacatgttgagctgccgcacgaagctggccatgttgttgtgcttgaagtacttgggcagcacctccttggcaaactggccctggtcgaacacgtggaagctgttcccgctctgaaagggagacacatgggtgggtcacgcgtggtggtgaggggcagcgtgcccaagccgccccttccccaggccgccccttctgaaacgcaggcagtgcacgttccacctgatggggctggggccatgggaggcccagggggctggcgggaggcgagttcgttcctgggaccacctgccacacgggcctcatctgtgcagcgtgacctgcatcctcactgtgaggcccaggactgggcggtgggcagatgcgaggccttcctctcagtcggaaagcccctccccagggcttccagagaaggccacgtttccactcacaaagcatccgccgcactctggccacatttccactcacaaagcacccgccgcactctggccacgtttccactcacaaagcacctgtttaagcaggacctttcccttgggaacagcgaaggaaatggagccctaatttcattactcccgaggaaaacacagtcgcgttcagaaatccaaattcagtcttgttttgtgacgtgagacaagaaacagagacagtcaaacactgcatataccttcctcttccatttctctaccgagctcaggcccagagctatcaggaggcgctggtgagggaggcatccctgttggccgtggccgcggtggctcagaggggacatcgaaggcttaggggacagcgagaagcccacacggcggggaaggggggcctgaagcagggccagagaggggtgaggggtgtctgcataggaaggggcggctgactcagtgaagaaactggtgaagggcagtggggcaggtttctccctgc

SEQ ID NO: 12336 - DNA, 34966 bp, Homo sapiens
  misc_feature (1)...(34966): n = A,T,C or G, or insertion/deletion polymorphism (see Tables 1-2)
cagggcagggcctcggcccctcagctaaagcacaggacacgcgggcaggtgcatgggcgccacggcagggcagggcctcggcctcccagctaaagcacaggacacgcgggcagatgcacgggcgccatggcagggcagggcctcggcccctcagctaaagcacaggacacgcgggcaggtgcatgagcgccacaacagggcagggcctcaggcagggacttgggcagccagcagcgtggggaactctgaggaccgccccaccagcccggccggccttgccacctcaggccctgctggatgacggagcacacagaccacagacagcggtactttggaaaacaccctgcatggggcagccagttacgcagtcacagaaacccgagcagggcaatgggcaggacaagcacacactcagcagtgcagaggacctggtgctccaggggccaggagacaagcagcgagaagagaagatggcgcctccctagactccgcagacacctctagtacctttcaagtacttggatatgttattatgcgaaaacattgttttggtttttgaggcagagcctcactctgtcacccagactggagtgcagtggtgagatctcggctcactgcaacctccgcctcccaggttcaagtgattctaacgcctcagcctcccgagtagctgggattacaggcacgcgccaccacgcccagctaatttttatatttttagtagagacagggtttcaccatgttagccaggctggtcttgaactcctgagctcaggtgatccatccaccttagcctcccaaagtgctgggattacaggcgtgagccaccacgcccgctgaaagaatttaataaaaaaatcattaacatgtaaatgtgtaaatccttaatttaaaaagggacagaagacccagaaagatgtacaccagaccactaactgtgctcacgggttaggtgtgagggccctgagtgggagcttccaccctactgaatggtgctgctacaatatctacattattttccaggatgttttatctcataatttttttttgaaacagggtcttgcttgtcacccaggctggagtgcagtggctctatcatagctcactgtgacctggattcctgggctcaggagatcctcccactttggcctctcgagctgctgggattacaggtatgagccactgtgcctggcccagtattgtatcattttaaaaactcaagaaggggtaacgtagttgtccataatcttacaaaccactgccaacacagcacatcattttttctctgtgtatgttagtggtataattaaagcctgaattaagtgtgattttaaatcttttcttcccagcaaacaagccaacccaacacagctagcacacaatgaacaagccatggttccttggcttctatcacggggacctctgccaaggccgtaacttccagaacaccgaaactactgggagagtaaatccttacaaacgatttccagaatgtttagagtaacaaatgctgggctgggcgcggtggctcacacctgtaatcccagcactttgggaggccaaggcaggcagatcacttgaggtcaggagttcgagaccagcctggccaacatggtgaaaccccgtcactactaaacatacaaaaaaaaattagccgagcctggtagtgggcacctgtaatcccagctactcaggaggctgagacaggagaattgtttgaacccaggaggtggaagatgcagtgagccaagatcgccccactgcactccagcctgggcaacagagcaagactctgtcttagaaaaaaaaaaaaaaaataggccgggcgtggtggctcacctgaggtcaggaaatcgagaccagcctggccaacacggcaaaaccctgtctctactaaaagtacaaaaattagccgggcgtgatggcatgtacctgtaatcccagctactagagaggctgaggcaggagaattacttgcagtgagccaagatcacaccactgcactccagcctgggcgacagagtaagactctgtctcaaaaaaataaaaaataaaaaaaaataacaaatgctgtgttttagttaaattatgcttttctcctgttgttctcaataagagtagggtgcatcctcccccaccatcgctgcaacaggtacaatgttaaaccctctacccgtcggctgctcaggcccctgaagccctgtggggtcaggcccagctgggttccgttggggcccccatgccgcctgcttgagccctgccatgctgctcagctccctcctcagctgggtcctgccactggattccaagcagtaaaatccccacctcaaggaaacccaacctgttgccaggagggttgcccgagcatcgtctgacggggaagggcctaggcatgtggattttcagagttcctgggaacggcacgcaactggggatggaaaccagcgtcctagagcccaagcgtgccccaggtgcagtgaaggagggacgccggccttggggttctgagggacggtggagaaggcagtacagtggcagtctcagaaagcccaaggccacctgcacatgggggacagccctcgagggggctcctcgctcacccacctgcacctgctcctcagtggtctttttaatcccactgtggccctcgtcatcaagggctccgtcctctccctcctcgtcgccttcgtcatcatcctcactgctgtcactgccggaatcttccaggcctgagaacacactytcctcgctgtcggagacgccagaatcgctgccggtgctgtggctgagaggagaggtgcagaggagggggggctgcaaggaaacactgggttggtgacaactgcccctccaggcatggggcactgaacactgcagggagagctgcctctcgcccctccagccacccaccagcagctccatgtggcctccaggaccacacccctccagtcacaaacttccaccaaaagcatccacccaacctgagccttcctcatcttctacctccactgacaagacagcctcttgcctttgccatcgacattttaattcctagcacctcacagggaaggggcttttcaaggacaacctcctcctcttggagctcagctctcatcgcaaaactaacactgctctctaccacccactgacactccggaggccctgtggggtcaggctgggctggactccactgggtccctcagacagcctgcctgagccctctccacacctcaccctggcatccaaggccccagagccaagaggtcactagaaaaggggctgggggctggaagagaaatgggtccccaaagggcttttaccacctgaagcagacgcctcctcatttaaccagattgggaccaacgattgatcagtaaattgaaaggattggctgaagagtcacaggaatgatagagactctaaccgcaaccacgcaccaacccacccactcctctctctgagcaggaccacagctgcctctgagcagagccctgctggctgcgtgacaccggcacacacagtgttcgggtccttcactggccttaaagggtggaacaagaacttagactcttaggaagcagttgaaggccaggcacagtggctcactcctgtaatcccaacactttgggaggctgaggcgggtggatcacctgaggtcaggagttcaagaccagcctggccaacatggtgaaaccatctctactaaaaatacaaaaattagctggtggtggcgggcacctctaatcccagctactcaggaggctgagttagccaggaggtggaagctgcagtgagccaagactgcaccactgcactctagcctgggcaacagagccaggctctgtctcaaaaaaaaaaaaaagaaaaaagaaagaaaaggaaaagaaaagaaaaaggaagcagttgaatgcagaattctagattttactgttttcctaatagtttacaagtctcacttaaggtacgacctgcatgtattagctattgcataccgagtgttcacacaatgcctctctcacacagagtcatgatgtgtcttggtattcagtcggctacacaatcacaataactagtggaaatggcatccgtggcctgggcgcaaacaactggctcctgaggaccgtttagtccaagggtggaagtcgcagaacctggcgcctagagtggcctgcgggccattcagcccatgggagccaggatgagttgaattcgcttcacaaagcaatggggcagtttcaacaacccagmgcggccgcggccgagggggctgtgaggggctggctgtccatcccctccaccacccaatttgatgatccccacaaccaagacagggctgagctagcagagagcaacagtgagttctaatacagcaaatgcagcagacactgggttctattcaggttttcttattctcatgtctatcccatgagcataaaaacgcaattaactagcgtatacgtaggttaagcatttactgggagcgcaagccgagcccttttattggcaggatgcacaaatggaacggctggagaggctgctgcaaggggcgccccgtccccactccccgctcccccgtttctttgcttcccggacgccgtcctttaccccgcagtccgctctgcctgagaccccccgatagaggagctgcacccacgcccaagaccgattcactgggcgcgggcgcccaggtgacagaagccgggcccacccgccccagcgcggccacgtgcccgccgggccctctagggacgcgccccgccgccccgcatcgccacagtcacctccggctcgggctcaggctccagttcgggctcagaccgccgcttctccggccgcacgctcggcgccgccgtgcgccccgcaccccgcgaacccgccatgccccaccgggcgccggccgccacccgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcctacggggtgctgggtcggcaactattaggagaaagtcaggacttggcacgtgaagtggagggcgttgctgtagtggaacaggaaaggcagtggaaacagtaagacgtcatgaagcttcaggttgatctcaagcccgtttccgaatcccaaatctgggtttcccaagaggagttttgtttttcattccttatggggcatctttattcgtgtttctgtcttcagttgcctggcagcaggcttgtttacatggtccgaccctgcaagaccggacagctccggtttgcagaagtaaatcagtgattgtctggagttggagatcagaatctgctgttcacatcccggctgtgacgtcgtgtccggtgaggggcagagccaccgcctgcggctggcaagtgatgacctgaagaagggccacactggccgagtggggtgactcttgcttgtaatcccagcactttgggaggcggaggcgggtggatcacttgaggccaggagttcgagaccagcccggacaatatggcaaaaccccagctctactaaaaatacaaaaaatttgccgggcgtggtggtgcttgcctgtggtcttagctacttgggaggctgagataggaggactccctggacctgggaggcagaggttgcactgaaccaagatcccgccactgcagcctggcaaagagtgagaccctgtctaagaaaaaaaagaaaaaaaagaaaggccactgatcattgggagcttttggaggcaccgtgaccggcagggtgccaccaagcatgtgtggcctcccaggagctaagaccccagagttcttcaggctctgctgagtgcctcccatttgcacagcctctttatgctgttaggaatgaagaaaagtctaaactgaagctgccccaggcaggaggccaggttttctgcttcttgggtttactgaggctctgctttacctacagagtgtttggaaataaagagaagactggaaatctttgctcttgttagaaacactttgtgtttgtcccgctgacacctctgtgttggccttcccatccccaggtcccattaaggcacagtgcaccttcctggaggctggcttcatttcaccatctcttcattctagaccttggattcttgtgcaaaggaaatactcccatgtttctgtcttcttttatccgtctttttcttttttcttttttttttttttagaccgagtcttgctctgtcacccaggttggagtgcagtggtgcgatctcggctcactgcgacctccacctcccgggttcaagcaattctgcctcagcctcccgagtagccaggactacaggtgcgtgctgccacacccggctgattgttgtatttttagtagagacggggtttcaccacattggacaggctggtctggaactcctgacctcaagttatccacccgccttggcctcccaaagtgctgggattactggtgtgagccactgcacccagcccttcttctttttcttattccccttaatcctcagaagttaaggggaataactcccccattgggggaggggcatccgmgattatctgggatattctaagcttaatcctactagcgtgatctgtcctgtcccgtaatctgcttgctgtttctgcttaaagattatgaggcatgtgggttagggcccaktgtacccttttttgggaccgaggcatgttctgggcagggcttttgagcaaggaaggcaggtgtgatgaggcccgtggccagcctccactccactcacaggtgcaccacctgtggatctgttctccctggggagggatggggagccaactggaatgtgagtgtttggttccacctggtcagtatgaagtggcaatggttggtgcaggacgtagcactgggggcgagcatggcaatgagacagaaacactgacttaaaactggaaggaagcccttctccargccgcgcagggggctgcagagctttccggcgctggctgcctggcctggagaaaggaggtgatcatcccatcctgtgactttgagagcactcacacaagccctgaggactccctgtcagcagagtcccaacagggcaccctcccacaaatctactgcccaggcccagctggctctcggaggccttgagaaggccctggtgctcttgctctctgctgccttctctgggagagtctccttctggctcagagtcttaccaccattctgccaagaaaaaccctccctatttgacacaagaagatgaggcagaatcacaggcatggtgactaactctcaaggctgaataacctgggggagaccgaggcccagaaactggccagtaactttactgagcctggccaggaatgggaccaggtctggaccaccattgcacgtcccctccctggcctgagatcaggactcccactgcagccactggaggcagaatgccgggtcactgcccaggagaccccattggtggggactgtggcagctrccccatccctgtgttgtttgatttcccacccccccctcccaagaccctcattcccatgagcaccccacccacacaggcaagggccttgaggggacccagcaagtcgtggaggacagcacagccttggagaggaaatgtgtcagccacaaggttatgatcccrgggatccacataagagcatgggcgtgcacgtgggtggtcctccctcagccagcttctcaacagcttctcccaaaggtacacctggatccagtaccactgagacccaaagacggggttgggggactgaatacctggactgacaggcacctccatagaactgagacccatgagacccgggacccgcagcctccctgccccgtgccctggtgccggccctcagcccagcttcctcgtctgcatgcagcagctcctctgtccaccagcrgaggctcttctagggccttgctgggctgcagctgactcaggagggcaacagcctcttcagagaatttgacagcatggagaaccaaacaaaagcagaaagtgaagcctcagaactgggttcaccatcatcccagttttttacaagctatgattttgtcccatctttattaacaagataaggaagtatgaaaartaatctcgacatctgagatggtgagattacagccccaggagccacccagctggctgaggagcctgagaacaaggcacagccacatgacctgtgccagacaaatgctagaatgatggtcacgcaggttagaacgaacccaggtagacggaggcctcaggatcagggtgaggccagagggggcacctgggtgcaaaatttaaggaagcactttttgttttttagataaggtctcgctctgttgcccaggctggagtgcagggctatgattgcagctcgctgcagcctctgcctcccaggctcaagtgatccagtcacctcagctgagtcactgggactacaggcttgcaccaccagacctggcttttttttttttttctttttaaggttttagtagagacagggtctcgccgtattgcccaagctagtctggaactcacgggctcaagccatcctcccatctcagcctcccgaagtgctgggattacaggcttgagccaccgcgcctggccctgaggcattcctttttaagacctacctgcattcggatggcgctgggagtgggggcctccttagatgtgggctcctggatgcttctctgtcttcacctggccccagcctcatgggtgcagctggaaagactctagaaggatgtgctgaaaccctggggctccctgagactgagtgagctggaggtcaccaaggccctcggcctatcgcgggagagagttccattgaaagccagtggtcaggtggccgctgtggagggtctctgggtggacaattgggagcagagtggtccctgcagtgaggcagggggcagggcgtgaggggtccctgaagtaaggcagggcagggcgtccactcataagcacacgaggagttgcagaagcagagccgacctggccacgctcagtcactcagaccctggccacagatcgtgtccggagctcccacggcaggcagggccacccctgcttccctggttctgagagccgccaagacccagcaggcccactggccccaccctggaagatctggtatttggcccaagatgctggaggccccacagcagcagctgtgagaagtgctgcagggtctggagggcctgatgtgtgcccggaccatagtgcctcctggtgtggccataagaaggcacacagctggggctggtcgtggtggctcacgcctgtaatcccagcactttgggaggctgaggtgggcggatcacgagatcaggaggtcaggagattgagaccatcctggctaacatggtgaaaccccgtctatattaaaaaatacaaaaaactagctggacgtggtggtgggtgcctgtagtcccagctacttgcgaggctgaggcaggagaacggcgtgaacccaggaggcggggcttgcagtgagctgagatcgcgccattgcactccagcctgggtgacagagcgggactccatctcaaaaaaaaaaaaaaagaaggcacacatctgtcctcatacagcttctgtgcatagcacagaaaaaattaaaaaggctctgtgctgtagcctcctgtgtttcctctgccccggatggtgtggtggggggggtgcggtgaggaggggcccagggcacagaagggctgagctgcagtggcctcctggggggaggcagatgcctccggtgccccatgcccacccaactccacaggctagtgtttgctcagtcctttattgagggaccagggatggacagcctggccctgaaagtctctcagttttggaggagtcagcctgtgtgcagggcgagctggagaggggtcggtggggctcacagtgccttcccagaggaagcaagcagctcccatcgggtatattgagggctgttggctccagggtctcctcaaggtctggcaggtggaggggaggctgtctaaggaaaggaggtggtcccaaatgtctcaaggcacctggcagcaagggctgctgctgcctcagcctcctccctgtgaccctgtgggccatggtgagcagcagtagccaccacacttgtgcacggcagccagtgacgagatgtgatgagagatgagggcgattgtgctgctcttggtccttgtgtggcgagaacacgctggaagctcctccagagcggaaacaagaagagtgtttatgagaaaggtgcgggtggctcagatgtggacagaaccagaccagggaacggggccacaaagtgagccactttgtctgcacctgctcgcgcttcctgcctgcctcactgcttccatgccctgactccggtggtccctgctccccacacgtgggccacagctactcacacacgcgctccctttgctcctaaagcctatactcccgggacccggagagggaacagccggccagccgagcccaggagcccagatcaccggtcagcagatacagctttgacttggcaggaggctggaacaagaggcttgtggcctgggctgtggggccaccttgtagaatacggcactgttcacgttttgggccagggagccctttgagaagatactcagagacacagacactttctatgtaaggtgtccctacaggcaggatctcacacacatttcaggtccttcacagtgctgcagaaaatgaggccacaggctccaagtttactgcaagctgcggggtttgctgacacctacacttctcagcgtgtggcatctcgcaccagccaggggcctcccatttccagtggcaggttttcgtgatatccagttatgaccggtgactcctccaagaggtgcctgtggtcagcagaggagggaccttgttccactgaggcaggaagatgagagagacactgggttctctgatgggttcaccagcagaccctgtgaaattcataatggcccctaaggtaggggttgcctgacatgttcaacttggatttaacccttaaggcataagaagccgctgaaaatgttcagacgttacaaaactagggccgggcacggtggctcacggctgtaatcccagcacttcgggaggctgaggcggttggatcacctgaggtcagcagttcaagaccagcctgaccaacatggtgaaaccccgtctctactaaaaatacaaaaaaaaaaaaaatagccaggcgtggtggtgcgtgcctgtaatcccagctactcgggaggctgaggcaggagaatcacttgaacctgggatacagaggttgcagtgagccgagattgcgccgctgcgctccagccacagagcgagaaactgtctcaaaaaaaaaaaaagaaagaaaagaaaaaaccggcgaggactgaggtaaaccacaaaattgtccaggctttttatgtggagggaatttgcagactcacgtgcagagaacccaacaaacccagactttggggcagctgaggcagctagaatgtgtggggtgtggtaccagaaaggaaggagttacgcccaaaacaaagagctccagcaatctgcgtgtgagcccgcttgcatcttgggttggatccgatttgctggtgcacacagtgaaacctcgtggagctggaccaagagcaacttgaaggggaagagtaagtgtaaggggacagatgagcaggactcacacagggccgtggttatttcagttcccaccagccagagtatagaagccactttaaatacaaggagctttcatgacaccttagaggaaacacagcttggaagtggcgcagaataagctgcagaggaaaggccactccaatgccgtggaaacaagtgcaaggcaagccctggaaacaccactgcctgctagcacggagtacacacagcactcttgagagaaggaagccaggcgaagtggctcacacctgtaatcccagcactttgggaggccgaagcaggcggattatctgaggtcaggagttcaagaccagcctggccaatatggtgaaacgccgtctctactacaaaaaattagccatgtgtggtgatgggcgcctgtggtcccagctacttgggaggctgaggcaagagaaccacatgagcccgggaggcagaggttgcagtgagccgagatcgcatcactgcacttcagcctgggcaacagagcaagactccttctaaaaaaaaaaaaaaaaaattcacgtccagaatctaatcagtcatgggcagacaagccaaagcagaaaaatggacttgtcactggagggggtccagtagcaggcccagttttgataggattagccaacaaagacagtaaacaattataaaaatgttccctgtgctcaaagaaataacacaaaaatgtgactgagggctgggcgtggtggctcacacctgtaatcccagcactctgggaggccgaggcgggtggatcacgaggtcaggagatcaagaccatcctggctaacatggtgaaaccccgtctctactaaaaatacaaaaaattagccgggcgtggtggcgggcacctgtagtcccagctcctccagaggctgaggcaggagaattgcttggacccgggaggtggagcttgcagtgagccaagatcgtgccactgcactccagcctgggtgacagagcgagaccccgtctcaaaaaataagaaaacatgactgagaaatggaagatacagaaaagaagcaagttggacaaaatgtcactggaactaatctcccaagtagaagaattccacattgtttactgagatagttccccttcgaggaggtgatgcttaactcctcactccagaagcctgggctttacctagtgaccctcttccaaagagcagagcacagaagcaggaggagcagctttccagtggagacctccagcaacacagcctcaccagggaccatgctcaccatcagcagtgacatgcgtatcactgttgtgtactctttttttttttttttttttttttgagacggagtctcgctctgttgccaggctggagtgcagtggcacaatctcggctcactgcaacctccacctcccaggtccaagcaattctcctgcctcagcctcccacgaagctgggactacaggcacccgccacctcgcccggctaattttgttgtatttttagtagagatggggtttcaccgtgttagccaggatggtctcaatctcctgacctcgtgatccgcccaccttggcctcccaaagtgttgggcgcgtcagccaccgcgcccggcctgttgtgtactcttgataggatgatgagaacagcactctacctctttgatcttcctcccaaaaacatacgtaaccccagctaatgatgaaaaaacatcaaacaaatccaaattgagagacattccacaaactgtttgacgagtcctcaaaattgtcaaggttctcaaaaactaggcaagtctgaaaggtgccagagtcagtgggactgaagaagatgtgacaactggatggattttggatgatgtcctggagcagaggaaggattgggtaaaaagctaaggaatctgattagaatgtgsgtcctagttaacaatgtgtctaatgttcttgagacaactgtaccacacaaaggcaggatgttaatgatgggggacactggtgtagggcatgtattctaaagtaaaaaggtggttcttcagagtcaccggagcggtttaacaaaacattagaaacttcagaagaaaagattcctgaactaaaagcaatggaaactgtccacagtgatgtacagggagaaaaaggactgcaaaaacttagccgagcttcaaggacataatatcatgtggtctaacgtatttgaggttccagaaaacagtggggaagagaatacagaaatatgaccaaaaggctggacacggtggctcctgcccgaaatcccagcactytgggaggctgacatgggtggatcgcttgagcccaggagttcaagaccagcctgggcaacatagcaagaccctgtctctataaataatacaaaaattagccgggcgtggtagtgcctgcctgtggtcccaactactcgggaggctgaggcgggaggatcacctgagtgcaggaggtggaggctgcagtgagccatgatcgtaccactgcactccagcctgggcaacagagccctgtctcaaaaaaaaaattatggccaaaatttttcccaaatttttgaaaagctgtaagctcacaaatccaagaatatcagtcttaagcaggataaaaccaaaaccatatcaaggtacattatataatcaaagtgctggaacaggctggtgaagagaaaatcttaaaagctccagaagaggccgggcgtggtggctcacgcctgtaatcccagcactttgggaggccaaggcgggcggatcaccaggtcaggaggtcgagaccatcctggctaatacagtgaaaccccgtctctattgaaaatacaaaaattagccgggcgtggtggcgggtgcctgtagtcctagctactcgggaggctgaggcaggagaatggcgtgaacccgggaggcagagcttgcagtgagccgagatcgcaccactgcactccagcctgggcgacaaagcgagactccgtctcaaaaaaaataaaaagcatccagaagagccgtgcacggtggtggtgcctgtggtgccagctactcagaggctcgggtggmaggattgctcccagatggggcaacatagcttggccaacatggtgaaaccttgtctctactaaaaatacaaaaactagctgggcgtggtggcaggtgcctgtaatccccgctactcrggaggctgaggcgggagaatctctggaacccaggaggcagaggctgcagtgagccgaaactgcaccattgcactccagcctgggcgacacagcgagactccgtctccaaaaaaaaaaatttttttttgcaactcaggaagacaaccatttaaaaaaaataaaaggcaggccgggcgccgtggctcacgcctgtaatcccagcactttgggagaccgaggcaggcggatcacaaggtcaggaattcaaaagcagcctggccaatatggtgaaaccccgtctctactgaaaatacaaaaattagctgggcgtgatggcaggtgcctgtagtcccagctactcaggaggctgaggtgggagaatcgcatgaacccgggaggcagaggttgcagtgagctgagatcgcgccattgcactctagcctgggcagtggagcgagactccatctaaaaaaaaaagataataataataataaataaaacgcaagtggctgagcatggtagctgacacctgtaatcccaacactttgggaggccagcgcgggtagattgcttccactcaggagttcgagaccagcctgggcaacatagggagacccatctctacaaaaaaaaatgagcctgatgtggtggtgtgctcctgtgggcccagctacgcgggaggctgaggtgggaggatctcttgatcccaggaggtagaggttgcagtgagcccagatcgcgccactgcactccagcctgggtgacaaagcagactctgtctcgaaaaaacatacattgaaaaaggcagaagatttgaacagatacatcaaaaaaaagatagacaaatagcaaataagcacttgaacaggtgctcagcatcgttcgttgtcagaggaatgcacacgaaaaccgcagcgacagcgactagaacagccaggtgctgaggagggtgcggagcccctggaactcacccgtgctgctgagaacacaaatgctgcatccgctttggaaagcagcttgggagttgcatgtgaaattcagcatttaccacacggccagcagttctgctttggttattctactccagagtttccactgggggtcctttatgatttcgtctcttctatcatttttttggtatagatgggggtctcgctatttggattattgttgcaggcgtgtttggggtttttgagtagtggtagtgtctgaggtcagtcagggttgttctggccccagcagggctcttcgtagcttttcctgtgcaggtgaacaagcctgcggtttcacttgtttctcttaacttagaggagctgttgttcccaagagcagtcttgggctgaactttcaaataaaatgagtttcctcagggagcttcagagctctttccttatggacggcctctctccccaggctgatttctctgcaccacccttctgggcactgggtaagacagcagcctctgatcttcttggcctggctttcccagcatgggtgctctaccctactgttttaacctagaaagcctgaactgtatttaaaacttgtggtttttaaggccaggcacagtggctcatgcctgtaatcccagcaccttgggaagccaaggtgggtggatcacttatggtcaggagttcaagaccagcctgaccaacctggtgaaagcctgtctctactaaaaatataaaaataagccgggcgtggtggcacatgcctgtaataccagctacccaggaagctgaggcaggagaattgcttgaacccaggaggcggaggttgcagtgagccaagatggcaccactgcactccagcctgggcgacagcgagactccatataaaaaataaaaaaaaaaattgtggttttgaaaatgctttaattaggtgggagctgtggggagggtgatcagagacctgggtgtcctcagcctgctgtggcgggggtagtctcctctctgaggcttgggcaaggtggaggaagggagcccctggcttcttggccacgtgcaccaggatcttagtctcttcaacttggagtcggtgaggatgtgaaactctggtggtctgcccagcccatgagatccaggaaaccttatttgggaattgaggggagaagggtccccatcttcctgctcccctctccctgagtgtagtacccatcatggtgagctggggtgagagggaaagaggaggctgaggctcagatgccaccaggcttaatgttcgtaccaggtgtcagtagattttactccgtaagtgttcatctgttatatgcgtttaggacagttttgagactttaagtggtttaagctttgcttgtttcacaggaagtacttccatgaagttcctcacattgctgttccagaagtggaaatctctccattttcaaagcatagctttgccggatattgaatttttatgttttgtagagatggggtctcgctatgttgcccaggctggtctccaactcctgggctcaagggatcctcctgccttggcctcccaaagtgctgggattacaggcatgagtaactacacccggccaatatacaaagattgagtggcagggtcttttattttaatgcttttattttatttgttttggtttgtttttgtttctgtttttttggagatggagtctcgctctgtcacccaggctagagggcagtggcacgatctgtgctcactacaacttctacctcccgggttcaagcagttcttctgcctcagcctcccaagtagctgggattacaggcatgagccacgacactaaaatttttccatttttagtagaggcggggtttcaccatgctggccaggctggaactcctgacctcaaacgatccacacacctcagcctcccaaagtgttgggattacaggcatgagccaccacaccaggcattttaatccttttttttttttttttattgagacagagtctcactctgtcccccaggctggagtgcagtggggtgatctcggctcactgcaacctctgcctcctgggttcaagccattctcctgcctcagcctcccgagtagctgggacagcaggcgcccatcaccacgcccggctaattttgtttgtagtagagacggggtttcaccatattggccaggctggtcttgaactcctgacctcagataatccgcctgcttcggcctcccaaagtgctgggattacaggtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggatggtctagatcttttgaccttgtgatccaaccaccttggcctcccaaagtgctgagattacaggcgtgagccactgcgcctggccggctcctccttcttattccttctgtctttttttctcctactggagcacctcaattgactgatcttcatgtttgctgactccttcttctcctagtcaggtctgctcttaagcccctctggttaatttttttttttttttttttttttttttttgagacggagtctcactctgtagcccaggctggagtgcaatggcgcgatctcggctcactgcaacctctgcctcccgggttcaaacaattctcctgcctcagcctcctgagtagccgggattacaggcatgagccaccacacctggctaattttgtatttttagtagagacggggtttctccatgttggtcaggttggtctccaactcctgacctcaggtgatccgcctgccttggcctcccaaactgctgggattacaggcgtgagccaccgcgcccggcccctctggttgacttttaatctgagttattatactcttcagctccataattttgatttcgtgcttctttacaatttttatctctttattgatactctctgataagatgtcattctcatactttagttcttcagatgtggtttcctttagttgtttgaacatatttgaaatgattgacttaaaatctttgcctcgtaagtccagtgtccaatgttttggcttctttggggacagtttctattgattgcctttttttttttttcccgtgtatggggtatgggtcctagcttcttgtttctttgcatatctctatttttttttttaactagagttttttgtttgtttgtttgtttgtttgtttttgagtctgttacccaggctggagcgcagtagttcaatcacagctcactgcagccttcacctccggagctcaagggatcctccctcctcagcctcctgagtagctgggatgataggtgtgcgccaccacgcccacttaatttttgtatttcttctagagacggggttttgccatgttgcccaggccagtctccaactcctgagcttgagcaacccacccgcctcggcttcccaaagtgctgggaccgcaggcgtgaaccagcgcagccggctggaaaactggaactctcatcggttgagagtggcagctctggagctcggactcccccacctccccaggatttgtcattgctgctgtttgtcgtggttatctgtcaggtagcttttcggcactaattctgtaaaggttgcgttctttcttgtttatggccactgccgtctctgttcagttaactgagataggtggtgatggggcagaaatgttcttgaatgcctggggccagtgagtctcccgtcttttccgggggctgtgtgtgtgtgtgtgtgtgttggggacgccttcagcacttggccaggcagtggacaacccaactgtatgcctgacttcctgcttacacagagcctcaaggtcagccagaagtgagagctcggggctggctcaggtctttcctgagcacgggcacggctcacacgtgtacacggctgcgagatgtcctggaatatctcagagcttttcagagcccctagtggcacctccttctccccagctgccaggcactgcctcaggcagccacagcgttcaaaaatcacctgtaaaggtttcaacaggcacacctcggcaaacagcttttttattcaggagagcttcaagtcaaatcagagacagccttgggagtggactcttaggtcagatgctgacagtcctctgggaatggggccctggaggagctcaagccctggcccaccccgcagcggctgccaggacgctgttcccacggggactgcagctgttggtttttaaggctgcagatggagtgggaatagggcatgtaaaatgccacaaagcctggctgggcacagaggctcacgcctgtaatcccagcactgcaggaggccaaggtgggcggattgattgaggtcaggaattcgagaccagtctgggcaacatggtgaaaccccatctctcctaaaaatacagaaatgagccgggcgtggtggcgcctatagtcagctactcgggaggctgaggcaggagaatcgcttgaactcgggaggctgaggcacgagaatcgcttgaactgggaggctgaggcacgagaatcgcttgaactgggatgcagaggctgcagtgagccatgttggtgctggtgcactccagcctgagcaagaccttgtctcagaaaaaaaaaaagttcacaaagcccactgttcttactaagattcagctgtttttcttgaataaatgctccccgtgctactgtaattctttggttaactttcagagttctggaaagttggcttggcgctttycgccgtctctctcctgctgccttggggtcctttccgtgaccgtttccctccctgacacgtgtacatccctgtgtatttcacatctctctatgctggaaagaggttctccacttctagtgccacaccacgggggtctttctggctttttccctgtttgcatctgcagctcccttccctggcagggagaaacctgccccactgcccttcaccagtttcttcactgagtcagccrccccttcctatgcagacacccctcacccctctctggccctgcttcaggccccccttccccgccgtgtgggcttctcgctgtcccctaagccttcgatgtcccctctgagccaccgcggccacggccaacagggatgcctccctcaccagcgcctcctgatagctctgggcctgagctcggtagagaaatggaagaggaaggtatatgcagtgtttgactgtctctgtttcttgtctcacgtcacaaaacaagactgaatttggatttctgaacgcgactgtgttttcctcgggagtaatgaaattagggctccatttccttcgctgttcccaagggaaaggtcctgcttaaacaggtgctttgtgagtggaaacgtggccagagtgcggcgggtgctttgtgagkggaaatgtggccagagtgcggcggatgctttgtgagtggaaacgtggccttctctggaagccctggggaggggctttccgactgagaggaaggcctcgcatctgcccaccgcccagtcctgggcctcacagtgaggatgcaggtcacgctgcacagatgaggccmgtgtggcaggtggtcccaggaacgaactcgcctcccgccagccccmtgggcctcccatggccccagccccatcaggtggaacgtgcactgcctgcgtttcagaaggggcggcctggggaaggggcggcttgggcacgctgcccctcaccaccacgcgtgacccacccatgtgtctccctttcagagcgggaacagcttccacgtgttcgaccagggccagtttgccaaggaggtgctgcccaagtacttcaagcacaacaacatggccagcttcgtgcggcagctcaacatgtgtgagtgctgcctccaggcagcgcaggggtgcgggaggcagacctgcagatggcgggaccccagcaggaggaccctgtgatgaaggacggggcgtcctgtgctggccaagggcatggcgtgggaccctgcaagcctgggggccggggagcagccgcctcttccatgggggagggtccttgtgggtatgaacctggggtccccatggaagaaccgtgaagccggagctgtactccacgtgtgtcgggcgcagggagccctgtggggacacagggtctcccttagaccaaggccactcggccacccaggcatgggctctgagggggcagggcagggtctgaccatggccaagccccgcagcagcctcctggagcagtggccgctcttcaggggttctggtcccgccctgaggcagagctgcccccttccctgttatgtgcagatggcttccggaaagtggtccacatcgagcagggcggcctggtcaagccagagagagacgacacggagttccagcacccatgcttcctgcgtggccaggagcagctccttgagaacatcaagaggaaagtgaccagtgtgagtgccggccctgcacccttgmccggtctcacctgccacagctctccccgcccgcccctccctgagggctcccaccccagcctgccccttcctgagggacctggctgcagtggacgagcctgagcctgccaagctcctaggctgctccagtgactcctgtccctctcgggaatccaggtgtccaccctgaagagtgaagacataaagatccgccaggacagcgtcaccaagctgctgacggacgtgcagctgatgaaggggaagcaggagtgcatggactccaagctcctggccatgaagcagtaggtcccacaccagcattatgggccacagcgggtcctggcgcccaccaagaggccccgggtgctgtgggggcagggccctgaccggggccaggtgctcagctccaccctcccgctccacgcacatctaccctgggcctctgccccagccccgccgcccgtggctgctgcaacagctctggggccagccgttttccatgtgcagaagggggttgggagggtcccctgctctgcacatccccagcgccctctgggccattggcttctgcctggctccgagcttggcgggacccaccagcctacttttgaggacaagccttgcacagcagacccgtcccacccgcctcgggcctggggtcagacccacctcaggcccttcctggaaccgctgtcccacactcgcctgggcccatggagctagcccccagcccctcctcaccgggaccctgcggctctggggaaaccttagcaggagcctaacacacggtggcacctgagaaactgaggcaagcccacctcggaaggccagctcaggtctcacgtccactttggggctccaggcatgcgggaaccccaatgccagtacggcttcctcggctccgtgcagcaggcgctcttgacccccacgtcatggaggaggccttggcctcagactctcctgcatggggtctagcaggagccaccggctttgtgattcctggagtccggccacgtggacctggcctaccaagaagactcacaggcttgacagggcccagcctcccagagcagcaggagcgcggtcatggccctgctcacctggctggggacagctcttccccacccctgagccacctccaggcctggcgagggccctgagcacctacaggacatgggacagccagtgtcgcagcctgaagaaccgtcctcccttaacctggctgctcaggccttggaagggcggcccaagggtctgctcctggcctgtgtccaaggcagccctccaggtgtttgccaggatggatgccaggatccgggtgcacctggctcgcatggatccatccccaacaccctacgtgacaccaggtgtccccrgcagggaggggcagtgggaccagcaagccctggccctggcccccagtccctccacacacaagttctcatcctggggtgggccaggccagacatggtcacacttacccctgctcctgcatgggggacagggagggtctgtggggctccctcagccctggggctcatgggattgggccccactgacccagcctggtctgttgcagtgagaatgaggctctgtggcgggaggtggccagccttcggcagaagcatgcccagcaacagaaagtcgtcaacaaggtgggggcagggccagagggccggcgggggccccacaagggccggggtaactgtgtcctctctctccacagctcattcagttcctgatctcactggtgcagtcaaaccggatcctgggggtgaagagaaagatgtgaggttttggggatgcctgcatccaccacccggggcccagggctgtcccccttctctgtcagctgtgccccgggtaccccgaggtggggggtggtggctgacctgcacccttccccacagccccctgatgctgaacgacagtggctcagcacattccatgcccaagtatagccggcagttctccctggagcacgtccacggctcgggcccctactcggtgagtgccggagacagggcacccgcccaggcatgcaggcggcagtggggtgggttgcccctgccggcactgcatggacctcctgcctttgattgcaggccccctccccagcctacagcagctccagcctctacgcccctgatgctgtggccagctctggacccatcatctccgacatcaccgagctggctcctgccagccccatggcctcccccggcgggagcatagacgagaggtgggggccgcatcaccccagccatcctgtcccccaatgaggcgagcccctgtgggcccagggcagagttggggatgaggtggggctggccgagacgccagctcacctggcccccctcgtgtgcaggcccctatccagcagccccctggtgcgtgtcaaggaggagccccccagcccgcctcagagcccccgggtagaggaggcgagtcccgggcgcccatcttccgtggacaccctcttgtccccgaccgccctcattgactccatcctgcgggagagtgaacctgcccccgcctccgtcacagccctcacggacgccaggggccacacggacaccgagggccggcctccctcccccccgcccacctccacccctgaaaagtgcctcagcgtagcctgcctggacaagtgagtgccgcccacccctggccccacccacagcgcctggacgcacagccctgggcttcagccccgactgtcccagtggactgagcagggcagctggcgaggcaggaccctacccccaacctcggggctcggggctggggagggagacaggtgccagccagatcaccccacagtcccaaacgccacagaagccacgggcatgtccggacaggctgccgggccctgctctcagccacccctcctgctgccgccaccctcgccacaggccacgggccctggcaggtcgtgctgcccagacacatggcaggagatggtgagcagggccggcctccacacccccagcccctgcctgcaatgggggctcttgtttttgtatcttgcagtttggctcgcactccacagatgtctagggtcgcccgcctcttcccctgcccctcttcctctccgcatggccaagtccagccagggttagcgctgaccccactggggagggaggagggctctgccagcgctcgggccctcccacacagccgtggaccagacccagcctggccgggcatgagcgtygggcctgggcggcagcagccgagacccctctgtggcgggggctcagtgtcgtcatggctcccctggccacgggcctgtggtcattgcctgtgacarggatgacagggacaggcctccctgctctggcacggcctctggtgttggcaggatccagactgcggtgctgactgcacttcctgtcaggcagggtctccagggcacctctgggacccagcctggctgtccgtcccatagcccaggtgtgccctgtggcctrgggctttcttggtcacagccaccagaccgtgggtctcatccccacagcagcaccagggcagggactgagccacccacacactgagcagagccccacctgttttcccagtgcaacgggaaacctcaccaaccctgaacactgaaatccctgatccttgtgctggagctgaatacgccccttgtctcctgggtccactgccaccaaggcccccaggccctcatggcaaagggatgcccagcataggcccagccgcacccctgcagggcacagascctccactgccttccaggccgtcctcgaatgcgctgccccctccagcctgtgcaggcgtacacgggggtgcagcctggggggtacagtcaaggggagcccttctcccacaggagggcattggggtgtggggcctggggcactggttcaggtaccgccttatcccgggccaggaatgagctcagtgaccacttggatgctatggactccaacctggataacctgcagaccatgctgagcagccacggcttcagcgtggacaccagtgccctgctggacgtgagtggagccccgccgccccgcckccccgccccgcctccccgcgcctccccgcctccccgcctcgcctcgccgcctccccgcctccccgcgccgcctccccgcctccccgcgccgcctccccgcctccccgcgccgcctccccgcctccccgcttccccgccccgcccccgggtgctgttctgacttccctccctcctccgcagctgttcagcccctcggtgaccgtgcccgacatgagcctgcctgaccttgacagcagcctggccagtgtgcgtaggcgggcggggggtgagggggaacgagaccagcgggagtgctcacaataccgtctccaccccacagatccaagagctcctgtctccccaggagccccccaggcctcccgaggcagagaacagcagcccggattcaggtgagccaagtcccaccggccccacctctgcccccaaccccccaccgccttgacacccccacccccgcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacmcagtggatggacggacaagacaggcagagatctataaacagacaggctctatgctatggcctccatgtgtttcctctgtcccagggtggtgcggtgggtggtgctgcaatgaggaggggcccagggcacagaagggccrggctgcagtggcctcctgggggaagacggatgcttgcagctagctccgtgcctgcccgactccccaggaccagcatgtgcttgcagttctttattgagggaccaggggtgggcgcctcaccttggccctgggggtctctggttgtcacaggaccaccaggaacccccttcccaaggtgttcgcactcggacaggtgatgcggggcgggcacactgtctttctgccagagccagcaccctgtgtaggcacggggaacgggagcctgtcccgtagctttagggttctccactcagcctggtggaggaagggaagggggcytgcgctgggcagtggagcaggctttgctgctttatctggcagcaacagtttgttctcgagctccactggccaactgatagggagaggcacaggagcccatgtgggatggaggagtcggccccacacccatycccccaccaggagctcacccactactgccatcctcagcagggcccaaggagatgcctccatctcagggcccaccagcccccactggggtagagggaggataccaccaagggagcccaccctcccctcacaccaccagttcagcaggttgctgatgaggcccctggtgcagtcctgggaccctgtgcagggcctcctcaaacacctgccttgttgggccatagctgcaggtctggggacaccagggcctggtccagtcttggggtctttaatcaagcagtcaccccagcaaggtaaggcagcagcagggccctggggttacccctgacctcccgctaccatcaaggggggccccatctatccagcttggtggattgcagggcctgggaacaaggtgtcctgaaggctgcagggctgcgctgtctgcactgcccagcctggtgccagaagagcagagggcaaggcaggcctggggatcaggggtgccccaacctcgtggagggcagctgagagccaccagcccacctggctgcccaggttccaagtgaaggaaagaggctgccaaaccgagccctgccccaaggcgaatagccatggacatagccattgtgtaccgtagcccctcggctcaccagacccacaccagaaaggccctgtggactgcccatccctgggccatcctggctggagcccacttcccgcaaacccagggccgacctcttcccaagctgaagctgagcacggtgggtgcaagttgaccatcctgcactgagggccagagtgccgattcccgcacacccagcaggagtagcaccaggagaggacgcctgagctgagcttttctaggtaggggagtgtggggaatgggggcgtctgcctggccttgcactccccctaccggccatgcccgccctgctgcagtggagctgctgctccccggcaggtcctgggacagctgtccacacagctctggcactcgcccttgtgggtgtggccataccccccaccaggccccaggcccctggcaggctgaagaggtcactggacagcactttattgacaccctcggacccggggcagggtcagcaagactcccagctggcatcagactgtgtctggcctgctgtcgccatccctgaggggtgcaggacagagccccataggggcagagaggcctccctgggaccagaggaggatgctgtgcagccaggcccatccccagcactcgaggcctaggaggagaggtgggctctggcagcgggtgtgaggtggcagtgagaagccaggccctcaggtgcagctcaggcctctgccgctggggcctcatagttgagcacgtagtagtcgtggacgtacatgaggacggcwattggctgtccgatgatgagcgacagccacacagctgcgttgccatagttgccctggaaaaagcggcccacgaaccaggccagtgggatctagggagtgaggggccaagtcagtcggccatggtgaccacagggctgggggcttcagggtccctgggcatggggagggtcagccgaggggttcaggtgcggggtaactgggcgagtgaggaggccacgtgggggtcactcacctgagccatcatgcccgtgaacgcccagaggcggaacattcgcagagggacgctcaccaggtactgagatgggagggagagaggatgccagggagtggggtgtcagccgtccctgctgtgggcatacccctgcccagggatgaggcaagatgccccccagagcactgacctcgtggaagaaggccgaggccaggaacacccctgtcctggccatccacttgctgctgccccgtcgaagcatgggcttgtagaagtgtctgcagaggagggggcatggaaagcggttcaggttcacagccatgttccacatcacacacacacacaccccacctacctgatgcaccacttgtgcacagggatsttccagttctgccagaagtaggtgacagactcggagttcctgggggccaagagaccacagggggatcagagcacaccatggcccatcccagcccccagggacaccccagggacactcaccaccagtcccggtagaactcccggtctccaaactgcatgagctcagccacggcattcaggcaggagtggaagagccagtagaagaagatgagccagatgaggtgattggggacctggcagggaggtgggggtgggcaccaagttctagaaccttcccccacatgccactgtcccctcctgtcctgygcatgcgccacctgtccgcactcaccgccagcttcaggaggcgctcgatgatgcgtgagtagtccatgtcctgcagaaacaagcccttcagctagccatgctcctggtcactccccagccaccccagctgcaagagcacctgagccactcaccttgaagggcttcatggagttctggatggtggggaccatccactgcaaaggagggcaccacgtcagctcccagccatgcccagctacacccaaccctgccctaccccacttacctgctggatcagccccacctggagctgggtgaagaacagctgggggggaaacagagagcagccagctgaggccctggctagccagaaggccccctagcctccagtggctgcccccagcccccaacctcaccatctcaaggatccgtcgcagcagaaagcgcttccggatgcggggagagcggggaaagttgagctcgtagcacaaggtgggggcgaagaggaagtagtagagatctggaatgggaatggggggttggtaccagaacaggcccagcctgtcccccgcacctcaggcccacagaggtcctcaccgcggtaggtcagattgtccgggtagctcacggtgtgcggggcagcagcactgctggccttcttccctgcagaggctacgagcacagcagagtgggagggggctggtggggccctgctgctgcccagccccccagcaggcagccccagcccctggcagcccctcaccagccttggccctggccctgcggcaccatgagttgacgtcgcggtaggagaagagcttgaggaagaggatggtgtgcgccatcagcgccagcagggagcccactgcaggagaggtggactcaggcctccacagcgccacagccggaggccatgcccgtggctggcccgagacagatgggcagggtgggatgggggcgcacctggagtgatagactcaaccagtaagaccacagccgctgggaaacacagaatggtggccaggttggccacgtgcagcagcagtcccgcctgctccgtcagggcaccctggagtggggagcagagcactcaaccagggctcccattgcctgggagagggctgccaggcctggggagcagctcctcccaggagcgcacacagcagggtgagcacacacggaggtgaggggcactgcttaccaccgccaggcgcytctcaacctggaatgcagccacagcaaagacattggccgctgtggacagaagcaccaaggggcaggtttagggccacgtcagcctgatccccacccgaggccctcctcagagcccagctcaccaataaccaggcatggggcgggccagctatagggatccttcaggaacagagaaaccacctggatggggtccaccaggatgccatacctgggggtggagggatgggggtctgagtgggtggcaggtggggctgtggggcggggcctggacaggccatgggtggggcaggggtgggacctggcaaaggcactcacttgatgaggttctccagaaataaccgggcattgctcaagatctgcgagggatggacaggagggtgcagcccctttagtcctggccacagggtactcaccccagatcctcccaacacctctgggcacgtcccagcccgagctcagggcggcagcctcaggcttgcagacccagccctgtctggtctccatgccaagctctgagactcagcacccacctcagccaacaccagtgctgggtaaggggaagtccctccctgtccccatcacaccagacggtcccacatggagggaaccaaccggccagaccaaccaaccctgccagacgcctgggtcttcaggagcagaaagaccagctgctgatctgctcacatccctcctgctgagccgagccagtgagggacccaaggctcccacagccaaccacaccccagagacagccccagaatacaggcctgcccagggaggcctgcccacggctgagccccaaggaaccagtccctactggtggccaaggctgaagagggggagttgtctactctttctctgcaggagcagtgtccagctgtgtcgcaaggggggctgggcctggagtgcttcccagggcttgtgccccgcctgcctcttctgcttcctgccgccctctaagccttggacacttggctccaaagcaacttcccaggactgagcccccatggaataaggctcttgggacgagcctggagttgggtgcttggcctccctctgcaaggacaggaacctcctcctccatcttacaagcactaccaacacctccattaagctgggccccaatgccgcagacctggctgaccacccggagctcgggcctcatgcggtagtgaactggtgctggggaaaagggtcgctggcaagggaacactgagggtgtcttgcctgggtggtcagggaaggcttcatgagagagaagactgcttcagagacacaagggctactgccccgcctcccccggccgcagggctgacacacaggccttctgcatggacacgtggcccacactgtcactggcctctcccgagggctgacagcaggcagaagccaaagctgccaatggacggtacccacctccaggcccaggccacagaaggaatgcaacaagcagcccagagcgggatacatgcctggggtgggggcatgggggagccaaagcagggaaaaggcttcagggctgggccaaagggccaggcaggcccaaggggttggggagaatacacagtgctgcctgggctggacaaggcccaacctgggccaggaatgggctgcgtctcctgagtgctgggctggcgctgggcccactgtcctcctgcctggccagcttctcagccaccaggactcgtgggcctccacagctggccacccccagggaaccttctaggaccatgggcggtgggggatgtggatgtgcgtggagccccttccacgtgggtagccacaggagcagcacccaaggccagagatagacacgcctgggtgaaggtcaaaggcctcgagccacatcagccctgagttggggaggctgggcccagatagcccttgtccccgacctgccctgcaggtgcccctttgagccctagactccaactacttctggggtnnnnnnnnnnnnnnnnnnnnccaggaggactgcagagtggtggccaggcctgcagggctccatacccacagaggccatgtggcgtagcacaggaagctcttctcacatcccctgccagagaggccttgtgtccacagagcatgcagtccactctcccaccagcccagggcaagaccccctccaccctgccctccctggaggccctgcacccctcaggcccagctcacaacacacaggctccagccaggcactgttcggcctccccacgcccacaccacatcwgcaggrctctcctgggatccaatgggaagcagcaagtatgtggtgcatgggcacccaagtgaccacagcaggggcagccactgccactcccctccccaacagtccagtgctggcagccacatggaggtgcagcctgctccacacaccccagcccacaggggctccagcctggacaccctgggtgacagagcctgttctcaggcaaaggccagcctgggacagagccccacctggacctagacccgctcccgacaccatgtcccactcaccagcatcaccacacaccagttcaggatgccacggtagttgctgaagccactgtcagagctgaataaagaatcctgcaggcgatggcacctgacagagcacaacacaagcaccccctgagtgggcaccagcagggcagcgccacccccgcaggatccaggcccccaccccagtgtcctcgtctgccctcaggccccactccttatttacaaccaggaggagaagccaggcagagccacactgtggcctcaagacctacagtgggcaaagctctccggacccccagagcctgcacctccaggcagcgggacga

SEQ ID NO: 12337 - DNA, 34655 bp, Homo sapiens
tttatatatgtatattgactatttctgaagtacctaatttttctattgtttgtctatgttgatttgcagttgtcctttaagtagtctgaagttctctgttgaatataggaatgggaaatatcttctttaactttgcaggattttattttaagttgtgtgtctttgataagaagttcttaattttcaaattttaattttattattttaaggggttagcacctttttgcctttaagaatgctctgtctacgccaaagcctggaaatgttctaaaacttttaattctaaaagtatgattgttttacctttcacatacaagtttgcaatccatttggaatttatttttaagtatggtatgaggtatgggtcaaaattaatttgtcttctgtgcctatcaactgacctagaaccatttattgagtggtttctccattttctccattgtattcccatgtcttgtttgtcattaatcaggtgatagtctatgtgtgagtctgtctctgggctctattctgttcaattggtcaatttgtctctctttgcgttaataacatagcatctaattgtcttaatctctcctggctgctatgacagaatatgataaactaggtagcttttaaacaaaacaaacttatttctcacaattctgcaggctgagaagtccaagttcaaggagccaataggttcaatgtctgatgagggctgctttttggtttatagatagtaatgtattgctgtgtcctcacacagagtaagaggaaggcagctctctgaggcctcttctataaaagcactaagttcatttataaaagcctgcccccgtgaccaaattaccacctagagggcccacatccttaaaccatcacattggtgattaggttgtaacatatgaatttagggcagtgttggtatatagaaatgcaactgatttttgtgcattaaatttatttcccgagactttactgaatccatttatcaggtctaggagtcttttggaggaatttttagggctttctaggtataagatcatgttgtcagcaaacagagataatttgactccctcttttccaatttggatgccttttatttctttctcctgcctgattgctctggctaggtcttccagtactatgttaataggagtggtgagattaggcatccttgacttgttccagttcttagggggaacgcttccaacctttgtccattcagtatggtgttgactgtgggtttgtcagagatggctccggtatgtccctttgaggtctagtttgttgagggtttttaaaaaaaatcataatgagatgttgtattttatcaagtgctttttctgtgtccacacaaaaaattgcctaggaatacatttaactgaggaagtgaaagatctctacaataggaattatgacacactgaggaaagaaattgtagatgacacaaacaaatggaaaaacatctaatactcatgaataggaaaaataaatatcattaaaatgaccatacttcccaaatcagtttacagattcaattactgtagtcatttttcacagaattagaaaaaacaattctaaaattcatatggaaccaaaaatgaacccaaaagtcaaaacagtctgagcaaaaacggacaaagccagaggcattacattacctgactttatactatgtggctgtagtaaccaaaacagcatggtactggtacaaaaatagatacatagttcaatgggacagaatagagaactcagaaataaagccccatacctacaacaaactgatattttacaaaactgacaaaaataaacaatgaggaagggatacgctattcagtaaatggtactgggaaaactgacttgccatgcagaagaatgaaactggaccccatatatcaccatatacaaaaattaactaaaggtggatgaaaacattaagtgtaaagcctgagagtataaaaatcatagaagaaaacgtaggaaaaaattcttctggacattggcctaatcaaataatttatgactaagacctaaaaagcaaatgcaacaaaaacaaaaatagagaaatgggactcaattaaactaaagagcttttgcacagaaaaagaagcaacagagttaacagacaacctacgaaatgagagaaaatatttgcaaactatgcatctgacaaagaactaatgtccagaatctataaggaatacaaacaaatcaacagaaaaataacccctttaaaaagtgggcaaaggacatgaacagacattactcaaaagaagacagaaaagaggccaacaaacatatgaaaaatgttcaacatcactaattgtcagggaaatgcaaattaaaaccacagtgagatatcatctcacaccagacagaatggctattactaaaaagtaaagaaataacagatgttggtgaggatgtgcagaaaagagaatgccatacacttctggtgggaatgtaaattagtacaagtcctatggaaaacagtatggagatttctcaaagaactaaaaatagaactactctttgacccagcaatcccactattggtatctacttaagggaaaggaaatcactttaccaaaaagacacctacacttttatgtttatcgcagcatcatttacaatctcaaagtcgtggaatcaatctaagtgttcatcagtagttgactggataaaggaaatgtggcacatatttcatacgatggaatactatgcataaattcatgttctttgcagcaacatgggtggagctggaggccgtttttctacgtgaaataactcggaatcaaaaaatcaaatatcagatgttctcacttacagtgggagctaaacaatgggtacacatggatataaatatggaaatagtagatgttgaggactccaaaagagaggtggaagagggcaaagccttgaaaaactatctattggatactatgttcgctatttgagtaatgctttcactagaagcccaaacttcagcgttacataatatacctatgcaacaaacctgcaccagtaaccctgaatctaatgtttaaaaaaatgaatttagaggggcgatgcaagcatccagactattgcacatgtttatgaaggttttataatattacgtcttctagtttcattttcttttgctccagttatcaatttattccctcagctccaaactcatgcattgcccagtctctgaaaatggaaacagtccctttaaatgtttttcctttgtcagccggcataaacttaacttttgtcagtagagggcgctgaagagacattgcaagagaaagttttgctctctggttctgcagattttgaagcacgtgttacttcccagggccagcttctgcagcaggcacagctattccagtgccaagctcctgcagtgagtccatggtggccagcagagcctagcagctttcagctttcctcagtatgcccctaaggtggttttgtagcaatgtgactcgggtgagacatttccctcccaccagctttccccagtagcatagagtgtgaatttccagcagttgttaccagtgcagcgccataagcacttttctggcatttcgcgagccacagtcacatccatggtctggctatcagcctgccaggacctcttcattgtctaatatttaaaataattcactagcaaagtcatgggggttggggattttcgttgtaagaaagttgtcctttaattttttttgcaataatttcacacttacagaaaagttgaaatatagtacagaaagttttcatatacccttgattcaactttccttaaaattaacatttctcataaccagagtaaaattatcaacaccaagaaattaacattggtataatattattaactaaatcacagatctcattcaaatttcattagtttttctattagtgtcctttgtctgtcccaagatccatttaagatctcacaatgtatttagttgtttctttagtctcctccagtctgtgacagttccttagtctttccttgtctttcaggatcttgacacttgaagaattctgggaagttattttataatatgtccttcagtttgagtctgtctgatgttttctcatgattagatgaaagttatgcaaaaataccacacaagcgatgcactcttctctgtgaatgataactggggtacctggcatcaatatgcccatcctggcaatgttaactttgatcgtttatttgaggtggtatctgtaggatttatctactttaaagttactgtttttttcttttgaaattaataaatataccaggggagagtctttgaggctatataaatattctatttctctccaaatttatactcattaattttagcatacattgctggatgatgcctataaacatttattactatagagtttacctaatactgattttctacttcactaatttttcctacatttattaattggaatttagaattgtgaattctcactcatttatttacttactcagttatttatttatatcagtatagatatttactttattctatggtgataatccaatactcttattgtttttttctctcaaattgttcggcttttggtcatttctctgccttctgatacgccccatttgtttttgagcatcttcttactttctggcatgagaagatattctacgttcattttgtagttttgtgatcccagacctgtagtcaaacatttctccaagtagccttgtttccttttattggagactgatatgacacgatagctggctaacaccttgagtgacagaccctgagcagagaatccagctgagtcatgctaatctcctaatccatggaaactgtgcaataatatatttgaattgttttaaagcctgtggatagtgataacttgttacaaagtaagataaaactgatacaccctttttttctaagacattcaattttgatatgccattcctctgcttttagagccttaataacttctcattgtcttaatgataaaatccaacttaattaaaaacttgcaaggccctcttgcaccctcgtcacctccctagccccaccgcttatgaatccaatgctgtcactccattccagacagaccgaaatacttggatggccctgatgacaccgtgttctcctgacttccttgctttcatttcatgtctcagtttaaactttgatttgctagcaagccttttacaagtgccccaagactggatgaggctactgttctcctggctttcagagaatcttgtttagtccttagcccagtaattcagttgtctgtgtctgactgtcttcttgagtatacagcactctctttgagggcatttttttcattttaatttttatgttttaaatcttacccaccgttatccttccccagggtctatgccagtgtggactgagtgaaggagtaaatgagcaaatgaacagtgtaatgccttatgaattcagcaaaagccgaatcatcatctgtttgttccagtgcagacaggcttggctttgaacagcatccagctccacgattctatcagctaaattttttttttgtactttaagaaatagggatagtcatagtgtttactgtacgcagttgttctgaggagaaattaggaaaaggtatgcagttacacaatgccacgtacaactctaaattccaattaataaatgtaggacaaacgagggaagtagaaaaatgcacaagaaatgttaactattagctttactgcagtttcttcttggtagttatcatttcatgcctgcctacatacatacaaggggaccagtgatagtttttatgtgctcagcaagattttttttttctttctttctcttcctagtgaggaaaaagaaagttagtggcagttggcatgctgccagctgagtttttttgctgctttgagtttcaggtttctttctttctcttcctagtgaggaaaaagaaagttagtggcagttggcatgctgccagctgagtttttttgctgctttgagtctcagttttctttctttcctagagtctctgaagccacagatctsttaagaactttctgtctccaaaccgtggctgctcgataaatcagacagaacagttaatcctcaatttaagcctgatctaacccctagaaacaggtaagcgactttttaattgaaacatagtatttgtacgtatttatggggttatgtgtgatattttgatacaagcatacaatgtaatgaccaaatcaggatcattgggaaatccatcacctcaaccatttatcatttctttgtatttggaacattccaaattttctcttctagctatttcaaaatagacaataaattattgttaactatagttaamctgttgtgctatgaacacaagaacttattccttctatgtagctgtatttttgtaaccattaaccaacctcttttcatcatctccttcctctgactttcccaacctctggtaaccaccatgctactctctgcctccatgaaatcaacttttattttaagcttccacgtgtgagtgagaacatcacaggtaagtgacttcttgccatccaattttgctagctgtgtgtgaagaaaaaagcttgctttctttttttctaaaaaggagtttcagagtggaattgctgctaatactttgctctttcatttgtcttttattttaatgaaaatttcacacacagataactagagagtataaatgaaccatactgtaatctgatatagttttatccaattttaaaaatgatttgctttttaaattagaatagttttcttttacttaaatacaaaagcattacaaataaagttgaagaaatctatgactctctactatatattgttttcttatgagatggagtctcactctattgcccaggctggagagcagtgtctcgatgtcggctcactgcaacctcagcctcctgggttcaagggattcttgtgcctcagcctcccaagtacctgggattacaggcgtgcaccagcatgcctggctaatttttgtatttttagtagagacgaggtttcaccatgttggccaggctggtcttgaactcctgaccgcaagtgatctgccagcctcagcctcccaaagtgctgggattacaggtgtgagccaccacacctagcctctcctatattctttacctttctttttatttccagaaggcaacattatctagactttggtataaattattgtcataattgtttttatggttttctgtatgtgtgtatatatttatctaaatatgatctctagtataatttgttaaaattacttctgtttttatataccagcaaaaatggttttacacaataacttaaaaaattaatatacttatattaattttatttttattgatacataatacattacatatttatggggtacaggtgatatttggtgatgcacttagaatgtgtaatgatcaagtcagggtatttgtggtttccatcgctttgagtatttattatttccatgtgctgggaacaacccaagtcttctagctactttgaaatagacaatacattgcttttggccatagtcactctactttgttgttgactaatagaacttctaccttctatttaactgtatatttgtactcattaacctacatctcttcatctctccctcctagacacccacccacccttcctagcctccagtatttatcattatactatccacatttataagatcaacatttttagctgatctaaaatgatgagtgagaacgtgtgatatttcctgtgcctaggttatttcacttaatattctccagttccgtccatgttgctgcaaatgacatgattttactgtttttatagctaaatagtattccattgtgtaatataccacattttctttatccatccacttatggacagttaggttgattccatatcttttctattgttaatagaaattcacaatagaaaggttgctgtgataaacctgagagacaccagaaggaattttaacatattgaccatactaaacaatatttaacatattgattgtattcagctatcttttacaatgtggtgtacagactctaaaatagctcctaattgtccctgtcctattttttttttaatactcatgtccgtgtataatccccccttgtctgtggatggaaactgtgacttaacggtaacaaatagaatttggcaaatgtgatatgttaagattataatgtctgctatgctaggagattctctcccttgctggtttcaatgaagtaagtggtcatgttggggaggcccatttggcaaagaactaagggtgacttcaggccaatgactaactgagaactgaggataacctctgatcattagctagcaagaaatggagttctcatatctacaaccataaggaactgaattctgctaacaaccataggagcttggaagcatgtccttctcccgttaaacattcagaagagtctgcagctgtggctcgcactttgataactgcctcatgaaaaattctgaagcagagaaccaaactggatttctgacccagagaaactgtgagactataaatgtgtgttgttttaagtctctaaacgtatgagaaattgctatgcagcaatagataaatagcacactaaattagttaatactattactttatcggtagatgctttaaggttttccacatataagataatatcatctgtgagcagagatgattatacttcctttataattcaggtaccttttcctttttcactttcttttttattttggcctacttgttctggctaggacattcagtattatgttgaatagaagtggtaaaagtggataatcttgtcttgtactttaycttagaggaaaagctgtcagtttttcactgctgaatatgatgttaactatgaactttttatacatgtatttactatgttgaggtaatttccttctactcctggtttaagtgtttttgtgtttttttkttttttktttttttaaatcatggaaggacttgggttttatcaaatgtcttttctgtatctattgagatgaccaatttgtattagtcagcgttcttcagagaaactgaaccaacataaaaaaaataaawttaaaaaaaaactaaggaaatttgttatgggaggtggctcatgtggtgttggagggcgagaagtctcactatctgccacctgccagatgtaaagccaggaaagctggtggtgtaattcagtctgaatccaaatgcctgagaactggtggagccagtggtggaactcccagtctgaawtcaaagtcctgggaactgtgggaactgagagagctggaggtgtaagtcccagaatccgaatgtttgagaaccaggagctcagatatctgagagcagaagaagatggatactccagctcaagaatagagaatttgctcttcctctgcctttttgctctatttgggccctcaatggattggatgatgtcagctcatgttggatcttttttatgcagtttactaattcaaatgctaatctaaaatgtgtttgtatattcatttgcctcaacatttcttttcttttctttttttcctttcttttctttttttgagatggagtgtctctctgtcacccaggctggagtgcagtggtgcaatctctgcctcccaggttcaagcgattctcctacttcagccttctgagtagctgggactacaggtgcacaccaccacacccaatttttgtatttttgtatttttgttagagacggggcttttccgtattggccaggctggtctcagactcatgacctcaagtgttccgccgaactcggcctcccaaagtactgggtttacaggtgtgagtcaccacgcctggcctcaagatatttttaaaattcccttttgatttcattttgatccactgcttattccagagggtgtagtttaattctcacatccttgttaattttctagattttctgatattgatttctagtttcattacatggttatgaggaaagacttgatatggtttcaatcttcttagatttgttaagacttgttttttgacctaacatgtaatctatcctggagaacgctcctataatacacttgagaagaatgtgtattttgttgttgctgggtggaatgccctgtatatgcctattaggtccattgggactatagtgttcaagttttctgttttcctattgatcttctgtttggatattttataatggataaagtattgaaagtgggctatcaaaatctccttctcttattgtgttgctgtttctrccttcaattctttcagtgtttgcttcatttatttaggtgctctgatgttggatgaacatatatttataacggttatatttttctggagaattgacccttttcttattatatgatgtccttcatagcctgttatgacaggttttgatttaatgtctattttgtgtgggataaggacacacaccccttgcgggttatcttgcggttcttgcagttaccatttgcaaaggtacccttattatcacttgattttcatyctatgtgtgttcttaagtctaagtgagttcttggggacagcatgctgttgtattttgtcatgacatgctttgactcagtattatccttctttctttccttccttttttttttttggtttgctaatattttgctgaggatcattccatctatatttataaaagagattggcctgtaatttttcttgcttataacgccattaacaggttttggtatctaagttattctctggaagaacatgtgtaagattgtgtattatttattcttcaaaatttggtagaattcagcagctagactctgatccttgagttttcttggggaagtcttaaattaattatgaatttagtttttaaaaatagctatgagatagtcaaattttgtatttacttttatgtcagctttggtaagttgtatttttctagaaatttgtccacttattctcaaatttaattttacaaagttgtttatcttcagaccattttatcgtttatcatttattgcatctggactgatgttttctcttacgtttttgattttaggacattctttcccttttttccctttatcagtgtcagcagtgttttacaaattttgttaatccttttgaaaactgggttttggttttgttaatcttctctattgtatacttgatttgtccattaatatttctgtccattatttcttgcttttatttttattgttgatttctttctacttactttgagtttaattggtattttttctgactttttgaagtgaaagtctatataattaattttcagcctttctccatttctaatacatatgtttaaacttatatgatttttgtaacattttatcttcattgtataagttttaacaagtatcttttgtcatttaattaaatttcattatgatttcttatgtgaataatggattatttcaaattatattttttattttccaatgtatgaggggatctactagttatcttcttgttaaaaaaattctggcatatactgtctgttcaatattatagtactttgaaaatttttgagacttgcttgctttttaaggtttgtagaatatctcttctatattctttttcttttattcttgttttctggttcatatatcttaactaattttactgtatcctttaatcccttttgcccttttctctttttattctttttttgtctcaatacttcagttggtaaattttcttctaattctttatgcctaccttgcagttaaatgtattcatttaattattaatttcagatatatatttttacatagcaaatctctttttgacttcttattgtattcattttactgtaaatcattcaatcttaccttttagctgtttgaacatattaaacatagtaatttaaaaatctctatgggtaactccagtataagtatgtgtttgtttctagtgtgtgctttttcctcttggttttctatcatgttgtttcatttacctccaaacatgaatgtgtttatgatgaatgagagtcactgaatatttaaaaaatcatagagatattttgaagctggaagaatgttcttttcatccagacaagatttattttgtttctgctatgcagctatggacactagcaattctcatttaccttaattcaatcmaggactgagaatactgaagtatgaaattaactctgtctgcttccagttcatacttcttccctgtacctcttttcttaaattttttttaaaattttatttcaacagcatttggagtataagtggtttttttttacrtggatgaattatatagtggtgaattctgagattttagtgcatccatcactcaagtagtgtacattgtatctaatatgtagttttttttaatccctagctcctyttccatcctctcctttctgagtctctaaagtccatcatatcagtctgtatgcctttgtgtactcatagcttagctcccacttataagtgagagcatatggtttttggttttctctgtagctctttagaatcccaaactgtagcctaagggaaaggtttccaaggtgctctccttattgcactccaaagtatgatttttatctccctaactctatgaatctagcaaacactttgcttaacttttcagcatctcaagtgccttttctgaatttgacagatacacgtcagaaatgtgctcccaaatgcctagcttatctctctttattaacttctccaaatctttgccaatagctatatgtcttaactgccttgtttgctctttagagctttgtaacacatgcatttttatagtttattctgcttttcaagtttttttcattgaaataattcttgtaatgaccaatagtctagtatgctgctgtaagacttctatagctgttaactcctttcatatttcaatttctttatgtgctkttttttgcaagaattcctaggctccattttctaattcatacgttggcaaatgatgaatgtgatatgacaatgatgacctctgttccagccatatacttttttaaagaaaattttattggaacacagtcatgctctcttgtttacatattatctatgacttcttttgtattacagtggcaaagttgagtaattgtggaagagaccatatggcctacaaaggctaaaatatttactatcttgttcattaagaaaaaatttgctgactcttattgagatttatttttcctttattcaactttctgaaktttgtcaattgatttaaaaattttaatgacttttcctttctaaattatatatttttatatctaacattattgtgccatttctatatttttgctatattttttgccttaaccaaacartgtgttttaattgagtcagtgaataaagaactcactgaaagtagaagtggaaacctaagctataagctactatattatataagcttctcaacctataattgtttttccattagatatagaacaatggaagtgacaacaagattgacatggaatgatgaaaatcatctgcgcaagctgcttggaaatgtttctttgagtcttctctataagtctagtgttcatggaggtagcattgaagatatggttgaaagatgcagccgtcagggatgtactataacaatggcttacattgattacaatatgattgtagcctttatgcttggaaattatattaatttacrtgaaagttctacagagccaaatgattccctatggttttcacttcaaaagaaaaatgacaccactgaaatagaaactttactcttaaatacarcaccaaaaattattgatgagcaactggtgtgtcgtttatcgaaaacggatattttcattatatgtcgagataataaaatttatctagataaaatgataacaagaaacttgaaactaaggttttatggccacygtcagtatttggaatgtgaagtttttcgagttgaaggtwtgtaaaattagayaatcctacatctcacattatgattctaatccttgtgttcggtaggtaataattgatctacaagagcaaggaaagtgaaaggaacagttagattcatrccatactctttgataaattctgaaatgaaacgtggggaacataaggattatgaggtttttatccagaacgtataggctgctttgagcaaagcaagttgagaaatatatgtgcagagatagagatgacaaaggagatggggatgtggagagagagagatcttatcatcagagctgctctgttttgacatatgacccaaagatcagacccttatatgacccttagaacttctaggtgtaattatgtgagagcttccagagcaagttaatgtgcagagaggataatttttcctcctcttcctctcatgttgccaactctgactcctaactgagcagctcagccctgggttatgcaagaaaactccatgtcttatttcaaaagtagacttggccacatttaaccaracaagttttaaaaatgtattatgctatgtttatttcctataggaattaaggataacctagacgacataaagaggataattaaagccagagagtaagttggattcttgggctatctattaatcattttatttagaccaattgtataaagaatgytgacaaatatgtggtaaagataaaaatcatgccactggaatgattaaaaaagagttataatgttattgacataaaataacaaaagcactactaactatgaaactttaaatatccacctgatgacattgaccaatttgacttcatttccactttagaccaaaattttccaggtarggtctggataaccattttaggtaatttctctgaatcctttccttgagaaacagcttttgagaatcctcagtaaatgtcaaaaacaaactttctttttaaatttatagatagctacattgcatatattttattttgatttctccttaatgtacttttagtgaaaataataatttatgttcaatgtcactgatatttcttattacattcatgtgatctaagactaatagttgaaaaatggtttggttgcaggttaatatttaactttagtcagatataaaataatgcattttctttaagcacaaaatgtataactttagatatttcaaatcatattatagaagatctcattatcaaaataataattaagtattgaaaaaatacccttctcagggaagagaaagaagctctaggtgacttgmgatgttctttatggtattctttattggctgttctgatgctgtatttaaccactatattttaacaggcacagaaataggcttctagcagacatcagagacyataggccctatgcagacttggtttcagaaattcgtattcttttggtgggtccagttgggtctggaaagtccagttttttcaattcartcaagtctatttttcatggccatgtgactggccaagccgtagtggggtctgataycaccagcataaccgagcgggtaagttatttccctgaggattttattttatagattacaattattatattgcttatgtctttgcctttttctcttagggcaatcctaatatacaattaaatgctaaatcaaatggaaaataggagtaaaattttgatcagaaccacctccattgtgctatattatacagagaagctttcaaattttatggatggaagaagcagttatataaagaatactttttagtatttgtataaaaaacaacaaaaaattaaaaaccctatgaaaatctttgaccattatatatgatgttcattttactcatgtactacatgattttacctggtttaaaatgtttttctttttttgtaataaaataatgagaattatgtaaggtaattttttttaattacatgagaccattctctaagacatggtcatgaaaagcaaaatagcaattcactttggtgggtcaactttgaaggagaacttgaagtgtaaatcttacaaaaactatcttatttacaaaaagatatacataaggaaataaatagtaatatagatttcttaattgttgctctaaagaactacaaattatgatgcagcacttgtctagaaaattctttcttgtttatgcttttcaatgttatcatgcacatgcaatcaaacaaaaaataataaagggaaagaatagaaaattttagaatcaggcttttttaatgattaccacaaattaatattgtcacttgttagggaatatgctgtgtattatcaatgcaaaatttagcataagacagcataataagacagtaatggttcattttagcttttgtgtcacattcaataactggaagaattttctaggactttcaagaatcacatcttatttgttgatgttggccagatactgtgctcttgagtggctttattttaatatattagtgtagtctcagaagccrtggcaaggtacggcagcacaaattaaattaattaggcattgattgaaatgtttctgtttgctaaatatttattcagacatagagacctaaatacaaataatgcttggtcccattacccagatatctcagagaccaatgcagataataaatctgtatcattcattgtgatatatgctataatagagatactactcaggacaaaatttctctttcttccttttaagttttaaattccaaaggtcttattttaagagaagatgtagatactgaactccaatgaaatgcaaatgttatttaaattgaagaaatatagggcagacttttatgagggaaattgaatattttattgcttaaaagactctttcctttgaataattgaagttgtaaagaaagcaaattaatgggtaaggaaactaggaagatgcatattggtgttcctgaaattttacaatgtactttaactctagtgcttagtataatttctttcatgttgaggcactggtaagtcctattctcctagataaaaatcttcagtgggattacgcctctgcgtttcatggcccaatgagagcttttgattttattacagattacaataagtcatagactgttctctcccttctggtttgagtgatactacacccttgccagcaccacagatggaaaaattgtaattaaagtgtctctgagaaatccttttctttgcaatcttcccaaatcgtccatatttttttgtgtatgttgaatgtatatctgaccatcaaataaaatactttcagaattgttctagaaaatatccttgcaataagattgaatgtgtttatctaggaaagaaagttctgttgtgcttctcaaagtgaaatttgtggaccccttgggttcccggagacattttaagggtatctctgtgttcaaaactatttttagaattattctaagttttttttgtcttttctagtgtattgacacttgaattaattacacaacatagttttacctgttggcacattagtatgaatcaaacggtggcaccaaacactactagtagtcactgtatttctcccaattactgcacttacaggaaaaaaaatgccagttttactccttgatgaatagtaacagttattggttttatttaaactccactttggaatacacatcattttgatattcagtgtgataaaatgggaagtgctcataaagtacttctaatgcatattgaaaattggcagttgtctttagaaaaagcactggagcagctgagttgttaactgaactttttttaaatgtgacatcatttttactggacagcacagacttactcattcatacttggatatttggcaggtatcttaatgcaaatgctcaagtgaccctactaataaagaacaaaaacaaaaactgacagtgtttgttgccaataacaaaatttgagcttttgagaaaaatcaaactttgagaaacctgtattcactattctgagcctgacagcttttcaacacttaaagacttatccaatgaaattaatggtggtattaacaaatgtgatgttttaatattgcatgatgaaatgtgtcaacattaggaagatctggataacccagtggacgaatgttttaagatgatcaataaattaggttaaaaaatcatgcatgagtaaaggatatattcaaagtataagacaaaccaatggatttaatgtggcagcatataaaaatgtcgcagattccacattgcaactaacctttaagaagttattacttgttgagctttgctatattacattgaggaatattcacaattacctgaaagctatacagtgaaatattacctccttttcatattatacatacatgtgagaggccatattttcttcacatacttcaattgaaacaacatatcaagagattgaattggagccacatatgagattacagttatattctttaatccagacattaaagagaattttactaataaaccaatgatttctgttttctgtaaatttttaaaaaaatgctttttaagtaaaaaatgttatttgatgaacatgtgacaggtttataattgaatttttaatgattaaaacaacacttaagagcaggaggggcagagcaagatggtcacataggtctctccagcaatcattcctccactgaaacatcaatttgaataattattagcacacaaaatatcacctcagtaaaccaggtgaaagattactgtacctagttctagcacaataataacaaaagatacattgaagagggtaggaaagatagttttacgttatctgcatcacccccctcaaccccagggagcatagtgtggagagaactgtcatctgctttggggaaaagagggaagtgagcacaggactttgcctggactccaatatcaggcctactgcagtaaaatccagcactggatagaacctcatggccccagactttaggctgttatttgacggctgagcctctagccccatgctggtgccaagtgagaccatgtggccctaggcttcaagcttgcatggtggactcagtccctggaccacaccatggatgggttattagtggcccaacctctgaacagcacttagtgacacggatgccgcagtggccctgagctttacgcatgcctcagtgctgcaccagtcacagtggtcccaggctttgggactatgcaaggcagcctgcccagaatttttggataggctgattgttgaaggacttttccagacaaaggcaatctgcaaagattggaataagtacctacttccagagatgtttatacattgacacattgtcacaagagtcaaaagcaatcagggtaacatgacgtcagtaaagagagaaaataacgtgccagtggccaatcctaaagaaatggagatgtatgaaccacccgaagaattcaaaataattattttaaggaagcacagcaaacttcaagaaaatacagagaaacaatttaacaaaatgagaaaaatgatgagtgatcagaataagaaatttaatagaaaggttgtaataattataaaaaagaaacaaatttcagagatgaaaaatacaatgggtgaaatgagaaatgaaatagagagcatcaacagcagaattgatcaagtagaagagtctgtgaacttaaaggtaggttatttgaaaatatagatagagaataaaaaaacagaatgaagaggaaggaagaaagcttatgggatttatgggacatcatcaaaaggacaaatattcaagttacaagggggaaaggagacaagaaattaaaagtaatagaaatcttaagtaaataaatagtagcaaaaaacttttaaaacctggaggatgatgtaaatatccaggtaaaactgagagaaaagtccccagtcagatttaatccaaagaagattaacccaagatatattaaaatcaaactgtaaaatatcaaagacaaagagaggattctgaaaactggaagataaaaaagcaaataacatattagaaagttttaatatgactagcagcagacttagcagaaactctgcaggccaagagagtaggatgaaatattcaaagtgctaaaagaaaaaacaaagaaacaaacaaacccatccaattgagaatattatacccagtaaagctgtgcttcagaaataaaggagggataaagattttcctggatgaacaaaagctgagggagttcattacaattatacctgtcttacaagaatgttaaagcgagtttttcaagctgaaagaaaaggatgctaataagtaatataaaaatatctgaaagtataaaactcactggtaaaactacagtaaaattcagaatactcatactataatgatggtgatgtttaaaagacaaaactgctaaaataataatagctataagattttgttaaaggacatgcaatatggaaagatgtaaattgtggtatcaaaggtgcaaactgtggggaggagtggagtaaaaatgtggagtgttttttttttctctgtaagtggagctgttattaacttaaaataaccagttacaaatatgtttattttttgtaagcatcatggttaagcacaaaacaaatactgatagtagatacacaaaatataaaaagcatggagtcaaaacataccattatatatatatatrtgtgtgtgtgtgtgtgtgtgtatgtgtatatatatatatatacacacacgttttacatgataaattacatagaawtttcttttttaattaaaaaggaatatttacatttttttcagttgtaatttccactattttaaatatccatagatataacccacataaacaacagatctttgggattctcaataacttttaagagtctaaaggggtcctgagaccaractgtttgaggaccatggtrttcaaatattaaccaatctcttttcttcttattgtcatgtcttgaatgctgggtgatgaatgaacctttacacttaatgtatttttttaacagtataggatatattctgttaaagatggaaaaaatggaaaatctctgccatttatgttgtgtgacactatggggctagatggggcagaaggagcaggactgtgcatggatgacattccccacatyttaaaaggttgtatgccagacagatatcaggtaagatttcttcaatatccaaaacatttcaaatcattttcttcagtatttttcattgaatttttaaccacataaggcaatttcaactcccataatgtggtttcaacatcaatcaacactattctactttgaatgaataagaattcatatgaaaaagtagagtgactattgttcttttctgtaacattgagaaataaagccaaaaggcaggattctactcatttgcattctagtaaaagatcaaggagatagtgtgtttttatcactctttacaataatgtaaactaatgatagtcacttaatcccttgcactttttgggttacatagacaaaatattggaacaagtaactattttgtgttgaaatgtcattttatactgtaaatgcttagatttcaccactaaatacctagattcaaaatttggctttgctactaacagatgtttacccgtaagttgcacacttctctctctcggtcttttttttttttttttcaggtgtgaaatattgctattaatagtgtctatctcatagggtggctaagatgattaaatgagatgatatagtttaagttctcaaaaaagccaacaatgattgttacctttcttttaggtgttgggtatcagcctcaatttctaaagaagaatctcttttgcctcccaattgtgctgaattggaaaccttacctatgtatttatttattcattcaaaaaccatctattataaaccatatttgtgccaaactctaagccagttactgaaaacacataagtcaataacagcacaatccttatcctccaggagttcataatccagtcagggaaaaggagacacacagataaagagaggagggatagagcgaagacattggagaaatcaggagcataccaacaccctaatttttcacagcagggagccagtcaattcagtccaacactgaaatacatagcttaataactacatgtttccaaaccattgtttcataatctatttccttaatcttagaaagattactgtcttgtggtaagaagacattaacttcaaatttggtatttcttttatttcactttagtttatttttcttctataaaatcaaaataaattacagtcttttaatttaaatagcattttcaacatatttttctttcttttattctctctatccagttcatttaagcatgcaaaatgcttagggaggagtcttaaattgtatttaacaaacgttaatggtgtttatttctggatactaggatttgaaattagcttttcaaaaatattatttaaactttcctgcaatacttacaatggataattatcatttttaccaaagcaataaagtgttttttttcctataagagagatataatggcattatgctcacagtggaaaggaagtaaagaggaggtgctactgtttggggaaagagtagctgaggagaaagagggagatcagtagttacagtattagaagcattaattgtgtctttaagggttaaacagaggctctctgatttctgaatgttaccttatgttttyataacagtttaattccyrtaaaccaattacacctgagcattctacttttatcacctctccatctctgaaggacaggattcactgtgtggcttatgtcttagacatcaactctattgacaatctctactctaaaatgttggcaaaagtgaagcaagttcacaaagaagtattaaactgtggtgagtctcactgaacttataaaaaaatttactttgaaataattatagatttgtaggaagttgcaaagagagtacagagatttcccatgtacctttcatcctatttccctggagtggtggccatcggagggagagatcattcacaggcatgactgaagaaagaccccaaatcctaatgttcagtctttaaagaatagactggccaaccatttttttttcgtgtgtgattttcctgaggctttagatagggctaaaacctatgtgggtagacagggaagatcgaaaccagaaaattgattattgttaacaatgtgtgtttatagttctatgtcattttatcacatgtgtaagtttatgtacccatcactgcaaccaaatattacatcactttgtagatttccctcatggcacccactattcctccaccatccttaactcttggcaaccactaatattttcttcatttccataattttgtcatttcgtgaatgttatacaaatggaatcatacagtatgtcaccttttgagactggcttttttgactcaacctaatatcctttgacatccatccaagatgtatgtatgtatttattgttcatttaaaaaattgtatagtattccatggtatagatataccacagtttaaccatgctctatcaaaaaatattccagtttttagctattgcaaacaaaactcctatcaagttttgtgtggatataagtttttattcctctggggtacatctccagaaatgtaatgctggatcataaagtaactgtatgtttagctttgaaagagatcaccaaactatactccagagggactgtaccattttacaatcccaccagcaatacatgagagatctattttttctgcattcttgctagtatttggtatcgttgctattaaaaattccttaactcttctaatagatgtatgctgatatttcatcagggtcttaatttgcattgcttaatgactaatgacattgaacatcttctcatgtgcttatttgccttctgtatagcttgtttagtgaaatgcctcttcacgtcttttgattattttctgattggatgatttgtgttttttagaagttgaatgttaaaagatctataaatcctaaatatgagtcaattgtcagatacattgtttgcggatagtttctcccagtctgtagttgtcttactattatgatgatttccatccctgccatctctcatctctccttttggaactctgggacatgaattctagatattttgttatagtctcacaatttatttatttattttttatatctatttgctctttatttttcagagtgggtaatttctattgttatatctttgaattcacttgttcatcactttgccctctccattctgcttttgagcatagctattgtttttcctatcttgggtattatggttttttagctctaaaatttcaagttgattctttttcaggtcttctatttctttgctgagacatcccacttccttcatttgtttcaagaatgttcctacttggttcttaagcatttttatgatggttgctttagaatccttgccaaataattctaacatctttgtcatctaattagggtcatgatcttctgattagcttttctcattcaagttgagaatttcctgggttttgatgtgacaaatgatttttaattgcatcttcgatattttaggtactttattttatgactctggatcttacatcttgtgttttagcaaacatattctgatactggtaagatggaaagtacaggtttcccataaggccttgtttgacacccttggagaaagggcactttcttactgtgccccatataggataccctgacatcacaggggctagaagcctccttgcatcgaaggttaatgaaggctaaagttccagcttctcacttgttctcctctgacacttccagagagggaaaagagcacctcattgctgctgattcggtggaagtctaggatccccaagtagcctcccttgacaccatcaagagggaccttgttagtatagtgcaggtataaatgtcctggctccctacatttttttcttctcttatactaccttggctaagggtgaaagttgggaaagggaaggacatatccatggatagggctaaggtgaattctgtggtgtttgactggggtagtgtggctattttctgaaagttttctgtcttgctacactgtcctttttctcatgctttgactagatgaaactagtcaacagcaaaaaaaattttcctttttgctggctctaatttgtattttccagttgtgagtgtctccaaaagccaatctgggacataygaagtaaaaagaaaacctagagagctcatctctgtattgtttcttgggtctcaaggtctctagccaaattgcattatctgcacttttcaatctttatgtttgatttatgcataatgtccagagattttagctacatttagtgtaaagaagagggaaaagtgtgtctactccatttggtccagaactggaagtactctcactgaacttccaaaagattttaatataaagaattgttggggcatttatactccaaagcctcgttgcttactttatcagtagaaagatcacatatttaggttccgaaaagtgctatgccgtttaatgtatagagcatggtcttgcttaagtgaacctagtttttaaatagtagtaaactttgacctcgagaaaggtaatttaattgctctgaactttatctcctgttcttctaaaatggggataataagttttgcatctgaacttaataaactgtctaacaaaagtctgagtagtgaacattagatatacacaatgtaaatatataagcttatataagtacttaacagctctaaaattatggagggtttggggtaagacagaaatgctaagttttaaaatgacttttcaaggatgtatggcaacacattgtccttggcgtgctggatggcaatgcttaatgcaacttagtgtgctgacttaggacstctaaaaggacattgtattaattttgaaacagaagaattacattgcaacagaggttgaaaaaaattataggtgtcaactgagaactgctctctaccagaacctaggtattaattggccaactttgctagttattcctctgaaacctgaatgaagagaaggtagtaaaggaaatcatttagtaatggaaaaaataaacacaagattttagtaggaagaaggtactaaaagccctgttaaaagagtcctgggagcttccttgactggcatttgaaattaatcttatattttcctcataagcagttgttagcatagcagaattttgatttgtttagaagtcaaatgtgatttactaattcaatccctgtggtttgagggagaaaggagtaggtccctattagaactgtgaaatcagtacagtttgctctcataaatgctcatacacaaccctcctcacttcctctttttcttgtggttctttttagtccccaaagtccagcaaccccttttttccccttgaccaatttaaaacaaaccatttgaatggaatcgtagatgattgcaatttagtgtggatttagttgcattgaaaaatgctgtcacatgttggaaaaaaaagatcaaagatcatttctcctctagaaaagcttcaggctccatattgagatgtattggggatatttcattcttcagctctcaaaatcaccctatagarttgccttcacacatatttaataacttgttgacacattgctatttatgatataaaataactgatttatctatttgatataggtatagcatatgtggccttgcttactaaagtggatgattgcagtgaggttcttcaagacaactttttaaacatgagtagatctatgacttctcaaagccgggtaaaaaatgctgatcataaccagatattattgtaatagtatcacaatcatacgtgtgtgtgtttgtgtgtgtctgtacgtgtatatgtgctyacagagtgtatttgcagggaaatgaagaatgggatcaattgcttgattaattcaaatttatatcacaytttaaaactgcaatgatctgaattattgtatgttccgaagataacttattaagccattgcttttttggtttctttcttaaattgtatttaaaattggtcaaatttcaaatattaaatacaggacttacactttytaaatatactttccacaggtcatgaatgtccataaaatkctaggcattcctatttccaatattttgatggttggaaattatgcttcagatttggaactggaccccatgaaggatattctcatcctctctgcactgaggcagatgctgcgggctgcagatgattttttagaagatttgcctcttgargaaactggtaatctggcccttttctccccctgtcatagatcactggtgccttttgaaaaatcctaagttatacatcagttattagatgactggggcccacctgcatgccctagtcctgaaagctacattaggatatatgtttcatttccactcttgtttgtttcattttcaggtgcaattgagagagcgttacagccctgcatttgagataagttgccttgattctgacatttggcccagcctgtactggtgtgccgcaatgagagtcaatctctattgacagcctgcttcagattttgcttttgttcgttttgccttctgtccttggaacagtcatatctcaagttcaaaggccaaaacctgagaagcggtgggctaagataggtcctactgcaaaccacccctccatatttccgtaccatttacaattcagtttctgtgacatctttttaaaccactggaggaaaaatgagatattctctaatttattcttctataacactctatatagagctatgtgagtactaatcacattgaataatagttataaaattattgtatagacatctgcttcttaaacagattgtgagttctttgagaaacagcgtggattttacttatctgtgtattcacagagcttagcacagtgcctggtaatgagcaagcatacttgccattacttttccttcccactctctccaacrtcacattcactttaaatttttctgtatatagaaaggaaaactagcctgggcaacatgatgaaaccccatctccactgcaaaaaaaaaaaaaaaaaataagaaagaacaaaacaaaccccacaaaaattagctgggtatgatggcacgtgcctgtagtcccagttactcaggatgattgattgagccttggaggtggaggctacagtgagctgagattgtgccactgtactctagccagggagaaagagtgagatcctggctcaaaaaaaccaaataaaacaaaacaaacaaacgaaaaacagaaaggaagactgaaagagaatgaaaagctggggagaggaaataaaaataaagaaggaagagtgtttcatttatatctgaatgaaaatatgaatgactctaagtaattgaattaattaaaatgagccaacttttttttaacaatttacattttatttctatgggaaaaaataaatattcctcttctaacaaacccatgcttgattttcattaattgaattccaaatcatcctagccatgtgtccttccatttaggttactggggcaaatcagtaagaaagttcttatatttatgctccaaataattctgaagtcctcttactagctgtgaaagctagtactattaagaaagaaaacaaaattcccaaaagatagctttcacttttttttttccttaaagacttcctaattctcttctccaaattcttagtcttcttcaaaataatatgctttggttcaatagttatccacattctgacagtctaatttagttttaatcagaattatactcatcttttgggtagtcatagatattaagaaagcaagagtttcttatgtccagttatggaatatttcctaaagcaaggctgcaggtgaagttgtgctcaagtgaatgttcaggagacacaattcagtggaagaaattaagtctttaaaaaagacctaggaataggagaaccatggaaattgaggaggtaggcctacaagtagatattgggaacaaaattagagaggcaaccagaaaaagttattttaggctcaccagagttgttcttattgcacagtaacacaccaatataccaaaacagcaggtattgcagtagagaaagagtttaataattgaatggcagaaaaatgaggaaggttgaggaaacctcaaatctacctccctgctgagtctaagtttaggatttttaagagaaaggcaggtaaggtgctgaaggtctggagctgctgatttgttggggtatagggaatgaaatgaaacatacagagatgaaaactggaagtttttttttgtttgttttgttttttttttgttgttgtttttttttttttttgtttttttgctgagtsaattccttggagggggtcttcagactgactggtgtcagcagacccatgggattccaagatctggaaaactttttagatagaaacttgatgtttcttaacgttacatatattatcttatagaaataactaagggaagttagtgccttgtgaccacatctatgtgacttttaggcagtaagaaactataaggaaaggagctaacagtcatgctgtaagtagctacagggaattggcttaaagggcaagctggttagtacttagctgtgtttttattcaaagtctacattttatgtagtggttaatgtttgctgttcattaggatggtttcacagttaccatacaaatgtagaagcaacaggtccaaaaagtagggcatgattttctccatgtaatccagggagaaaacaagccatgaccattgttggttgggagactgaaggtgattgaaggttcaccatcatcctcaccaacttttgggccataattcacccaaccctttggtggagcctgaaaaaaatctgggcagaatgtaggacttctttattttgtttaaaggggtaacacagagtgcccttatgaaggagttggagatcctgcaaggaagagaaggagtgaaggagagatcaagagagagaaacaatgaggaacatttcatttgacccaacatcctttaggagcataaatgttgacactaagttatcccttttgtgctaaaatggacagtattggcaaaatgataccacaacttcttattctctggctctatattgctttggaaacacttaaacatcaaatggagttaaatacatatttgaaatttaggttaggaaatattggtgaggaggcctcaaaaagggggaaacatcttttgtctgggaggatattttccattttgtggatttccctgatctttttctaccaccctgaggggtggtgggaattatcattttgctacattttagaggtcatccaggatttttgaaactttacattctttacggttaagcaagatgtacagctcagtcaaagacactaaattcttcttagaaaaatagtgctaaggagtatagcagatgacctatatgtgtgttggctgggagaatatcatcttaaagtgagagtgatgttgtggagacagttgaaatgtcaatgctagagcctctgtggtgtgaatgggcacgttaggttgttgcattagaaagtgactgtttctgacagaaatttgtagctttgtgcaaactcacccaccatctacctcaataaaatatagagaaaagaaaaatagagcagtttgagttctatgaggtatgcaggcccagagagacataagtatgttcctttagtcttgcttcctgtgtgccacactgcccctccacaaccatagctgggggcaattgtttaaagtcattttgttcccgactagctgccttgcacattatcttcattttcctggaatttgatacagagagcaatttatagccaattgatagcttatgctgtttcaatgtaaattcgtggtaaataacttaggaactgcctcttctttttctttgaaaacctacttataactgttgctaataagaatgtgtattgttcaggacaacttgtctccatacagttgggttgtaaccctcatgcttggcccaaataaactctctacttatatcagtttttcctacacttcttccttttagktcaacaataccaagaggggttactgtgctgggtaatgtgtaaacttgtgtcttgtttagaaagataaatttaaagactatcacattgctttttcataaaacaagacaggtctacaattaatttattttgacgcaaattgataggggggccaagtaagccccatatgcttaatgatcagctgatgaataatcatctcctagcaacataactcaatctaatgctaaggtacccacaagatggcaaggctgatcaaagtcgtcatggaatcctgcaaccaaaagccatgggaatttggaagccctcaaatcccattcctaatctgatgagtctatggaccaatttgtggaggacagtagattaaatagatctgatttttgccatcaatgtaaggaggataaaaacttgcataccaattgtacacccttgcaaaatctttctctgatgttggagaaaatgggccagtgagatcatggatatagaagtacagtcaatgttcagctgtaccctcccacaatcccacttccttcctcaacacaattcaaacaaatagactcagactgtttcaggctccaggacaggaagtgcagtgtaggcaaaattgcaaaaattgagggcacaggggtggagrtgggggggttgaataacaagctgtgctaaataattacgtgtaaatatattttttcatttttaaaaattgatttcttttgcacattccatgacaatatatgtcacatttttaaaataaatgcaaagaagcatacatccaagccactgagctcatttgtcttctgttttgataaagtggtaaagaaggaactaacatgggaatgcattgctacaatttaaataagcataccaagataaattcatttatggtgctttgagtatatgagaccctcttctaccagacagatgatcagtgttagatttatagagaagggattatcaaattcccatggccaagaaggtcagagagagagaaaaaaaaaagtgattcatgtgcatggtagaattatagacatatcaaatggacactgtattagtccgttctcatgctgctataaagaactgcccaagactgggtaatttataaaggaaagagttttaatttgactcacagttccacagagctgggaggcctcaggaaactcacaatcatagtggaaagggaagcaaacattttcttcttcacatggtggcaggagagaaaaatgagtgcctagcaaagagggaagccccttataaaaaccatcagatctcatgagaattaactcactatgacaagaacaggatgggagaaactgtctctgtgattcaattatttccacctggtccctcctacaacaaatggggattaagggaactaaaattcaagatgaaatttaggtagggacacagccaaaccatatcattccacccctgaccctttcccaaatctcatgtcctcacatttcaaaacacaatcaagccttcccaacagtccccccaaatattaactattttcagcattaactcaaaagtccacagtccaaagtctcattggtgacaaggcaagtcccttctgcctatgagcctgtaaaatcaaaagcaagttagttacttcctagatacagtgagggtacagacattgggtaaatacatccattccaaatgggagaaatcggccaaaacaaaggagctgcaggccccatgcaagtctgaaatccagttggacagtcagagcttaaagctctgaaatgatctcctttgaatctatgtattacatccaggtcacgctgatgcaataggtgggctctgaatgctttgggaagctctgtccctgtggctttgcaggatacagcacccccccacccaagctgctttcacagctggcattgagtttctgcagcttttctaggcacacagtgcaagctgttagtgtatctaccattctggggaatgaaggacagtggctctcttctcacagttccactaggcagtgccccagaggggactctgtgtgggggctttgatcccacattttccttccacattgccctagcagaggttctctatgagggctctgaccttgcagcagacttctacctggacatccaggtgtttccatatatcctctgaaatctaggcagaagttcccaaaccttattcttgctctctgtgtacccacaggaccaagaccttatggaagctgccaaggctgggggtttgcaccctctgaagcaatttcctgagctgtaccttggccctgtttagccacggctggagtggccgtgacacagtcccgaggctacatacagtagtgggaccctggacccagcccaggaaaccattttttccctcctaggcctctaggcctgtgatagaagggcccgccataagatctctgacatgcccttgagacattttccccattgtcttggtgattaacattcaatttcttgttatgtatgcaaacttctgctgctagcttgaatttctccccagaaaatagggttttcttttctatcccattgccagcctgtgaatttttgaactttcatgctctgctttctcttgaatgctttgctgcttagaaatttcttctgccagatacataaaatcatctctctcaggtttaaagttccacaaatctctagggcaggggcaaaatgctgccagtctctgctaaagcacagcaagagtcacttttgctccagttcccaacaagtttctcatctccatctgagacctcctcagcctaaactttattgtccatattactatcagcattttgttcaaagccactcaacaagtctctaggaagttccaaactttcccacaattttgtcttcttctgagtcctctaaactgttccagcctctgttggttacgttccaaagttgcttccacatttttgggtatccttatagcagtgccccactccctctgtaccgatttactgtattagtctgttctcacactgctataaagaactgcctgagactgggtaatgtataaaggaaagaggtttaattgactcacagttccacagggctgaggaggcctcaggaagcttacaatcatgtcagaaagggaagcaaacatgtccttcttcacgtggcagcaggagagggaaatgagtgcccagagaaaggggaagccctttataaaaccatcacatcttataagaactaactcactatgatgcgaactgccccatgattcaattatctccacctggtccctccattctactgttcactgctatcctcctccaaactttactctgcactaaccatactgaactccttacttcaaaaagctgccacaggggtgattatccttgccattctctctgcttataaagcacttttcctagatatttccatggtactccctctcactccattcaggacacttctccaatgacatctcattagatagacctttcctgattatgctgtctaaagtaggagatttcttcccacatcactcctattcctcctctttttctcacttaatactccaaaactctgtttatttacttgaaaagtggcaataatattggtgtcctcatcataaagttattaaaataaacacacgagatacatgtaaattgtcttgcaaataatgtctataataatataatttttaaagccaagtatataatacctcataagctgcttaaaatatttttatttgatgatgctattgtttttaatagggccagcaaattaaaaaaacctttttagggcaggcaggt

SEQ ID NO: 12338 - DNA, 14171 bp, Homo sapiens
atacaggctttatgatcaaatacgaactcaaattctgactctgctacttactagctaccaggcatctagtacaacttacgttccttcccctaccctcaaatccattctaatttcctcttttgttcacatactaaggctgccagttctaactcccaaagagcctttggattaatctccttcttgccgtcttttgttacgaccaactccgttatttattcccactcctggactactgcccagctccccagctgatctgcagtctcctccctccaccccacccctcactgtactcccccactctgcttcaaaacagtctctccaacagtcaaaatggattggttccttctcctggttaaagcccttcacagcagggggagtgtgtgcttgtgaactgcagaggctggggacggggcagtgtgacactagtgtgcatggcaggaaacagtgactcaccatcgtgttaagcttaaaatcaamaagtatgcaaatttgagctaaactgaataactggtgccgaaagatttgaaaacatttaccggacataagcttaaaattaaaatggaaaatttatatgtattaacctcattcattttcatgatcatggcaatacatgctgtggtgcgacatttgcaacttactggcctttagggtaaatccatattattggccatggcatttcaagtctctccagccttttcttcctctgcttcccaagtacaccctacacctgcacacatagccctcctttaccctgttccaggctttgggaagtcctgatgtctcatagttgaggtccaaaagggggagtttgggaaagcaatgaatgagggcaagtgcctcttctgaatccctgcaggaaaatacctgaccctagagaatgtggctgatctggtgaggccatccccactgaccctccacacggtgcraaaatggctcttggcagccggagcccagaagtgccattctgtgatcacacaggactttctgacttgctggctgagcatcyrgtgagaggaaatgattgctccatggagggcaccagtcatcccatcagtgagatggatgggagggagttgagagcttgctggggcttgtgggtgggagctaatgcatggggagacagtgactgactgcccagggatgctcagaggtagcttcttctgttccgttttgagctttctgacctctgttctctgacctccagacaagcagagctgctgctccctggggctgagtttcatcactatgtgggaggacctacggaracccatgttgtaaggyccccacatccctaccagcttccacaggccttggccccccatgtggactttggtaacacctatggggtgaatgggggwtgggrcacacagatccaggggctgaggaagtttagatgccattggggactgggggtggggtgagttgtaaggtgggcattacagtctataagatctcctcaagcctgacttctccctacagtggggggactgcaccgttttcccccaacatcatccctgaggcaaygtcctgagccgcaggtgacagggactgtaggcctgcatctgggggtaacccyctctgtgatcygtaagygatacaacttgacctcacaagacgtgggctctggcaccagcaataacagccaagcctgtgcccaggtgagccaagcaaagagccccagggtcctcayagcctccccacagtgtcctcaattccttaccaccctgggactcaccctcggacccacgatctctgctctgactccctccatagttcctggagcagtatttccatgactcagacctggctcagttcatgcgcctcttcggtggcaactttgcacatcaggcatcagtagcccgtgtggttggacaacagggccggggccgggccgggattgaggccagtctagatrtgcmgtacctgatgagtgctggtgccaacatctccacctgggtctacagtagccctggtactaccaagaggactggacagtggggaagggggtgggagatgggtgttgatccctgctccctcaagggaatgctataagctggagagagatcctgacaacccccagtgactatctttgtgcccatccctcaaaaaaaaaaaaaaaaaaatccaggccggcatgagggacaggagcccttcctgcagtggctcatgctgctcagtaatgagtcagccctgccacatgtgcatactgtgagctatggagatgatgaggactccctcagcagcgcctacatccagcgggtcaacactgagctcatgaaggctgccgctcggggtctcaccctgctcttcgcctcaggtgacctcctaccctaaacttagacaacgcttacacctctgcagcctgggagctttgactccacagtgatccctgagcctggtctctgactcataatctgaactcagaccttccagtagggaccactgacctgacctctacactctgacctcctacagtaacaaatttcccctctgacatccgaacccacatactaagccctaaccaattaatatgaatgctacacttggtctctctcaggtgacagtggggccgggtgttggtctgtctctggaagacaccagttccgccctaccttccctgcctccaggtaagtactctagcctaccactcaggtataaccaccacctttcacttgtgatctcatgatgtagaacctttgtcttgaccccaccatgtgctcctgtggttcagccttaagctttgcctgccctggttgctgtactcctgtctcttcttcctgcaggtcccaggccccaaatctcttgtgtgggatacagctcccattgttccttttcgtcagttcccaggcattttagtggaagatttggtgggtgttctgtagagaaaagtgtgcacagtcacctcgggccatgccttgaaggctcaaaatctcttagtcaatcccatatacatgcttccccacagagtctagttcctccagcaagacctgggctatactcacccctccccacatatcttggaggtccccttgggtcccctactatccaaatgctgtcttctcccctcagcccctatgtcaccacagtgggaggcacatccttccaggaacctttcctcatcacaaatgaaattgttgactatatcagtggtggtggcttcagcaatgtgttcccacggccttcataccaggtacgtgtgtttgtgtggatggatgcagggtaagagtgaggatgggggatcctcagttcagctgactgctgggcaggccacatgccaatactcactcaaaaatgcctttcaggaggaagctgtaacgaagttcctgagctctagcccccacctgccaccatccagttacttcaatgccagtggccgtgcctacccagatgtggctgcactttctgatggctactgggtggtcagcaacagagtgcccattccatgggtgtccggaacctcggtgagaatcagcccatctccaaactctcactcaggaactacccttaccccctaacaccttgaacaccttgcacctagaacccctgactccttagagatgtctgatactttaaagcatcactcccaaaaagtccaatcactcagaacccctgacctctacttgcaccttcactcttgtaggcctctactccagtgtttggggggatcctatccttgatcaatgagcacaggatccttagtggccgcccccctcttggctttctcaacccaaggctctaccagcagcatggggcaggactctttgatgtaagtatggaagggaagggtgtggacgttttcaaacaactatggggagtgctaagggggacttgggggcagttagggtggtgtggaatagcctttgaaatgtgagtacagggtgaggagatatactctttaagtactggtactagtaggcccagatctgatgccagcctcctccctaggtaacccgtggctgccatgagtcctgtctggatgaagaggtagagggccagggtttctgctctggtcctggctgggatcctgtaacaggctggggaacacccaacttcccagctttgctgaagactctactcaacccctgaccctttcctatcaggagagatggcttgtcccctgccctgaagctggcagttcagtcccttattctgccctgttggaagccctgctgaaccctcaactattgactgctgcagacagcttatctccctaaccctgaaatgctgtgagcttgacttgactcccaaccctaccatgctccatcatactcaggtctccctactcctgccttagattcctcaataagatgctgtaactagcattttttgaatgcctctccctccgcatctcatctttctcttttcaatcaggcttttccaaagggttgtatacagactctgtgcactatttcacttgatattcattccccaattcactgcaaggagacctctactgtcaccgtttactctttcctaccctgacatccagaaacaatggcctccagtgcatacttctcaatctttgctttatggcctttccatcatagttgcccactccctctccttacttagcttccaggtcttaacttctctgactactcttgtcttcctctctcatcaatttctgcttcttcatggaatgctgaccttcattgctccatttgtagatttttgctcttctcagtttactcattgtcccctggaacaaatcactgacatctacaaccattaccatctcactaaataagactttctatccaataatgattgatacctcaaatgtaagatgcgtgatactcaacatttcatcgtccaccttcccaaccccaaacaattccatctcgtttcttcttggtaaatgatgctatgctttttccaaccaagccagaaacctgtgtcatcttttcaccccaccttcaatcaacaagtcctcaatcaacaagtcctactgactgcacatcttaaatatatctttatcagtccacaagtccttccaattatatttcccaagtatatctagaacttatccacttatatccccactgctactaccttagtttagggctatattctcttgaaaaaaagtgtccttacttcctgccaatccccaagtcatcttccagagtaaaatgcaaatcccatcaggccacttggatgaaaacccttcaaggattactggatagaattcaggctttcccctccagcccccaatcatagctcacaaaccttccttgctatttgttcttaagtaaaaaatcatttttcctcctccctccccaaaccccaaggaactctcactcttgctcaagctgttccgtccccttaccacccctgatacaactgccaggttaatttccagaattcttgcaagactcagttcagaagtcaccttctttcgtgaatgttttgattccctgaggctactttattttggtatggctgaaaaatcctagattttctaaacaaaacctgtttgaatcttggttctgatatggactaggagagagactgggtcaagtaagcttatctccctgaggctgtttcctcgtctgttaagtgtgaatatcaatacctgcctttcataatcaccagggaataaagtggaataatgttgataacagtgcttggcacctggaagtaggtggcagatgttaacgcccttcctcccttgcactgcgccccctgtgcctacctctagcattgtaacgaccacatagtattgaaatggccagtttacttgtctgccttcctttccaagaccgttggtgcctagaggactagaatcgtgtcctatttaactttgtgttcccaggtcctagctcaggagttggcaaataagaattaaatgtctgctacaccgaaaacctcacgcctctcattcgttgtgatttttgcatatgttgttgactcaggctgaaactcctcctcctcctacagcagcactgtgtgccgccccactgctgcccccacctctcggggcagctggcggagaagagagggggctttccaaatccactatgaatccttaaaaggctgaataagggaacttgaaacgatgcagacaggcaggcaacccgtagtcgagggacatagggccataaaygtcgaagccaggtcttgagcgtcagacagaatgaggtgtcccagagcggcggaggagagccagacgcacgctggttccggtctggacggaatcgccgcggagcacggcagaggctagggcggaatggctacggcagcgcagttcgccaaggmtcggtctccgccctgcagcctatttcctctaacccgcagatccactatgggaggaggcggggagcgggctggagagcactaacagagacaggcggggcgagtcgtgggcgcgtgacgtcaccccggggtgtgcgcggcgcgagcggaagcggaagcggctctgttcgccgcctctcccaccggcccgatgagctgcagcggctccggcgcggaccccgaggcggcgccggcctccgccgcctcggccccgggccccgcgcccccggtctcggctcccgccgcgctgccctccagcaccgccgcggagaacaaggccagccccgcggggacagcggggggacctggggctggagcagctgctgggggcacgggacccttggcggcgcgggccggggagccagctgagcggcgtggggcgggtgagggccgggacgggtgagggcgagggaagcgtcttgggctgggtccagcggcgggtgagggcagagggtatagacagacctagctggggccctgcgcctcccacctctgtgtctcattttgctggttctcctccagctccggtgtcggcgggtggcgcggcgcccccggagggggccatatctaacggggtttacgtactgccgagcgcggccaacggagacgtgaagcccgtggtgtccagcacgcctttkgtggacttcttgatgcagctggaagattacacgcctacggtgggcttccgcccgaacaaggccacctagcctgctgwcaaaactttcagccacatcgtgcttttcagcgttctcttccatttgctcccctagtcgctcttctgtgtttgccctctgctcacccaaactgtgagcttcctgataatcaggcctatccatttccctcaccctcctcccgctctgctgacagttctcttaattgatttctcagatcccagatgcagtgactggttactacctgaaccgtgctggctttgaggcctcagacccacgcatgtgagtaaacccagggcaggttagttttgggtgcttgtgcagtatgttgtccatctccttctcatctaagttttttctctctagaattcggctcatctccttagctgcccagaaattcatctcagatattgccaatgatgccctacagcactgcaaaatgaagggcacrgcctccggcagctcccggagcaagagcaaggtgtgaggggaggcttaatgaatcagtaattaccttccacaacagtggaggcttatcctgccacccctttsgggaaactgaatcgtaggggaggtgtaagacttactcagggtcacccatctgggattgaagtccgggattcctgtgctcagttggtgctcttccctcttccctcaggaccgcaagtacactctaaccatggaggacttgacccctgccctcagcgagtatggcatcaatgtgaagaagccgcactacttcacctgagccacccaacctaaatgtacttatctgtccccatgtccccacaccagcctgttttcataataaactttattgtgacaggcggggctgatccctcccatgttggragacaccatgtggcaagtgacaaagctctgagcccgcccctcttggggccacagtggtagggatgggggaaggggatggaccccatggctggggtagtaccatgactggaggcgggggaggcaaccagaggcctgctgctttggggaggtgcattcccccaaccatgtcccgacacctctggagttcargcaaggaccttccagtcctacttgtcctgcatcttctcaaggataggcacaatcatgtcaaatttgggtcgctttgcagggtcttcattcatgcagatcttcatgagcttacacacatgaggggaaatacctggtgggatggtaggccgaaggccttccaatgccacctgcgaatacaagaaaaaaagcagcctcacaatttgagtctgtcatgtagagagaagccactggcccttgggacaggattactgtatatccgaacaaatatgtgaggagccaaggcccactacagttattttcaccatcaccaaccactcccgcaacacaaatgtatgctgttgtgctctcaccttcattccaatctccatattggagaggtcagcaaagggtacctcccgtgtcaccagttcccacagaagcactgcaaaactccacatgtctgctgagcgtctgtttgtgtcttcaggcttcttctgcagagctggagagatagggcttgtctgttctggcccccttgcctgtcctgtctctgcccccttccactacttctgaggtggtccttttttacctcccgacatgatgacttcactcaccttcgggggctacccaggcaggtgcatacatgcgaccaggacattggaaagagaacttgacatcagccatgctaattcgggcagtcatgtcctcatcaatctgaggaagagaaaacagatagaaggaggtaagtcatagataggcaaagggcttttggggcctgggccaggagtgagcttgtggcctcaccattacactacggctattgagtgcatgtcgtgggatgaggggctctagtgtgtgtaggaaggccatgccccttgccatgtccaaagcaaacttcacagcctggctctggtccacgacgaaatctgagaggaggcaaaagtcaaatagttcagagaggctccctctctgccatttcctccccaaggaaattcaacatccctactcactggtgccttcatgtagtacattgtagagggatccatacggcatccagtgtgtgatgagagtaggatgaggagcaggtggagactggcaggcacctagcactgggagcacatttggatgcgagaaaatcctagaagagggagggagtggttgagacccagtacaaaagatctctttcagtgctattcagggttccttggaactagcagcttccaggttacgccttgcactacctgagccggggacactcttcattgaagtccctgctcttccttgtactccagtctcgaaccttcagcaccttcacgacaatgtcattgccctgccagcggcccttccatagctgcaggacaggtaggggttaggaggcttgaaatgttgctgccacttccttgcccactaactggaggaaaaacttaaaacaggtacaaagcaagtaatttatgggggtttagtgagggaagggcaagaagggcaggggtcacctctccagagtgattctcgttgagcttcgtcaggaagttaagctgtttgaagtcaatgccagagtgtttgttcagggttccatttcctaagagtgtgggcaggtcaggtacccagcttcaccctaacccagccccaagaggccaggattatttccttttacaacccttcttcccacagtggtgactcacggggccgagtgcgggtggtccccttccagaatgtgtccttgtatggaatacggttgagattctggcccatcttctctgcccgctctagggaagaaaaacaacctaagctgtggtacagagggagaagacaggtgggaagggacgagaggacacaagctaggggatggggagatggacctcggagaagctctctcaggggtgccttggctttgtccacaggcatctctccatacttgttacagatgctgacaagggccccatttgccaccaggtcctggaatgaaaaggccattatgatgagagccactgctacctcgctggcagtcactgaaccaaccatgaatgcacaaatgtagaacttaatcctgtaagtgtcacacagtagtactgacagaatgggttgagggttccaaaatctcccaccaaggctcagactttacttcctacccatctcaggaattaagggctgagtactcacctctgccacttgatcttggccccaaaaacaggcatagtgcaggggcacattcccgtgttcattcactgcattgatgtctgccttgtactgcaatagctggaccccatggccagacaaaaagaagaggcagaaagtacagtcagttccaaatgagatactggtgtcagggcatgggaaaagggggaagagcacacatgctttctactgtatgttacagtgcctgtgactgaccctcatggcatgtatgtgatgtggatgacgaaggagtttgtacgtaccttctgtacaatatcacggtgtccatgactggctgccagatgcaggggggtgtcatccccacggttcattacattgatccgtgccccccgcatgatcaacatctcaaccacagcagagcggccctctcggcaggcccagtgcaagggggagaagccatgatcgtccctttgaggaaggggcaatggtcattgagctggaggtgggatggggcaaaggttttgattcctgaaaaactgataattacatactctctgggaaggcttacctctctaggactttgattctcattcatgccagcaactcccaaagctgtccatttcagaccttcccctgagcttcaaaccaaaccaaccacctagatatctcaacaacctctataaaaaaatgtgttatcttcaccatatcccacatctcatttccttaggtggtagtgctcttcccctggtttctcttgcaccccttctgcaacatctattggtcctttctgttttccaccacatcttatatgtccccctacttcagcacttgttgcactggattgtaaaaatctgttaatggactgtcttgtctgttagacctttaagtttcttgagggaatggattgacagcagctgttcagtgcatgttagtgggggagaagggtgtcttggagaaggcaggccacaacttatagaagagggaacaaacttactatttggctctggtactgaaactaacatctaaaaatggaatggaatttaaatgatgttttggaagggtttatgttgaaaaggagaaatgcttttgactactgatgaggtagataacaaaccaccatgcaaagcaggattcccctacttagcaatcctgtgcatagaaaacagaagaaaatgagaatggctgttttgggattaaaactatacctgatttttttcttttccaagaaatatgtattttataaagtaaagtatacaaacaaaacaaaacaattggtttggagctgggcctgcctgacagcctggggccataaaaggaaattccctccagttcggggctgcagattcaaggggcggagcagggggcggtccgtggtctgggccagcagcctccggatgccttagtgttgtggtcacttcctgtgtgcgactctaggcaaggcctggagctgatcaggggtctggccatccagatgcccgtacagctgaaggggttggggggtgtggcctttaagttaatcattttcctccacaacttgctcgcatctgctaacacagaaatagccaaaagcttttccttgagatgggattatccccaggaagcattacgccccctgtttatcagttggtcttgcctcctagacctttaatttgtgccctgacttatcagcttccagtactgcctgtggcgccagggcaggccaaactcggggggcaaaagtatgggcacaagggttctgttcactatcaggctgcgtgccacctcagggcctggacttctatctcaagaagacctgcaaggaattaaccccctcttcatatccagcatatagccaactttggcccccatactttactcctcaaaccagcaccacaaccttccagtttcattaattccaccccttttccttctggcagcatcttcctagagtcttcctagactcagctagagtcttcctagatgctaggcccactgggcaactgcctaagcctctatttcctcaccaacaaaacagtaacagtgcttactgtctttatcagggtaccctttgagaattatatgaaaaatggaacaaatgactttgcaaagtattaaagagaaatagtgtagaacctaatgggaaccagtgaagtctagactaagatgacaggtgatcctgacctgtcaaacctaaaaactaaactccaccaattttaaaaaataaagaatttgaatttgccactctgagtcaccatcactactgctcttcttgccttcctatctcagccaaccttgtagaactggtgtacattcactttcactatttgctcacctctcaacttttgttttctttttcttttttaagacagagtcttgctctgtggcccaggctggagggcagtggcatgatcttggctcactgcagcctctgcttcccgggttcaagcagttctcctgcctcagcctccgagtagctgggattacaggcgcacgccaccacgcctggctaatttttgtatttttagtagagacagggtttcaccatgttggtcaggctggtctcgaactcctgacctcgtgatccaccagcctcggcctcccaaagtgctgggattacaggcgtgagccaccgcgcccggcctacttttcaatctgccacaaatctgctgtatcgagagcagagattatgtcagattctggactctagcacccagcacagaaggtgttcatcatagtgccttaaattaaggaacccaatgtagtctgatttcttcacccattattctgaaacaacactcacagatggtcaaatacatcctaactgcacactgaggggagcaacagacactggggcctaccagagtggggcgggtaggaagagggagggatcaggaaaaataactaatgggtgccacggcttaatacctgggtgatgaaatgatctgcacaacaaacctccatgacctgagtttacccatccaacaaacctgcacatgtaccccttaacttaaaaaaaaaaaacccaactgtaaattcaatggctactttaaaatattaatgttctttgatctctcagtagcctgtactgccgttgactacctccccttcattaaaacattctcttctgtaagctttactcacacattttcctatttctttttcaacttgcggttgctccttttctgtcgtgcaggcttcctgtcccctgacctcttgccttccactctcctgagacgttctccttcacaaccacgtcttcaagtatcatctatatatatgatatatatatgctatctatatgctgatagctctcaaatctgtgtctccaagtcagattcctcccctgaattgcaaatctgcataaccaacaacacactcaacatttccaccttgctgtattgtcaccttaactttaacatgtccaaaataaaatgcctcatcctccagttttctccatctcagtaaaaacaaccaagttcccaagccagaaccctggtcctcatctttgcccttactcactccccacaccaagttccacaattcttcgtcctaaagacttctggaatttgatcacttctctttttcactcaccctaattctagtccaagacatcattacttctacgatgaactaggcaattgcctcctttccacctgctcttcacaaagcatccaagacgatactgaaaaatggacaatctcattatgtcactatacagctttaaaaccttgcttttaaaataaagaccttcttatagcctaaatatgcttgcatgatctggctgatccttggagacctctacagtcttatgtcctgttcttttcctcttgtacccaatgctccgacccacagagatcatctatcctccagccatatggaactccagacaatttcctgttctctctgctctgtgccttgccccctagcctttggccatgcagtctactgaggctggaaagctctctgtagcctctgcctgtgaaactcttattctgcagtcaagattcagctcaaactgcgtcctctgtgaaaaccctctgccccccacaggctatgcttagcactcattacact

SEQ ID NO: 12339 - DNA, 19159 bp, Homo sapiens
gaaaccccgtcactactaaaaatacaaaaattagctgggcgtggtggcatgtgcctgtattcccagctactcgggagtctgaggcaggagaagtgcttgaaccagcaggcagaggtttcagtgacctgagatcacgccaccgcattccagcctgggccacagagcaagactctgtcttaaaaaaaaaaaaaaaaaaaaattaactctcctggttttactcctacatctctgggtgaaccttctcctcttccatcaccttcactgcttcattttcctttacccatccatgacatgctcctcagttctattctgagccattttctcttctcattatcttaccctgaatatctcatctattctgactttaattaccacctctaggctgctgattcccagacccccagcacagatttcacgcatgtcccacttcctaaaatccaacactttgaatggcatcaccagcctacccacagttgagcaacctggaacttacttcagattcctctcttaccaacctcaacatcccaccaattctacctaatgaagttctcctgtctgcctacttcttccatcatgactagtcaacagtgccctcatcttgtgccctagtacctgggtttctataacacccctgttctcatctatcccactcaactggaccctgtcattccttatctctccctaggtgaataagtacactggctatatctcaaatgacaagctccgggaatacaaagataaacatggcttgagaaaacagcagccaaatgcacaaaggaatcacaatgcaatatttagaagctgaagtagcacyrttcacatagtactttgagagtacagatgaagaactgattttgctttgggagtagaataggaaacaactaggctgttcggaaagatgagcaaactgccagtccgatgaatatccagcagaaagaacagtacgtgtagaggcactgtgtagtgcctgcctaatgattcacagcccagcctccaaacatgccctctggactacagcctgtttcaaaacctccatccccttattagaggcatccaactggctcagggcatagaacctatgatctcccaatgggtactgtcaggtattcctggaaacaagtacaagaggccatatctttatacctgggcacatggcagataccttttgggggaggcctagaatctatcattcaaactcaccttccctcagcaccttgcctatagctttcccaggacatgctgatctgagtccactgcaaggcagagatagtggacagactcttccgccaatgaacagcccaatgcccccaagcccawatggcatcaacragttgtttatgaacagagacccagctccctcactacccctccaaggacagaagctcagaatctattaaaagtcattaaatagcctatgaagcaggcctgstgasrggtctagcctctcccagaggcttccttagtcaacaaatccattctttacccctcagcctccaaccagcctagggaagatcttcaaaaaacaataaggcttacaacacataatagtcatagctagkttactgagcacctcctatgttcccagccctggctacagatttctccagttaacccrcacaaccaccctgcaagacamaaattctaccattttccraatgaggaatgtgatatacagagattaaatgactttargtgcctytgggtagcaggccaagaattaaatccaggtctacctgattccaaaatctgtgctctcagctatatacatcccaaagtcccacaggacaataggtgttgggagyggcttgatgctatrtggttccaaaaatggagatgaggggagaggggaaagataaaccactagaaatgctcggtatggggacaaccaaacagtckcaagttggtggctcagactgatgtcttgagccaagatgttggtggacaaccagttgcctcagagtcaaacagcaacagctgcctgtctgcaaccttgaawgcctgggcaaactgaagctgaaggagcagaagctatgggtgagcagaggaagctgatctgtagacagatcagatgacagcagagtggagatggcaggacaggaaggccatgtggcttcttagttggaaagaagagcaaaacctaaagatgccttgaattccaaaccatctagttttcataacacctgaagtgtcatgagacagatatccccatgttctcacaataaactctttattgtttagctagccccagtgactttatgcatcttataaccaagaagccttcagyagagcaagtctgagccagaggttttatcacactttgtcctcagggtccaccaggaaccaggtcttggctcacagccaggctggaaacagtcttcacagttctgagcctggagtttgagatctgcctcccctttcaaggaagatccagaggtcacctgcgcttgtagagacatggctgaagctgcaggcctgaaagctgagccttgggccctaccagagggggcccagtcttttggaaatcaaacaagaagaaatggctgttggtcaggtcctaggggcagaaaagacccagtgagaaccaaatcctcatcccaactccttaaaacacctccctctatgtactgcctctgctcacaaagcttcccagggctcccacttccgttggggagcaaaatgtctgttcctgtgcctaaagcctccttcctgaacaccagtaccctgaatagggccacatgagacaaaaacaggtacagatgtcttggggccctcaccttggagacaatcttgaagcctagcttggtcacagcccgcagaaaggttcgaacatcctcaaagcggctgctgacctcagccactttcaggagacccctgagaaagacagaaagttctgtgtaagtgcacagactcatgcatgcacacatacatacatgcatctgtgtcctgggggctcttaccctggcttcagtactctrtttgcctcctctaggaagtccctgatgttggttcccatcagtgaaaggcaaaacacagccacatccacagactcatcctccagaggaacctgtggagagtgagagtgttgtataaggcacacagtgcagaagaagaaagccagcactgagataccaggatgggaaaggggaaggaagggttagagattagcatacggaggttggccctagagcacaagccagataacataggggtttacctgggccatgtcacacacagtgaccctagggtccagagaagccaagtcaaagcaatgcacagggttccggatacttgaagccaagcggcaatccccacagccgaagtcagccaccactagggatgcaggcctgagagtygaaggcaagggtcacatattggtctgatctgagcctatgactgacccaccacatggcttctcacagtccctgacccccattcaccgctgscgaagatccctggcgatgcggtccactggctgcagtggccacttcttcacttggctctggaagccgcggtggtagagaagaaaagcctcagggtcttcctggaagagacgctgtgcagcactgctgggccctgagtacaactgttcattgaggtagcgaaatcgggccccawccagccgctgtgccatrcgggctcgcaaagcccctgcccgagcctcatggctgtctgtcctgggaacaggagacacctctgtcttctctgtgggggcctcagctggggcctggtctggcacctgaggtggctgaaacttgttcttacatcttctcttrttcttttgccggttccgccactgcttgcggcttaatgtatgagggggtttaggggaagtggacccagggctttgctttggtggatcatttgtagtactacccttccaggctttgggacctacagggagggagatgggaaggtgcacatgaggcaagatctcttacattcggagtcacggcaagtcatcccagccatacctctgtctttgagatcgtgactgtggcctgcagagaagtacttcttattgcctgagtacaccattagccccaatcctaatggcagtggataatcactcttgtatgtagaaccagctgaccccccgacacacacacaccaacacacacacatatacacatccaatggtacctgtttggtcaacattgtccaggtgctgggstgaatttataggggcatgtttctggcatttcctctttcttttctcatcttcagcagagtcactgccaacaagagcctgtttgtggcatttcttcttcctttctacttcttcctcagagtcactgcaaggtgggccctgtttttgacatttcttcttccctttcttccctacttcagcagaggcactggcaaatgatgcctttttggggcatttcttcttcctttcctcctcctcctcctcagagtcacttatacataggctggggggatgctgggaaagagatgctgcctctagggcccgtaatgtggccaagagctggcrgcgcttggagccctggaggaaaacaggggatgacagtgggyctaaagagaatggatgaggcctggagaacaagaagggagagatgtggacctgattcagactggcagaagcatctgaattcttcccagtcaagcctgccagaacccagaagaacttttatgtcaccaccccaacttctgggaagctggagagcagagaaaccacctatcccactttcttcaatgtgtaaatgagctaatggaggtttccccaaaggaaaatgcaaaggccacaagcaacaagaccaaggccagagaccaggaattccaacccttcaccttgagcttttgcctagagctgatacatttctgtaagaggtaaggaggcttctgaacacaggagacacatgatcacacacgtatattaaatatttaacatgtctctagctgcagtgtagaaaacaaactgaaggggagaaattgcagacagagaggccagcggcttggacaatggtaatggggctaggggatgaaaaaggaggaaacaaagcaggccgattccatgttggaggcagactgaagggtaagaaaagcctgaggaagcagggccctcacatctgcagaggctcaaaggagaagatgtattgtcgggaaggctgattctgtgttgcagtcctaccaggtaatcctaggccagkcacttaccctgattctaagtttcccacaccctcctttgaacaatgatactgacaactcttactgtctccaatccatwctccacactgtaaccgacgaccctttcaaaatacaaatctgaagaaataattccattgcttaaaacctttcattggcttctattctcaatatacgcaaaacttctacctcttgaacttgaacagcatatatgcccctttcatttactatgtatttcaaccacaaggaccacttgtgtttgtgactctgacagaacatgctctcttgtcccagggcccttgtacgtactttttcctgtctgaagaaccctcttcgcttcaccaacttctactcaacaactctctctgacccaacgtcagtttcttttggaagttctcggatcttcagatcaggactcgcccttaacggtgccacaggtgtccctccccgcaatacacacagcgctgggatccaccaatgtccgcttcgcggcctgaaacagctcccattgctcccgcgagtcactcaccttgttttgcgaggaggccgcaggcggaggtcgtgagattacgggcccaaggcccgcggctactggggccgcctcggcccactcaggctcttcgaacatgagggtcgggagggcagggtcgccgagtccccgctcttctccacgtgcacagcgctcctctggaagtcggagcgctcagacctgccagaaccgacccggaaaccaaagcgtgacagccaggggttgctagagcggccggcgcggcgcagcgaaccatcgagtttarccaggcgcggctagaagggcagggaggcggtgggaggggagggacggaggcccgcgctgcccaagagcgccacgggcggggcggggccggcggcgggctgcgggcgcggccggacggkagttccccggagaaggatcctgcagcccgagtcccggtgagtgcgagaggacccgcgccccctgtcacccctcacttctcctgagtcccaagtaaggaacggagccaaccctggggaggacccccggtcccctctcccagagtatacggagcctgaacctccccacttcccccaactctgwtcgcsgatagggtctagttgcctgctctcggacatccgttcagcagacactacctcttcgtcaccccctgcccaccctgacccgcctttacctcgcgtctagaggacacagccagggrtcatcccgcagccccgaacwccttcacagacccccactagccggggacgcagctcaggccccctacccccaacacaaacacttctctcctgtagaggataaagcttggggttcatcctccttccctggatcactccacagtcctcaggcttccccaatccaggggactcggcgccgggacgctgctatggacgacattttcactcagtgccgggagggcaacgcagtcgccgttcgcctgtggctggacaacacggagaacgacctcaaccaggggtgagctgaaacggttggtggatgagaggaaggctrgagatctcctggctacgtggagtggagtgctcatgtctggtggtggcggctgcctttgctagccagtgtaatgagtgctaagcatagcctgtggggggcagagggttttcacagaggacgcagtttgagctgaatcttgactgcagaataagagtttcacaggcagaggctacagagagctttccagcctcagtagactgcatggccaaaggctagggggcaaggcacagagcagagagaacaggaaattgtctggagttccatatggctggaggatagatgatctctgtgggtcggagcattgggtacaagaggaaaagaacaggacataagactgtagargtctccaaggatcagccagatcatgcaagcatatttaggctataagaaggtctttattttaaaagcaaggttttaaagctgtatagtgacataatgagattgtccatttttcagtatcgtcttggatgctttgtgaagagcaggtggaaaggaggcaattgcctagttcatcgtagaagtaatgatgtcttggactagaattagggtgagtgaaaaagagaagtgatcaaattccagaagtctttaggacgaagaattgtggaacttggtgtggggagtgagtaagggcaaagatgaggaccagggttctggcttgggaacttggttgtttttactgagatggagaaaactggaggatgaggcattttattttggacatgttaaagttaaggtgacaatacagcaaggtggaaatgttgagtgtgttgttggttatgcagatttgcaattcaggggaggaatctgacttggagacacagatttgagagctatcagcatatagatagcatatatatatcatatatatagatgatacttgaagacgtggttgtgaaggagaacgtctcaggagagtggaaggcaagaggtcaggggacaggaagcctgcacgacagaaaaggagcaacygsaagttgaaaaagaaataggaaaatgtgtgagtaaagcttacagaagagaatgttttaatgaaggggaggtagtcaacrgcagtacaggctactgagagatcaaagaacattaatattttaaagtagccattgaatttacagttgggttttttttttttaagttaaggggtacatgtgcaggtttgttggatgggtaaactcakgtcatggaggtttgttgtgcagatcatttcatcacccaggtattaagccgtggcacccattagttatttttcctgatccctccctcttcctayccgccccactctggtaggycccagtgtctgttgctcccctcagtgtgcagttaggatgtatttgaccatctgtgagtgttgtttcagaataatgggtgaagaaatcagactacattgggttccttaatttaaggcactatgatgaacaccttctgtgctgggtgctagagtccagaatctgacataatctctgctctcratacagcagatttgtggcagattgaaaagtaggccgggygcggtggctcacgcctgtaatcccagcactttgggaggccgaggctggtggatcacgaggtcaggagttcgagaccagcctgaccaacatggtgaaaccctgtctctactaaaaatacaaaaattagccaggcgtggtggcgtgcgcctgtaatcccagctactcggaggctgaggcaggagaactgcttgaacccgggaagcagaggctgcagtgagccaagatcatgccactgccctccagcctgggccacagagcaagactctgtcttaaaaaagaaaaagaaaacaaaagttgagaggtgagcaaatagtgaaagtgaatgtacaccagttctacaaggttggctgagataggaaggcaagaagagcagtagtgatggtgactcagagtggcaaawtcaaattctttattttttaaaattggtggagtttagtttttaggtttgacaggtcaggatcacctgtcatcttagtctagacttcactggttcccattaggttctacactatttctctttaatactttgcaaagtcatttgttccatttttcatataattctcaaagggtaccctgataaagacagtaagcactgttactgttttgttggtgaggaaatagaggcttaggcagttssccagtgggcctagcatctaggaagactctagctgagtctaggaagactctaggaagatgctgccagaaggaaaaggggtggaattaatgaaactggaaggttgtggtgctggtttgaggagtaaagtatgggggccaaagttggctatatgctggatatgaagagggggttaattccttgcaggtcttcttgagatagaagtccaggccctgaggtggcasgcagcctgatagtgaacagaacccttgtgcccatacttttgccccccgagtttggcctgccctrgcgccacaggcagtactggaagctgataagtcagggcacaaattaaaggtctaggaggcaagaccaactgataaacagggggcgtaatgcttcctggggataatcccatctcaaggaaaagcttttggctatttctgtgttagcagatgcgagcaagttgtggaggaaaatgattaacttaaaggccacaccccmcaaccccttcagctgtacgggcatctggatggccagacccctgatcagctccaggccttgcctagagtcgcacacaggaagtgaccacaacactaaggcatccggaggctgctggcccagaccacggacygccccctgctccgccccttgaatctgcagccccgaactggagggaatttccttttatggccccaggctgtcaggcaggcccagctccaaaccaattgttttgttttgtttgtatactttactttataaaatacatatttcttggaaaagaaaaaaatcaggtatagttttaatcccaaaacagccattctcattttcttctgttttctatgcacaggattgctaagtaggggaatcctgctttgcatggtggtttgttatctacctcatcagtagtcaaaagcatttctccttttcaacataaacccttccaaaacatcatttaaattccattccatttttagatgttagtttcagtaccagmgccaaatagtaagtttgttccctcttctataagttgtggcctgccttctccaagacacccttctcccccactaacatgcactgaacagctgctgtcaatccattccctcaagaaacttaaaggtctaacagacaagacagtccattaacagatttttacaatccagtgcaacaagtgctgaagtagggggacatataagatgtggtggaaaacagaaaggaccaatagatgttgcagaaggggtgcaagagaaaccaggggaagagcactaccacctaaggaaatgagatgtgggatatgrtgaagataacacatttttttatagaggttgttgagatatctaggtggttggtttggtttgaagctcaggggaaggtctgaaatggacagctttgggagttgctggcatgaatgagaatcaaagtcctagagaggtaagccttcccagagagtatgtaattatcagtttttcaggaatcaaaacctttgccccatcccacctccagctcaatgaccattgccccttcctcaaagggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaaggtacgtacaaactccttcgtcatccacatcacatacatgccatgagggtcagtcacaggcactgtaacatacagtagaaagcatgtgtrctcttcccccttttcccatgccctgacaccagtatctcatttggaactgactgtactttctgcctcttctttttgtctggccatggggtccagctattgcagtacaaggcagacatcaatgcagtgaatgaacaygggaatgtgcccctgcactatgcctgtttttggggccaagatcaagtggcagaggtgagtactcagcccttaattcctgagatgggtaggaagtaaagtctgagccttggtgggagattttggaaccctcaacccattctgtcagtactactgtgtgacacttacaggattaagttctacatttgtgcattcatggttggttcagtgactgccagcgaggtagcagtggctctcatcataatggccttttcattccaggacctggtggcaaatggggcccttgtcagcatctgtaacaagtatggagagatgcctgtggacaaagccaaggcacccctgagagagcttctccgaggtccatctccccatcccctagcttgtgtcctctcgtcccttcccacctgtcttctccctctgtaccacagcttaggttgtttttcttccctagagcgggcagagaagatgggccagaatctcaaccgtattccatacaaggacacattctggaaggggaccacccgcactcggccccgtgagtcaccactgtgggaagaagggttgtaaaaggaaataatcctggcctcttggggctgggttagggtgaagctgggtacctgacctgcccacactcttaggaaatggaaccctgaacaaacactctggcattgacttcaaacagcttaacttcctgacgaagctcaacgagaatcactctggagaggtgacccctgcccttcttgcccytccctcactaaacccccataaattacttgctttgtacctgttttaagtttttcctccagttagtgggcaaggaagtggcagcaacatttcaagcctcctaacccctacctgtcctgcagctatggaagggccgctggcagggcaatgacattgtcgtgaaggtgctgaaggttcgagactggagtacaaggaagagcagggacttcaatgaagagtgtccccggctcaggtagtgcaaggcgtaacctggaagctgctagttccaaggaaccctgaatagcactgaaagagatcttttgtactgggtctcaaccactccctccctcttctaggattttctcgcatccaaatgtgctcccagtgctaggtgcctgccagtctccacctgctcctcatcctactctcatcacacactggatgccrtatggatccctctacaatgtactacatgaaggcaccagtgagtagggatgttgaatttccttggggaggaaatggcagagagggagcctctctgaactatttgacttttgcctcctctcagatttcgtcgtggaccagagccaggctgtgaagtttgctttggacatggcaaggggcatggcyttcctacacacactagagcccctcatcccacgacatgcactcaatagccgtagtgtaatggtgaggccacaagctcactcctggcccaggccccaaaagccctttgcctatctatgacttacctccttctatctgttttctcttcctcagattgatgaggacatgactgcccgaattagcatggctgatgtcaagttctctttccaatgtcctggtcgcatgtatgcacctgcctgggtagcccccgaaggtgagtgaagtcatcatgtcgggaggtaaaaaaggaccacctcagaagtagtggaagggggcagagacaggacaggcaagggggccagaacagacaagccctatctctccagctctgcagaagaagcctgaagacacaaacagacgctcagcagacatgtggagttttgcagtgcttctgtgggaactggtgacacgggaggtaccctttgctgacctctccaatatggagattggaatgaaggtgagagcacaacagcatacatttgtgttgcgggagtggttggtgatggtgaaaataactgtagtgggccttggctcctcacatatttgttcggatatacagtaatcctgtcccaagggccagtggcttctctctacatgacagactcaaattgtgaggctgctttttttcttgtattcgcaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcytgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctyccaacatgggagggatcagccccgcctgtcacaataaagtttattatgaaaacaggctggtgtggggacatggggacagataagtacatttaggttgggtggctcaggtgaagtagtgcggcttcttcacattgatgccatactcgctgagggcaggggtcaagtcctccatggttagagtgtacttgcggtcctgagggaagagggaagagcaccaactgagcacaggaatcccggacttcaatcccagatgggtgaccctgagtaagtcttacacctcccctacgattcagtttcccsaaaggggtggcaggataagcctccactgttgtggaaggtaattactgattcattaagcctcccctcacaccttgctcttgctccgggagctgccggaggcygtgcccttcattttgcagtgctgtagggcatcattggcaatatctgagatgaatttctgggcagctaaggagatgagccgaattctagagagaaaaaacttagatgagaaggagatggacaacatactgcacaagcacccaaaactaacctgccctgggtttactcacatgcgtgggtctgaggcctcaaagccagcacggttcaggtagtaaccagtcactgcatctgggatctgagaaatcaattaagagaactgtcagcagagcgggaggagggtgagggaaatggataggcctgattatcaggaagctcacagtttgggtgagcagagggcaaacacagaagagcgactaggggagcaaatggaagagaacgctgaaaagcacgatgtggctgaaagttttgacagcaggctaggtggccttgttcgggcggaagcccaccgtaggcgtgtaatcttccagctgcatcaagaagtccaccaaaggcgtgctggacaccacgggcttcacgtctccgttggccgcgctcggcagtacgtaaaccccgttagatatggccccctccgggggcgccgcgccacccgccgacaccggagctggaggagaaccagcaaaatgagacacagaggtgggaggcgcagggccccagctaggtctgtctataccctctgccctcacccgccgctggacccagcccaagacgcttccctcgccctcacccgtcccggccctcacccgccccacgccgctcagctggctccccggcccgcgccgccaagggtcccgtgcccccagcagctgctccagccccaggtccccccgctgtccccgcggggctggccttgttctccgcggcggtgctggagggcagcgcggcgggagccgagaccgggggcgcggggcccggggccgaggcggcggaggccggcgccgcctcggggtccgcgccggagccgctgcagctcatcgggccggtgggagaggcggcgaacagagccgcttccgcttccgctcgcgccgcgcacaccccggggtgacgtcacgcgcccacgactcgccccgcctgtctctgttagtgctctccagcccgctccccgcctcctcccatagtggatctgcgggttagaggaaataggctgcagggcggagaccgagccttggcgaactgcgctgccgtagccattccgccctagcctctgccgtgctccgcggcgattccgtccagaccggaaccagcgtgcgtctggctctcctccgccgctctgggacacctcattctgtctgacgctcaagacctggcttcgacrtttatggccctatgtccctcgactacgggttgcctgcctgtctgcatcgtttcaagttcccttattcagccttttaaggattcatagtggatttggaaagccccctctcttctccgccagctgccccgagaggtgggggcagcagtggggcggcacacagtgctgctgtaggaggaggaggagtttcagcctgagtcaacaacatatgcaaaaatcacaacgaatgagaggcgtgaggttttcggtgtagcagacatttaattcttatttgccaactcctgagctaggacctgggaacacaaagttaaataggacacgattctagtcctctaggcaccaacggtcttggaaaggaaggcagacaagtaaactggccatttcaatactatgtggtcgttacaatgctagaggtaggcacagggggcgcagtgcaagggaggaagggcgttaacatctgccacctacttccaggtgccaagcactgttatcaacattattccactttattccctggtgattatgaaaggcaggtattgatattcacacttaacagacgaggaaacagcctcagggagataagcttacttgacccagtctctctcctagtccatatcagaaccaagattcaaacaggttttgtttagaaaatctaggatttttcagccataccaaaataaagtagcctcagggaatcaaaacattcacgaaagaaggtgacttctgaactgagtcttgcaagaattctggaaattaacctggcagttgtatcaggggtggtaaggggacggaacagcttgagcaagagtgagagttccttggggtttggggagggaggaggaaaaatgattttttacttaagaacaaatagcaaggaaggtttgtgagctatgattgggggctggaggggaaagcctgaattctatccagtaatccttgaagggttttcatccaagtggcctgatgggatttgcattttactctggaagatgacttggggattggcaggaagtaaggacactttttttcaagagaatatagccctaaactaaggtagtagcagtggggatataagtggataagttctagatatacttgggaaatataattggaaggacttgtggactgataaagatatatttaagatgtgcagtcagtaggacttgttgattgaggacttgttgattgaaggtggggtgaaaagatgacacaggtttctggcttggttggaaaaagcatagcatcatttaccaagaagaaacgagatggaattgtttggggttgggaaggtggacgatgaaatgttgagtatcacgcatcttacatttgaggtatcaatcattattggatagaaagtcttatttagtgagatggtaatggttgtagatgtcagtgatttgttccaggggacaatgagtaaactgagaagagcaaaaatctacaaatggagcaatgaaggtcagcattccatgaagaagcagaaattgatgagagaggaagacaagagtagtcagagaagttaagacctggaagctaagtaaggagagggagtgggcaactatgatggaaaggccataaagcaaagattgagaagtatgcactggaggccattgtttctggatgtcagggtaggaaagagtaaacggtgacagtagaggtctccttgcagtgaattggggaatgaatatcaagtgaaatagtgcacagagtctgtatacaaccctttggaaaagcctgattgaaaagagaaagatgagatgcggagggagaggcattcaaaaaatgctagttacagcatcttattgaggaatctaaggcaggagtagggagacctgagtatgatggagcatggtagggttgggagtcaagtcaagctcacmgcatttcrgggttagggagataagctgtctgcagcagtcaatagttgagggttcagcagggcttccaacagggcagaataagggactgaactgccagcttcagggcaggggacaagccatctctcctgataggaaagggtcaggggttgagtagagtcttcagcaaagctgggaagttgggtgttccccagcctgttacagratcccagccaggaccagagcagaaaccctggccctctacctcttcatccagacaggactcatggcagccacgggttacctagggaggaggctggcatcagatctgggcctactagtaccagtacttaaagagtatatctcctcaccctgtactcacatttcaaaggctattccacaccaccctaactgcccccaagtcccccttagcactccccatagttgtttgaaaacgtccacacccttcccttccatacttacatcaaagagtcctgccccatgctgctggtagagccttgggttgagaaagccaagaggggggcggccactaaggatcctgtgctcattgatcaaggataggatccccccaaacactggagtagaggcctacaagagtgaaggtgcaagtagaggtcaggggttctgagtgattggactttttgggagtgatgctttaaagtatcagacatctctaaggagtcaggggttctaggtgcaaggtgttcaaggtgttagggggtaagggtagttcctgagtgagagtttggagatgggctgattctcaccgaggttccggacacccatggaatgggcactctgttgctgaccacccagtagccatcagaaagtgcagccacatctgggtaggcacggccactggcattgaagtaactggatggtggcaggtgggggctagagctcaggaacttcgttacagcttcctcctgaaaggcatttttgagtgagtattggcatgtggcctgcccagcagtcagctgaactgaggatcccccatcctcactcttaccctgcatccatccacacaaacacacgtacctggtatgaaggccgtgggaacacattgctgaagccaccaccactgatatagtcaacaatttcatttgtgatgaggaaaggttcctggaaggatgtgcctcccactgtggtgacataggggctgaggggagaagacagcatttggatagtaggggacccaaggggacctccaagatatgtggggaggggtgagtatagcccaggtcttgctggaggaactagactctgtggggaagcatgtatatgggattgactaagagattttgagccttcaaggcatggcccgaggtgactgtgcacacttttctctacagaacacccaccaaatcttccactaaaatgcctgggaactgacgaaaaggaacaatgggagctgtatcccacacaagagatttggggcctgggacctgcaggaagaagagacaggagtacagcaaccagggcaggcaaagcttaaggctgaaccacaggagcacatggtggggtcaagacaaaggttctacatcatgagatcacaagtgaaaggtggtggttatacctgagtggtaggctagagtacttacctggaggcagggaaggtagggcggaactggtgtcttccagagacagaccaacacccggccccactgtcacctgagagagaccaagtgtagcattcatattaattggttagggcttagtatgtgggttcggatgtcagaggggaaatttgttactgtaggaggtcagagtgtagaggtcaggtcagtggtccctactggaaggtctgagttcagattatgagtcagagaccaggctcagggatcactgtggagtcaaagctcccaggctgcagaggtgtaagcgttgtctaagtttagggtaggaggtcacctgaggcgaagagcagggtgagaccccgagcrgcagccttcatgagctyagtgttgacccgctggatgtaggcgctgctgagggagtcctcatcatctccatagctcacagtatgcacatgtggcagggctgactcattactgagcagcatgagccactgcaggaagggctcctgtccctcatgccggcctggatttttttttttttttttttgagggatgggcacaaagatagtcactgggggttgtcaggatctctctccagcttatagcattcccttgagggagcagggatcaacacccatctcccacccccttccccactgtccagtcctcttggtagtaccagggctactgtagacccaggtggagatgttggcaccagcactcatcaggtackgcayatctagactggcctcaatcccggcccggccccggccctgttgtccaaccacacgggctactgatgcctgatgtgcaaagttgccaccgaagaggcgcatgaactgagccaggtctgagtcatggaaatactgctccaggaactatggagggag

SEQ ID NO: 12340 - DNA, 35344 bp, Homo sapiens
gcttgcagaaaagtccagaaatgagtactctgttacagggccaggactagggcgagagcagtgaggcatactactgaggtgcaaaatgtcagggagtgtccaaaaatgcagtaatcaagataaataatacttgaatgcaatgttttaaaatgaaaagttaatgcaaaaaacacatggtgagcaaaatgtcacgttttaaaaataaatatgggatcaggcagtcgctcgcgcctgcaatcccagcactttgggaggccgaggcgggcggatcacctgaggtcaggagtttgagaacagcctggccaacatggtgaaaccccgtctctactaaaaatacaaaaattagccaggcgtggtggcgggtgcctgtaatcccagctactcaggaggctgagacgagagaattgcttgaacctgggaggcggaggttgcaatgagccgagatagcaccattgtactacagcctgggcaacaagagtgaaactccgtctcgaaaataaataaataaataatcgacctttggacttgcacagcataacctcgctgcttcaccctgatcctggctgtgatgaaacaccagcttctggacttttctgcaggtctccacacttttcttggctgtgggtgcagcatctccagggtttggccaaaggggtggtgttctccatgttctctggctttccaggggacaaacagtgccttctcattcagtcaatggacatttttcaggctggaattctctgacccacagccaagggaagtaatcaaggtggctaggcaggatgtctcctggccaacagaactaacaagagttcaaattcacattacaaggcagctgaagctcctttggtggctgaacctccttgatgcggacttacacccctactgtattcgttaccttttccactctacaaactttggtcactcatccctgcatccattcatccctccttccacccatccatccaacaatacagctgttggtccatcttgccatggacagagccgtctatccagccatcccttcttctattcattcatccacacatgcatccaaacacatagccaggcacccaaccactgagccaatcccctaccgacctaccatataaaatcagcctgtggatgtggaaggagtcccaccccttaccagcaggcctacttaacttctccaagtctcaatctcttcatctgaaaattgagtatgtgtatgctcataagggccttcacagggttgttatgagcagtaaataacaaaacccatgtgaatggtggctattatattaccatggtaagaaaatgaatgtggcgaaaggcccagcttgtctgctacaatgttggctctaacaggtgatctggaaaaccagtcaaacctgtagttaacagttgtggggggtgggggaggggggtgataaagttgtgttatcctttttgttatccccagattcagcttaaggaaaagaataaatggatgtggggcaggtaacaatgactagaacattcatgcaggaggcattctgcatgcaggcagtgactgcagattccaggacctgtggttagcggactcctattgatgtttctgggaactctagacctggaagttcaggtaggtaggcaagcctcaggactcatcgtcatcacttgttcccatggggcaaatgctttagtggagaactctggactcaggtagccaggggttcatgcaggggttcaaatcccactcttacttacttgtgtggccttagacaatgtacgtaagtgcctcaattaccccatccgtacaatggggattaagaagtgaagattctgctgatacggtggctcaggcctataatcctagcactttgggaggccgaggcaggtgggttgccggagctcaggagtttgagacccgcctgggcaccatggagaaaccctgtctccactaagatacaaaaaattagctgggcgtggtggtgggcacctgtaatcccagccacttaggaggctgaagcaggagaattgcttgaactggggaggcggaggttgcagtgagccgagatcgtgccattgcactccagcctgggcgacagagcgagactctgtctccaaaaaaactaaataaaaataaaataaaaggtgaagagtcacaaagtttatttgtgtgaggcacttggagcagggtccaacacatccccacaagaggtcatgactctgaccatggataggcctgttctttgcccttggcctcccagcccccatatgcaccagaccttcagaccaatgaggcacctgccagtttgggtgtttcatctggtgtattggtttcttcctattgttgtgttctaattaccacaaacttagaggcttataatagcacaaatgtactctacggaagttctgtaagtcagaagtccatgtggacttggttggttccctggagggtctgggggagaatctgcttccaagctcattcagagggctggcagaatgcagttccatgctggtgaagggctgaggtcctggtttccttgctggctgtcactacggttatttccagcttctataggttgcctgtgtaccttggctttggccctcttcaaagccagcagtggcagatagagtccttctcatgattcagcgctctctgaccccacctgcctcatcccccctctgacttctccgacctctccttctgccccctctctccgactcttctcctatgctcttctgcttctaaaggcccacatgattccacagggcccctcggataacccaggataatcctatttaaagtcagctgattcaaacgttgattccatccgcaaagtcctccatggcagtcgctagattgtgcttgagtgaataggaagctttcgagttctgcctaccagccctgtccagccaagactgtgccagcagctgcagtcctcagcctcatttctgtagaggtgcagaggactggaaccacggagaagccctccagccagctggagccagagggtcagacaaactcaccatgaaaagtgtgtgcaggtagcaaaggataaaaagcacacaacggagcatcagaaaagcccatgcatggggggagtctctattctggtgccatgctcagggccaggtattttacctataattatatttaaactgcatgaccgtatctaactaccctggaaagcagggatacttgctccattttacagatgaggaaactgaggctggtgggggggaggcgggggggaaccatttgcttaggtcacacagtgaatctgtagtagggctagaaccaaacattggtctccaattaaccaggtcagtgccctccacatctcagcacccaggggccctggcctgctggaacgatccacaaaggagggtcaccagggacctagcgcaggaggcagctctggggcctgaggtctagcatgcagagctttcaattctgacatcctccaagtggctgggatgggcagaggggtgaagcattccaggtacacatgaagggcaggacatctgcctagaaggacacctttatcccaaggccagcgacttctgttccaaatagtaaccgagcagggtcttttctgagacatatgcctcaaagcacagagagactggtcacacccagagaggggcatccagacagagatggagtcacaacctaaggaagatctgctttatctgaaaaaaggtgcctgctggagctcaccctggttccatggagattccatgtccacatgccacactggccacaggagaggagagagactgtgggggaggctctttaaatgcagatttctgagccctacccagacccagtaggtcatatcccaggaaagaagtccaggaatctgcttccccaggtgcctgagacacagagtctgggctagaacatcaggggatgaaacaccagtcggagggaggccacgagagagctcagatctggctctactcacaggttggaaagatgcatttttaaaaagagagggaagggcacagaggctcacatctctaatcctagcactctgggaggctgaggcaggaggatcacttgagcccaggagtttgagaccccatctctactaaaaatacaaaaaaactagctgggcgtgatggtacgagcctgtggtcccagctactcaaaaggctgatgtgggaggatctcctgagcctgggaggccaaggctgcagtgaactgtgatgatgccactgaactccaacctgggtggcaagagagccaggccctgtctcaaaataaataaataaaaatttaaaaatgaagagacagagaaagagcaagcccagagcagagagcactgcagtaggtcaaggctgggttcagacactctctgcgcacagactgggaaagttaccatctactcttgtggcctcagtttcctcatctgtaaaatggggggtcaacaacatgccactttgcaaggtgatgatgtaagtgaagaacagggcatcactgggcatttgaggctacggcacaggctggtctgaatcaccctctcctcacccaaagcagtgacagcaccggcctcctcagcctggaacgcacgttcttctgtctgtctcacacccagacccttacataccatcttctttagctttgcaaactacagagaatggccctacagctcttaatgtagcttcctcagcagaaagactaaaatgtctgttgagggggcaaaacaattcacaaggaggtcgtctagcttcttcagttgtaagtccactccaagcaaaagggaagccagggaaatgtggttaaccagggcagggagacgtggggagtgtgggggaaagtctgaggtggagacacacagggacatggggggtatgaggtggggacaggcagggagatgggggtgcaaggtggagacacgcagggacatgagggggtgtgaggtggggacaggcaggaagatgggaggtgcaaggcggggacaggcagggacataggggtgtgaggtggggaaatgcaggaagatggggggatgtgaggtggggactggcagggatatgggggtgtgaggtggggacaggcagagacatgggggtgtgaggtggggacaggcagggacataggggtatggtggggataggcagggagatggggggtgcgaggtggggacaggaagggacataaggctgtgaggtggagacaggcagggacatggggggtgtgaggtggggacaggcagggagatggggggtgcgaggtggggacaagcagggacatggggagtgcgaggtggggacaggcagggacgtggggcgtgcgaggtggggacaggcagggacataagggtgtgaggtggagacaggcagggacatggggagtctgaggtggggacaggcagggagatggggggtgtgagttggggacaggcagggagatgggggggtgcgaggtggggataagcagggacatgggggtgcgaggtggggacaggcagggacatgggggtgggaggtggggacaggcagggacatagggggtgggaggtgggcacattcagggagatgggggtgtgaggtggagacaggcagggacatagggggagcgaggtggggacaggcagggagatggagggtgcaaggtgaagacaggcagggacatggtgtgaggtggggacaggaagggacatgaggggtgcgagttggggataggcagggagatgggggggtgcgaggtggggacacgcagggagatgggggacgtggggatggcgacaggctgggagagggagaggccaggctgagacctccccgcgcggtgccagccagtccaggcagatccaggactcagccaggcctgatacccagataagcccttcctcccagaggagataagggagcgacgcggccggccgacaggtgaactagagctggcgagttagtcggcgccgccccctcccgcgagcccggcctcgggggagtaccgcccaccccgccccgcgctcgctccgccccgcgctcgctccgccccttcgcgctcccgccgctcctccacgctcgtgccgcccccccccgcgctcccagttgacgctctgggccgccacctccgcggaccctgagcgcaagagccaagccgccagcgctgckatgtgggccacgctgccgctgctctgcgccrgggcctggctcctgggagtccccgtctgcggtgccrccgaactgtscgtgaactccttaggtacgcagagggcgcgccgcccgagagggtgctagcaggccctagagtggackctgggagaacttggccaggggcgcactgggctccggaggaacggggcagagctttccccggtgagaggccaggaactctgcrtgctggcacggggaggggtaaactgcattataggcgggggttctcggagggtgggcggcttgtaggaccagaggagcagatgggctgagtgtccagggtcccacctagccaggtggctctccagcctagaataccaaaggagcccgcagctccttccgccttccycaactggggacacagagtgtcacacagaggactctgatctgtccctgccagaggtgagcaaggacgtcccagccttctctagcagcttcccccgggacttggcacacaggggatccccgtagtgtcttgggagtcccatctgtagagtaggttggacgggctgtttggaacagtgaatccctgtgcaacggcaccagggaaagcactcagaccaacagcgcttttaacagcaccccagggcccatggcgtcaggtggagccccaggactcctcttgttggccaggttggctgcgactggtccagcttcgtgctgcccttgcatcctgtctactgcccgggctcaggcacctcccctggctgaaggcaaggagcctgctcttccctactgcctccctcctttcctactgtccctggtcccagcctcagcccacaggctctgaacttaaagaccacctgcccccttcacmgagaaaagtagccaagaaacaacccaaggagccaagaacctagggagggggggtgccctgagctctggaggaacgggacagggctttcccccagctagaggctcaggggatgggacagagatcactgaggctgaatctgggccagagggttgcctcattccttcccacctatttatttaaaaagctccccagccttgcaaacctcagtgggcgcccagctccaggtcagttcccgcctaaggaaaacctagctgccgcaagcgagggctgcctggagaaggctggcgctgagaggctgtctgaattccagagcagggcttggcaaactttttctgtgaaagaccagacggtaaataacttaggctttatggtggtctctgtagcaactactaactctgccatggtagtgtgatagcaaccatagattgtatgtaagtgagtcagtgtaactgggttctaataaatgatttttatggccactgaaatttcagtttcaagggatttttgggtgctacgaaatatgtttcttctaaccatttaaaattgtaagaaaccgtttgtagcccaggagctgtactaaaacaggagtcagggaccggctgcggtggctcacacctgtaatctcagcaatttgggagaccgaggcagtcggatcactttaggtcaggagttcgagagcagcctggccaacatggtgaaaccctgtctctactaaaaatacaaaaattagctgggtgtggtagccaggtgcctgtaatcccaggtactcaggaggctggggcaggagaatcgcttgaaactgagaggtggcgatcactccagcctgggtgacagagtaagactccatctaaaacaaacaaacaaacaaacaggggaatactgtactttcctgaaacctgctgtaaatccaggcaaggtattatggcacttttaaagtcctgactagattggaatggatctattttagggtaaggcacggttcaccagcagattattctggccccagaataatctctccrgaggcaaactggtagtcaattgtcctaaactcaaaccctgcctccaactcttgtcctgagttgaggtctgtcttcctctaaagccctcagctgcagcagggcccttaatcaagatctggaatcccctgaaaccctaaagggagccatgttgaggaaatgtgcattttccccagggaaaacggccatagattggtctctggaacaggttcgagacccaaaaacggagatctaaatgctgtgtggtagtgatcttcacactggaggtatggatccttggggaaacacgaagatatttcaagtgatgccggcagagagtgttctggaaatccatttacagaccttttatttccaagtgtcctctttgctaaaactgggagagagcccctgaaggcaagggggaacctctttcctctcattcaatctgaacctgaacccatgggtataaaaacaatagggacagcaaacaaaaagacaaaacggtaataaatygttcatatctggcattctcaattcctcaaggaaactgaattgaagaggagaggacttcatggggatatcaactgatgaggtcttaaaaataaygttgagtgaggccaggcgtgggggctcacgcctgtgatcccagcactttggtaggccaaggtgggtggatcacctgaggtcagaagtttcagaccagattggctaacatggtgaaaccccatctctactaaaaatataaaaattagccgggcgtggtggtgggcacctgtaatcccagctacttgggaggctgagatagaattgcttgaaccagggaggtggaggttgcagtgagctgatatcgtgccactgccctccagcctgggcaacagagccagactccttctcaaaaaaaaaaaaaaaaaagaaggaaagaaagggagggagggagggctgagtgatagagcaccatgggattrgatgcacagaaaggagtgcgaagaattaagtggcrttgctcttaaaaactgcctccattcccagctgcttatttgagcagggtttcccagccctttgacctataagaaacaaaaataagascagaawtaatgctgaaccttttctcaaccaaacaatattcactcatgaaaatataaatccattgcgggggatgggcagtagagtactgtttatcacattaagagatgcatttctgrtacaattttacttttgatgtttaacaattacttttcataatgtataatacatttgaaatgttttaatcagttgggacactaataataattatgattactcaatccagaataaattttttttttttttttttgagacggagtctcgctctgtcgcccaggctggagtgcagtggcgtgatctcggctcactgcaagccccgcctcccgggttcacgccattctcctgcctcagcctcctgagtagctgggactgcaggcgcccgccaccacgcccggctaatttgttttttgtatttttagtagagttggggtttcaccgtgttagccaggatggtctcgatcttctgaactcgtgatccgcccgtctcagcctctcaaagtgctgggattacaggcatgagccaccgcgcccagctccagaataaatttttataatattcacagatgtatgggtcacaggtagtaaaaacatttaattttttttttttttttttttttttttttagacagagtctcgctttgtcgcccaggctggagtgcagtggcacgatcttggctactgcaacctctgcctcccaggttcaagcaattcttctgcctcagcctcccaagtagctgggactacaggtgcatgccaccacgcctggcttatttttgtatttttagtagagatgaggtttcaccatgttggccaggctggtctcaaactcctgacctcatgatccacctgcctcagcctcccaaagtgctgggattacaggcatgagccacggcgcccagccaaaataaataatttaaatttaaactttttgttgttgttgcagaaaagaatgtgaaggtgatcaagcataaaaatgtatgttcccttaggataaaattctgccaggtggggatggagataggtgttcaacaagaaaaagaaactctgtataatatctgactcttttttgttttgttttctttatttgagatggagtttcgctcttgtcacccaggctggggtgcagtggcacaatctcggctcacagcagcctccgcctctcrggttcaagcgatcctcctgcctcagcctcctgagtagctgggattacaggcgcctgccaccatgcccagctaatttttgtatttttagtggagctggggttttgccatgttggccaagttggtcatgagctcctgacctcaggtgatctgcccaccttggcctcccaaagtgctgggattacaggcgtgagccaccacaccccgcctaaatacctgactcttatagaaaagtttgttcatgttactgatggtggatatcaaatcatcatggtatttagattccactggctagctttaaaagaatgatataacaatcttatttttagagatttttttttttttttgagacaaggtctcactcctgtcacccaggcaggaatgcagtggcgctatcatagctcattgcagcctcaacctcccaggctcaagtgattctcccgtctaattttttttatttttttgtagagacgaggtctcactttgttgcccagactggtcccaaactcctaggctcaagggattcrcctgtgtcagcctcccaaagtactgagattataggcttgggccacactgccaggtgttatttttaaatctcaatatttataagttggaatatgtctttggaggtattcaaatttaaaatgaaatgtttagataagaacatacatggggaaatacggcaggaatccaaaaacaaatggctggcctgcttttgtaaaatattttgtcttgtttgttttattatgtttttgataatatctgtacatatttgggggtacatgtgaggtttcgtttttgtgaagtcttgcgggaacgcagtcctacccattaatgttcacagtctctgtggctgtctctgagccgcaggggcagagttgagtagttgtggcagagaccatatagacggcaaagcctgaaatatttactacctgtccccataaggaaaaacagtgcttgcccttggaatagataggtttgttttttgttgttgttgtttttgagacggagtctctctctgtcgcccaggctggagtgcagtggcacgatctcggctcactgcaacctccgcctcccgggttcaagcgattctcctcagcctcccgagtagctgggattacaggcacacaccaccatacccagctgatttttatatttttgtggagacagggtttcgccatgttggccaagctggtcttgaacccctgacctcaggcaatcggcccacctcggcctcccaaagtgctgggattacaggcatgagccaccgcgcccagctggagtagatagctttttaaattaacttcttaccgaaatataacttcatacagaaaggggcacaaatcattgagtatgcatttccacgaattttctcaatctaaacacactcagttaaccagcgcccagttgaagaaacaggatatgagcagcatcccggaagtgctttctgcaccccgacccagtaggcataaccaccatcctgactttcaacaccattgactaatagtatatactttttcacattaatttggggtacaaaaccaggaagagtcggagtttctttttgcattctgcattatataacaccatttttggtgttttaaatttagyccagttttcgaaaatgcaaatcagttctaaagtgccctactttgctatagactcaacattactgtgatgcgcccagacctaattttttttttcttttyacagagaagtttcacttcaagtcatggatgtctaaggtcrgtgcccaacttcttctttttgaagtttttcatttcacaaagtttcctgttatcaaaccaaactgtcccagatttgagacaatgaaaaagggaatttccaactttgcctagtggggtctttccagaagttgaactggccaaacactgggaaagatgcagttaagtaaattccttccaaatagtggtcccaagtgattaacttggctgacagccttccaagccctgggattcatttctgtattttgttttcaaagcacattgtggagaatgtaaattagtacaaccattgtaaaaaaacagtatggaggttccatcaaaaactcaaaacaaaactaccatatgacccagcaagcctactactgagtatatatccaaaagaaaggaaattagtatattggagggatatctgcaccctcatgtttattgcagaactagtcacaatagccaagatatggaatcaacctaagtgcctatcaatgggtaaagcaaatgtggtgtatgtacacaacggaatattattcagccataacaaagaatgaaattctgtcatttgcagcaacatggatggaactggaggtcattatgtttagtgaaataagccaagcatagaaaggcaaatattacatgttctcactcgtatgtgggagataaaaaagtggatctgatgaagaaagacagtagaatggtgactagcagaagctaggaagggcagggaagcagggatgaagataaactgattcctgagtacaaaatatttttttttttttgagacagagtctcactttgtcacccaggctgaagtgcagtggcacactctcggctcactgcaacctccaccttctgggttcaagcgattctcatgcctcagcctcctgagtagctgggattacaagtgtctgccaccatgcccggctaatttttgtatttttagtagagatgggggttcgccatgttggccaggtgggtcttgaactcctgacctcaggtgatccacccgcctcagcctcccaaagtgctgggattacaggcgtgagccactgcacctggcccaaaaataattagaagaaatgagaccaagtgttcaaaaaacaagtagattcaactgtagtaagcaatcattattttgtatttccaaatagctagtagagaataatttgaatgttcccagcataaagaaatttttaaagtaatggatctcccaatgaccttgatttgattattacacattatatgaatgtatcgaaatattacatttaccaaaaaaagtacatcagttatatatcaataaaaaattatacacatttgtttttagaaaaccaaagcacactgtgtactggttgcagaatcagttggggaacaccagtgcatgtgcttttgaaaaatggtgatctttgctgtaaacttgacccagcaccagcagtggcgtccaggagtgccccacatgtggcaggtttgttcaccagtgcctcttggaccacattctgactttcacgcagctgcatggtcttcattctggccacaggtccctgaaaacggggttgttttgtaacttcccaaatttctcagcagtaccccgcccattaacacagatttggcctgagaatcatagcagaaagaaaaccttcatctttcctcttaggaaaacaaaaaggtctccctctagggagctgcagcctgtttccatgacttgctactggcgtgttttgttttagcaccgtaagacctacagtacggaggagtaccaccacaggctgcagacgtttgccagcaactggaggaagataaacgcccacaacaatgggaaccacacatttaaaagtacgtggaacgcctyccttccttcctggaaggatgtcagttagtgacccagcccatgaaagggcccgctgggggctggtgggtggagggagcagaagcccaggctctgaagctgtgtttggctgacctcagattgtggctccgctgttactctctgtgtaatgtgggatcgtaaatttgggacaaagccggtacccctctgggtggttgtgaagtttacaagagactctgtagaagcccctgccccattcctgccatctgagggtccagcctggaagccaaggtctgtctttggattgttgcggggggtaggggttgctcatgggctcagagcagcccctgggagcatctgccttcactccggattaatttcactagaaactcacataggccgggcgcggtggctcaygcctgtaattccagcactttgggaggccgagatgggtggatcacctgaggtygggagttcaagaccagcctaaccaacatggagaaaccccatctctactaaaaatacaaaattagccgggcttggtggcgcatgtctgtaatcccagctatttgggaggctgaggcaggagaatcacttgatcccgggaggtggaggttgcggtgagccgagatagtgccattgcactccagsctgggcaacaagagtgaaactccatctcaaaaaaaaaaagaaactcacacgcacgtccagcgtattttctgaggactctgagaaatattggtagttgactaaattggtaataaaggcatcaagcatgagctggaaagaaacttgggcttgaacctcatttctgcccagtcctagcctgtgacctccagggatgctaacatgggcagtaaagaggaaatgagcccaggtgtggtggcccacacctataatccctaaagacagggtcaggagttcgagaccagcctggccaacatggcaaaaccccatctctactaaaaatacaaaacttagccgggcatggtggcaggtgcctgtagtctcagctactagggaagctgaggcaggagaatcgcttgaatccgggaggcagaggttgcagtgagccaagatcgcgtccctgcctccagcctgggtgacagagcgagactctgtctcaaaaaaaaaaaaaaaaaaaagaaaagaaaagaaaaagcagaaatgatcacgcatccctgctggggctgtgtagagaccaaattaggcagcaggtgggaaggcccctggcaccagtggagtggttctttacctagctatccatcagactcacgaggggagtatctaaaaaagtaagtgcccaggccccaccccagaccaactgcattagcatctctggagtacggcccggacatctataccattgaaaaagctccccaggtattttggcagcactgtaagggctgattgaattatctactgaattatattaaatacaaaaacttaaaggagatgggttgcagtggttctaaatacgacacaggtaaacaggaggtttcatcactttttcttgtttcttcattagtgattcactaaccatttctgttttggttttttccttctcttttgtagtggcactgaaccaattttcagacatgagctttgctgaaataaaacacaagtatctctggtcagagcctcaggtaggtataattcattgcaaccaaatctgaatccttttactgaaacctttggaataaatttggagcctgctctgcttctaggcagattcagtcccatccccagatgcagctgagggtatccccagattctttgggggaaccagaagagtcagctctcagcagttcctcagtccaggcccatggccttagcattgtggacccttaacttagggctaccagattaaaatatagatactcagttaaaaatgaatttcagatacacaacaagtaattctttagcataagtatattctaaatattgcacaggatatacttacactacaaagttatttgttgtttacctgaaattcaaatttaactaggtgagctgtatttttatttgctacatctgtctaccctatcctaatgctctggactctcaaggggacatgtcatttagcacttgggaccagtagacaggagagggaaggttctgagagctgcagcctttcttattctctcttggtgattccatgtttatacatttcttcttcttgttgtcagaaaggtttttggttttgtttattttcctgaaaataatgtgtttggttgttccagaattgctcagccaccaaaagtaactaccttcgaggtactggtccctacccaccttccgtggactggcggaaaaaaggaaattttgtctcacctgtgaaaaatcaggtatgcctggcaatctccatcctctccctgcaaaacggccacactcccagacaatacaccaggaagaacaactcaaaaggtccacaaaaccaccacaagcacatccctgcctctgtttcctctcggcatctctccagccctcttcctttgaggggccagggaggtcagcacttctctaggctgctctggaggatgcaaaagttcctctktattgggctaaagtttactcccttccttccccacgccccagattttcccattggtcccaggtctctcctacagagccatccaaaacgttatgttccctgtgcccatctggacaccagaaccccatgcatctcctcttcccgcctccatcttctccgagccaccagggtccagcccctgccctggctggccgcctccctctggttagtccatgtgtcatgcatcagcaagcttctcatggcaggggctggcctccgtggcccttgctgtggggcacagagggcttggcaaggtgagaggccctgccttcctccatgggggagcagtctgggggcatctcagcacaggccctgtcccagagagtctggaccctgcccccgctgttctcccggcctgctgcggcccctcccctagcagggaacctgccgtggccttcttcagaaggatgccgacctctggactctaggaaatatgaggtgaaggtttccttcctggaaactcctggctttccatcgaaattctccatgagaaatgttttttcactttccaaaaagccatccatgcagcacagctttaaagcctcccgggcttgcagtgttcctggagcctgccaagtgctggatgtttaactagcatcaggagccaaagcaaacctccccttgcagcaggaggtggagtagaagcctgcctttgccccgtgacatttttagaccctctgagaaccacatgacaattcagagcaacacgtaacctaaacctgcccaccacttggacaggtgggaaagagaggcccaccaagaattttccaagtcctcctgttaactgatcctgggccatcaggcaggacgcagccggctgggctaagggagcggaatgaggtgcttcctgacgcagatgtgtgccgtctcttactgtggccgctgtgtggggatagagacggacagcagccacagcgtccatcagctcagcaccctccttgagagtttctcactttacagagggagagcctgagagggagggtggtttgcctgaggtccaaggtaagtaagtgacaaaggggactcaaaaccaggcccctgccccaagtcgagcacccaagggtcagccgagctccgcctccttcagcagtgagcttagtctcccccgaagtggccacgtctgcctcgttgactgtctcatggaccctctcaccaggccgtccctccctcccccagctgagagagatatgtgaagggaagagattgggtgaggccagtgtcaacctagggtgatgacctgggaggcaggtaggggacttaagagacatttcagaagtagaagctggaagactgaaccagcaaggtgaggaaacagagatgaacctgagagaaatccttacagcagccaccagcattgtgcccacgggggtgactgcctgaccagcagaatctgacttaaccctgctagcgccctgcaagcaggaaccctcgccattcccactttacaagcaatgaagccaaggcttcgagaggggaagtgacttgcccaggtcacccacctggtgtgtggcagagctgggatgtgaaccaggcaggcaggctgcagccccccacacctaatcctcatgttattctggaggtgttgtgaataagggggctaggcagcggcaatgaactgttagaaggtggggaaatgggtggatggggcgggtcccccagagtctggggtgtcaggggtgtctgggtggggttgtctggcagttagttggatgtctgagcctaagtggaggtcagcactgggctagggtttggggagctgttagtttaacaggactgggcagaagagactggaggtggaaaggtgagagaaggttctaaaaacagaactttggggcatccttctgcagggaaccagtagggaaaagaggagccagtgaagatcgagaaggaagagagccagaagactgcagaatggggtgggggactccaggccctggcagaatggtggggattggccaccaagaggtggtgattgggagtccacaggcactggtcagaggccacctgctgctcctgctcctttgcaagcctctcaggacttgcgaggctcagaatgaatggatctggaacagggcttgcgagcctcagaatgaatggatctggaacagggcctgcgaggctcagaatgaatggatctggaacagggcttggtaaactgccaaggcacctggggactcgggagctctggcagggtcagcagaggaaggcagaaggcagggctgtctcacggcgtccccatcactgatgtcctctgctctcccctggcctttccagggtgcctgcggcagttgctggactttctccaccactggggccctggagtctgcratcgccatcgcaaccggaaagatgctgtccttggtaagaaatcagccacaggcgaccccctgcrgaggacaccccatcctgatgtgggccaggcctgggcctttggtttccctggagcattggctaagggtgctgtttcaggtggacccagatgccccagccttgtggacatctggcatgagaatctcaattgatgcttttcccgggaaggatctgagtttattaaggaaccggcccaagggctcattcctagatggatctgggtggtccttagcttgacagcctggagccttcccggcggaggggttcagaaaggcggagcctgcctggtgggtagccaactaggagctacacccttcccagcagcctcagttgtcttcatgagggaagagccgggacctatgcatccatcccctcgcccacaagagacggatgatgcccctgaaggaactatcctagcccctgcctctgtggagaaaggagggacagtgcacagccggcctggtgatgccatgaggaccctgggttgtggacaggtgggrgtagggtctctggctgggcctgtttcccccatcctatacaccgctgtgggaccccacactctgcatcgtatgggcacacctacggggcaggggtttggacccaacagcccttgccccctctcaccttccctggctgcccctgcttactgagcccctcccgacatgtgccagctgctgggctggcactgcaggacatacagcaactgtccctgcccttggggagtttataatttggtcaccttgacacagcactgacggggcctcagatgtggctcagccagggaggcttagcgcctcacgccaaagccttgacggcttctcagctggcaggtcactgggttgtgtccttcttccaggsggaacagcagctggtggactgcgcccaggacttcaataatyacggctgccaagggtacgtctctgaccagaaggggcccaaaacttcctcatttcccactgaccgcttcgacaggatcymgtgtgtgctgggtctgccacagatataacccaccactgccctgggygatggcaaaatggtctctgttgtacaggggtggtcacctcacatggccaggtctcatagccaggacagggcagagctggaatctgagtccaggcctctgtcctctctccactgtatcacctggctctccacagtgcggttggcctcacccgccaccaaggcctctgggagtgtggccaaaagaatttaatagagtgagcaacacaccattacacatcatcctccaaacccgagatscacacacagatacagggttggcctttagatgaactcactaaagtcccagcctcccaagctcattgcgccctgtgagggtgaggtggctgtgtgtaagggctgtaccttgcctggacctgctttcctggcccactgtaaagcaggttgccaggaatttgctgacatttctacagtgactctagccctcccttcatgcagtgctctgagacatttctgtggtctttgctcacctggcacatggtgtgcataaagccaggctcttggggtgccgtgcctcgactcccctccacctccctggggcacatccctctcccagaccccagcccctctgagctggctcttcctcctgcagggagccgtgctgcagccaagtcctggggacccaggggtgacgtcgtagcctgctctcagatccaccatcatgctcagtgtccccttacttttggtctgtttccactccacagcttagaaacccaacccataacaagagtctgacatttgggcactctggggtcccaccrtttttatttttttttatttatttatttatttatttatttattttttctttttttgagatggagtctcgctctgttgcccaggctggagtgcagtggcgcgatctcagctcactgcaagctccgcctcccgggttcaccccattctcctgcctcagcctcccagggagctgggattacaggcgtgcgccaccacacctggctaatttttgtatttttagtagagatgggggtttcaccatgttggccaggctagtctcgaacccctgacctcaggtgatccacccaccttggcctcccaaagtgctgggattacaggtgtgagccaccacatccagcctgtttttcaaaggagtctatttgctttggttcaggacagtacttccttttctcattcatacaacaaatatcacagagcacccgctgtgtgtaggccctggggatacagcgctcagcagaactggaagagcgggcattctggcaggctcagagagaccacagtcaaggctagactaggtcaggcggtgcggaatgctatggagagaaacagagaagggacggggattgctgggcagctgctgagtttttgtttattctgggaggccacatgatgtagaaaagacccacttttggaaccacttcccagctttagctgtgtggccctggccaggttattcagcctctttgcctcagccagtgacagcatccaccacacagggtcgacacgaggggtcagggagtcatgcctgggaagcacctgcccaggggctcggctgtggcgatgacagtgctctgggctgatgctgttgaccatggtgtggggctgtgcactcctgacagagcggctggccttaaggggtctctatcccactgaggcatgtttgggctggtccttggactccggtggcctcatctgagtttgctgagtcttatcccaaggctgggcctctcagagaccccctctgccactgggacatgcccaaccaagtccccagcctgccaggccagatatctcgccrcgccagtccccgagggccccgcctctatcaggacagccccaggtgggctcacctgtgtgtacttcttgcaggggtctccccagccaggctttcgagtatatcctgtacaacaaggggatcatgggtgaagacacctacccctaccagggcaaggtaactccaacagcctccactctgtcttcttggcgtacagcatgcctagcttcactccctccccagccttggaagacatcccttctcccccsacctccctcccgccggaattctcacaattgtctgttctctccaaattcttccttcccctcctccacccacctgagcccactgctctcaccagtccaggggcctctttatcattctcaccccatacccgctctgcggcaccatctctttccttcccgagccagacttctcaggacccctccttccccccacctgccccatcttcctggctcctctccctcctgccacgagcgccatcctctcgcctctgtccatgcagttggcctcttgtgccaaggaccctttgggggcccacccccacccctacsctatcaaggctgctgggcctcccaccatcacctccgcccagcctggccacagccaagtgccttgtctttccccaagacctgttgctcctcctttatttcccctcgtggtgatgagcagcactggcctccctcagaatttcccaggtgtccacagtcctgttgggccggtccccctctccaccccaccctgccgccagcctgctgaccaccacagacctcacatgactcccttggcccatctgtgtcgctgaccactcagaccggggcctccatccagacccctgagggtggcctcccccaggcctctcaaacccagctcagaccccacgcctgcctcgatcagaatgccgccgaggctccatgcggccttcgggagaaagcccagactccaactcagtctccctgtctcttttactctcccttctttttttttttttttttttttttttgagacggagtcttgctctgttgcccaggctggagtgcaatggcgcaatctcggctcactgcaacctccgcctcccgagttcaagcagttatctgcctcagcctcctgagtagctgggagtacaggcacccgccaccacgcccagctaactttttatatttttagtagagacagggtttcaccatcttggccagactggtattgaactcctggcctcgtgatctaccgcctcggcctcccaaagtgctgtgattacaggcgtgagccaccgtgcccggccaactctcccttcttaacctcacgcccaggcccagccacatgytggttcctaaatgccaggtcctaccctccctctagttctgtcccttgtcctgctgccttctctcctgccttgaaagggctgcgcttccctccttgtgaccttacccctgcacctgcctcttgccagcattgttttttgggctgagactgtccccactcccctgcctcacaggctctgactcggcctccacttctcagtgagtttcctcaggccgggtgaggcccctcctcaggctcccacsacacaccatgtgtgcccacctctgccaaagccagcacaggaccatctgctaccagaccctaagctccttgaggacaaggatgctttaattctctctgaaattatcccatcccccaggccctggcacatcttgttttgtttagtaaatgttattgaactgcgtggggaggctgagacttcgggtccataacctgtatttcatgccctttgcatcctcaacaggatggttattgcaagttccaacctggaaaggccatcggctttgtcaaggatgtagccaacatcacaatcgtgagtgccgatccccctctgggatggggaatgtgtcctgatgaggaggcctctctcatgctgtcggatagccagtgggcccagcaaggcagcccttctggcagcacatccctttgacgagttcatattatccctgggtctcagtcgctgtgatggtggcgaggcaggagatgggagggagagcgcaaactggcaggcaggccctctggttctgaactccagatccacacatgccttcattcttttggttctgttttcttgcttgtaaaatgcaagcaattgtccgcatcctgcagaagagggtatgagcacgtgcttgacacagcgtgtgtgaaactgaggagggtgagtgtgtgtcactcaggatgagccaggttctgttgcaataacaaccgtgcccaatctgcatggctgacaacagtcaaagggtgtgtggcactcctgcgcccatgcacagcttagggagggtggtgtgtgctccgtgtcattggcctcacgccaggactagagggaaagaaggtggtaaatgatgccctagctctaaagccaaaacaagccgcccagtcacagttgacctcaagtgaatagggaagtgtggtcttaccctgcttctcccagagagaactggaacgtgaatgaacgccttcgtgactgcagtgtgcatgcatgcaagtgtgggaggrtgtgtgaggagtggaggaatatmgcttaggttgtgtgtgygcccacgaatgtatgtacagttcacaaacgtgatgtctgtgtaatgacagcggctgccatttagttgaagcatgtgccaagctctcagcaataacatcttaacttgatggagtacttctaggtgctgtaccaaccctcaatacrcactatcycctctagacccgaactggccctaggagatgagtatccttattacctcatttgacaggtgaggaaacgggggctccaagtggttaagtaatgtgcccaaggccacagagctaggaaatagatgctggatttgaactaagaatgtgtcattccagaaccagggctcattgccttgacaacatacagcrcaaatcctgtactcaggatgtcaccctcttcagaatgttgctgctgtcactcaagctggctgctctgggccatgatatcccaaggacaggtgaatttgggcctcaaaggtatccctttgcatggtccccaggagagcctcattggtgacacctgcagggccctgacgaccaggccagaactagcattcagccctcttgggcaggcccatggggtggaaatrgtgccacctgcagaagtcatcgcccctgtgctgggctggcctctgtgccctccatgtctcagatatgccctgacctgttgggctcacaaggccttgtccacataccaggaaggagggcactcccttgccaggcacctgtttgcttttcacagctgggtctctgtccacccctctagggaggcaggactgagggaggctgggcgccccgtccctcctgcacttgctttccttcagtagggccctggcctcagcacaggtaacttcccccctcatttcagctcccagaggtctcttggttagtgcacttgaacccagccacccccaacccagaagctccaaaaagtgccaatgcctgggacccaccctgcagatactgttgtagttggtctgaggcacagcctggacttggggtttttttaaggttctgcatggggttctacctgctgctgtcacctggtctctgcagctctgttccaaagctgcagcctccaggaagccaccctgacttccccccacctaccttcccccttggaggggacaggttctactcagaagtcacacagccctcggatgggtcttctcgtttccaccgccatctgggacctacccgtccatggtttataacccctgtgttctagcagcaaagctttgtagactctgggtttatgggtgtaggggtgagagctgctggcccaggagaggacctcagggaatggatgtgaatgactgaatgagtaggtccacgctgtaccccgtggtccctatctcagagggtgcaggrtttcctaggagcagagttggggagaggaacgagagatggccagacagacccagccagagacaggaagggagagaggccgcaggggagctgcytctggccatccatgctgctctgggcctctagcccctagcttgaggcaaaaggctgtactgtgaaaggagtggggagrtgacaggccatgtgwttctgtctcggtcctgtttccacagtatgacgaggaagcgatggtggaggctgtggccctctacaaccctgtgagctttgcctttgaggtgactcaggacttcatgatgtatagaacsggcatctactccaggtgagtcagggtcccaggagccaggagggacagtggggaggggcytggtgggcctcctcacaccccactygtgggacttgggctcgtggcccagactcctgtgtgtcagacccttcatgacacctgccaggtgctgggcgttttgcacatccctcagttaatcctcacacagccccaagggccaggagccatggcctcttctcacagcaaaggagaggtggtcagaagggatacgacagacacaggccacctggctagtgagagctagggccaaaatttgagagctttgtgctccttaacagaagagttgcctccagtttaaaaaaaacccatgttcaggccaggcgtggtggctcatgcctgtactcccagcactttgggaggccgaggcaggtggatcacttgaggccaggagttcaagaccagcctggccaacatggcgaaaccccatctctactaaaaatacaaaaaaaaaaaaaaagccagcgtggtggtgcatgcctataatcccagctactcgggaggctgagacacaagaatggcttgaacctaggaggtggaagtagcactaagccaagatcgtgccactgcactccaaccttggtgacagagcaaagctctgtctcagaaaaaaaaaaaaaatacccatgtttaaagatttgaagacgtaaaatagggagaagagtagctgccctcacacactaggatcctgtgctggaggagtcaccccaggcttcttcagaaaaaccaagctttagcctctttactatggggtttctctcacccacaccttttcgcctgcctggtttgcagcctcatttccctcccttcatcagttgctgcccgttaacgtcactcactaatgtcactcacgtctgtgctctcctctccctccctgaggctctgccctggtcaccattgtccttggaccccctaaccccccacacactgttccagcttccactgggagctgtctgccttctgaaacactcctcttgccaacgccaacctttgaayacaccagtgtccctgctttcccagggtcctaccctgagggggaccctcatgatctggtcctccctctttttccacactcatctgccatcaaacccgtccccgccgttccaccctgcagcccccaccccagccacgcagaagggttcgcagttccatgggcgttccccgcctccacagggagccttccctgacccaccctgcccaccctcccccccccccccgctgggttggatcccccccacctcctgggggctctgtcgccctcccactgtcagagccctcaggccactgtagagaagcagcctctttgccaacctgctccctgccaaacagggcttccaagggacagttatgcatgctgcctggatcccggcacctggccctggcgcgagcctatggcccacttacacatcagctgaattcacacctgaccactgcagtttgttctcttgaatttcttggaatttccttatggaggctagttcacttttgtaaacagaaaaagttgtatttttgccataggtataaagtaatatttaataaatgcagtggcaacaaagcaaagctgtgttaaagtctgccagacactgttgcctacagaaggtgcagcaggaaggtggctctctccttgccaggaaagagggagtagaaagtgtcaggggtgagacacgggccagcaccatatggagattctcctgacagaagcagaagaaccaaaagaactgaaagggccgggtgcggtggctcacacctgcaatcccagcactttgggaggccgaggtgggtggatcacctgaggtcaggagctcgagaccaacctagccaacatgatgaaacccygtctctacccaaaatacaaaaattagctgggtgtggtggtgcacgcctgtaatcaggctactcgggagtctgaggcaggagaatcgtttgaaccctggaggtgaaggttgcagtgagcagagattgcaccattgcactccagcctgggcaacagagtgagactccgtctcaaaagaaaaaaagaactgaaaggagttctctcacggagactaaatgtgattacatcaccaccttacatgcctccctggtccrctgtggggaacattgctctaaagcgctcaaagaggcgttgttggatgggactgtcattgcttttatccttcccatatgatcacctctttttgaattttgttttccagtacttcctgccataaaactccagataaagtaaaccatgcagtactggctgttgggtatggagaaaaaaatgggatcccttactggatcgtgaaaaactcttggggtccccagtggggaatgaacgggtaagcagctcccaggtcccactkctgggaggsggatgttgctcaggcctggaggccctgggggcatcacttccacctcagagttackgcttccacrgacgagctggtcagccaagccctaggccaggccagggggaaagggagcatgagaatgtagcctccacatttccaagcccccatttgcagccctcacagggccccaggtctttaggacrctgcagggagagcaggaggccagctggctcagaaggactgctaggaaaacagctcagaacttggaactctgctggcacgaaatcagtgtctgggagggtccgtctttgagaaatcaaagcaacaaatgtacccctgatcactgacagcccctccttccgggagaaaaggctggcatggggcggcctgggtgtatatgctgctgtgcctttgtcctgtcctcccagattccatgtccttgtctgaaaaggagmgctttcctgttccctcgggctcctggtgataaaatagctgtgtgagsgcccggccagggctaagagggggccctcggtaaattttcgggagaagtgggatatggatcattcatttggcagctaaggagagggaagaatgaattcttcacaaagtcaggtccgtgatttgccggtgatcaaataagccraatgctactgttttatgaataaatttagagggtctcacccctgaagtcagctcttggtgagcagcaaaacattctagaaaggcctgtggtggggagaccgccggccgggcctcagctcctctttctgcccaggtacttcctcatcgagcgcggaaagaacatgtgtggcctggctgcctgcgcctcctaccccatccctctggtgtgagccgtggcagccgcagcgcagactggcggagaagkagaggaaygggcagcctgggcctgggtggaaatcctgccctggargaagttgtggggagatccactgggacccccaacattytgccctcacctctgtgcccagcctggaaacctacagacaaggaggagttccmccatgagctcacccgtgtctatgacgcaaagatcaccagccatgtgccttagtgtccttyttaacagactcaaaccacatggaccacraatattctttctgtccagaaggrctactttccacatatagagctccagggactgtyttttctgtattcgctgttcaataaacattgagtgagcacctccccagatggagcatgctggtcctgggccatgactcaaaccaggtctgtcctcgccactcagtctcccaggagggaggcatcagggggtgtccaggctctggctgggaggatggtgggggtgctggcggtattatccaccagatggggtatccaggatgaagagcaggcttaatttgagatcttgactatttgtcccaaacctgagtggagaggtggggaggaaggagaaaaacgggccaagctgcggcagaggcaggattcaaacccacaatgtcagcccagaagcctgtacttctctgtgtggcctccccagtctcagctgcctactcctactcagactctgccccccacctccacatgagactgcccaccccttcctcaccaaccccttatttatttcaaacgtgcccagatgctcctgtcgtttccacaccatcccttcccttatcttgccttttgagaaatcttgatctctgtttagagggcggccatgaagttgctgctgcttcctgaagcctccgggctctgggatgtctgtagaacaagctggagtccaccagctctttgtcctatggctcacagactttcttaatgataaaagctgtcatcttatttgggcttcctgaaaagctaaaggcttgagaatatttgaaaaatatatatgttcatgataaggcttatttagataatgcaaatatagtttaatttattagaaaattctagtaacataagaccacaactgtataagacaaaaaacaatcaccttgctaggcatggtggctcacgcctataatcccagcactttgggaggccgaggcaggtggatcacctgaggtcaggagtttgagactagcctggccaacatggtgaaaccccgtctctaataaaaatacaaaaaaaaaaatttagccaggagtggtagtgcacacctgtagtcccagctactcgggagggtgaggcaagagaatcgcttaagcctgggagatggaggttgcagtgagctgagatcatgccactgcactccagcctcaaaaaaaaaataataataataatagacttcattggatggaattctattctagatttaaaaaaaaactaacatgaaatgaaagcataatttctttttctttctttttttttttttttttttagatgtagtctcactctgtcacccaggctggagtgcagtggtgtgatctcagctcactgcaacctccacctccccagttcaagcgattctcctgcctcagcctcctgaatagctgggattacaggcatgcaccaccactcctggctaatttatgtatttttagtagagatggggtctcaccatgttggtcaagctggtctcgaactcctgacctcaagtgatcccaaagtgctgggattacaggagtgtgagcaaccgcacccagcctgaaagcataatttctgaatttgacaaagattctcaaatcaatggtcagttgtataaaaggattcccattgaagtcagtggtataaaaggattcccattgaagatacatggcaaataagtctaagggtaccattcttgcttacatctatctggaagatctggctgctgtgataaataaacccaattaatatttgcagacagcatgataatgtggctaaaaacattcaggagaatcaacaaaacttagaactaatgaaagagttctgaaagtggctggataccagaaaaaaaaatcaaaaactcagaaaaaatacactattttttgttactattgcaactttactattgcaacaaaaccagcagctaggaataaccaccaaaaagtcttatatgaagaaaattactaaattaataacactataaaggaagacttagataaatggagagccaccatattcttttgttgttgttgttgagacagagtctcacactgttgcccgggctggagtgcaatggcatgatcttggctcactgcaacctccgcctcccgggttcacgtgattctcctgcctcagccacccgagtagctgggattacaggtgcccaccaccacacctggctagtgttttgtatttttagtagagacgaggtttcactatgttggcagattggtctcaaactcctgacctcatgatccacctgcctcgacctcccaaggtgctgggatgacatgcatgagccaccatgcccggccgaggcacaccatattcttgaatggaaagattagcataaataagttgattattgccagaaataaaagtacagatggtatatttccaactaaaatcccaataaaattctgttatcctttttatctgggggaaaaaaggccaaggtagttttataaatgagcaatgagggtggatttttttcacatattaaaatttacaaaatgttaacccttaaaacagtgtgccaattaagaatagattactcactcaggtctaggaagtaagaattcgatacatccgtcacagacgagtccattttcaccattcaattaaaggtgctagaagctgggtgcggtggctcacgcctgtaatcccagcactttgggaggctaaggcagatggatcacgaggtcaggagttcaagaccagcctggccaacatagtgaaatcctgtctctactagaaatacaaaaattagccgggcatggtggcggatgcctataatcccagctactcgagaggctgaggcaggagaatcacttgaacccggcaggcagaggttgcagtgagtggagatcgcacccctgcactccaacctgggtgacagagcgagactccgtctcaaaaaaaaaatagtgctagaaattgaacagtaggttggaaaaacaatgtaacctaaatcctcacccagctctatattgtttttaaagtgaacattttcttttctaacgggtttagatatagaatgactgtggagacagaggagaattcttgcacacccacacccagatctctctgcgatgaatgtagtagtttgatacaaatgtcacaattaatgatccaatatagaacattattaaccacattccaattaaatactcatttaaagggagggtcctgggtgaggttccaaagaaattcaaattaccacaaaaatcaaataactgttttcaaaattagcctcccctgagggatttaggtgctccgcagggattgtgggcttgggctggaacacagacctgagactttgaagcagagttctcctttccataagagccccgaatgtctcaaacccagacaatgatgagagtcttttattataaaaaggcctgcaggcctggtgtggtggctcacggcttataatcccagcactttgggaggccaaggtgggcagatcacctgaggtcaggagttcgagaccagcatggtgaaaccctgtctctactaaaaacacaaaaaaattaccttggcgtggtggcacgcacctgtagtcccagctacttgggaggctgaggcaggagaatcgcttgaacccgggaggcagaggttgcagtgagccgagatcgtgccactgcactccagcctggcaagagagcgagactccatctcaaaaaaaagagggggagggggagggggagggggcgggggggggactttcaggggccaattccctccttttcagccatttaccaaacacctgcagagtatccactgtgtgcagtcctctcctgtgccaggcaccagggagcacacaggatgtttataacatccagtgttggcaggactgttgtgaaacaagcagcatggcctgtgccttggtgctgtttggatttaaagagatcggcagacatggctacatccaactgagataagtaaatttcaaatgcacttgaaccctaaggatgctacagagcctggtacacagcaggtactgcctaattgatctcagtcatcacccctgcccctactccatgacaggccccgtgcggacctctagcaatctcaggcccatggactatgtctttaacactaaggtgctcctgcacttagggaaaagatagcagagttttaaaaaaacaaaaaacagttaaagtccaaaggttaaaaacaaagacatcacaagaaaagaaaactacagagcaatgttccttatcaatacagatgtgaaaatcctcaataaaatactagcagaccaaatccggcaatatataaaaagaattatataccatctctactaaaaatacaaaagttatttaccatctctactaaaaatacaaaaattagctagccgtggtggtgtgcacctgtaatcccagctgctccagaggctgaggcaggagaactgcttgaacccgggaggtggaggctgcagtgagccaagattgtgccactgcactccagcctgggtaaaaaaaaaaaaaaaaaaaaaaaaaagtattactatatgaacccagtaattccactgctaagagaattgaaaacatgtacacacagaaacttgtacatgaatattcctaacaacattatatataattgccaaaatggggaaacaacccagatgtctgtcaactgacagataaaatatgatacatccatacaaagaaacatccagcctaagaaggaagtgctgacacacactacaccatggatgaacgttggaaacatcaggccaagtgaaagaagccagacgcaaaagactacacattgtgtaattctgtctatatgagccaggcacagtgggctcacacctgtaatcacagcacttttggaggccaagacaggagaagttcttgaggccaggagttgaagaccgtcctgggcaacatggcaaaacttcatctctacaaaaaaatactaaacaaacaaaaaattagccgggcatgatagcagagcctgtagtcccagctactcaggagactgagaggtgggaggatcacttgagcccaggaggtcaaggctccagtgagccatgattgcatcattgcacttcagcctgagtgaagagcaatactgtctcaaaaaaaagaaaagaaaagaaagaaaaaaaaaaaggccaggcaaggtggctcacgcctgtaatcccagcactttgggaggccgaggtgggtggatcacaaggtcaggagatcgagaccatcctaacacggtgaaaccccatctctactaaaaaatacaaaaaaattagccgggcacggtggcaggcgcctgtagtcccagctactccggaggctgaggcaggagaatggcaggaacccgggaggcggagtttgcagtgagccgagatcacgccactgcactccagcctggggacagagcaagactccatctcaaaaaaaaataaaataaaataaaaataaaaaaaagaaaacgaaaaaaagcagaagcctgtgtactcaagactttaaaatttcaagacatgttaattgtgggggctcagggcatgtccctaccatggtcattattagtgtgagtgaactaagcatctcctcccaaaaccatagtgtccgtgacaggaagcccagctcctgccagaatatccagtggaaagaatgctaatggaacacaactttttggaagcagacacacctggattccaatctcagttctcccttgaattttctgtgtgaccttggcggtagtgggggtgttagttaccctctctgagcctccatttcattgtctacaaattgatataatcatattttcttcgtgatttttaaaagttttttaatttttgtagagatggggtttcactatgttgcccaggctggtctcaagctcctggactcaagcgatcataccgcctcagcctcccaaagtgctgggatcacaggcattgagccaccgcgcttggccgccttcacgattttgtggacagaattgagatgatttatggaaatactcagcgtcacatctggctcttagtaagcactcataaaagagagttatctttcactcatttgtccaataatcatgtattaaactgcgacacatgcccagccctgccctaggaggcagaggcggcacacagcaggggcaagtcaggtctactagctgcacctacaaactcatgagcttcctcacccaagtgagtcttttcactttgccctggag

SEQ ID NO: 12341 - DNA, 54464 bp, Homo sapiens
  misc_feature (1)...(54464): n = A,T,C or G, or insertion/deletion polymorphism (see Tables 1-2)
gaaataagtatctgttgatgaaccacctgtctctgctattctgttggggcagtccagatagacaaagacatgcccgttcccgcggcccaccacctctgccctgagcacagtgggtgagtctcggttccccttatcccatccctgctggggtccagccctggcttttcctgaggtagtttctccaggaccaagcagacacccacaaccagcagcccttaaggcatggacgcactcgtccctgaggcctgggtgtcccgcctggaggggcatgtccacagctgctctgggtcctgacgctccaggagctcacgctgtctgcagatccaccacttccctgggcagyccccggcctgcgtcttcctcagtgctcagctggaggtggagagaaatcaggctgggacggagggtggcccttgctttgcacgattcctgcctcgacgttacaccagggacattccagcatctccccttcattaactgtagaccgccagcaaatccagatttcattcaaccaagtaaactggtagagtcatttccagcagctaatgtgagctagcgcattaaattcagaatctctagtaagtgtacctgcatcaataaagccaagccggtccagctgcattaataccctaccctccattcccacacggttcccaggtctccgtgtgtgaatttgtaacatcttacgagcattttggtgtgaaagtggttccttcctgagtcaggctttgtacttgacccttcccctccctgggagtacactgaggttctagaggcaacagggtggctatggtggttaaataaaatgagcatcatttctaggcacctggccaggtaagcttatcacagcattttcaagcagaacaaaaaaaataaataaaggctactctcagatcttggaggacaagctgcttcccctggaaggagaggctcagagaaccagggggttcacaattctcagcttcatctgagcccaaccagacatccccatgccaagcttcagcatccagttccttcccactcagtgcccacgtttcagtagtgaggctgtgagtgtgagccacacagcagtcacacaactcagagttaaactgtgcatccgagttgtagcagcagcagccccgaggctctcaggaacaagggactcttccatggccatggcagtcctgattctctgtctatgacttaaactgagtttagagacctgaacgtgtggttccttcctgttagtgctgctggacactcaggggaccccccacagccctcgtggttgtggtcatcctcgtggccgtgacagcctcacacagcagcacgtgggttcccgaggccctcaattctgctggtgcctcacagccagcatgggggatggcttggttaactgtgaagctcccccaacaacactgtgggccaacagcctccccttcccactggccaggagatcggcctgcagcccagcccaagcaacaaccacactaacctaatccccggaccccaccttttgatagtgacaggaggcagacaaatcctaggcagacagggacaggttcccagtgaaaccccacctccgagccaaagacagtttaaagcctgaaagccaagctacaaattaaatcctcagcctggattgagaacccatcttcccatttggctgctttcctctgattgatccccacccttcacctattttacatgtacctatcttttcctaattcattttctacactggcatgcccacctttgagtggtacctttgtttaagccttttttgcataatcagaagccaatcagcatgcactcccccattctgagcccataaatgccccggacccagccacactaggagagaaaccacctgacttcaggtcgggaaccacccgtgcatcccctctctgctgagagctgttccgtctctcaataaaattcttctctgcccttctcacrcttcgattggcagcatctcctcattcttcttggacacgggacaagaacttgggaactgccatacatgggtacaagctataacacaagcaggctggaacatgcccagcccagccacaggctgagctggtgaacagccaggtgtggcccaggcaggctgagtgggtgggccacctcctgcggcaggtagcatggccaagagaggcctggggagggggggtgtcagcagccagaggtacctggctggcaaagtgaccaaagaggtacctgactgtgtcactttgagggcctgtctctggggaccccctcctagtatgaatttatgtatcagttggggtctacttgggagatggaaaccacaacagtgattctaatagcatgaatttaatgtgcagaatttttcattagttctgggtaaaaacagctctagggaatcatggaggttgcaaccacaaaattcagagaggtgacctggctggcgacactggtgataatggtcacctgccatgcagcctttcagctcaggtgggcacactcctctgcccctgcccacttcctctcccaggtgaatcttgaccacacctgtgcctggcactgtgcacacattctctgttgttcaactctgcgatcaatctggaaaaaaaagaaaaaaaaaaaacctttttaggagagtaaaaggaaaataaatcttggggccccaaaatcactaagccaaagggaaaagtcaagctgggaactgcttagggcaagcctgcctccaattccattcaaagtcattcccccgctcgctgagatagatgcatatctgattgccttctttggaaaggctcatcagaaactcaaaagaatgtaactctatcttacatgtgttgattgatgtctcatatctccctaaaatgtataaaaccaagctgtcctctgaccaccctgggcacacgtcaggacctcctgaggctgtgtcacaggtgtgcatccttaattttggcaaaataaacttcccaaattgactgagacctgtctcagatttttggaattcacaagtgaggaggcagaggctccagctactggggatgggctggtggctcaatgacacagattttggggcagcgggaccactgggccccttccctcctgccctggatacccagggcctgacttcaggaggcagctgacaaggaaggtggggaccccagaggcccggctgtcgtcccagcagccggaaagaggctcacccagaaatgctggtgagcctcttctgacctgtgcatcttctctaagtggggcacctcattcctgcccagagcgtagctgggcagacctgagggagaggccctgctcccaatgggcagaggaaatgcccgttgggcacgtctggggtgcaccaaagcacaggacctgccaccagtagcctggcctgagagtgtggggcagtcacaggcaggcgtctccagggcctgagggcagcccccaaggcagggtggacacggcaacctgggtgagggcagccccacagcagtgtggacaaaggctagtgccctcaaggcccaccctggccccagggctgctgcaggaagcacttccctgacccccgtcccacctgcctccttggacccctgagctggggctgctccttggatctccacatcccacagcaacccagagagtaggaggggcagggaacacccattttcccccaatctccctaggagatgggattaatgtccacctccggggtgctgggctctggctatgcgggtgtctggggggacaatccatgcaggtatttgcgggggatggtctgtgcgggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctgtgtgggtgtttggggggacagtctgtgtgggtgtttgggggcatggtctgtgtgggtgttggggggatggtctgtgtaggtatctggggggacagtttattctgtgtaggttgtctggggggatggtctgtgcgggtgtctggggggatggtctgtgtgggtgtctggggggatggtctgtgtgggtgtctggggggatggtctgtgtgggtgtctggggggacggtctgtgcgggtgtctggggagagagtcatctgtgcaggtgtttggggcggctgggttgcactgccctgggcacctgcaaatctgtgagtgtccagtgaccgggataggtctcggggtctgcagcctccttggcctttagcctcctttcccagtttctcttgtctggcaggtgccaggctaggacccaagcctcctgctgtcacctagaagtagggagaacctgggaataaggggtcccaagtttggcagcccaggtcaccaggtggccttgggccaggctgggggctgctgggctggacaggcctggggttcgggaaggaggagcatgcacagggccagccttggggagtcggttcagagtccagggagcccctgctgagagtaggccaggcccctgcatctgtttctccctctgtggatttgtaccttagagacaagaacactgtgacatccagaaagggcctgctggcaccagggctgtcgggcaggtgggctcggaaaggctctggcctctccccatagcaggagcctccagccaggctggaccctggcccactcccagctccccagaaagggcggtcccagcttcctgcttggctggccttgacattgtttccatttgggccagcaacccaggcagcctgaggccagactgcagctcctgggctggttgctgggcgtgatggcagggggctgctaggacagccagcgggccccagggagagacttcccgggctcagggtggtgtctgggatctgatcccagcctggctgcagctcgaagcctttctcctcccagggcctggccaacctaaagggccatagacaaagcttccaacagcactcagcgtgggagacctggccggggcggccgtgaggagcagtttgccgtgggacccgtagctctgtggcccagccctgcccagatgccctgacacatgcccaaggcctgggcaggaggactcgttctggggattctgaaacagaagctagaaacctcatcaggcctggagaatcagacagagactgctctgcccagaacccccgtccgcaagcagggctgggtgcagggctcacactctgatcactgcgaacccttcagaagccacagagcccttctgccagctccccggccagggctgcccaccctctgtagcttgaggtctgaacctcatgagttttctgtgggcagagggaagcagccaaacccaggctagtatctctgggtgggaccctcctggcagccagcgcccacccccttcaggaccaccccttccccttgcaccttggcaagatccccagaacccaccatcctccttggagactgaagagaaagaacacccagggtggggcctttgtaaccccccaccgggtggttaggggcagagcagagggtgtggagtaggacaagggcctgaccttcctcccagcagcccctggggcccctttggactgaaaggtcaggagacagaagcaaggaaggagggcggcttgggaggcggggccagaggccctgagaagggcacccatgaggcagggcagcccgggtgccaagaagctgccctcagcccctccccccatgccacacccccagtggaacctcctgactgtgagcaggagtcaccgcctccagggagcccatgcctgcatcacaaaggaggcccggaagccttcaggcagcctcaactcagccccaagccactgctctcccatcccagtccctggaaatccacccacttggcccagctcaccccaactccaacccactgggacccagtctccaggggcctgactgtgggcggcagccactcctgagtgagcaaaggtgagttgtgctgaaggaaggtacccggcctgctttcctgggccttgaaaccctctccaggccctctcctgggccttgaaaccctctccaggcgctcagcccctttctcaggaggctgggcrgggcgtcctgtgtgcagtctcgcctgtgccagggcaggcagccccctctggcatacggtttatcttacccaaaggacccgctgtcccccatctgtagtaasctggagaggccacgagtgtccccagggagccgcagtgccttcgcctcagcagacactccacacctgcccygggtacttggctcaatttgaaggtgtttattttgtgtgtgccgtggggcacatggagccgtctgtggatacctgcaggacagaatgaattcaggacgcaggagcagattcattaattctgaccaaagaaagaagttcgtggaagctgagctcagacttgtccaaatgattgatccattcattcatcattcattcattcattcacccaacagataatgaccgaggtctctggggtgggggtgccagtctaggtgaagcggcccccacagagggtgcccctgcccgtggagctgacgttcccagggggctgcagaagtatcgaggagatgtggaggtggagctgggagtccctggagagacacagagcaggggaggggctggggctccccgagttgaacccgaggccgagccaaggaaggccccactgggaaggggagcttggcaggaatctgggaggcctgcctgggtgggtggggagggtggggggagaaacctggtgggcctgcctgagggtaaggggagggcatagtgagaggggaggagggccaaagagggtcctgacatcagggcaaggcccggctcttcctccaagggtttggctaccaggggccagggagtgacggcctctgattctagttacaggcccctgggcccctgtggtggggatcagtgggtgagacagacccctcagggggaggtgattggtggggcctggaacaggcagcgagtggcaggaatgagaaagggtccgactgagatgggmttggaggctgaggactggcgcggggtgtggacgcaggcaagggaggcagatggctccaaagtccagcttcagccagtggcgggataggggtgtctaggggcacagcagagggcgtcaaaggaagcatctgagggtgtgtggatgcatgaacgctgcggttcacagagccagggactgagagaggtggctgaggggacaggaagggaggagcgagggacctggaggagaggagtgaggtccaggtccccgtccccgctcctcacacagccagaggtcagggatctctggaggagtcgctgaaatgagctggcccagccacctttgcagggtgttgcccagacaggctaagggacatctaggatctcccagggagtcagggacagaactcaggcaaagtccacagcaggggggcggtggggtacaggggggcggaagcacatttagcccaggtgctggcagtctcagcagccagtccctgacccacccacaggcaggactgggcctggcttcctttcgctgctcccacattatccgccctgcctggtacagggctaagctggggctcagcacagcaggtgtgtgattgcgtgtgacgactgaaagtgctggaaggccaaagcacccagccgcttccctaggaccgggcaacttcccagcagggctccgagtgccagcgagggatgtgcacatccatgcatgtgctcacatatgtgcacacacacacagacatgcacagccacacaccagagcacacgcacacacgtgcacacccacacacacaatcatgcacatgcacatgagcgcacacgcacaggtgcacaatcacagtcacacacgtgcacacacgagcgtacacgcacacacgtgcatatccacgcacacaatcatgcacatgcacacacaagagcacacgcacacaatgcacagtcacacacatgcacacacgagagtacacgcacacaggtgcatatccacgcacataatcatgcacacgcacacacgagaggacacacgtgcacactcaggcacacacgtgcatatccacataatgcacatgcacacatgagagcacacgcacacrtgcacaatcacacagtcacacacgtgcacacacgagtgtacacgcacacacgtgcatatccgcacacataatcatgcacacgcacacacgcgagcacaggcacacacgtgcagtcacacacatgcacacacgaggmcacacgtgcacactcactcacagtcacacacatgcacacatgagcgtagacagtgcatatccacgcaatcatgcacacgcacacacgagagcacacgcacacacgtgcacacacacacatgcacacaccagagcgcacacacacgttcacgctcatgcagtcatgcacatgcacacaccagaacatgtgcacacgtgtgtgtacacgatcatacatcagaacatatgcacacacgcacagtcatacacatgcacacgcccaactacatgcacacactcatttgcacacatgtgtacactcaggttcacactcccacacatacacgcacactggagcacgcagacttgggagcctcctgagtccagtgtcctgtgccccaacccttcctgcccagctccctgtcctgcctacagcagcagcctgtgcccagccgtgtgtgtcttcaagtgctgcccactgccctgctggctccagaaggtgtcccctccatagtaacagggtcaggggacgaccagagctgcacaccagccaggtggctgccagggttgagactcaagcctgcctggccctgcagatcccttcctggcccacgtagtcaccgcctgtgtgggtacctactgttctggtgtcgcccatcactggcttctgggcttcaacaggaaaggtgggctgggagcccagaagcccaagtggcctccccgacagcgtcyctgacctagcgctcaggcccacagctccaagacamccagcatgagcagcccaggggggctccactacaggagtcccttgacagcacaggagctgagcctcctgggtccagcttgcgaccccaagctgggagcatcccagtcctagaacctccatgcactcagagattccggcccaggggtagtgtggaaagtcccgggacccagtcacccagggttgtgagcttggagagggagacgggaagagtgttccaaaggcacccagcgcccgctcccagccagcatccggcccttccagcctcgggccgggctcggggagctccacgcccctctcccctctcccctgccctgggcctgcaggttcctccgcggtgctctcccstccagagccctgctgatggggaagtccgaaggcccmgtggggatggtggagagcgcyggccgtgcagggcagaagcgcccggggttcctggagggggggctgctgctgctgctgctgctggtgaccgctgccctggtggccttgggtgtcctctacgccgaccgcagaggtgagtgcgggtgccccgcccccgcctgtccccgcgcccgctctccgcgctcgccccgctgcacctgctgcagggtccgcctgcccccagcccgagcccgcccgtcagatggggcaggtgggtctgcactgggcacccaggggctcccggggccgagctgcggactcagaggcggcgggaggggcactgacctgcagggagcccgcggtcccttccagaaagctctgccccggccccgactcccgcgcgctgcttctgcagctccgcacccgcccgcctccgcctccgcctccgcctccgccggactcccggagggtggggggcgcagacccgtcgcccgcccctccgcccaccccctccctgcctggccgcgcagccccggctggggaccaccggcgtccgtgtccctcccgccgcccgggctcacctggctgcctcactcccccgctgccatcctgcggagagacctgagggtcctgccgcccccgccccgctcaaggccgggtcaggtcacgggaccacggcgggaaggggccagtctggggtcccacggagacaaaggcgtggccagggctgctcgctggaacctcgggctgtcccgggaacactccccccgcccccggctgtcccgggaacactccccccgcccccacgccggcccctcccttgatctcccctcttggttcaggggctcccaggcacccgtagacctggtcaccttccagccgcccctgccagcccctccgcaggcacagccctggtccctctgagaccgggcagcgcgcacacatcggggagcaatgctcacccccggggcaggtgcgtagggcgctcccaccgtggcaggcaccggactcagagctcatggcggacctcgcaccccaggtccaacaatggggcgcctcagcctgtgttactagaatgccccctcatgtctggagccctgcgcactgcctgggaccatccctccacccctgcgggaggctgtgtctgtgaagcagaagtgggtgctgcctgtggatgtgcagggcgtcccggcccggggctgcatggctggccactgtacagtgtggctgctgcccagaccgcagcccctggccctctagggtctcccctgggacagaggggtcctgcgacctccatgggcggtgggcagtgggggagggaaaggctcactcacmctgaggaacccagagcccaagggaagctctgttcagagcctgctgggctcaaaacacctgctttccaggctttcataaaacaaggctgaccccacacacacccccagctgtggggtaggaggaggcctctcttcttctgggtcgtgccaaagggcctgagcccacccatcccagagagaccctccctgcccagccaggtgcctcgggagtgccccacggtgccatggatctcagcaaagcctgcctccacccactccagtgtggaaacgggccctggaccccctccctccagggcggcagagccctctgttccccgtcaagaccccccaccaggaatgaccccacagctgaccttggcctcagtccaggattgtttgtggaaggttttctaagcagttattatcatttatttctgtgtattttctcatttccattatgactttttcattgacttataagtcatttagaaatttttttaatttccagacatgagtttttagttacttttttaaaattattgatttctaacttaactgtgttgtcagaaaccatggtttatgccattatttatgtggttctttctttgatatttgctgggcttgctttggggctaacacttgatcgattttataaataagccctgtgtgctgcggaataggctcaatcaccaaatgctgagtgatggtgtctatctacatccactagatcaatcaagtcttctacatattggctctttttccattctcttgatctcaaaagaatgaaagatttggaaagatcaagaaaatgatttcttaaaatcatgtactgaagtgtgtatgctaaaatcttgcactaaagaatcacccrttcttgtagttacatcaaatcttacctaatttacctatttaaggcgatattactatgtgaacgcaaatttaggtatgaattataaaattagtttcataaatttaatattgtagtaagatacacatatgaagttaatatatctttcacttcgtgaaactgtgtagtcaccgtttctgacttaacaaggctttttgccttaaatcctgttgagcctgacatgagtactagctactcagcatttgctgtgtctattttttccattctttttctttgaaacttttcatctccttagctttagatgtgtctctttcaatcgtgtatggctggattgggggtttgtctatcttttaattggaggattttgttggtttataattaccaggacaactaaaatgtatgtgtttcctattgtgttgttttgtgtgtctcatkcgtttttttctcttttcttgccttgttttggatcaacctatcattatttcctctattttccctcaactaacttggaagttttgtatttctatcttttcgacagttatcttagatttttttgttttaattatttttaaagttataaactttcttttataaaatcaaatgtttttacaaaaatgacagtgagaaatacagtctcatgtccatcctagaattctactcctccaaaacaactgtattcattttctagtacaggggttggcaaactatggcccataggccaaatctggccccttgcttctttttgtatataaagttttattggaacacagccagacccattcatttatgtatcatctatggctactttcctgctaggacagcaaagttgaacaggtgagatgaagcatgtatgtggcccacaaagcctcaaatatttacatctggctttttacagaagtccaaccccaagactggagtgcccctcgtgtataaacctggtctgtgaacccttctctctttatcgtacagtttagatcatgaggaggcattatcagattgtggctagcacccaggctcacagtttttgaccactcagaaagctcaatccacatacctcttccccaaatttctttgtcaccaattttccaatcatacttcttccaagtccctgaccatccagccaaaccattggctacagcccatgaatcggtacataatcgcatcgcacatctggcctcttctccttccaagcaaagtgcacaacaaggtacrctgcttgaagttctgcccactgggaagatttcccttcaccgctgtccttcatggatgtcctggaaaggggctatagtgctgcagctgtccacttgtgggtggtgccttcatatcatgcagaaccatctgtgaatcaggccctagtcttctcttcttcctctgtccactggtcatagggaactccccatgaggctatcggtgcaggctggaggagagaaggcagggtgggaggagtgaagaccatgggcatttgagccacttcctcatgtaacttacttgtgccttcaggacttgcttgagcccgatcttgtatataccacttccatttgatgatggaatgccactgtgcatgacccactttatggctagatgggtcagaaagcacccagttcatgataggaagttcaggtcgcatggtgacttggtgatccgtagtcaaacgttcactttccaccaaagcccagtaacgggccaagagctgtctcaaaaggagagcagttaactgcagaagatagcagggccccgctccaaaatcctagagggctccgctgtgattcacccacaggggcctgccaaaggctccaaacagcatccctatctatctgccactgacactccaggcaccgttggatctgctgggtcatacagcccaagtggcagagcagcttgcccagcagcctggacctgttgcagagcctgctcctgttctggaccccgctcgacactggcagccttttggatcacttgataaatgggctgaagtaactcgcccagatgaggagtgtgctgcctccagaatccaaacaggcccactaggcccgagacaccttgtctcagatgaaactttggactcggaattttgagttaatgccggaatgagttcagactttgggggactgttgggaaggcatgattggtttcaaaatgtgagaaggacatgagatttgggaggggctgggggcagaatgatatagtttggctctgcgtccccacccaatctcatgtcaaattgtaatcctcatgtgtcaggggagaggcctggtgggatgtgattggatcatgggagtggatttccctcttgcagttctcgtgatagtgagtgagttctcacgagatctggttgtttgaaagtgtgcagctcctcccccttcgcgctctctctctcccctgctccaccatggtgagacgtgcttgcgtcccctttgccttctgccatgattgtaagcttcctcaggcgtcctagccacgcttcctgtacagcctgaggaactgggagtcaatgaaacctcttctcttcataaattacccagtttcaggtagttctttctagcagtgtgataatggacgatacaagtagagactgagatcaatagcatttgcactgggcctggaacacactgttaagaacrtaagagctattgctgtcattagtaatattctgtattattggcaacatcatcacaatacactgctgtgggagggtctgagatacttctttgcagactccaatatttgtcaaaacataaaatcaggagcctcatgaatagtgtttaaatttttacataataatacattgcaccatttggtatatgagtctttttgaaatggtatatgcaggacggtttcctaatatacagaatcaggtacacctcctcttccatcagtgcgtgagtgtgagggattgaattcctctggttaggagttagctggctgggggttctactgctgttgttacccacagtgcacctcagactcacgtttctccagcaatgagctcctgttccctgcacttagagaagtcagcccggggaccagacggttctctcctcttgcctgctccagccttggccttcagcagtctggatgcctatgacacagagggcatcctccccawgccctggtccttctgtgagtggtgagttgctgttgctggtcagtactaggctcgggctggaggtgggggctctctggtgtcgtggcccagtctcaggcttaggcaggcctagtatacctggggctggggatgcacctcttggcatccctaccacatccccatgtcaaccaagcttcgccctgtgcctgagttgcccacccctcctctagaggcaggagactgcttgatgtcagtctaggattctgggcccacaaggatctcctgcccttccatgggccggggatttttactcctgaccctcctacagaacaggggatttgcctggttcctgggcgtgagaggggttacacctgcctcagtggtttaaagcttttgctgcctgccagacgagtatagtttcatgtctcagccaaagcaggtccctgcctccatccctgggccaccaagggaggctctctccagccttctgagacctgccccagcctttctcatcggcatctgggaaaggccgtggacagaacatggagtgattgaaaacctcttcgtgatgggggctcccggctactccaaactcatgtagcagcccacactgggcctgtaagaatgtgtgaaaaattttagctgatttcttctgacccacttggaacatctcttactctcaggtcttgaccaaagtgaaataatttacatatccggcctttccttggagggccttatcactcggaaattgtttacctgattgtctttgacctcaggtcttggatgggctccaaaaagttgtgctttttgtagtttctttggctttttcttgtacggaaggaaatgatattcaattgcagcttttgatgtcctcggcaaaaagcagaacttctctaccttaaatttttatgcttatttaacttaaatattaaagtaatcaatatctctattatttcttccaaacaatacaagcatttagaacagtttaactcttcgcaccactacccaccctgttcacatgttattgccgttaagaacttggtttttttttttttttagacggagtcactctgttgccaggctggagtgcagtggcgtgatctcggctcactgcaacctctgcctcctgggttcaagcgagtctcctgcctcagcctcctgagtagctgggactacaggtgcgtgccatcacacccagctaattttttgtatttttggtagagatggggtttcaccatgttggccaggatggtgttgatctcttgaccttggcctcccaaagtgctgggattacaggggtaagccaccgctcctggacttttttttttttttttttttgagacagagtttcactctttcacccaggctggagcgaagtgacactattttggctcactgcaaccttcgcccccagattcaagcgattctcctgcctcagcctcccaagtagctgggattactggtgcccaccaccacgcccaaataatttttgtatttttagtagagatgggattttgacatgttggccaggctgctctcaaactcctgacctcaggtgatccaccagccttggcttcccaaagtgctgagattgcagatgtgagccaccgcgcccggccaagaatttggtttctatcttactttttacctaccacagatcagcaacattactatttaatatggtcaatgttaactcagatcttcccctatcctcatgaattccattatgcatctttcttcttacatcttgggcagttcttattaaataatttttcttttttctgaaatacatacttcagagtctcctactcaaagtgtggcccacagaccagtggtgtcagccattgcctgggagcctgttagaaattcagaaactcaaggtccaaccaaggccgcaggaccrgtgttggtatttcagcaagacccccaggtgattcatctgcacattcatgttagggaagcactggtttaaaacagtgttgaccaaatttgcttgataattggaatcacctggggaaattgttacaaatccagacrttgggccctccctcagtttgcctgggctacagtcacaaaatgctcaggtggcttaaaaacagaaacatattttctcctcctagttctggaggctgtgaagtccaagatctagatgccaactgaatcagaccctcttgtcaatgacaagagtcaaactctgtaaaacatttgcagagatttattcggagccaaatacgagtgaccaatggcccgtgacacagccccaggaggtcctgaggacgtgtgccctaggtggttaggctgcagtctggatttacacattttcgggaaacataagacatcaatcaatacatgtaagatatggctgggcacagtggctcacacctgtaatcccagcacttcgggaggccaaggtaggtggatcacctgaagtcgggagctsgagatcagcctgaccaatgtgagaaaccccatctctacttaaaatacaaaattagccaggcgtgatggcggatgcctgtaatcccagctactcgggaggctgaggcaggagaatcacttgaacctgagaggcggaggytgcagtgagccgagatcgtgccattgcatgatgatggatgaaactgcatctccaaaacaaaaaaaaaaaaatgtgcattggttcagtccagaaaggtgggacaactccaagtaggggcttccacatcacaggtagattcaaaggttttctgatagcagttggctggaagagtttatctaaagacttggaaccaatagaagggaatgtctgggttaaaataaggggttgtggagaccaaggtccttattatataggtgaagcctccaggtagcaggctttggagaaaatagattgtagttcttattagacttagtctgttctctcagtcttaaggtctctggttttgtttgtttgtttttgagacagggtctcactctgtcactcaggctggagggcagtggtgcaatcacagctcactgcagcctcaacctcctgggctcaagtgatcctcccacctcagcctcccaagtagctgggacctcaggcacatgccaccacacctggctaggtttttctattttttgtaaagatgggtctctctgtgttgcccaggctggtctcaaactcctgggctcaagcagtcctcctgcctcagcctcccaaagtgctgggattataggtgtgagccatcacgcctggcatgtctctgttttaaggtgaatgctggtcagctgtgcctgaattccaatgggaagagggtataatggggcatgtccaacccccacttcccatcatggcctgaactcgtttttcaggttaactttggaatgcccttgcctgaagggagggtccatcagtcacctggaaaatttagtttatttttggttcatgctttcttcccacaaggcccatgcttttttttttttcattattttattgtttaaaaatgttttcccacttcaataagctggtctaccaaatggccaccttcttgctgtgtcctcatgtggtggaaagagacagtgagctctgtcatttcttccccctcttatgagggcaccagacttaccagrttatgccccccaccagccctgcccattgagctgattttaaacctcctcacaggccctatccccaaatagtcacattaggggttagggcttcaaaccacaaagtcagtccataacaagccccaaacagtgaaacccgggaatcttgtagggtaagacctctgaatcccacaygcatttgagaccttgcttgtgatcagacaagtttggggagccctgcttgaaaataatctatcagcattaaactcttatctcttgtctatgtgaaaattactttatttagcgctcgtccttcagtgatcatttaattggttaaatgagtctgagctgttattttctctcaatatcttgaagatttagctctcatgccttctgactccccttgctgctgttcagacgtggcttcagagaaaagtacagtcagcctaactgccgctcctctgttgggtgaacaatcttttctccttgagctatgttctctttgtcttgggtattctgaattgttatcatgagttgtttagctgtgaaattatttgtatttattctgctgtggatttgttgtgattcctgaagctgagcactgataacatatattaatgttggaaaattgtacccgttatcttcctggatggtgtatctcccacaatatcccttttctctccttttccattttccactgcatatctgctccatttttcccactgtcctccatgtctttcagcttttctttcatattttccatcttgttgactttctcctgcattctgggtcagttctttagaactacacttcatttcactaaatcttctgttctgttatgtctgttgcttaactcagccttttgggtttgtagttgtttttgttttataaatctcaacaactacgtggttttatttctagaatttacaatggatcctttttcaaattgattttttattgttccttgttcttgcttttgatttttttttttttttttttgatagagtctcactctgtcgcccaggctggaatgcagtggcrcgatcttggatccatgcaacctctgcctcctggattcaagtgattctcatgcctcagcctcctgagaagctgggattacaggtgtccgccaccatgcctggctaatttttgtaattttagtagagacggggtttcaccatgttggccaggctggtctcaaactcctgacctcaagtgatctgcccaccttggcctcccaaagtgctaggattacaggcatgagccaccacacctggcctagttttgattctttttgaagcatttcaaacgtacttacgttattttattttagcagttggggtcttaaaacccagcccaacactcactggcataaaacaatgatttattgtgaggcacctccactgtttgcctggggtcatctgacctaggttgggctcagctggggtgctctgtccatgtaactttcatcctcctaccagagcccagcaagcattcctgcgcagatccctctcctggcagtgaaagaaatccaaaaggacaggtgaaaacatgaaagccctcttagggcccaggctcagaactggaaccctgtcattcccacctcattctgttggccaaagcaagtcacttgggccacgcacagtcaagagatagaagaaaaaaaataatttgtcccttttgtgggagcaactacggagtcacatggccaaggcacggatgcagagaagactcagatccagggccagtggtgccagcttccatacgttctggatcagatcattcctaattggcaatctttggggttctggttttgctgtttgttttctctcactaatgtaagattttcttttttaaaaatgtaaatacatattcaaattggcttttatctatggggatcctgtgttattgggctgagaaatgttccctctggagaatatgtatttgttttcatcaggcaccttaggacactaccagcctggagtttctttaaattggcttctccgcgagaggtttccttggccacacatttctgtaaactcggcaatggcatgacaagccgtctgtgattacacatcctccagggagggtgtttctttctccactctgtgaagttctttgtgcctttgtttcttctgaaagagggatggagaagagagggaaaagaaaaaaatgtaaattatttacatcaagattgttttagtccatttgtgttgctctaaaggaatacctgagactgagtaatttatagagaaaagaggtggatttggctcatggttctgcaggctgcacaggaagcatggctccccatctacttcagactgttccattcatggtggaaggtaaaggggagcctgtgcatgcaggtcatatggcaagagaaagagagagagagagagagaagaggtgccaggctcttttcaagccactcaggggcaccaagccattcatgaagaatcaggtccacaatccaaacacctcccaccaggccccacccccaacattgggtatcacatttcaacatgagacttggtagggaaaaataaaccacatccaaaccgtggcagaggtcttattcaaatcaaggcatttggaaaactttaggaaaacaaaaccttcagaggaaatgtcaaaaatagtttttaaaatgtagaaagcctatgtcaaaatgattggcatattacagaagttattcaagcaaatataaaagaacaaagagaagatcctgtgtcaactgagtattcaggaaagctgccctttttggaattatgaaaaagaaaaatctccttttggagagatcattgactgtgtttcctgtgatcatattttagcattagggtaagattttgtttcttttcagccattgtgtcaaaagggtctcactgtttttgctttttctcttagaagaacagagctgtcgaatgccagtatggggtctggaggttcatgccctgccactcccccaaggaaagtgaccttgggtgtgtgatcttgcctccccaacagttttcccaagaaaagtagagatgaggaacctcacaagcttcttttttttgagatagaatctcgctctgtcgcccaggctggagtgcagtggcgcaatctcagctcactgcaacctccacccacggtgttcaagtaattctcccacctcagcctcttgagtagatgggattacaggcatgcaccaccacgcctgactaattttttttttttttttttttttttgagacggagtctckctctgtcgcccaggctggagtgcagtggcgcgatctcggctcactgcaagctctgcctcccgggttcacgccattctcctgcctcagcctcccgagtagctgggactacaggcgcccgccaccacgcccggctaattttttgtatttttagtagagacggggtttcaccgtgttagccgggatggtctcgatctcctgacctcgtgatccgcccgcctcggcctcccaaagtgctgggattacaggcgtgagccaccgcgcctggccacgcctgactaatttttgaatttttagtagagacggggttttgccatgttggccaggctggtcttgaagtgatcctggcctcaagtgatccagcttccttgtgatgattaagtgaggcactgtaagttaagggacgacacggaaaaaacatgcctagctcatctaattcagttttgaaagtgctgctcaggagctcactacatcctcaggcagcccttgatctgcagcatctggtgaatttccttgggggtttcccccatcaacaaggctacgggaaatcctatgttgggaatgccgtgggagctgtagaggcaggatgcaggcatgaaggaggcatgaactcgcctcttcagttgtcctaatttgttctggatacatctgactagatgggaaacaaatgaatcagaggcactgtttgggtccaggtctcccgtcacactttgctccctctttaccctttctcaggctcatcattcctgcccaccaatctggtcttcccactggtttcgtgtcccttctgagtgaagaccttttagcatttgttgtggggcacatcyggtagagacacatgttctcagctttggtctaaaatgtctttatttcactttcacttttgaaatatgtttttgctgggtatagaattataagctgataatgtattattgtttttttcaaggacttaaagagctcattccatcatcttctggccttcattctttctggtgagaggtcaccgtcattcttactgttgttcccctcaatataatgtgtctttttttgtctgcttttttttttttttttttgagctagggtctcactctgttgcccaggctggagggcagtggcataatcacagcttactggaacatcccccctcccagactcaagcgatcttcccacctcagcctcccaaatagctggaaccacaggtgtccaccatcatgcccagctaatttttgttttataatttttttatagaggtaaggtttctccatgttgcccgggctggtctcaactcctggactcaagcaatccacctacctcagcctcgcaaagtgctgggattcaggcatgagccaccatgcccagccccactgactgcttttaagtatgtcttgaaattcttaatcctgaatttctctttatctttagtcctccacagtttgactatgatgctgctggatggttttctttgtatttgcccagcttgggatacactgcccttcttggggtagatttatatcttttaccaactttaaatatttattggtcagtatctcttcaaatattgctctctgagtctctagttacatatatgttaagccatttaacattgtcctacaggtctgagatcttctgttcaggtttccttccgtaatatttcaaaaatttagaacaattttagatttacagaagcattgcaaaatagtacagaaatccctatataccccacccccagtctcccctattatgaacatcttgcattagcctgatacatttgccacaagtagtgaaccaatagtgataatattactattaactaaagttcacactcaattcacatttccccgttttccctcatgtcctcttaccgtcccagggtcatatccagaatgccacatcttctcaggctcctcttggctgtgacagtttctcagactttcattgttttcttgtttgtgtttttgttttttgtgatcttgacagtcttgaggattactgatcaggtggaatgaccctcagttggaattagcctaatggttttctcatgattagactggggtaacatgtgttgaagaggaaggccgcaggtcacaggtgcacactttcaatgactggacttatcactgttgatgttaaccttaattgcctggctggaggtagtgtctggtttctgcgctgcaagttacttttttcccttctttttcatagtgcagtctttgaaaggaagccactgtgtgcagctcacacctgaggagtggggagttatgctccacatccttagaggcagagtatctacctaaagtatttggcattcttctgtatgagagattcatctattctccctcatttatttatttactcaatgatttgtagatatttattttacactttgcattataatccactgctatattgcattgctcaaattgttctaactctggccattgggagttgtcagttgcttctatgaccctctgatgtatccccattatcgtgaatttggggtgagttttttgggggggagcactttcttactttttgacatttcaacatgctccaagctcatctcgtatgtttcctaccccagttgtataatcaaccatttttctaaggagccctggcttcttttatcggataatggtatcaaaaaccaacagcttctaggataatgtggtgtctgaaaaacaaacagaaaccaagagctgggtcctattctttgcttattgctactccttggttggtgttgcttctagtctagctcacctggcagagcaaaggaatatgtatgtatacatgaacccatctagatactcatatctataaatatttatatatgcaaccatctgcatctatattaagctaaaaatgagttcacactgttgtctccaactctactccaccaccacatggaccattctgacttcctcctttccttgtctgtaacttctcactgcagcagcaataagcccagccacctgctatccacttactttttccattccaatgtacatgtgcagtggtttcagagttcagctgggatcccatgtaggacaactttatcaactagagtacagcgcttatgtacagcttcctttgctttagtctcatagactctactcatttctaaagttacttaggtcaacactttattcccctatccatttcagtgagattgttttatacatttgtcttgagtctcattctgcgtttcatcctgggattcccctgacagtctaaataattttttaactttgcatacaataaggtttactctttgtgctataacattctgtgggttttgacaaatgggttcaccattcaccaccacagtatcgtacagaatagttgccctgccaaatgcattcactatttgtcattttttgcccccaaaactcccttgttcttcacctattcaacctcttcaacatccattttcccaaactcctggcaactactatttaacatctctcctctctaaagttttgtttttccagaatgtcacataattggaatcagacagtatgtagctcatagttttttgttttttgttttttgtttttgtttttattttgagacagggtctcactctgtctcccaggctggagtgcagtggtgcaatctcagctcactgcagcctcaacctcccgggctcaagcagtcctcccacctcagcctcccaagtagctggaactacagacgtatgccgccatgcttgaacgtccttgccaggcgcatgtgcccctcctcatgctttgactccaaaggcaatgcagccacaggcctctcctctcctgggaaggcttcattcctccctggaatttgactcatgctggtttctctatgtcctcagctctcgtgggtttctaaaagtgcccatgctgtaggttctccagcttgctctcctggctagggtgggggccacagtcaatttcaactttctgcatcctaatcagaagcagaaagcccttgccctccttgtcaccactttggtcagaggtgatgtccctcgaatccactcttttgctgaggtgaggccctctggagtccacagtccagtctctggtccataggctctgggttactgcaattggcaaacaccacagggcagccatgccttccgctcgcactcaccacctcctttccgttgctggcctgggggattcctttgctctgaagctcagccttgcccttcagcactttacctcggtgtatgcagcatgyggcactttctccctgtttccaccgggcggggggctccttgagggctgggccctgtcaggctcacatctgaactgcagcatctggcctggctcacagtcatcatccagtgtttcactaatggctttttgaatggccaggcccccaaggagctgatatttttgtggcttctagcaccctctctgcagtctctgcccagggctaggccaggttccaggcctgccaacagccctgacctgaacgagccctgttccctccttccattcagtcctctgtgtacctcactgctggggaaattcggccacaagccaggtctgaaggtagccaggcctggcttgtcacctctctggacctggggtcccctcttctctccatcccaccctcctctcccatacatctctccaggcagttgacagccatcccaggagcccccgatgctgaccaggcaggcccctcccagcaggcagtagagagatggagggagggtggcttggcaccttcagcagcagtgagggtggaggggctagggacaagggtcattagtgggaagccaccctctctgaaaaggccctgtccctctaaatgagcctgccctgtgggactccaggagcgtgccaccttgtgtgggccttgtcagggtcaggaagatcctgaggtagaggaggctgtcgggaagaggaaggtctcacctcaggacccctctaggccctggcacatcggggaccttggggtgggtggagggagaattaaagggtggggctggcaaggcagggcaaaccgccccccattcaagcccagcaggacacagattgaagctggcccctgcagtgaactctgtggatctcctgtctcgctgccctggggaccagccctcactacaggggtagggctgcagcacccagcactgtgggaagatggcgtgctgacccagggaggcccccagcacccccagggagctgcaggcaggaggccgcagctgagcgctgtgtttctccccagggaagcagctgccacgccttgctagccggctgtgcttcttacaggaggagaggaccwttgtaaaacgaaaaccccgaggtagcctttgccttcccttccaaaacagccccaggcaggtgggcgctggcctcccaaggtggggggactccgtggaggggcaggggctgggttctgcccaaccctcatgtgccggaggagggccatggggagaggacagtggcagggacctcagctgggtgcacctgctggacgcaggaggcttactgggcactgtggacactccgcacctgctcctgcgtggcctcagcacattcaattccaccagctggcacaggggtggggcaggccggggcagggcatgcagagaggggcagcaaggcaggctgcctggaggagctggccctggcagcaggtgagagtgggctgggcagaaggcaggagggcagaatggccggcttcagcccttggggcctggggcagctgtgggggtacatggaggcagagggtgtaaaggggctcccaggtccctgcagcggtcaaggacaaagaacgaagctcactatcactgaaggcctcaggcctgggccacctggggaggacttgggctgccaggctggaccacccatggggatggaagatggggtggagggccacaccccacccccaccagactatgctttggttaccctggccttgccctactggcttcagcccatgctccacccaccctgaccttgccccgcccaccccagtctatgcccatccccatgccacacccaccagaccttgccccgcccacacccactccagtcctgccccaccctctccgtggctcccggtgctcaggctgctccttgcccgcagggatcccagaggcccaagaggtgagcgaggtctgcaccacccctggctgcgtgatagcaggtaagccccgcccccttgccgtccacagcctgcccaagggctgggggctcccggctgacactgacgtaggccccgcccaaggcccagggaagcaactccaagacacggcgggcggtggagccgggtgggccggactcggactcgctgtggagcgggcggagctggtgtttctggcatctggcgtccgctgggcccccagtccccagcctccagcagccaggccctgcagcaacagcatcccgtgccaagaaccccagcggcttttgtccacatttatagaaagaaaggttcaatgaatagccactttcttatttcagattttctcccaggcatttgtcttaaaattgggggtcaggtaccgctatttgcagatgacaaaaactgttaacatgctgtgaaagcgccaatagtggagaagctctggactgtggcttttctgcccgtgctgggggctggggggcctgtggacacgccttccgtgaggtccccagccccagaggtggagtggccaagaccaagttggacagaatttgagggacggttcttggtcggggggtgcagcccagctaccccagttgaaagcgttcagtgggaagcctgggtctcccctgtcctgtgcacattcggggttcctggggcaaagccaacccctctagcagaatacaaacccccatggtggtaagagtcgtccctccctctggggaccaagcacactgatgagtgagggggcagggggcagagtcagaacagaaaggccctggcggacagccaggagctgggcccggcttacagggcatggtcaccagctgagcacctcctgtgagctggcaccatctcagccatcgcctcagcctgcaagtcagaccgctggtgttcccggattcacagacaaggaaatgagtctcggagggtttggggttcaagatcaagtggttaataagtgaaaacccagccgactcatgcctgaattcccagcaactctggaggccgagrtggaccacttgagcccaggagttccagaccagcctgggcaacacagcgagaccctgttctaaaataaattttttaaaaaggcattcgggagaggagacacacatctgttatcccagctactcaggaggctgaagtgggaggattgcttaagcccaggagttcaaggctgcagtgagctgtgatcacgccactgcactccagcctgggcaacagagtgagaccctgtctctaaaaataaataagtgaaaaccctagcactgaatccaggttgggggattccctctctgcagctcagagagggtggttaactctccctgggcacacagctgcgactggatggacagcagccccttcccaagggaccaggctgtgtcttggaccgggagacaggcttctgggctgtccacaactctctctgtctcccctctccctgctccacgccatggggacgagcagcygccaggatcctccagaacatggacccgaccacggaaccgtgtgacgacttctaccagtttgcatgcggaggctggctgcggcgccacgtgatccctgagaccaactcaagatacagcatctttgacgtcctccgcgacgagctggaggtcatcctcaaaggtggcaragcacggccgggggtgcagtggggtgacgccgaacaggacagcaccgggccaggagttggtcctggctgtgtctcgcccctgtttgtgcttcctccttggtccagtgggcgcagaggagagggaataaagacccagcagctggggggccgcctctcgccgagcacttcagggggtgtagggacctgtgacctggcccctgcagcctcgtcaggcctctgtccaaccttttcctgtgcccacagcggtgctggagaattcgactgccaaggaccggccggctgtggagaaggccaggacgctgtaccgctcctgcatgaaccagagtgagtgggggccgccaggaaggggccgaggcaggggacgggggcgggctgcccctgccagggcctagcgcagccccaggaccccatggctgcccctagggtaggagtgggtgcctttaggactcatgccagagggtctatgtgctgtgtcccgctcccagccacagggtccaggctcgcagtaatgccagctgccctgcggcctcactcacaccccaaccccagcacaggccacacgttccaggctgcaggaagactgtgtgtgtgtgtgtgtgtgtgtgtgtgtgtgtgtgtgtgtgtgtattatatggatatgagtatgtgtatatatgtgcatgcatattatacatttatatgcatatgtgtgtgttgtgtgtatatgtatgtatattgtgtatgtatatgtgtatacgtgtatgtgtatatatgtgttcatgcatgtatctatatatgttacatgtggtttgtgcatgtgtacatgtgggtacatgtgttgtgtatgcatgtatgtgtgttgttatgtatatgtgtatatgtatatgcatgcggtgtgtacatatgtgtgtgcattgtgtgcacatgtgtgttacgtgcatgtcacatgtgtattgtgtatagtgtatatgtgtattatgtgcacatgcatgtatgtgtatatgtgtgtattctatgggtgtgttgtgtgtgcatatgtgtatgttgtgtgtgcatgtatgtgtgtgttatgtgtatatgtgtgtactgtatatatatgtgctgtgtgtacttgtgtacatgtgtatatgtgtgtatgtgtatgtgtgtatgtgtatgtgtgtatatgtgttatgtgtgtatacatgttatgtgtgtgctgtatgtgtgtcatatgtgcttgtgtgtgcatgtggatgtatgtggatgtgtgtgtgtggtgtggggggcagattatccatgtttcagttcctattaaaggaattcacgtgcttggagcacccccggcccagcaccgtttaactcctccacttgggggtctgcaggcccaacctgtggttgtggctgctgtagagacagcttctccgctgagcaccagggttcagggctggttgttttgcccagggggtctcgtggagcctccgcctgactgtggaactcgctgggaccctggctttagggggcgtctccgtgagacccctgcttgggtgcrctgggcttgtctcctccccatggaaacagaaggcygggcccccattctgggcaatactcccagctggagatgacttcctgtgtcctcgcctttacttaatttttggcctgagaggctgaatatacaaacggcaggggccagaccatgtggaaaactggaacgcaactcaggaccggcagcccagccgggracccagccctttatccccagtgggcagcccaggaggtcagacggcactccccacggcatccggcccctaacagccggggcctgcctcatcacaggcagcctcccctggaatgtctgtcccttcctccagcataggaccctagccaagcccagaggaggccggcctctagtgagcccgccacagcctccccaggccagcagcccccactcagcccactcrggcctcccctcttccactaggaagccctgctgctccctgcaggcctttgacctgacggggcacctgccatgctgtgccagcactgaagccttcactttgccctgtgggtggtcttcacttattcccacagtgactatctccgcgtccccacctttacctaatcttcgactgcaaragccctgcttgtcggggccccaccgtgctgagccgagacacaggacacacacaggccccagggctcccctgcctaccccgcgccccctcccagcccacccaccgctgcctgagtcctcgccgaggcttggcctgatcccagagcctcctctcctctcccaggctcctcgcctgctggccggctcccaggccccaggggctgcctcccatcatcctctttgtcccccggggctcatgtgcttttctcagcccccaggtctcctttcacgcccgtgtccagtctcagcctccgcctcctgcgctgcagagctgccaagatgctgacctgtgacgggagggtgcaggtgtaaaggcccagaggctgggaggccgcctctcgcggagcactgcaggggctgtggggacctgtgacgccggccaacggcgcccccacagttctgtgtcgtggcacgtgagccacagggaggctgggagagtgaccactgcgtcccttctcaggtgtgatagagaagcgaggctctcagcccctgctggacatcttggaggtggtgggaggctggccggtggcgatggacaggtggaacgagaccgtaggtaaggccgggcctggcagcagcctcacagacagacaaaggaggaccaggaccagggctccttcggtctgaggccttccaggaggggaccccacccccacccccagctggctgctctcaggagccccaagaggcccaacccagccggggcaacctcagggtcctgggaggtggtttaggttccatgctggggagttggtgccccgtggccagtcccatccagccctgcagaggggtgcccctcctcggcccctaggagcgctcgacactcaggccccagccaggctccggccaggccctggccccagggctccccactctgagcatgtgctccattcccccgggggcaggagtggcacctcacgtggctggcagccctgacaaccccatgctgctcccaaccccctccggtcacctgggggcccgcctgtggctcctgggctgttagggaaagtgtctcccacatcccccagcccctaaggcgcacaggtgagctccccaccctatggccccctagttcctggctccggaggccagattcaccgacaaggggccgggctggggccccagggcccrccagtctccagtgcggggcactgtctccccaggactcgagtgggagctggagcggcagctggcgctgatgaactcacagttcaacaggcgcgtcctcatcgacctcttcatctggaacgacgaccagaactccagccggcacatcatctacgtacgagccgcgccggtgggcaggggtaggcagggtccccaagcctggctgggggctcttgcagcacagcagaaggatgggccaggccgacagggagctccggggtctcctgggacctgggctcctggctcctgtccaygtccrtgggcccgggaacgagctgctgctgctggagtttctgttgggcctcctggccaagctgggggccacagtagaacccggytctggtcagaggggcgggggctcctgaacagcggggctggaaccggggcaggaggcctgacctcagggatccactgctggccacgggctggaggccaaagagaaacacacgaaacaaatacgcgccccactctgggggagccgcgggtgctgcgaggcccgggacagcctgaacccctccccaccccacccccgccaccctctccagtccagcccagcgcccccaccatcactcggggcagggtctggcctcccgggtccggcacaagctccaccaccagctcctgggcagagcacgtgtgcacggggcacagtcctgtggggaggcggctgcagcctgcctcagccaggctgcggggaccccgggccccttgcccagggtcacaccttctgtatttccagatagaccagcccaccttgggcatgccctcccgagagtactacttcaacggcggcagcaaccggaaggtgggtgggtcctcaccgcaatgccagatgacccccccatcaccccctaccccgtggtctggccttcccgttgcccacctggccttccctccccgaagctggtgttagtgagcacctgtggaggttgagcccggcactgagggtggcgggtgcagacgtgacctattgcttgccaccatcctgggggacgttccctcaacacccgggccaggcctggggacaagctcagctcagcagcagccccatggggcagaactgtcatccccctcccgtcagtacagacccaggctctgcagcaccggattcccaggagggcccctggagatctgagtgcaggcagctgggccccgagcctgctccatctcaaggggctgtcaagagaggggagggatgaggacccccactgtggacaaggggaccttgaggctggcaggcccagggctagcccagggtgcagggaagggtggggaaggacagggagcaggtgaggagggcaaggcatccagcaccagggcagaggtgaacaggcatgaggcatgaatgccccagagggccagacacaatccagggggcctcctggtggaggtgggctatgaactagactttgaaggatgaccaagcccagaggaagggccgtgtggccaaaggtggagcagtggggctgagagaaccacgccagagcaggagggactggagtgtctcaaaagcgccatgtctggccatgtgttcagaccaggcagctatgggccaagcctggccagagcattggcctgcactggggaagccctgcccagcgcgaggaaggcagctccctgaggagcaaacttcctcaggatcccactccagacactcaggccgggaagcacctgggtagggaagcccaaattagccctggcacccaccaccccggcacccaccaccctggcacccacagccccggcaggcccaagttagccctggcaccccaagcccagcaccccaaccccagcactgagagccccagcacccacctgtgcaaacccttataggcagccacacagtttaagccctgagcagccctgcagactaggtaccccgtccagtggctcgggcacaggtcacrcgtctgagacgctcccactcggcactctgtgtgcccgagagcctgctggtcaaggtgggtggacacgcattaggggcttccccatgtcctacgcccaccccacccccacagaaaactccctgggggccatggtggcygaggccacccagctctgcccggcgtcctttggcccaggtgcgggaagcctacctgcagttcatggtgtcagtggccacgttgctgcgggaggatgcaaacctgcccagggacagctgcctggtgcaggaggacatggtgcaggtkctggagctggagacacagctggccaaggtaagggggccggggcgggtggggagcgggcagcgagtgggctgggagccccaggcggtgtggctggccaaggtgagggggtgctgggtkggccggtagcaggcagggactgggccaggagccccagggggcatcctggccacccgcccgtgtgactgctatccccggcacaggccacggtaccccaggaggagagacacgacgtcatcgccttgtaccaccggatgggactggaggagctgcaaagccagtttggcctgaaggtgaggccacaccacacaggaggccggcactggccgggtggagactcgtgggggacatggaagcggccctctgagagggcacgttgcctggcatttaagctcagaaacattccccatccccgagcagggagaccctgtacctgatcacccaaacttgctgcagagcagcaccagcacgattactaatgtcactgggacagcagtgccaactgtgccatcctggaacagagtcacccatctgtgcggtgctgtgatggccccggtcttctgagcaggaaacggaggcctcagggggctgctgatgtgtgggggtgtacagggtcccacccagggctctcagacccyaagtcccgctcagaaccttagcagggtgcttcctcccagtcctgyctgccctgagggtagcagttccccctggccacaccctcaggcgctcccctgcccagtgcccaggccaggcaccgccctgtgctttgaggtgggggctggagaggagcagcccagcctgggaaggggcaagtcccccactccctcagccgactctcaccctgctggagcagctggccttctcgagggcctcctcccccaggaggcgcaggcgtgcagcttcggcaaagggtgcccaagtcagtggggggagggcaagggcagaagggggtccaaagcccctgccccctcaaccagagtatgtccctgagtgtctggagccacagctcttgccaagggcaagacagagagactctggggagagcctcgccccagggcacctagtgccttggaaggctggtggtccctagatcggttctggtccccagggctggcctgcggggacacaccttccccaacaccccgctgcccagaacacacgcagtggggccaggctctgctctggcactgggctttatccccttcccaaacaaaggcctatctcgatcgaggttccggtgcgggagagggacagaaaagcggagtgacctctaaaacgtgtcagaaagccagaaagggggcaggatgagctcagccaggacagcagacaggaggtaaagccttgcagagaaccaagggccatggccatctggggccagtgtggctcacacagcagttccccaagagtctggggcagggactcccagctaatgagcaccggggctagagagagatggagtaggaagtaaagcgggggatgccgtgtccgacctcgggggccacttgaaagtctcagactctgcccgagargagtgggggtatgacaggacgtgacctggttcacaagtaagagtgagtgaaggggacggggcaggtggcagagaagccaatcagaggctgccacgtagcccgggcaagagatggcagctctgccaaggggggtgcccgtggtggaggtggctttggggttgattttggaagtggagccaacagggtttgcaaaaggactaaatatggaagtgagagagctcagatggcctgaggttgccgtggagacatcacagcggcaggttcaggggagcgtccaggagcccagggtttggggacatttggtttacaatgcatttatgatgttcagaatcgccccagagtgaacacatccacacaatcacccctcagatcaagacttacgtgaccaccgacatcccagaagcccccacatgcccctgcctagcccctgtgcctgcctccttccctggagaagagaccctgacttctccctggagggaggccggtccctgacgtggcctctagattgctgagtggcctctgactctaagaacatgcgacaactcgggtcccactgtgctgtctctgggccttttctgagtgatgttgtcatgcccatgcctgtgtgtgcctgtggcaggcaagtgggtaggagtggaattgctgggtggaagcacacgcatctgttcaacagtaacaggcactgtctttccccagaattatccagggatgtgcgctccccaacagcggctggtgccacaccctcgcccgtgctgggtggtgtccgttctcagccgtttctgcacctgtgtagtggggtttcatctgggttcaatgtgactttccccaagggcggaggaggttaaacgccatctcctgtcaattggccaatgccattcccttttgtggaacgtctgtttgagtcttgcccatttgttctatcgggcgatctttctctgattgattcttggagttacctattttagatgtgactccttggtcagcttatgtgtacaaatgttctccccactgggcagcttgcttttttactctcataagggtttctttgtttcaatggaggctattaaatggtccaatttattggcttagcaaatgtgtgcagatctcttcttcgtggttagtattctttgtgttctgctaaagaactctttgcctaccctcaggtttgcttaggtctacaatctactttgagttgatttttttaatggacagtgagatgtaggaattgtttctttcttatggatttccagtcattcagcaccatttattaaaaagagccccctgtgagcccctggtcttggtgccttctgtgttataaatcaggtgttcctgtgtgtctatgcgtgggcccatatgtatatttctggactctcttttgccccactggtctctttatctatccaagtgataacccctaccaccatcactccttcagctttataatgtcttgatagtcaatagartatatatttcaactttgttcttcaagagtgtcttgataattctcagtcctttgcattttcacataaaacttaaaatctgccttccatttgcatacacgcacacacacaaaaagaaaaytctgctagaaatttgatagggatcactttgaatctctctatcaatttggggaagactttgcaatgctgagtcttccaatccatgaacatgrtatatgcttccatttatgcttcaatttttcttaataacttttaaagctttcagtgtcaagttcttatacatattttattagataaattacaggtgtttggttttctactataaatagaatcattttgaaattatcttatttgttgctgatatatggaaatactgactttgtaaatatgcagtcttactcaatgcacttattagttctggttatttatttgtagaataaacaaaatcatatcatttgtaaaaaaacarsrggggggttgkgtkttgtttgtttgagacagggtctcactctgtcatgcagactggagtggagtggcacagtcatggctcactgcagccttgacctcttgggctcaagcctcctgagtagctgcgaccacaggaatacaccatgaccaagccttgcctgatttttttttycccagaaacagggtttctctatgttggccaggctggtcttgaactcctgtgctcaagcagtcctcccgccctggcctcccaaagtgctgggattacaggcatgagccaccgcacctggtccagttttatttattctctttcagttcttactggctttatttcatgtttgcttttactgaactggacaggattttgagcataatgctgatgtcataatagtagacattaaaagaaaagcacgtatattcttaccactaaattttatgtttggccaggcatggtggctcatgcctgtaatcccagcactttgggaggccgaggcaggtggatcacctgaggtcaggagcttgagaccagcctggccaacatggtgaaaccctgtctctactaaaaatacaaaaactagctaggtgtgttagcacatgcctgtaatctcagctactagggaggctgaggcagcataattgcttgaacccaggggtcagaggttgcagtgacccaagattgcgctgctgcacttgaacctgggcaacaaagcgagactctgtctcaaaaataaatttaaaaaaaagttatgtttgctatggagttgtttttgttgctkctgctgcttcatacatttcctttatcaggttatagaattttccttctatttttctttttatctttttttttttttttttgagacaaagtcttgctctgttgcccaggctggagcgcagtggagtgatctcagctcaccataacctctgcctcccaggttcaagcgattctcatgcctcagcctcccaagtagctgggactacagcatgcgccaccacacccagctaatttttgcatttttagtagacacagggtttcaccatgttggccagcatggccttgaactcctggcctcaggtgatctgcccgcctcgacctcccaaagtgttgggattacaggcgtgagccactgtggctgaccccttctatttttatttgccaagagtttttattatgaatagatggcagattttatcaaatgctttttctgcatctgttgaaataatcatgtgactttcctcctttattcagttattgtagtgaattaaaattattttattttcaaatgttacaccaaacttgtattccttgaataaatctaattcagctgtgatatattagcattttatacaagtatggctaggttctatttgctaatattttgcttagaacttttgtatctatgacataaacgagactggcttattatttactctgcttataatatccttattttggtatyaaggttattcttggcctcataaatcaagttgaaaagcattttctcatctctggaaagttttaataagattggcagttttccttaaatgtcagatagaatccactggtgaagccaaatgggtctggaaatttctttrttggaaagtttcaaattaaatattccatttatttaacctagaagactattcatattttctatttctttttttgtcatttttgctaagttgtgtttttctaggaacttgcctgttatacttaggctttcgcatatatctgcatgatcgcttgggtttttacagctgtaggctctgtaataatgtcacccaccctttcctgattctgattacctgcaccttctctcttattccttgaacattcttcaacaggggctgggtttcttagattcccaggaactgtttctccctctctctctctccctctttctccccacttcctctatctgcagggatttaactggactctgttcatacaaactgtgctatcctctgtcaaaatcaagctgctgccagatgaggaagtggtggtctatggcatcccctacctgcagaaccttgaaaacatcatcgacacctactcagccaggtgaggcccagggagggtctccaaaggcctcagcatctttgcccctgctctcccatcctccccaacacagcttctgctcccaggaggggaccctatgaagcatctgccctgaggggtgtgggacatgaggggttaagctttagtggccagtggagtcttacattaaaaatgtgtcacatcccaagcacccggggcagatgggctggatcttggaggtggttgtcctggaggttttctccagcacccataactctctggggtggaacgtgctggccragggccctaagccatatctcctcccttgsaaagacctctcacctgttctcccctcaccctctaccttctgcccccaggaccatacagaactacctggtctggcgcctggtgctggaccgcattggtagcctaagccagagattcaaggacacacgagtgaactaccgcaaggtgagccccttccctgcccagagcctggccgggcactcattcattcaggccacgatgctgagcataagctgtaggcaaacaccgaggtccacaccagggtcacagccatggacgaggcagggcgaggcgcccaccccagtggggagtggaccatgacagtcaacaaggcagaacgtagctctgccaaaaccgcagagtatgatgtggcrgggaggcagggagggacgaggacagggagcactgctccggggaggcgacatttgagaccttaaaggcctgaagaggyggcggggtgatttcccgggagcagaaacagccagtgccagtgcagaggccagaggcaggagcaggcaggggccggayccgtggtcagcagcggacaggaaggagaagatggcagggagggaggcgaggtgaccacgggccacagcagccggtttggattgtactcccygtctgaaagccgcaggggtgctaagagcagagacgcggtcagatatgctgctcctgtagtcactgtggctgctccagggctggggtgagggtggrgacaaggaaccgcagggaggccctagggggattctggctgttctggggagagtgagttgagtagggggcggggtcagcatggaggccgatgtggtcamccaggtgaggtgacaggcttggccatggtgctggcagacacacagacgcaggggaggtgttgaccgcagcagctgagggattgggtataggggctaagggcagaggggagtcgggactctcaagacctttgttagagtaatgggagggacagaggtccccactgcaatggggagactgaggcagaggcaagctgggggcaagtcaagcctcctgttgccatgggggggtaggtcagagacatctgtgagtcaagcgtcaggggggcactgagtctaggagctttggggaggaagaaagggctgcctccctttcctaragggcaggaagtcctgcagcccagaaggtgtggcaggacgctgggcagagtgctccctgggctttgcctgagtctggggcccagagtctcgtgctcctgtgtccctggggacagatgagcaggtgttctcacagctgcttcaacaatggagagaccagggccctgggagctggtggctgagagggacgtggtcccaggccttgctctggggtcagcgccagccctgtgccttgagactggggctggagtcctggagagcagagtccagccagacaaccaggacaggggccggggaggaacccccccaactcctcagggtaaaggcccagctctcagtctgcggaagttccccaatcacaataccatgcccatccttccccccgccgcagcagcacccagaggtgaggctgagatcatcccgtgcccccgctagccccggggcaccctgaggctgaggataggtgggtctgctcaccccgtaagcccagggccccacgccaggcctgggaaggctgacgtgggggcccgtgggatgatcgggtggccccvccaggcgctgtttggcacaatggtggaggaggtgcgctggcgtgaatgtgtgggctacgtcaacagcaacatggagaacgccgtgggctccctctacgtcagggaggcgttccctggagacagcaagagcatggtgggcgcccctcatccatggcccacgcggggccagccttccacagggacaccgagcctccctgccctgagactcccaccccgcccaggctcaggggcacctgccccagctcaccagacagagggaggctaagggaagccgtgcccaccccatgcccctgaccccagccggccactgggccccagcctgagccctgcaggtccagctgggaaaggcacaggtggtacaagttgcccctggcccacgaggacccacagcccagcagggaggaccctgaagttgggttgtcatctcatccccccaccrgccccacacctcaccygagaggcccacagctgggcagccctgggccttgccccggcggggctcagaccagacctccccaaagcccttgaggctggtcattcgccctccagatgagtctgggacacgagggccatgcccgattcccaggtcagagaactcattgacaaggtgcggacagtgtttgtggagacgctggacgagctgggctggatggacgaggartccaagaagaaggcrcaggagaaggtatgtggctcgcagaggtcagggcagccccgactggatctgggcacgggcagcaccgccccgacaaagcctcctgacggtccccacggggagaaggcagccccgggaggcgcagacaggaccccacggggagaaggcagccccgggaggcgcagacaggaccccacggggagaaggcagccccgggaggcgcagacaggaccactcgcccactgtggagctgaggaaaagcaggcaggggcaggaaccaggcctgggacatccccagcaccccccatgagccagcgggggtagcggtggcctcgggagcaagggtcagacccaccagaagctcctctggacccaagtgacagacggcagccgagtgacccctccagggcccctgcccccacccggacccctggcgggctgttgggctctaggtcaggtgggcggagccttccatattctgtccccattaaacctccccagagcctgcaaggtgggggccagatcccggagccccccagcccctcaccacaggacagggagagcacagccaggatgccccgggctgacccctcccacagtgtggcactcactgaccggcccccgggctgactccatccgcagtggggcacccactgaccagtccctcctccccactcaggccatgagcatccgggagcagatcgggcaccctgactacatcctggaggagaygaacaggcgcctggacgaggagtactccaatgtgcgcccccaaccccagccctaaactgccccccacaccgtggacatgggccctgattgcctgggggctcctctgtgccaagctctgtgccctcctcccaggcgctaacacagctgtcctcaccgtgccctagggtggtggctycagcactaccctcagtgtacagatggggaaactgaggcctggagggacgagggacttgctcagagtcatgtaaatgcccacagccagggctgccccgttcacctgcacccacagccgactgtccacgtgcggacgcctggcaaggcttgaggtccttccccaaccacccaggacctctccccttgctcctctgagggcccggccccagcatctggcagtgactgcccctctcccgtagctgaacttctcagaggacctgtactttgagaacagtctgcagaacctcaaggtgggcgcccagcggagcctcaggaagcttcgggaaaaggtggacccaaatctgtgagtggcatcgctggtgcggcatgggcggggggggccagggagtggccagtaaggcgtgcagggctgcctgccaggcgggggactggatgcgtggctggggtccagtgccagctgaggggtgcagtcactgggcctatcttggacagagtcccccatcaccctctgctttctggggcccaagtcgcctcctcctcagggaccccaggaaggaaccagatcttgggataggcctgggcccttgctctggtgtggccagggtaggccctggtccatcaaggcagagagagcccagagggagggtccccggagaggcggctcccagagaccggcttgtctatcacagctggatcatcggggcggcggtggtcaatgcgttctactccccaaaccgaaaccagattggtaagttcctccccctccctgcctgcccaggccctttggtgccagagttgaaggggtggcttgcagccccctgcccatcccttcctcctgggggcaccccagcctgttcttggaacattctcctatgtcaccccttgctgcccccgtggggaacactcrctccygtgcccatgagcggcttcgggagggacttggcaggcggcccagagcctttcctgcaggcagaacaggatggtgggaggaggccggactgaggtcctgggtctgccaggcacgagcccgcccagcctctgaacctccgtgtcttcatctgtaaattgagggaatcctgacctctgcctcccggtctgtgggatcaagtgtcagaacccctggcagcgccatccctgagcctggcacacaggagatgtgtccactcacagcttattctttgtcccrcccttggggacagtattccctgccgggatcctccagccccccttcttcagcaaggagcagccacaggccttgaactttggaggcattgggatggtgatcgggcacgagatcacrcacggctttgacgacaatggtgagcggccgcccctccaatcacacacgccctcccctctccgcggagaagcagccaggaaggggcctgggggcgctccattcaacccyttcacggtttcagtggggacaccgaggccaggtcctcagggagctgtgggggcagagcaggctttgaatgccaggctggggccctgtctgggggcactgactcccagcatggaggaggggacccagggactccagcccatgaccctgactccacctggcactgggcacttccctcccacggcctgtgacatggggacracaacactgcccaatacagcagygaagcccagatcccagcctgggagactmtccagacggccagcatcctccaccggggggtgtgctacccccgccatggccatgctgacctccgcccctcggtggggactgccctgcctgggacaggggccccagctggttttcccctgtggctcggccatccggaccttccgtgggcagtccttgtccccagggaccacgtactcctctcgcctggaacttagagtttgggcatcccaggaggagcccttaaaccatgatgcctccaagaccacaggacccaggtgctaggccctagcctcagggggtggcatgggagaccactgaagccctccttctctgggggctgtgtagccccagacagctgctgccccttggagcccgcgatgctcttccaggctcagcctactcagactgtgggctctccgtactggggctggctgcaggaggggcaggagcrgccaggcacagtggctgccgtggggccrggcacagtgcagccaggggcatgtgggcagccctcctctgcccctgcccaggccggaacttcgacaagaatggcaacatgatggattggtggagtaacttctccacccagcacttccgggagcagtcagagtgcatgatctaccagtacggcaactactcctgggacctggcagacgaacagaacgtgagcgctgccaccagcacccaggctgcrggggtaccggagccccagccctggccctgagggagarggaagtcagggccggggctgccccaatcctgtctcctgtgcgcaggtgaacggattcaacacccttggggaaaacattgctgacaacggaggggtgcggcaagcctataaggtggggcctggcaggggagggggcgtcagcgcggcaggggagggggcgtcagcgcggcaggggagggggtgccagtgcatcaggggagggggcgccagcacggcaggggagggggcatcagcgcggcaggggagggggcgtcagcgcggcaggggagggggcgtcagcgcggcaggggagggggcgccagcacggcaggggagggggcgtcagcatggcaggggagggggcgccagtgcatcaggggagggggcatcagcgcggcaggggagggggtgccagcacagcaggggagggggcgtcagcatggcaggggagggggggcatcagcgctgcaggggaggggggcaccagtgcctcaggggaggggrcgtcaggggctcattcrggacaggtggtgtgcagtgggctgtctggccagggatccccccccgagggcccagctcaggggtccctgagtgactgaggtggtgagcgctcatccgtggggtgtgtgaagggcccttgcagcagcaggacccccacaggggtaggtcctggagccagacctctgctctgccctgagatctgagggttctggagtccaggctggcaggcctgagctcagctcctgtctggtgcctgcaggcctacctcaagtggatggcagagggtggcaaggaccagcagctgcccggcctggatctcacccatgagcagctcttcttcatcaactatgcccaggtggcagccgcagtcctggtcccaccatccccatgcttccccactcatctctggagggcccactctggggcacctccagggaccagagcccagcatggaaggccccttgggggaaaagcatgaggggcagggggcgggagctggacaggatttcaatgstgatgggaggaggggagcacctgctgactcccctcaccccaccctagaaggggcagcctggggatagtggagaccctcccccacccctcctggccaccccaccacgccacctgtagccacgcccccaacatgcccacaggtgtggtgcgggtcctaccggcccgagttcgccatccaatccatcaagacagacgtccacagtcccctgaagtacaggcaagtctcccatgctcacaacccccttgccacccacaaccccctcacccccaccccagtggcctgtaaaagaagaaagcacaaaaagtggctcaacagagacaggtttattttgggaataaacctgagaggggcttctggccgatttcggtcagggacattctcttacagactaagggcatttaagggtttaggaagggggagcctaccgcaggctgcraatgtttctgtgtgaaggagagttttattgcagagttggaatatctctggctggaggggaggttattctcaggattggcatgtttctggtcagatgggggtttatctcatggttgaaatgtttctgctcatactgacatgagccattaggctgatgttttgggctggtttttaatcacggagaacttaaaatggccatgtttgtccaagatggcaatgctcctgctgtcacacccacccacccacagggtactggggtcgctgcagaacctggccgccttcgcagacacgttccactgtgcccggggcacccccatgcaccccaaggagcgatgccgcgtgtggtagccaaggccctgccgcgctgtgcggcccacgcccaccygctgctcrgaggcatctgtgcgaaggtgcagctagcggcgacccagtgtacgtcccgccccggccaaccatgccaagcctgcctgccaggcctctgcgcctggcctagggtgcagccacctgcctgacacccagggatgagcagtgtccagtgcagtacctggaccggagccccctccacagacaccmgcggggctcagtgcccccgtcacagctctgtagagacaatcaactgtgtcctgcccaccctccaaggtgcattgtcttccagtatctacagcttcagacttgagctaagtaaatgcttcaaagaaatcagaggccttgcttgtctgggagggaccagggtgggtaaacaggtagcagtggtcttgggcaaaacagctgcccgggggtgggagagagtgacagctgggagctgatggggagggagccagttccagtcaggtctcctagggtccaatgctagggccagcagtgaccaggatgcccccaagtgcccacccccagggaccacacattcagatgcggggagccccactggggcaccgggggacccagagagctgcagctgggaacctgaaattttagcttggtgtaactgaaagccagaggaggggctgaacgcaaagggacgcagtgggtcacctgctatgcatttttaaatggccactgcaagggtggcattgggggcaggaagggagccgggagacccacaggaacccacagtggtccccaggtctggactagggagtgcagagagggctgcagttgtcatcggcctgcatgggaggggagggcctgagcaggtagtctgacctgggaggtaaggggctctgctctgggcctgttagggtccccagggaaaggtggccaagaagctggacacacctaattagactaagaccctcccgggccggccgccccaaaggccatacccagcaggtgcaaacaatgattctgacatcagtaaagagccttggggcaggctggcccatcacctgagagtctccagggtccacccaccccaccaggtggaatcaagcccatctctgccctgaaaacccaactctcctgagtggcccccaccagacacaggcactgaccccgaccctgctggagctgaccccacgctcctctcctgacgtgggcttgggtctgtcgcctttgaagggagtgacggggcagtgaggttaccatccccagtgccccacaggccaaaggcccaaggtctccagagaaagtcgcagagcaggaagatgacacctgggactcacagccaccctgcccgccctgagggcccaacagtgagcaaggcgggggctgtggaggatgcagggctcggagcctgcgaagcagtgcgtggtcaggaactgcagttttaatggctcgttgctgccggcggatcaggagaggttcggcatcccgacccagcgcctccggaacagttcttccaagtggacttccagcacacctagggcagcagacgccacccagatcctcggaggccagggccttcgcctccctcacacctctctgtcacactgtggggacagcagggtcccatggggccgctggacactggatcagacaaatgcctggagggcccccttggacaatccccagccctcccaaggctgagaggacacgcctctctgcccgccaccccatgtgtcgcccccacctctgaggacagtcccaaggtgcctgtccatccagccatgctgcccttcggcccctctcagcctgccccactctgcaagtggggtcacagtggcatccatatcccagggcacaattggcatgatgcccacagcgctgtggctcagctcccagccaagccgagtgctcctcccaggggacctaggggcagggcgtgggctggcaggcagcgcccccaaggcccagctcacctgaggcgggtcgctggcacagacctccgcagagatgcccaggacctgcaggatgtgctccttggggacgtagtcgcctggggacttctggacgaaatgcaggagcactttatcaccacctgtagcagcgggcaggcagtcacggcaccccggaggccgcctgcacctcacagccacataccaggaggagggagggtagggcagccctggccagccatatcccccacccggctacccagatgagtgagctgttctgccacagccccactcagcccagcagacacgcagaaccaggccacattgcggcggaggggctgtgatgagactgacaagccagagagagggcctgggctgggccaccaagttcagcaaggccctccttgaggcagtggccgaggcccctccctcgacccacctttgctgaccaccagcagccctccgctctgcagcaggtccccagacaagttcccctggatgccaacagccttggcctgtcaggagtgggtacagcctgagtcaatcctagaagaaaggctcctgggagctcccaccaccccccggcctgtacacccttgacccgcacacaccttggcagccacatcacgcacgggcttccccagagctgctgggaggatgctcaggctgttgtacctgcgaagacaccaggtcgcttggccaaactccggagaagcctgggtccagagcctgctccagtgtccatgagaccagttcctaggtcaggccccaccccacccacccgcctcaccagggctcagagatggcacaggcgaccagatcagtagccagcccagcccaccggcaggttggacaccgagcccagtggctgctagccgagggtccacagagggtgcagggagcatggatggggccccaggctgggtgtgcccagggatctggctcagctggcaactgccaagcaaaggaagcagcctgtggcacagacaccagaaagctaggatggcccctgatgggccacgaggctccaccccacgaggtggtctggacaccgagagtaagccccggacgaggtggctcattacagtcacccagcacccaagagaaggcctggcagaagggctggtcaacagtgccaccagagccgccttgcccaggaaggcccgagtggacagcaccacagagggcagcagggagaggaggtggcagggagcggtgggaacccctgggccccccaccccacgctacccaagggttcccgcccccactcaccgcttgaagcctagctccttgtaaagctgcttgctctcatccaggtagagctctggaaagcggaagccacatgtgtgtgccccaggcgcagaaccagcccccaacccactcaccacaaagaatcgccctcctccttccgaccctctgttcctctgcccaccctccgtgctcagcccacccccgcagggcagggaggggtaaaacggggctgagtgtcccccctcccctcagaagaggggctgagtcccagaggcaacaggtggagccggcggggcagagctcgtccagactctgctgctgggcccaggtctgtgcagggcaccacccagccaccagctgcggggcggggaggcagggagagatgagggacgctgacccgtgggcatatcaaggccgctccagcagacagaagggccggggttgggcaggaaagggccccgaacgccctgagcttagggaagggtatgtgcgccgccgcggcggggaacaggacgcacctcccgcgaagtagtcgccgtccaggaactcctgcagacccagggcctcgggccctacgcccaccaggcgcacgccgtgttggtccaggagcccagcaaggctgctgaggtcctgggcgatccagcggcacaccacgcacccgaagcgccgcagcccggccaccacgcacgcgtgctcccgccacaggctccgcagctccacggcctgccgggcggctgggtcatgggcgcgccccgttgcccccagccccgcccaggccccgcggcccccaccaccccatcgctgccaggacgcccgggcaaggagccagggacgcgcccaccgccctgcgtccacccggcctcacctccccggtcaccgcatgcttcaggatgcacgcgcccacgcgagcaaggtccaccgtgctcatggcggccgctgccagccctggttcccggctccccgactccctgttccccgctcccggctcctcgctcctggatccccgctcccggctcatagatccagccccaagccccgccccgagatgccccggtcccgcctttctcgctgccgccgaggccccgccccttcgggctcgtctccgccccgggcccgcccccaagatggccgcagcgcgccccggccacgcccccgaccgcaccccgagccctgctccgccccctcggattcgcccctagtcccgccttgtttcccctcctactccaggccaagcctcgagatcgcggcgccaaatcctgggtccgcctgcttcggtccctcccgcctcctcaatccgggccttgcgggacagttgctgtcccgcgtcctggtcccgcccctagccccgcctctccgttgggccgccgacttggaccccgtcggccattggcgcagcaggcggagctgggcggtgcggccctcggtgcgcggtgcgcctgtgcggaatgcggcgggaggcgggcagccggctcggggtcgtcccggggggcgccggggagcggctgggtacggtgggcccaggggtggtccagggagcggcgggggtctccctgcggcctcgcgcgagactgggctggactcagggttgaggggagagggtgagcgcaggggtcgcgggcataggggaccgcgggccggggtctcccgcggggcgggggtcccagcagtggggggcgggggggtgcgagggcttagcctttccacgtggcctggttttcgcttgaaaatccccgcaaatgcggcagcatctcaattatacatggacgcgatgtctttaatcatgaaatactgttcatgtcgtgccggttgcatatcagcttttaacccgccaaaccttggggcgaaatagaccccggggagataagcacagctcccagaagtgcactgcgggtcaggtgcctggcagatgcgtcctgttcctcccccactgcagccctgtgatagcttttgtcaccgagttggggtgagggccgggtcacagcttcacccggcctgggctcccacctgagcgggcccggcctggcagagtctgtgctgctggcacgggtcctcactccccaggccccaggacagctccaggggcctgggcgggctggagaaggaagggggagcccccacactgtattccaaataaagagaggccccgggggggtgctgctgcttcgcctgtgccctcgccctggggtggtgaaggtccagactgcgaaacggaagtcgtcactatgtcagaaagggcaaaaagcaaaacaaggaaggggaagcactaggagggaggagctgtggcagctccagagcccaggagtgcagcccccagagaccagggctacccctctaccgtctcgggctgtgcaggaggggccctctaccctctggagttgtgcaggagggggcccctctaccatctggggctgggcaggaagggcccccccccaccgtctcaggctgtgcaggagggggcccctctactgtctcgggctgtgcaggagggggcccctctatcttctggggctgtgcaggagggggcccctccactgtctcaggctgtgcaggagagggcccctctgccgtctggggctgtgcaagcagtgagcaagctgccgcctccttgggagctgggatcccagacgggattcagccattttcagagacgttcccagaaacgagaatgcgagatcaattcctcgcctggcatctcccaccaacgccatcgctgcaggagcctcactggaagccaacgggcagaggagagtgggaaaggagcttgcagcctcccagctccagtgatgcagagcagaaggtggctgggaggctgagaagccataagaaaatagcagggccagcccatgtggccgctcagatacatgctatgtgtgtgtttgcatatgtaggggctgaaaaactccacctccatccttttgaggtcctggctgggcccaagagttaaatcaagataagacagatcatcatgccagtgtatttgattaaagttggatgtggctcaggagccctcctaaggaagtgaagacccagtgaagcagactcagtcgtgtgctgagttggacagagaacagtgaggtttgaggaagcagctagatgatgtggggggctgaaaaggtgagaggcattttatcagggactgtacagcatttgctgggtctcagcttctcatccttgaggatcagagctttctagtgtagggagagcatctttcacctgggaatttcatcttctgcttttaagaaacacaagagagatcagaatgatctttttgcacctgttattgttttaactgcctttaattcctaatagtgactatgccaga

SEQ ID NO: 12342 - DNA, 16983 bp, Homo sapiens
attgcaccactgctcttcagcccgggtgacagagccagatcctgcctcaaaaataataataataataataataaaagaaagaaagttgatcaaatcccatctttggtgtatatagggtgggacttggggaaacacagctgctctttcccaggggtcctctgcagcctgcccacctggttgagtctgtgaggcttctcatagggacatcctgggctttgctggagggggatgggcaggatggcaggggccaggggccatttgggatggagctggagcgctccagcatcctctcagccacagtggggctgcgattcctgctgctcagaagcaaggcgagccggccagagtggctgataactgagcgtgcggttggcaaaggtggttaccagggtttgttttacagatgaagaaactgaggcttagacaaggtggtgacttacccacagtgacccagctgggcggtgccagagccagcatctgaataagccctggtctgatgcaggtcctgcgatctccccacgccctgacagtgacctatctttgtgcacacacgtgtgtttgtgtactgggcacacctcccctaaggtttgcagggcccagggctagaacagagatgtaaacacgagaagaggcaggaaggtgtgtgccattatcaaaagaaaagagaggctggccaggtgtggtggctcatgcctataatcccagcactttaggaggccgtggtgggtggatcacctgaggtcaggagttcaacaccagcctggccaacatggtgaaaccccgtctctactaaaaatacaaaaattagccaggtgtggtggtgcgcgcttgtagtcctacttgggaggctgaggcaggagaatcgcttgaacccgggaggtggaggttgcagtgagctgatactgtgccactgcactccagcctaggcgacagagcaagaatccgtctcaaaaaaaaaaaaaaaaaaaaaaagaaagaaaagaaaagaaaacagaggcaacagaagcagaacctcagatgtgagtgtcagtagacaggtattttaaaataactcattcatgtgttactaaaaacaggaaatgccgtctaacgggatctctggatggagaattccacagctgattggaacctaaacgagagaaccaaatggacatcccagggctgcaggtcagtgtcatgagacgggtgatggcagactggaccccgtggcaggtggaccatggaggggagacagagacagggcaacagaaacggtgcaaacagccactgaaatacccgtgggaaagaaaagcacaacagagaacaggagacttatgtgactccgactcaacaagacgcattagttaaaagatctaatatatgcgtatggggcttcccagaataagaggaaggaaggaaggaaagaatgagacatcataagatagtgttaaaaaaaaaagaattcccagccgggcacgctggctcacgcctgtaatctcagcactttggaaggccatggcgggtggatcacctgaagtcaggagttcaagaccagcctgaccaacatggtgaaaccttgtctctactaaaatacaaaagttagctgggcatgggtggtgggcacccgtaatctcagctactccagaggctgaggcaggagaatcgcttgaacccaagaggcagaggttgcagcgagctgagatcgagccgttgcactccagcctgggcaacaagagcaaaactgcatctcaaaacaaacaaacaaacaaataaaataaaagaattcccaaactgattaaagataccaacccacagactcaagaagcctagtaggacttctgctgctggccacgatgctgcaacttgtcaatgtaaaataaacaacagagagactggctctcccaaataaagtttactgggggatggcaggggattgcaatctgggatatgcatgctgagggggaccgtaggtgtatctttcttttaggggtgggaagaggaagtctacacagattgttttggaataaacctccctgggtacaggagcttattgcagggttggtgattactcatgggtaacatgattgttgcgggggagatgtcttcataggagcagctgatctggaatgttgtgtgctgtcggagtccctgtaacagttctcatcataggcacccgagcatgagggaccttccgttgaggcctcccagctccgttttgcttgggtcctgacataagtgactctgccttagtattgacaattttcacacagtggagccagtttcccccatttgtgccccctcccccagttcatatgctgaaaccgaatccctaatgtgatgacattatgaggtggggcttcggcatgtgcttaggtgggtagtgagggtggagccctcgggaatgggttagtgcttttatttatgtattttattttattttgagacgaagtctcactctgtcgcctaggctgggaggcagtggcatgatcttggctcattgcaacctctgcctcccaagttcaagtgattctcctgcctcagcctcccgggtagctgggattacaggcatgctccaccacgtccagctaatttttgtatctttagtagagataaggtttcaccatgttagccaggctggtctcgaactcctgactacaggtgatccgcccacctcggcctcccaaagtgctgggattacagacgtgagccaaaacacccggccaaagttagtgcctttaaaaaggaggccccccagagccccctcatgccttccaccctgtgaggacacagcatgaagaagtgatctaggaaccaggaaggggtcctcgccagaccttgaatatgccggcgctttgatcttggacctccagcctccagaaatgtgagaaatcaatttctgttctttagaagccaccccatctatgactaagacaccctcccaccttcatgctactgagtggacaagcttacatgaaatgactgttttcacatatgtggcaccaggcagcccagggatgccggtgaaatctctgggtaagtctctttggcctctggtactggcagcttctcctgttaagagggcagtcctccacgagtgtctcgtgccccccacctctcacagggtgtgccaggaatgcaggccctgagtaccctcccccatttctcagggtggtttgccctgagagtcctctagggacaaagagcagcttgctcactgcttgctgcagaaacagctgactcccccagtgcagggctcctcagtggccacgcaaacctactgactgtgcagtgcccacccaggcctacccacatggcacccgtggaatttgggggcaaggggataagaccaaacacacaggtgagcacctgcctgccacgccatgaatgaaaaagtcctttgtctctgaccccggagtttcacgtcttctgtcagcatccctgctgcggtaacgggccagctcttcctttgtaaggaaagctaaaacccagtcccagagctggcaccacctggaggaggaagtgctcttccctgcccctccttggccatgtgacttgctctggccagtgacatgggagtgcaagcgacacatcccagctgtgcatggccgctgggagagtgtggcatggtttctccatctctcctccatgtcctcccttgtcaggagaacggcatgttccagagagccacagcttgctcagcctggaccccagaacgaaggaggcatcagaagctgagccacccgtggccgacaagaaacctgagtgggaggggaaacttggttgctgtgatcgacccaggcttgcgagttgttttggcaacacagcctagcaagagccgaccaatatgtcattgatgaaagaaagtcaacaggcgtgtagaaggagctgtctactgagcatgtctgcacttttctgaattatgttgcacttgagtaaaaagtaagcaagcctgtctatttactttaaatgatgtgtgccagatatgtacagtatgcagagttaagaaggtgccaccccaaaataggctgctctggcatagtcactattaggaattaaaggcagttaaaacaataacaggtgcaaaaagatcattctgatctctcttgtgtttcttaaaagcagaagatgaaattcccaggtgaaagatgctctccctacactagaaagctctgatcctcaaggatgagaagctgagacccagcaaatgctgtacagtccctgataaaatgcctctcaccttttcagccccccacatcatctagctgcttcctcaaacctcactgttctctgtccaactcagcacacgactgagtctgcttcactgggtcttcacttccttaggagggctcctgagccacatccaactttaatcaaatacactggcatgatgatctgtcttatcttgatttaactcttgggcccagccaggacctcaaaaggatggaggtggagtttttcagcccctacatatgcaaacacacacatagcatgtatctgagcggccacatgggctggccctgctattttcttatggcttctcagcctcccagccaccttctgctctgcatcactggagctgggaggctgcaagctcctttcccactctcctctgcccgttggcttccagtgaggctcctgcagcgatggcgttggtgggagatgccaggcgaggaattgatctcgcattctcgtttctgggaacgtctctgaaaatggctgaatcccgtctgggatcccagctcccaaggaggcggcagcttgctcactgcttgcacagccccagacggcagaggggccctctcctgcacagcctgagacagtggaggggccccctcctgcacagccccagaagatagaggggccccctcctgcacagcccgagacagtagaggggccccctcctgcacagcctgagacggtgggggggggcccttcctgcccagccccagatggtagaggggccccctcctgcacaactccagagggtagagggcccctcctgcacagcccgagacggtagaggggtagccctggtctctgggggctgcactcctgggctctggagctgccacagctcctccctcctagtgcttccccttccttgttttgctttttgccctttctgacatagtgacgacttccgtttcgcagtctggaccttcaccaccccagggcgagggcacaggcgaagcagcagcacccccccggggcctctctttatttggaatacagtgtgggggctcccccttccttctccagcccgcccaggcccctggagctgtcctggggcctggggagtgaggacccgtgccagcagcacagactctgccaggccgggcccgctcaggtgggagcccaggccgggtgaagctgtgacccggccctcaccccaactcggtgacaaaagctatcacagggctgcagtgggggaggaacaggacgcatctgccaggcacctgacccgcagtgcacttctgggagctgtgcttatctccccggggtctatttcgccccaaggtttggcgggttaaaagctgatatgcaaccggcacgacatgaacagtatttcatgattaaagacatcgcgtccatgtataattgagatgctgccgcatttgcggggattttcaagcgaaaaccaggccacgtggaaaggctaagccctcgcacccccccgccccccactgctgggacccccgccccgcgggagaccccggcccgcggtcccctatgcccgcgacccctgcgctcaccctctcccctcaaccctgagtccagcccagtctcgcgcgaggccgcagggagacccccgccgctccctggaccacccctgggcccaccgtacccagccgctccccggcgccccccgggacgaccccgagccggctgcccgcctcccgccgcattccgcacaggcgcaccgcgcaccgagggccgcaccgcccagctccgcctgctgcgccaatggccgacggggtccaagtcggcggcccaacggagaggcggggctaggggcgggaccaggacgcgggacagcaactgtcccgcaaggcccggattgaggaggcgggagggaccgaagcaggcggacccaggatttggcgccgcgatctcgaggcttggcctggagtaggaggggaaacaaggcgggactaggggcgaatccgagggggcggagcagggctcggggtgcggtcgggggcgtggccggggcgcgctgcggccatcttgggggcgggcccggggcggagacgagcccgaaggggcggggcctcggcggcagcgagaaaggcgggaccggggcatctcggggcggggcttggggctggatctatgagccgggagcggggatccaggagcgaggagccgggagcggggaacagggagtcggggagccgggaaccagggctggcagcggccgccatgagcacggtggaccttgctcgcgtgggcgcgtgcatcctgaagcatgcggtgaccggggaggtgaggccgggtggacgcagggcggtgggcgcgtccctggctccttgcccgggcgtcctggcagcgatggggtggtgggggccgcggggcctgggcggggctgggggcaacggggcgcgcccatgacccagccgcccggcaggccgtggagctgcggagcctgtggcgggagcacgcgtgcgtggtggccgggctgcggcgcttcgggtgcgtggtgtgccgctggatcgcccaggacctcagcagccttgctgggctcctggaccaacacggcgtgcgcctggtgggcgtagggcccgaggccctgggtctgcaggagttcctggacggcgactacttcgcgggaggtgcgtcctgttccccgccgcggcggcgcacatacccttccctaagctcagggcgttcggggccctttcctgcccaaccccggcccttctgtctgctggagcggccttgatatgcccacgggtcagcgtccctcatctctccctgcctccccgccccgcagctggtggctgggtggtgccctgcacagacctgggcccagcagcagagtctggacgagctctgccccgccggctccacctgttgcctctgggactcagcccctcttctgaggggaggggggacactcagccccgttttacccctccctgccctgcgggggtgggctgagcacggagggtgggcagaggaacagagggtcggaaggaggagggcgattctttgtggtgagtgggttgggggctggttctgcgcctggggcacacacatgtggcttccgctttccagagctctacctggatgagagcaagcagctttacaaggagctaggcttcaagcggtgagtgggggcgggaacccttgggtagcgtggggtggggggcccaggggttcccaccgctccctgccacctcctctccctgctgccctctgtggtgctgtccactcgggccttcctgggcaaggcggctctggtggcactgttgaccagcccttctgccaggccttctcttgggtgctgggtgactgtaatgagccacctcgtccggggcttactctcggtgtccagaccacctcgtggggtggagcctcgtggcccatcaggggccatcctagctttctggtgtctgtgccacaggctgcttcctttgcttggcagttgccagctgagccagatccctgggcacacccagcctggggccccatccatgctccctgcaccctctgtggaccctcggctagcagccactgggctcggtgtccaacctgccggtgggctgggctggctactgatctggtcgcctgtgccatctctgagccctggtgaggcgggtgggtggggtggggcctgacctaggaactggtctcatggacactggagcaggctctggacccaggcttctccggagtttggccaagygacctggtgtcttcgcaggtacaacagcctgagcatcctcccagcagctctggggaagcccgtgcgtgatgtggctgccaaggtgtgtgcgggtcaagggtgtacaggccggggggtggtgggagctcccaggagcctttcttctaggattgactcaggctgtamccactcctgacaggccaaggctgttggcatccaggggaacttgtctggggacctgctgcagagcggagggctgctggtggtcagcaaaggtgggtcgagggaggggcctcggccactgcctcaaggagggccttgctgaacttggtggcccagcccaggccctctctctggcttgtcagtctcatcacagcccctccgccgcaatgtggcctggttctgcgtgtctgctgggctgagtggggctgtggcagaacagctcactcatctgggtagccgggtgggggatatggctggccagggctgccctaccctccctcctcctggtaygtggctgtgaggtgcaggcggcctccggggtgccgtgactgcctgcccgctgctacaggtggtgataaagtgctcctgcatttcgtccagaagtccccaggcgactacgtccccaaggagcacatcctgcaggtcctgggcatctctgcggaggtctgtgccagcgacccgcctcaggtgagctgggccttgggggcrctgcctgccagcccacgccctgccccyaggtcccctgggaggagcactcggcttggctgggagctgagccacagcgctgtgggcatcatgccaattgtgccctgggatatggatgccactgtgaccccacttgcagagtggggcaggctgagaggggccgaagggcagcatggctggatggacaggcaccttgggactgtcctcagaggtgggggcgacacatggggtggcgggcagagaggygtgtcctctcagccttgggagggctggggattgtccaagggggccctccaggcatttgtctgatccagtgtccagcggccccatgggaccctgctgtccccacagtgtgacagagaggtgtgagggaggcgaaggccctggcctccgaggatctgggtggcgtctgctgccctaggtgtgctggaagtccacttggaagaactgttccggaggcgctgggtcgggatgccgaacctctcctgatccgccggcagcaacgagccattaaaactgcagttcctgaccacgcactgcttcgcaggctccgagccctgcatcctccacagcccccgccttgctcactgttgggccctcagggcgggcagggtggctgtgagtcccaggtgtcatcttcctgctctgcgactttctctggagaccttgggcctttggcctgtggggcactggggatggtaacctcactgccccgtcactcccttcaaaggcgacagacccaagcccacgtcaggagaggagcgtggggtcagctccagcagggtcggggtcagtgcctgtgtctggtgggggccactcaggagagttgggttttcagggcagagatgggcttgattccacctggtggggtgggtggaccctggagactctcaggtgatgggccagcctgccccaaggctctttactgatgtyagaatcattgtttgcacctgctgggtatggcctttggggcggccggcccgggagggtcttagtctaattaggtgtgtccagcttcttggccacctttccctggggaccctaacaggcccagagcagagccccttacctcccaggtcagactacctgctcaggccctcccctcccatgcaggccgatgacaactgcagccctctctgcactccctagtccagacctggggaccactgtgggttcctgtgggtctcccggctcccttcctgcccccaatgccacccttgcagtggccatttaaaaatgcatagcaggtgacccactgcgtccctttgcgttcagcccctcctctggctttcagttacaccaagctaaaatttcaggttcccagctgcagctctctgggtcccccggtgccccagtggggctccccgcatctgaatgtgtggtccctgggggtgggcacttgggggcatcctggtcactgctggccctagcattggaccctaggagacctgactggaactggctccctccccatcagctcccagctgtcactctctcccacccccgggcagctgttttgcccaagaccactgctacctgtttacccaccctggtccctcccagacaagcaaggcctctgatttctttgaagcatttacttagctcaagtctgaagctgtagatactggaagacaatgcaccttggagggtgggcaggacacagttgattgtctctacagagctgtgacgggggcactgagccccgckggtgtctgtggagggggctccggtccaggtactgcactggacactgctcatccctgggtgtcaggcaggtggctgcaccctaggccaggcgcagaggcctggcaggcaggcttggcatggttggccggggcgggacgtacactgggtcgccgctagctgcaccttcgcacagatgcctcygagcagcrggtgggcgtgggccgcacagcgcggcagggccttggctaccacacgcggcatcgctccttggggtgcatgggggtgccccgggcacagtggaacgtgtctgcgaaggcggccaggttctgcagcgaccccagtaccctgtgggtgggtgggtgtgacagcaggagcattgccatcttggacaaacatggccattttaagttctccgtgattaaaaaccagcccaaaacatcagcctaatggctcatgtcagtatgagcagaaacatttcaaccatgagataaacccccatctgaccagaaacatgccaatcctgagaataacctcccctccagccagagatattccaactctgcaataaaactctccttcacacagaaacattcgcagcctgcggtaggctcccccttcctaaacccttaaatgcccttagtctgtaagagaatgtccctgaccgaaatcggccagaagcccctctcaggtttattcccaaaataaacctgtctctgttgagccactttttgtgctttcttcttttacaggccactggggtgggggtgagggggttgtgggtggcaagggggttgtgagcatgggagacttgcctgtacttcaggggactgtggacgtctgtcttgatggattggatggcgaactcgggccggtaggacccgcaccacacctgtgggcatgttgggggcgtggctacaggtggcgtggtggggtggccaggaggggtgggggagggtctccactatccccaggctgccccttctagggtggggtgaggggagtcagcaggtgctcccctcctcccatcagcattgaaatcctgtccagctcccgccccctgcccctcatgcttttcccccaaggggccttccatgctgggctctggtccctggaggtgccccagagtgggccctccagagatgagtggggaagcatggggatggtgggaccaggactgcggctgccacctgggcatagttgatgaagaagagctgctcatgggtgagatccaggccgggcagctgctggtccttgccaccctctgccatccacttgaggtaggcctgcaggcaccagacaggagctgagctcaggcctgccagcctggactccagaaccctcagatctcagggcagagcagaggtctggctccaggacctacccctgtgggggtcctgctgctgcaagggcccttcacacaccccacggatgagcgctcaccacctcagtcactcagggacccctgagctgggccctcggggggggatccctggccagacagcccactgcacaccacctgtccygaatgagcccctgacgycccctcccctgaggcactggtgcccccctcccctgcagcgctgatgccccccctcccctgccatgctgacgccccctcccctgctgtgctggcaccccctcccctgccgcgctgatgccccctcccctgatgcactggcgccccctcccctgccatgctgacgccccctcccctgccgtgctggcgccccctcccctgccgcgctgacgccccctcccctgccgcgctgacgccccctcccctgccgcgctgatgccccctcccctgccgtgctggcgccccctcccctgatgcactggcaccccctcccctgccgcgctgacgccccctcccctgccgcgctgacgccccctcccctgccaggccccaccttataggcttgccgcacccctccgttgtcagcaatgttttccccaagggtgttgaatccgttcacctgcgcacaggagacaggattggggcagccccggccctgacttccctctccctcagggccagggctggggctccggtacccccgcagcctgggtgctggtggcagcgctcacgttctgttcgtctgccaggtcccaggagtagttgccgtactggtagatcatgcactctgactgctcccggaagtgctgggtggagaagttactccaccaatccatcatgttgccattcttgtcgaagttccggcctgggcaggggcagaggagggctgcccacatgcccctggctgcactgtgcctggccccacggcagccactgtgcctggccgctcctgcccctcctgcagccagccccagtacggagagcccacagtctgagtaggctgagcctggaagagcatcgcgggctccaaggggcagcagctgtctggggctacacagcccccagagaaggagggcttcagtggtctcccatgccaccccctgaggctagggcctagcacctgggtcctgtggtcttggaggcatcatggtttaagggctcctcctgggatgcccaaactctaagttccaggcgagaggagtacgtggtccctggggacaaggactgcccacggaaggtccggatggccgagccacaggggaaaaccagctggggcccctgtcccaggcagggcagtccccaccgaggggcggaggtcagcatggccatggcgggggtagcacaccccccggtggaggatgctggccgtctggagagtctcccaggctgggatctgggcttcgctgctgtattgggcagtgttgtcgtccccatgtcacaggccgtgggagggaagtgcccagtgccaggtggagtcagggtcatgggctggagtccctgggtcccctcctccatgctgggagtcagtgcccccagacagggccccagcctggcattcaaagcctgctctgcccccacagctccctgaggacctggcctcggtgtccccactgaaaccgtgaargggttgaatggagcgcccccaggccccttcctggctgcttctccgcggagaggggagggcgtgtgtgattggaggggcggccgctcaccattgtcgtcaaagccgtgygtgatctcgtgcccgatcaccatcccaatgcctccaaagttcaaggcctgtggctgctccttgctgaagaaggggggctggaggatcccggcagggaatactgtccccaagggcgggacaaagaataagctgtgagtggacacatctcctgtgtgccaggctcagggatggcgctgccaggggttctgacacttgatcccacagaccgggaggcagaggtcaggattccctcaatttacagatgaagacacggaggttcagaggctgggcgggctcgtgcctggcagacccaggacctcagtccggcctcctcccaccatcctgttctgcctgcaggaaaggctctgggccgcctgccaagtccctcccgaagccgctcatgggcacgggagtgagtgttccccacgggggcagcaaggggtgacataggagaatgttccaagaacaggctggggtgcccccaggaggaagggatgggcagggggctgcaagccaccccttcaactctggcaccaaagggcctgggcaggcagggagggggaggaacttaccaatctggtttcggtttggggagtagaacgcattgaccaccgccgccccgatgatccagctgtgatagacaagccggtctctgggagccgcctctccggggaccctccctctgggctctctctgccttgatggaccagggcctaccctggccacaccagagcaagggcccaggcctatcccaagatctggttccttcctggggtccctgaggaggaggcgacttgggccccagaaagcagagggtgatgggggactctgtccaagataggcccagtgactgcacccctcagctggcactggaccccagccacgcatccagtcccccgcctggcaggcagccctgcacgccttactggccactccctggccccccccgcccatgccgcaccagcgatgccactcacagatttgggtccaccttttcccgaagcttcctgaggctccgctgggcgcccaccttgaggttctgcagactgttctcaaagtacaggtcctctgagaagttcagctacgggagaggggcagtcactgccagatgctggggccgggccctcagaggagcaaggggagaggtcctgggtggttggggaaggacctcaagccttgccaggcgtccgcacgtggacagtcggctgtgggtgcaggtgaacggggcagccctggctgtgggcatttacatgactctgagcaagtccctcgtccctccaggcctcagtttccccatctgtacactgagggtagtgctgragccaccaccctagggcacggtgaggacagctgtgttagcgcctgggaggagggcacagagcttggcacagaggagcccccaggcaatcagggcccatgtccacggtgtggggggcagtttagggctggggttgggggcgcacattggagtactcctcgtccaggcgcctgttcrtctcctccaggatgtagtcagggtgcccgatctgctcccggatgctcatggcctgagtggggaggagggactggtcagtgggtgccccactgcggatggagtcagcccgggggccggtcagtgagtgccacactgtgggaggggtcagcccggggcatcctggctgtgctctccctgtcctgtggtgaggggctggggggctccgggatctggcccccaccttgcaggctctggggaggtttaatggggacagaatatggaaggctccgcccacctgacctagagcccaacagcccgccaggggtccgggtgggggcaggggccctggaggggtcactcggctgccgtctgtcacttgggtccagaggagcttctggtgggtctgacccttgctcccgaggccaccgctacccccgctggctcatggggggtgctggggatgtcccaggcctggttcctgcccctgcctgcttttcctcagctccacagtgggcgagtggtcctgtctgcgcctcccggggctgccttctccccgtggggtcctgtctgcgcctcccggggctgccttctccccgtggggtcctgtctgcgcctcccggggctgccttctccccgtggggaccgtcaggaggctttgtcggggcggtgctgcccgtgcccagatccagtcggggctgccctgacctctgcgagccacataccttctcctgygccttcttcttggaytcctcgtccatccagcccagctcgtccagcgtctccacaaacactgtccgcaccttgtcaatgagttctctgacctgggaatcgggcatggccctcgtgtcccagactcatctggagggcgaatgaccagcctcaagggctttggggaggtctggtctgagccccgccggggcaaggcccagggctgcccagctgtgggcctctcgggtgaggtgtggggccggtggggggatgagatgacaacccaacttcagggtcctccctgctgggctgtgggtcctcgtgggccaggggcaacttgtaccacctgtgcctttcccagctggacctgcagggctcaggctggggcccagtggccggctggggtcaggggcatggggtgggcacggcttcccttagcctccctctgtctggtgagctggggcaggtgcccctgagcctgggcggggtgggagtctcagggcagggaggctcggtgtccctgtggaaggctggccccgcgtgggccatggatgaggggcgcccaccatgctcttgctgtctccagggaacgcctccctgacgtagagggagcccacggcgttctccatgttgctgttgacgtagcccacacattcacgccagcgcacctcctccaccattgtgccaaacagcgcctggbggggccacccgatcatcccacgggcccccacgtcagccttcccaggcctggcgtggggccctgggcttacggggtgagcagacccacctatcctcagcctcagggtgccccggggctagcgggggcacgggatgatctcagcctcacctctgggtgctgctgcggcggggggaaggatgggcatggtattgtgattggggaacttccgcagactgagagctgggcctttaccctgaggagttgggggggttcctccccggcccctgtcctggttgtctggctggactctgctctccaggactccagccccagtctcaaggcacagggctggcgctgaccccagagcaaggcctgggaccacgtccctctcagccaccagctcccagggccctggtctctccattgttgaagcagctgtgagaacacctgctcatctgtccccagggacacaggagcacgagactctgggccccagactcaggcaaagcccagggagcactctgcccagcgtcctgccacaccttctgggctgcaggacttcctgccctctaggaaagggaggcagccctttcttcctccccaaagctcctagactcagtgcccccctgacgcttgactcacagatgtctctgacctacccccccatggcaacaggaggcttgacttgcccccagcttgcctctgcctcagtctccccattgcagtggggacctctgtccctcccattactctaacaaaggtcttgagagtcccgactcccctctgcccttag

SEQ ID NO: 12343 - DNA, 22240 bp, Homo sapiens
cgcggtgggcactgtgatctgcagcgtcccacagcacagggcttgagggcagccgccaagatgcaggcagaggagtggggaggaaggggcatttgggagaaggcggccactgaggggcttcccttcagtgtgaactctgcttttccatcagaggggttcgagttctggagcctggatgtgaatggaggcgatgagtggaaggtggaggatctctctcgagaccagaggaaggaattccccaatgaccaggtcaagaaatacttcgttacttcatattagtaagatccggggacttggggtaggggaaagcccaaatcaatttaccctggggtctctcccaccctggaaggggcagtcctagcccctcactgccctagtggtgagcccagcccctcccacccctctgcctgcccccagcacctgcctcaagtcccaggtggtggacctcaaggccgaagggtattgggaggagctgatggataccacacggccggacatcgaggtcaaggactggtgagtgcctggggcgagggtctggggtggggcatgccaatcaggcgccccacccccgccctgcccccaatctccgaggccctgatgggccctccctctccctgcaggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggtgcgtgggcctgggggacgggggcagaggcagatcgtccaaggctgaggctgtggtcagacggggcctaggttcagatccaagctctgcaccttctcacctgtgcttccaatgctctgagcttcactcgctgtttctgtaaaatgggtatatagtgtttccctcatagagctctgaaagaaatcagtgaaatgatgctggcaaagccagggccaaaaaatattccaaaaggttggcagggcgtagtggctcacacctgtaatcccagcactttgggaggcccaggtaggcagatcacctgaggttgggagttcgagaccagcctgaccaacagggagaaaccccgtctttactaaaaatacaaaattacccaggcgtggtggcacatgccagctacttgggaggctgaggcagaagaatcgcttgaatccaggaggcggaggttgccgtgagccgagatcgcgccattgcactccagcctgggcaacaagagcgaaactccatctcaacaaaaaaagaaaagaaaagaaaaaaaattccaaaaggttgactgactgttactaattactagtattgattactactgttttctagactggggtcagcaaatatttgtttgtttgtttgtttgttttaatttacttaacatatttttagggacagggtctctgtcacccaggctggcgcattcatagctcactgcagactcaaactcttaggctcaagtcatcctcctgcctcagcatcctgagtagctgggagtacaggtgtgcaccaccactaattaaaaaaaaaatttttttttgtagagatggagttttgctttgttgcccaggctggtctcgcactcctggcctcaagtcatccttctgcctcagcctcccaaagtgctggaactacaggcatgagccactgtgcccagccctagcaaatgttttcttaaaatggcggatacgaatattttaggctttgcaggtcacattgtctctgtcacaattactcaactctccaactctgctgttgtgtgaaaacagctctagacaatatgtaaacgaatggacatggctatgttccagtaaaactttatttataaaaacaggcagtgggcctgcaggccatcgtttgccaaccccagccctgtccaatagaactttctgtagtgatagaaatggtctgtgtctatgctatccataaggtagccagtagctacatgtgaccactgaacagttagtaagagccagttcctagtacaactgagtacctgaattttttatttcatctaattttacttaatttttttttcttttttgagacggagtctcgctctgtcacccaggttggagtgcagtgacgcgatctcagctcaccacaacctctgcctcccggttcaaacgattctcctgcctcagcctcctgagtagctgggattacaggcatgcgccaccacgccagctaattttgtatttttagtagagacggggtttctccatgttggtcaggctggtctccatctcccgacctcaggtgatccacccgcctcagcctcccaaagttctgggattacaggcatgagccaccgcgccgggcacttttacttaattttaacctaaataatacatgtgccccgtgatgagtatattggacatcctttggcagcttgcagtttctttccattcctttgggctgaatgataatcctgtggagtagaccagcaggattttgctccattttatagatgaggaaactgaagcacagagaaaggaattggtctgtcccaaatcacagagttcaaactagaactccactgatttctagctggcaccaagaactcagccccttccttgttcccctgcccccctcaggcagtgccacactcagagtctgctcccaccctttttgttaaggctcatcttttatttcttttgttttttagagacacggtctcactctgttgcccaggctggagcgcagtgacgtgatcacagctcactgcagtcttgaactcctactttagcctgtactcctgcctcagcctgcctagaactacaggcacacaccaccatgcctggctaattttttttttcttgtagagatggtatctcactctctggtttgcgacaagactagttgcaaactcctgggctcaaacaaccctcccacctcagcctcccaaagtactgggattcccggtgtgagccgccacacccagcctgagtcagctcccttgacctttctcccccctctacctgccctgccaggtctcccacacattctccaactacccgcccggcgtccgctacatctggtttcagcacggcggcgtggacactcattactgggccggctggtacggcccgagggtcaccaacagcagcatcaccatcgggcccccrctgccctgacaccccctgagcccccatctgctgaaccctgactggtaaacaactgctgtcagaaaagggctgggcttgggaaggggaggtggaggccaggtgtccccagacctctaacccttgcccctagcagcctcttctttgtggagcctctcagtgtgggcagccctcgcatgctggggtcgggccagctctccccgaaaggtcttgacctgaatgatggccggggaagcctgcgtgtgcccctttcagagacggagcacctgagatgtgggaggtgcagcatgttcccctgggcccctcagaaagtcgagcttggaggccagcctggatctgtctctcccttcccctcctgggaccattctacctgtrttctttgaccctcggagcagggacaggcaagacaactggcaagcttgcagctgccctgatggtgcaggtgcagggaggtgaccatgtaactctgaccaatctgggaagtggagggtgggctcatgggccgtgctctgcccctgtctgctgctcccagtctttcgctctgcctgcctgctcagaagaggtggctttggcccagaggctcaggccgggactgagatggacagacccagggtggggtggggtccaggtcgggtgtggactgtcctcactgtcagtggagccccagaagctagatgggtaccaggtggggttaggttcccagaggactgagggaatcctgtacaggatgtcccagggtagatggggagcaggattgggacctgctctgacagctggacacatgagccctggatgagtatggtagggggtttgaagaatcccctgtccacctcccaaatccaggcccggccccctctggcttggagagcattccaagcccccaccccacccctagaactgccattcccaagacctctgtctcccagccaaccacccttggaacttgcctcttgtcctgctggaaagatagcagtgttctcctgacttcgccctactgcatgcagccaaataaaaggtgtgcccagtctaacctgtgccctgtggtttctggaaggaaaggcagactttaggtggtcctgcctggacctgcagatggtacaatggcatggcttctgtctaaggtacagaggggttggcatttcaggaaccaggccatcacagaaacaggttcatgggcagacccctcagtgagctgcaggtatctcacctggcagccgtccagtactgctggcttcctctggaggcccagccacaggctggggttggggtgtgtggacatctctgggcagctcttgagtccaccttgtgccagatcagcagtgccacccaggctctgcctcctggtgttactctttgccaacagctttacggacattggatgaagccgaagcatttagaatggtgcctggcacacagttggtgcgtgatatggttaagctttgtgtccccacccacatctcatcttgaatggtaatcctgggtgtttagggagagacctggtgggaagtgattggattatgggagcggttttcccccatgctgttctcatgatagtgagtgagttctcacgagatctgatggttttacaagtgacggtttccccggctccctcctgccgccatgtgaagaaggtcgttgcttccccttcaccttccaccaccatgattgtaagttccttttttcttttcttttcttttttttttttttttgagatggagtctcgctctgtcgcccaggctggagtgcagtggcgcaatctcagctcactgcaagctctgcctcccaggttcgcgccattcacctgcctcagcctctggagtagctgagactacaggcgcccaccaccatgcccggctaattttgtttgtatttttagtagagatggagtttcaccatgttggccagggtggtctcaatctcctgacctcgtgatccacccacctcgacctcccaaagtgctgagattacaggcgtgagccaccgcgcccagcgattgtttcttgaggcttccccagccatatggaactataagtcaattaaacctctttccttttataaatcacccagtctcgggtatttctttatagcagtgtgaacatggactataatccagtgctcaataagtactcctcacatttagctatctcagtcaagggtgagctagataagggctttggccagggcaggatcaccacccaccagcccatggcaaactgcaaaaggacggccttccacggagaacatgtagccctgactgcaattaatgtgtcctgggccagtccccttgtgcagtacacagcctgcacaacccttggtggttgcctgaacaaggtgcttgctaaatatttgttgactgatggaagaaattcatgaacttaatcctgataaaaaacctcagaggttttttattttttgagacaaggtctggctctgtcgcccaggctgcagtgcagtggtacagtctccactcactgcagcctcccaggttcaagcgattctcccacctcagcctccggaggagctgggattatagacctgtgccaccacgcccggctaatttttatatatttagtagagacagggtttttgccatgttggccaggctggtctcgaactcctgacctcaagcgatcctccccacctcggcctcccaaagtgctgggatcacaggcgttagccacctcctagcacctcaggttttttacctttgagtctatgaagcctgcggaggtcacgccctagggaaagaaggagcccactgggtgtcagctcctgcctctagggaggggaccgcgggtcaagggtggagccctgggccgcataaggaaggaactagtgcggaggtccggggagcggccgcgcgttcgggagcttcggccctgcgtaggaggcgggtgcaggtgtgggtgctgagccgcccgccgcctggagggggagacagcttcaggacacgcaggccgcagcgagggcccgggccctggggatcccaggttcgtcttcccgcggcgagggttaggggccgggccgagagggacggcagcggggtccggggcgggggtggggaccgagcgcagcgcgtgacgcggcggcggggcccagcgacaacgaagccgaggccgtaggctcgggccgacctggagctccgccgctgcgcccaggtcgcgtccccggggggacgggcggcgggcgagtggggagccggggtctccggcgcctgggcgttcacggagcctgcgggcgctggtccgggcggccaggggtggggggcgcgggcggctgggcccggacttcgactgggggcctggccccggggccacccaggcggaggctctgcggccgcctccaccccggccacatcccgaggccggcgccgggttcggagaactgtcaagggacctccaggcccccacacgcctgcgagatccggcgcttgccttgccccagccacagtttctgtttccgagaaaccggtgaagtaacaatgccactagagcttgctgggagggtgggtgcggagaaggcgagcacgagacgccgggccgggcagttggggaccccgatcggtgtgagagggcttcctagggctggcatggacttccccaccacaaaatgcccmgggccgggggggggaaggggcgcaagaaaatgcggactgggccagagaccagacttcggtcaccacggtgggaagctattggtgcctagatgcctctagcttggagcccagtgacttttatttcgtctagagtctagacagtgcctttagaagctgccagcatttatttatttatttatttatggcagagtcttgctctgtcacccaggctggagtgcagtggcatgatcacggctcactgcagcctcgacttcctgggctcaagcgttcctcctgcctcagcctcctgcatagctgggactacaggcacgggccaccaggcctagctaatttctttttttttttttttttttttttttttgagacggagtgtcgctctgtcgcccaggctggagtgcagtggcgcgatctcagctcactgcaagctccgcctcccgggttcaggccgtcctcctgcctcagcctcccgagtagctgggactacaggcacctgcttctcgagtagctgggactacaggcacctgcaaccaagcccggctaattttttgtatttttagtagagatggagtttcactgtgttagccaggacggtctcgatctcctaacctcgtgatccgcccacctcggcctcccaaagtgctgggattacaggcgtgagccaccgcgcccggccttttttttttttttttttttttttgagacagattctcactctgttgcccaggctggagtgcagtggcacgatctcggctcactgcaacctccgcttcccgggttcaggtgattctcctgcctcaccctcccgagtagctgggactacaggcgtccgccaccacgcccagctaatttttgtatttttagtagagacggggtttcgccatattggccaggctggtctcgaactcctgatcttgtgatccgcccgcctcggcctaccgaagtgctgggaatacaggcctgagtctgtgcgcccgacctaatttctttttttctagagacrgtctcactatgttgcctagactacaagcatttttaattgacaacttttacattttttttcaaatgcttacagttgcttctcagaacttagaagacttggccacattgggtttttttgttatttttttttttccatcaaagcatttttcttttctctttttttttttttttttttgagacagttttgctctgttgcccaggctggagtgccatggagcaatcatggctcactctgctccagcaggctccttctttccctagagtgtgacctcggcaggcctcatggactgtaaggtagaaaaatctgaggggctgggttcggtggctcacacctgtgagctactgcagccttgacctcctgggctcagaagatcctgacgccatagcctcccaagtagctaggaccataggcactcgccactatgcccggcgaattttttcactatttatagagacggggcctccctgtgttgccaaggttgcaaagccttttttcttttctttttttttttttttgagacggtgccttgtactgtcacccaggctggagtgcagtggygcaatctcggctcaccacaacctccgcctcccaggttcacacgattctcctgcctcagcctcctgagtagctgagattacaggtgcacaccaccacgcctggctaatttttttgtatttttagtagagatggggtttcactgtgttggccaggctggtctcgaacttctgaccttgtgatccgcacccctcggcctcccaaagggctggggttacaggcttgagccaccgcacccggcctgcaaagcatttttcacgaggcacaagtacctcacctgttttctctgccatgtaaagtgttcctccctgggcagaagtgagcatgcacccaccctcctgttttctgagatgggagccttcagaagaccatgaactgctgctttggccaagcctctatggaaaatcagaagaggccacagcaaaaggctgggtacastggctcacacctgtaatcccagacttcaggaggctgaggcgggtggatcacctgaggtcaggagttcaaaaccagcctggccaacatggtgaaaccctgtctctactaaaaatacaaaaattagctgggtgtggtggcgggcacctgtaatcacagttacttgagaggctgaggctggagaattgcttgaacccaggaggtggagattgcagtgagccgagatcacgccattgcactccagcctgggcaacaagagtgaaactgtctcggggtgggggggaagaaaaaaaaaaagaggccagcaaggttctgtttccctgcttgtaggtggagaacattctctcctcatgtgtaagcagatgaggcccacctgagtgacagtgcagagccctggctgccggccaacccccacctacctggggcaagtacctgggatccccttaagaggactaaccaggtgcccccaggtaacagattcaggccagggctgtggcactgcttgaagttttccagaacccgtgcgcagtgcagaggtacaaggaggacagtgttgagagccggtttgtgctgacagcaatgctgactgaagctctgtgcttcacttggtcctcctggcccttccagggtcgggacagttaccccctccttttcacagcttcccaactggtcactgcagaccaggattcaaacccaggcagtcttctcagccaccctccatctgattttttttttccggccatctccaagtggattctggcctgacaccaaagacagctcagccgggtgccgtgggggattcccatggggttgttttatcacatgtgacttccaggccaaagtaagcttctggagataggaaggtggtttctcagcgctagctcaccactaaatgaacattaatgagtctgggatgtaaaactgattttatattctggccgggtacggtggctcacgcctgtaatcccagcactttgggaggccgaggtgggcggatcatggggtcaggagattgagaccatcctggctaacacgatgaaaccccgtctctactaaaaatacagaaaattagctgggtatggtggcatgcgcctatagtcccaactactcgggaggctgaggcaggagaatcgcttgaacccaggaggcggaggttgcagtgagccgagattgcaccactgcactccagcctgggtgacagagcaagactctgtctcaaaaaaaaaaaaaaaaaagattttatattctaacagtgaatccagagcattaaaataacaatcaccaaaaccctcacagaactttgcagacaagtgtggcctccacaaaatcttacagtccacacaacccactggctttaaaattaagcaattttttttaaattggggaggggccttttaaaaaatgtgtctctaaagactttactatttgtattgcactcttctgaatgtgtgtcccatgactactctttccactgaggggctactgtttactggaaggaccctcagcctcagaaatgctcttttgtggktttttttttttttttagccagagtcttgcttggttgcccgggcaggggtgcagtggcgcgatcataggtcactgtagccttgaattcccaggctcaagggatcctctgcctcagcctcccaagtacctgggactccaggcatgtgccaccacacctggctaatgcagggttggagaggagtccctggcctggttccctggggacctgagggcccacytccctggtcaggctcataactgctgttgcccccacaggccatggatgctccccactccaaagcagccctggacagcattaacgagctgcccgagaacatcctgctggagctgttcacgcacgtgcccgcccgccagctgctgctgaactgccgcctggtctgcagcctctggcgggacctcatcgacctcatgaccctctggaaacgcaagtgcctgcragagggcttcatcaccaaggactgggaccagcccgtggccgactggaaaatcttctayttcctacggagcctgcataggaacctcctgcgcaacccgtgtgctgaaggtggcatgggggcagggtggaggctgccaccaggctcgttccttctcatccttgggccttggcacttgcaattcccacactacctggaatattctctaaccctaaacacccacctcacttccttggttccttctcattcttcaggtctcagttcagagacctgccctgtgctcccaatctaaaaacagccctctccacctctagcatagcacccccatttcatgccctgtaacacttttcacaaggcgcggtggctcacgcctgtaatcccggcactttgggaggccgagatgggcggatcacctgagctcaggagttagagaccagcctggtcaaaatggcaaagccctgtctctactaaaaacacacaaagttgggcatgctggcccacgcctacaattcccagctacttgggaggctgaggcaggagaatcacttgaacctgggaggcagaggttgcggtgagccgagatggctccattgcactccagcctgggtgacaagagtgaaacttttagtctcaaaaaaaaaaaaaaaatttttttttcagaatttccttatttttttctgctacaaacttcaagctccaggggccaaatggaccttgtttgccacactatagcatccacagtgacaccttcacatatacacacacacacatatgtatacatatacgtatatacacatgtatacatatatacacgtgtatacatatacacatgtatatatgtatatatgtacacatatatacgtatatatacatatgtatacatatatgtgtatacatatatacatatacatacacacacacacacacacacacacacaagtagttgggattacaggcgcccaccaccatgcccagctaatttttgtacttttagtagagatgaggttttgccatgttggccaggctggtctcgaattcctgacctcaggtgatctgcctgcctcggcctcccaaagtgctgggattacaggcgtgagccaccacaccgccgggggcggtggctcacgcctgtaatcccaacactttgggaggctgaggcgggcggatgacgaggtcaggagatcgagaccatcctggccaacaaggtgaaaccccatctctactaaaaatgtaaaaaaattagctgggcgtggtggcaggcacctgtagtcccagctacttgggaggctgaggcaggagaatagcgtgaacctgggaggcggagcttgcagtgagccaagattgcgccactgcactccagcctgggcaacagagcaagactccgtctcaaaaaaaaaaaaaaaagtgccctggtgattgcctgggcagcgccagtagagaagcgccattgtcttctaaggtcctctaagttcagtgtgaagagggtgattgctcccctgcacccaccaggcccacctaatggaggcccacccatgaatgttaccacagcgcccagcccaaagggtacctgttcttccacttggcactcttgccctgggcagaggccatctgagccctatgggaatcttggttcccatgacccaccgacaaacccacaaacccatcctctagggcctccaacctgggttatgtagttaaccaagggcctctccctcctggacatctgggatgccatctgggtcaagtaagcagtctgtgttgggatgaacacgttagccttttttaaaaaattattttacttattaaaaaaaaaaggggggggggtgtcgctatgttccccaggctggtcttgaactcctgggttcaagcaatccacctgccttggcctcccaaagtgctgggattacaggcgcaagccaccgtgcccggcttcacattagtctttgaggacagtactctcacaggcctctcgtaattttttgagaactgatacttgggtatttcccagagttccaccgcaacatggaagtgaggaaggggttggtttagaatttctggtaacacgcattcttttctccagctgcgtgttaggagtgaggccagtttgggactgagtgggagggacagagtcagatcagagctgatatggtgaggacagttgggaatgtgttggaggggtgctttgtaggggtgctccaaggtgcagttggggtacacttgggctggtggggtaccttggccacacaatgcccttgagaaggaacaagctggttaaccctttggtgtccacagccscagagacctgagcatgagcaagtcctgcctcccaagaaggtcactaacgccaaccaccctccctcccgccctcctgggactaagtggggagggctggactttggatttacacagggggtctcaccttggcttctgttcttcctagaggatatgtttgcatggcaaattgatttcaatggtggggaccgctggaaggtggagagcctccctggagcccacgggacagattttcctgaccccaaagtcaagaagtattttgtcacatcctacgagtaaggcaaactgaacctaccaggcttgcgtggaggggacagagggtcaggacacctttgccaagtctcaggcaaagtcttcctaagggaagtcctctctgcgaagctcgagggaggtggccccaaaacttgcccagagtcactgcttcctgaaatcactcagtgctgtgttaatggacagtgggggtggggatcactgaagcaggccaggagtccattgggcagttaagataagccagggctatctacaggcatctgtccgtaagctaggaacttgagtttacaaaagtgccctggaacaatgggcctttggactgggatcaaatgccgcccaggcacaagtgggtcaaactccctcctgyactggaggaaaagccagagtcagccccagccagtgcctgtcccgcagcggccaaggggtaccctaggtccccaaaccacctccctgggctcacaggggctgccaaggcctgggtgagggggggggccatgcagagcacacccaggtatgcaagcccccaactctgctccccagaatgtgcctcaagtcccagctggtggaccttgtagccgagggctactgggaggagctactagacacattccggccggacatcgtggttaaggactggtgagtagggtccatggcctgtgtccccacactctacatgctcctcttactgcgctgcatgtacgtgagacaacccatagcaagtgcccactctgcacagcagtgccctggagccaggtagccccggcctccgcccctgctctgcacccacaccctgcggcacctcctggcctccccaccaccctgtgacgtagtcaacaggacacagtagccccagtgtgcaggtgaggaggctgaggcccccaggtgcactgtcatggacaggcactttttttttttttgagacggagtctcgctctgtcacccaggctggagtgcagtggcgtgatcttggctcactgcaacctccgcctcccatgttcaagcgattctcctgcctcagcatcctgagtagctgggattacaggtgcccaccactacacccggctatttttttttatatttttaatacagacagcgtcttaccatgctggtcaggctggtttcaaactcctgacctcaagtgatccacccacctcggcctcccaaagtgctgggattacaggtgtgagccactgtgcccagccactgtgcactgacaggcacttgggcaacagaggacctcagccctctctggactgggtgggaacccccaggtcccctgacctacctgcctcccctgcccctttccctattcatcccatgactctttttggagctcctactctgtgcacagaactgtgccaggctctggcttggccggtggcagaagcaggaccccagttctaggcaggccccagggctgccactctgaggataaagcggtgaggatggaggggtatgcagagctgcaggggggagaggtggctgggytgagcagagggtgagctttgtgccagccccattacacaggccacccccttgactctcccactgaatccacagcctggtccattgtaagtacaggtgacatggcttggacagaccaggcctctctggaggggtcttttgatttytgaggtcatatctttagtaggatgcccaaaagggtccctcttctcagatggggtaacagaggccagcatggacagacagcttatccccgggccacagtggggcatagggagcgctgaagccagctgggccttgcaggcagagcagtgtcagctgatgggagatgaagctccgagctccaatgtataggtcccacctgcccccacccctggggccagccctcggtggcttggacacagggctctcaacccctccaccaggtttgctgccagagccgactgtggctgcacctaccaactcaaagtgcagctggcctcggctgactacttcgtgttggcctccttcgagcccmcacctgtgaccatccaacagtggaacaatgccacatggacagaggtgaggcctcacccacttgctctctctacccactcctcccagggccaggatggcaggaagcaaagggcagcctcagggcccagggtgcccctgctggcctggagctgttgccttccagcctgggcagctctcttagaggacctggctcctgccttcccctcccccgtcccggtggtcacttcctctcccttcctcccaacaggtctcctacaccttctcagactacccccggggtgtccgctacatcctcttccagcatgggggcagggacacccagtactgggcaggctggtatgggccccgagtcaccaacagcagcattgtcgtcagccccaagatgaccaggaaccaggcctcctccgaggctcagcctgggcagaagcatggacaggaggaggctgcccaatcgccctaccgagctgttgtccagattttctgacagctgtccatcctgtgtctgggtcagccagaggttcctccaggcaggagctgagcatggggtgggcagtgaggtccctgtaccagcgactcctgccccggttcaaccctaccagcttgtggtaacttactgtcacatagstctgacgttttgttgtaataaatgttttcaggccgggcactgtggctcacgcctgtaatcccagcactttgggagaccgaggcaggtggatcacgaggtcaggagatagagaccatcctggccaacacggtgaaaccctgtctctactaaaaatacaaaaaattagccgggcgtggtggcgggcgcctgtagtcccagctactcgggaggctgatgcagaagaatggcgtgaacccggaaggcrgagcttgcagtgagccgagatcacgccactgcactccagcctgggtgacagagcgagactctggctcataaaataataataataataaataaataaaaaataaatgttttcagtaaaaccagcctggggttggttttaggagtggggagagggggtccctggcattttggtggagaagcagcccctctcccaggttaccctggccatacctgtccctcccactccagttaatgatggctcagctcagcccagcccttggggcccctttattgaaacaactcacagcacagtatttgagacagacagtgttggccggcggaaccccaggaggctgagaagtcgaggttgcggcatccctcactgccctcctgggggaggcatcctccaagcagacctgagcggccccgggctggggcgggcgatccacacacagaggcgataagagcacttggaatcagggcagccatgcagcactgccctaggcggggatcccccaaagtctgacagtttgggcatcagtggggtggcaggtgccccctcagctgcctttatgagcgcgctcttccacgtaaagctgcatctgacggacacaagcaaacagccacagtcagcaagacagccagggcatccctgctggaggacacagaagcccctggtgggcagacctccaccacaggtggggcctcgtggccatagccatggtggagaagagtagagatgggaggagccctccaccaggcactcccccgttctctcccgcaagccctctagtaaggcctcagcaccgggcctcacttcgttaagcagcccctaaataaagcttcccgggtccccacgaagctcacctttaaaatgtccgacgtcatggtttttagtggtatcagccgggggtcatgcatgtggacatcctgctcatccgccaggatccaggggaaatcctagggaggagacmmaggtcaggggggtgayggggctrggccctggcctgccctcactttgctgtccctcccactccagaccaggggcctccaacctgagcctcagaatcactaggaagctgttggtgatgcagaccccaggaccgcccccatcccccacagaggccaagtccatagaacccaagtgacgaacaggctccaggcaccaacgctgaacctggtgggctaggacccctccctggagagcccccacttcagaagagccaggatgagctgggggccccagtaggtggctccacctgggctcctcactgccccaagtgcccagatggagcagtggacaggcctgaggacctgctgggtgccaggcgctgccacaccaatgtaatgggtggctggccacaggcagtgcccctgcccgcctggaactgcgacatcacgtttctagagcctgcgcccagacccagacccatctcatctcaccttgatgacctggatcttctccatgttgcgagtggcggcttctctcgtgtgcaccaggactgtgaaggtacagcctggagaggcaagaggttggtggaggctcccccaccgccctggtgccagccactgggcccagcctcttcccacttcccttgctggctcrgcagcacccccagagcagatggcaaagcaagtgctaagaaaagccccagtcaatagggagatggaagccaggtagaatcaatcagggaagcttcccagaggaggtggactctcagggttaggaagagatgagtctcagaacagccaaacatggacctgggaacacagaccaacccgagataaccatggaaatgccaagggaagagagggtggggagtggacacacctggggggttgtggtccaggacggcatcrcacacgctgatcttcaggatgaaggcccggagcagctgctccacatgagacaacagcgagtctgagctgggagtgagaggaggtcttcccatcacactggcgccctcccctccaccacaggcatcaagcctggatgcagacctggggtacaagaccccctccagtgcctgtgagagtgctgcatgcctaggacccagctccctatccggtccacacaattaaaccagcaagggagtttaaaagaaatgcccagccccaccccagataaagtcagaatttggcggggggtaggggacaggggaggtaggggcagcctgaggaggcctccctaggtggttttaatgtgcagccaggacccagaaccaggacaccaagccaggaggggaaagggcttgcctaaggccacacaggccgtggggacaggttggtgccagattccagtgccctgacctcaccattggaagcatgcagttgaccaactaacgcatgtgccagaggtcaacttcgagttgactggacacttgcctggggagtcagaaaactgcttctgtgtcctgggctctgcccccacccaggtgrccctgggtagctcatgtcatctctctggacccatctcagctgctcacaggctgtccccttgtcatgctggtgcttcttgccctttctcctcccaggcctttaccaaggtattcaagggccgccttaaaggggtgggtgtgttgccagagacacacctgatgccagctagtgggcgaggggcaggggcagcccacctgatggacagcagtggaggctgggtgatctcaaagacgaatttctccactgggcggtgctctttatccaaaatcaccaccaccactttctccacatcattctgcaaagagaggaacccccactgcagagccaggcaccccacccccactacaccaccctgcctccacccccttgcccaaggaaggaggagaaacggcccactcacagccctgctcagctgctaggctgggggtccccaagaggccagatagcgagtttgagaagccggcaccctccagcatgagtggtgtaggctgagagaatgcccgggccccatagggaaggtcccaggaagtctgagatcaggactagatggggaagaaaccctgaggggctcagctcagacagaacgtttagcgtggagaacaggggacggatgtgagaagaaccccgaaccctctggggcagcccctacttagagccagctccaacccgggctcccaggcccaaggcaccctgaacatggcccgcatgccttggggcctgcccctgggttgggatggtctccagagtgcagggaacaggcttctgggtattggagccatgaagaccccacagagtcctagcttcaccccatcccagagttggactgtgagcacacagggacgggggtgagcatggggtgagatggctggggagcccagtgcaccctcaccttctccaggagtggcttgacgcagtgcagcgtgtcctggatatactgattcagctccgggtggcaggacatctgcacacaataccatgcggctcgtgaggcccaaagcacagatggggaaaccacccaacacaaccaggagcctaaggccccatctgccttcggtccgaggcccagcagctctccagggctccctacccaggagaccccactttccctcaagaggctaagaactggccgggcatggtggctcacgcctataatctcagcactttgggaggccgaggcaggtggatcacaaggtcaggtattcgagaccagcctggccaatatggtgaaaccccatctctactaaaaatacaaaaattagccgggcatggtggcaggcaccttagtcccagctacttggcaggctaaggcaaaagaatcgcttgaacccgggaggcggaggttgcagtgagccgagatcacgccactgcactgcaacatgggcaacagagcgagactccatctcaaaaaaaaaaaaaaaaaaccagaggctaagaactgtgaacttatccatagagaaagaagttagaagataagaactcaggctgggcacagtggctcactcctctaatcccagcactttgagaggatgaggtgggtggatcacctgaggtcaggagtttgagaccagcctggccaaaatggcaaaaccccatctctactaaaaatacaaaaattggccaggtgaggtggcacctgtaatcccagctacttgggaggctgaggcaggagaatcacttgaacctgggaggcggaggttgcagtgagctgagatcaagccactgcactccagcttgggcaacaaagcaagactccatctcaaaggaaaagaaagataagaactcaatcccaatatgagcatttaatataccattaggggttcttaatgtggggtccatggactcctccagagtctgaaaaatccctaaagttgtatctttgtgcacttgggcatttttccagaaaaaggatccaggaaaatgtaatcagatgtcaaaagttaagaactaaggaactgtgtggcctcaggcaaattccttaacttctctgggcttcaatcacttcatcataaagaagaagtgagtaaatgtcaattgttttttcctttcccctctaaaggtgaccttcaacttactatgggtttatgtttggataaaccaatcaaatatcgccagcggaaaatgcagttaatacacataacatacagaacatcatagcttagccaggcctacctaaacacactcaaaacacattagcccacagttgggcaacattatctaacacaaaacctgtttcataataaagtgctcacgcctgtaatcccagcactttgggaggccaaggcaggtggatcaccagaggtcaggagatcgagaccagcctggccaacacggcgaaaccttgtctctactaaaaatacaaaaattagccagatgtggtggcacacgcctgtaatcccagctactcgggaggctgaggcaggagaatcacttgaacccaggaggcggaggttgcagtgagccaagatcacgccactgcactccagccagggcgacagagcgagactcagtctcaaaaaataaaataaaataaaatataaaataaaaaataaagtgctgactacctcaagtaatgtcttgaataccatactggaagtgagaaaacaatggtggtgtggggacttgaagcggggaccacctggatgtcctttaagcttctaccacttattctcatgtttcctgagtgccttccagagacaggcacttctagggactggagctacagtgcgatgcacactgctttgtctgccttttagccttaacccattgagtttaggataaatggtagggagaagatttggaggtttttggaaataccctcctcacaccaaggttcaccagcttcacgagctccttcaaagtgccaccatgcccccagggtaacttttttttttggagacatagtcttgctctgtcgcccaggctggagtgcagtggcacgatctgggcttacttcaacctctgcatcccgggttcaagcgagtctcctgcctcagcctccctagtaactgggattacaggcgcgtaccaccacaccaggctaatttttgtatttttagtagagacaggatctcatcatgttggtcaggctggtttcttgaactcctgaccttgtgattcgcccgcctcagcctcccaaagtgctgggattacaggtgtgagccaccatgcccggccacccccggggtaactcttatcaggcctggtccctaacttctggcaaggggaactctcttctgaggggtgggtaggcatcaccactttggaactggaaggcattggaaggcatgggcagggccctgcggaatgaggtggcttggcccgaagtggaagaggtttttttttttttttttttttttttttgagacggagtttcgctcttgtcacccaggctggaatgcagtggcacaatttcggctcactgcaacctccgcctcctgggttcaagggattctcctgcctcagcctcctgagtagctgggattacaggccttggccaccacgcccggctaatttttgtatttttagtagagacggggtttcaccatgtttgtcaggctggtctcgaactcctgacctcaggtgatccgcccgcctcggcctcccaaagtgctaggattacaggcgtgagccacggcgcccgaccaaagagtttttaaaagtccaccctgtacccactctgtggttctgggacgtgcctca

SEQ ID NO: 12344 - DNA, 23944 bp, Homo sapiens
tgcagctggtagtcccaacttatgcccagctctcagcagagaggagatcctggagcaggtagctcctctccaaaggcaggtcatctggtcatcggagtctggctgagtccaggggtttttatgggcttcagaggggaggaagtacatgctgattggttcacgggtggcaatgggtgggcctgaaaatagcaccataagttcccattctggcccatcagccccaccaccaggctttaggccatccctggcttgaaggtgaggcttcaccagggacctgcccctttctgcccaggagcttgtctgcctcctgccactgcccaagctatttgtgttgaggggctcctgcaggcccatgctgagccaccctcagtgctccctcagcctccctcctgtgctcgtcagtgcccaaagcctggaggggagccaaggcggcaggggtctggcatgtcagtgctgctctgagcatgcatacacctggctgggttgcaacagggcctgggcttggcctcaactttgctccaaaatcagagtcggcaccgggagtggggagagaccaggcaacaggagcaggtacttctgagcctgcaggggcagggaggcttccctggcccccaagagatgcccgggtccacagccatggctgratggctgcagctgtgcctgagagggcagggctcctgcctgattctggcccccaagagcacagggatgtccaggtctggagctgtgcctgggcagctgcagctgcacccagggagcacaaggctcccgccctgccaacttggaagtgggcagggcttccacagttcccggctcctcccagccctgtagagctcgcagccctggccacgcctcccccactgcagccagtgtcatgatagcagccactccagaagggccacccacgccatcaccaagattgcaacactgaactccagcctgggcaacagagcaagaccctgtctcaaaaaaaaaaagttattttctggaattatgcttgccatcgaaccccacctggagtttgcaaatatcatcttcctctttctgagacttgcattagttaacattgccagtcttcagctactctcattgttgcacagtgcccttcatggatcctaagctggagcagatacatccatttgtgaggctcaggatataatgattcagagaatgctcaagcatcctagcttctctgaatcattatgtcctgaagcacttagctcagtctacagctagtaattaagaacactggccttattatcaaggctgaactggaatcccggttctgctacttggtgggagaatgaccttgagcaaatcatgtttctaagcctcggatttctcatctctaaagtgaggataataaagcctacctgtaaggactgttataggcattaaattcccaccacagatgtaaagtgcttggctcagagtgaatgtgaaataaactgctagtgattatttcttcccagggagttgtaagactgggagatctagcccctcctccaatatccccctgctggcatataggtatgcaacctccaaacattcaggactcatagcaggtgcctgcctgcactcttcaaaccagtcctctagggggaagacaaagggaatgatcccttatctctggttccctcatcagccccagcaatgtcctagtcttggggtacactagcaaatattgtcagagcattttctcaggtccacgcccaccaccctacactttcctggtctttccttcctaagccaagagccattcctagagacaggacccccaggagtcttcacaaagtccctgtgctgaaacatctgaatttcaccacatagtatcttgtcattaaaacctaagagtgtctgtctcagaattggccagttttttcttccaaccatttacagagaatgtataatccacaatttataattccacaaccacctggaatagtatttgttgctcaatacacatctgacatctgacaggaagtatggaataaataaccaagaagcagttaaagctccccattaaaatcctcccacccagcttaaatactgggtgaactcctctttcatgttgttttatcgatcagaatggtttcctcttccctacctctgaattcttattatcactatctttattgcatacttactaattgatccaagatcctacagctaataattggcaaatctagaattcagctgtactgacttgaatagcatctccccaaaattcacatctactggaacttggaatgtgaacttatttcaaaatagtgtctttggctggcatggtggcttatgcctgtaatcccagtaatttgggaggctgaggcaggaggatcatttgagcccaggagttggaaaccagcctggtcaacataacaagacactgtctctacaaaagtaaaaaataaaaaaataaaaaaatagctgagcgtggtggcacatgtctgtattctcagctacttgggaggctaaggaggaaaattgcttgagcccaggaatttgaggctgccataagccatgactgtgccattgtactccagcgtgggtgacagagaaagaccctgtctcaaaagaaaaaaaaaatgtgtctttacagatgtaatcaagttaagataaagtcatactgaattagggtgggccctaaatccagtgactggtgtccttaaaaagaaggaaatgtggacacagaaacacaggaggagacacagagaggaaggtcatgtgaagatggaggctggggtgggagtgatgccgccacaagctgaggaatgccaaggattgccagaagtcaccagaaccaagcaagaggcaatgaaagaatcctccctcgcggcttcagagagagcatggcactgccaattttggacttctaccctccagaactgtgagagactaaatatctgttaagctaccttgtttttggtaatttggtatgatggccctaggaaactaatacactgtctgtcagatatcagacatcctcattcttaatgatatctcatctgtaccatgatgttatgcagccttatgattgtagcacctaaaccgtatccctcatggcacatttctcaggtgccttctatttcacagtaggaggcagatggagcacctggaagttgagggggtatggaggctgtgttaagggatgaggaagaagtaggattattgcaaggtagtggatgggtggggctgttttcttgaaactatgcccaaacttcattgttagccagaccctgtgatttagcagaaagaggaaaattagtttactaatgaaagaattatgatgcattagaaagcaagaaggactgggagttgcaaagcctgccacaaacgagctctgtgattaagcacgtggtattcagatgtggctttttaagctaggcaattcatcttgggaacattgacacatggtctgaaaagcaaaatattactctttcagctataaaaaaactcccggaatcctcattcagtcccgcccaatccctgatccttattctgtaactcccaattctaacatagggcagacacttaactttttagttgactaaataaataagggaatgaatactgaggatagaaaagggttggaggtgtcagaaatgaaatgatggtcaaggaaagagaaagactcagatgtatagggcatggaagaatgttcaagaatcaaagatgtctgccactaacatttggtaatcaaaagccatgacaagcaaatgtggcaatatatcagtatctgctcaatcttggtagtgagcgtagggtgtttgtaatattctttatagtttggtgggtttaaaatgtttcctttaaaaagaacaacagtgcagtagcaatctcaaaatggccaaatcaaaatgagtgcattaaattggcagcattcaattcacttgctttgatgggtgaatcctccccttcatcagcagaactgatttgactgtggtaaaaacagttcattcccacacacagatagaccaacacagcccttttggagagcacccatatataagaaaagccataaaatattcatttccttgggctttgtactcctggttctgggaatttatgcaaaggcaatgataatttgaaaggaaaaaggatgaaaatatgtaaattctatgacaattttttaataacaatgaacacttgggaaggatttaaggtgtcagtggggagtgctcaccactgcccccaccctggtcaagccatcctaagctgtgcctggatggctgtgtgtaaggaacatggctgtgctttggtcaaggataggacgaggtaaacatccacagggactcagcgagtttagagcgcaggcatataactccacttgttatcacagctatgtagccataacatgggaaggccatcccttggctctaagccactattgtctgtaaaaggtataattgccctgttgacatcgtgcaggcgtgctgacacccagagagagagagagagagccagagttgaccctcttggagactgacagtggggagccaggacacagctcggcttgctcatgcccagagagaggaagagttaagctgctgaccccgaaggcaagggagagtcggccatgcagctgtgtgggggagccgccagactaagcacctgagacagggcagacagtgtagagagctagtgtaagaaagctgttgatgagagctgctgctgagtaaaatcatcttttacctgcctacggtcccctgagtgttctttctgctcatccacccactccccttggacctcagcatgggctagaacctgaccccaagcatgacatttggctcagtcgtgaacctgacattgtggtagcctccacgtagtctctgcttcttgcccttgcccctgccatctactctccacttagcagccagagtgatcctttcaaaatgaaatcaaactgcttccttgcttcatttcaaaatgctcccaccaccctcactgctccaccctggtctgaaccacaacctcctggggcctggatatagcaatacctccctaaatggttttccctcttccatcttctttccccttagcacagaagtgaaagtgcttcttttcaaatcacaaatcagatcatgtcactctgctcagaaccttccagtggcttcccgtctgactcagcacacccatatgactcaacacacaaggagatcatctccttccagttacactgagcatttttattggttgctgactgtactcataatgctctctccttatatccacacggttcactccctcacttcctttaagcataaatcaaatcccttatcttggtattgacaagmcaaggacagactcctccaaagtgagcagggaggtcatgaccaccctagcttaaattttaccaatccatacagcctcatcctacttccctgttttattttttcctcttagcatttatcatcttctaataaattaaataacttagatatagccaggcgtgggggatcatgcctgtaatcccagcactttgggaggttgaggtgggcagatcacctgaggtcaggagttcgaaaccaacctggccaatgtggtgaaaccttgtctctactaaaagtacaaaaattagctgggcgtggtggtgtgtgcctgtagtcccagctactcaggaggctgaagcaggagaatcgctcgaacccgggaggcagaagttgcagtaagctgagatggtgccattgcactccagcctgggaaacagagtgagactccgtctcaaaaaaataaattaattaattatttttttaaaataacttagatatagccgggtgtggtggcatgcgcctgtaatcccagctactggggaggctgaggcaggagaatcacttgaacctgggaggaggaggttgcagtgagcagagatcgtgccactgcactccagcctgcgtgacagagcgagattctgtctccaaataaataaataaataaacttagataaaatttttcaagtgcctacctcgtctgccccaaacacaaataaactagaatataaattccatgaggaaagagatttttattggttttgttcacagctgttttcctagcacctagaacagtgtctggcacatagtggacattcaaaacacatttgttaaatgaarggattcatcctaaagttaaggatggttmagtaaatcggatggaagatgatgaaaaattaagcaattagaaaaaaactgtycttgtgtaatgtgtcaacatggaaacaggacataatgtaaacatcagaatcccttgctgtgattctggtttttgtggctctggttacattgtttttttgtgtgttttttttttttttttgctttcccgtttcttaaacattggcgttcccaagtttctccttggtcctcctgtcatttttatctactctcgtagcttcaaataccatctagtttatagtttatttagcatgttgtccaagccaccgtcttgggcccagggctctacctgtagcttttcatccacacttctcaggttgcttcttacacagcgccatagtagttaaaatacggtctggggatagtcgtctcttcatcagtctccccctataaaatggaggactcatagtataagttgcctagaacatattagtaaggactcaataaatgtttgagtaggatgagctgggtggctcatgcctgtagtccctgcacttygggaagccgaggcgggtggatggcttgagcccaggagtttgagaccagcctgggcaacatggcgaaactccatctctataaaaaatacaaaaaaactagctggactcccagctgcttggtggctgaggtggaaggatcgcctgagccctggaggtggaagctgcagtgagccgagaatcgcaccactgcactccagcctgggcgacagagtgagatcctgtctcaataaataaataaataatcagttgagtgcatactgtgtgcccaactacctttaagaactttacatatgatcccggcagccctaaaaggtaagcatatctatctccattacacagattaactaatgaggaaaagctatgtttataatgaacagtgaccaaaaagtatgcaaacgttaaatgaggtgttaaagtggtgggattgtaggtggtttctttttttctttcaaaaatttgtttagtattgtagttaggctgtttgtgtgtatgcatgtgtatgtgtgtatgagtgcgtttgtgtgtgaccaaaacagtaactggcaaacgtaacaacaggaaattgtagggcagggtctgggaaaaggggaggaacccaaggtactgacaagcccagaccggactcccccgaagtgagcaggcagcaaaggctgagagtgccagctgcctgggcactgacggaccccacccacggaaacgatgccttatgaggaagctaacccgggccacttaccgacgacctgcgcaggcgtggcttgaggaaacgcccgctgtgggcggagccacccgaaaggctccggtcgggggcgggaacaggatcggccygcgggctggcgtcgataggctgccgcaragacagggcgggctctgctaagsgacgcgcctcgccgtggggcggtgcctgcgcctgagcctctacgagagggaaggaacgctgctccgagctccgsgtcgcgtcgcgtagattcgcgtcgccgtcgacctcagaggcggggccggaagcgctacggtttgacccccgagtccctctgttcccgaaggggcggccgtctttctsccgacccgctccgcctcctctccttcttccccattacccggaggccgaagcccccagccagggcggggcggcgcagcccgagctcccggacccggaagaagcgccatctcccgcctccaccatggagcccaccgcaccgtccctsaccgaggaggacctcactgaagtgaagaaggacgtgagtaacgsagctgtgcccagggcgggcgggggcgggctgcagcccagcgggagasgaaagcggaagcctggagtccgaggacaaggaggatcctccaggtcggaggagcggaaagtcctagcacaggaggactgtggcgagccctgcatccgagggaccttggtggcagtgatcctccagtgatctgtcaatccaggttttacatcgctaaacgcagagcttgggctttgttgccaagtggwgttttgattcttgcccactcctcacccatctcctcatgctttccccccarctgggttcttggagatgcttcgttagggactggcggctcagattcatccttaagtcaggctgcctaggctgctcactcagcctagagcgaaggctgtaccaggtgaaggatcccaagcagtggaccaaaaatgtgaagctcttttgcataagggggcttgaggaagctcaacagctgaaagcacaacctggaattcccctagtaagcagacgcccacatatttaaattggggttgggggagtgaatacacgtagctgagaattaatgtacaggtaaacgtcgaaaatattcagtagctaaattatgctcttctcggatggtgcagaaccacataaaccttcatatttattcgtaacgaatggctttgttgagatatgacattctttttcctttgcgtttacttgttttgtcagatgagacctatatgagtatcactaaaatactttatctgaagtcaaatgaaaaacagaaactcaacatgaaacgtgttcttattgaacactgcagtacttttacaaagtcattttgatgaactggacaggatggcaactttttaaatgttcatccacttcaaatcccttcctcttccctgtaaggtttattacactgtactcacaattggtgtgactcaccagcagaaggaaactggatatgactgggagttgtgcttagtttcctcattcaacagagatttatggagcacttgctatatggaaagcactggccttgggtctggaaggatacaaaaaaatgaagatcagtttcctgctttacattctagttgagataagaatggaacataaataactactgtagaataaatgttgtcttattcatggtgagtgccagtaaaaccttgaacttccaagagytaggcctcctatgttccagatgctgtgtcacacagtttacaatgttcccacttaaccttcgcaacaacctctaaagaagataattgccattcccattttacagctaataaaacaggaactgagaaattacaagtggaaggaaataagatctgtatacaagtacagatgtgaagagtggcttccaggtctttgttcttctctgtcaattcattgatgttatctgtcttcaggatttcattttacgcctatatcagaaataaataaccttgaggaaaccatggatgggtttcaaaaggtctatgaaagaaactatgtgcatgcttttttcttagaggtttttttcatgatattttcaaaatgtcttctgatcttagagagttttaaaattatccacatatttggacttttctctccactctaggtccttatttccaaatgtctactggaaatctacttttatatcctacagattgctcaccttgtcaaatattgaacttttactatccttttcccaaagttgcttactgttgctgctgtattgcctttcttgatgaatggtgtgctaccaccctttgtcttgggacctcccacttctttagtgtctccccctcctcctatctagttatttgcctcattgtgttagttggatttagtacagtttaataaatatggattacatgctactgtgaggctgatactgtggttggttctaacagttcaaaaattaaaaatgaaaacacaatcctaacttgaaaagagctcaatttcttgagggggattgttttaartcacaaaataagtgcagtgagttttgcattcaactgaaacattaactacttggtgccctagtaagtgcaggatatacagtgttggctaaaacatacctcgtagctgcctgcttcaaacagagacgttagtttaaaacaaataaataaattttgttttcattaytgcaattactatgaaggaatcaaacagtgccaagacaataataggggaaatcgacttgagataggatggtcaggagaggttayatttaaactgattcctgaaagatttgacrgaactgagggaagagcattctgggcagaatagaatttgtcaaggacctaaaataggcaagaccctggtgacttggggaaatcggaggaaggcagagggtaatctgaagtgaagttaggaaggtgggctagagccattttcatgaagagccttttagtaaagtatctggggtttttttccccccaagtatagtagggacttgttgaagaattgtatagtttaaagatccctctgcctgtttcatggactgaggagaacaagaataagaacagggaagccagtgagcaggctcttggaatctatagagatgaatgaggatggtgatttggatcagggtgaaggcagtggagatgaatggagcagaattccagatgcagtttttgaaatagaaatgatatgacctggtgatggattgaacatgggagttgaggaagaggatgtaattagattagtacatggaaatgtcagatcagcaattacatctgcaaagtcaaagatcagaagagagatctgagctagaaatgtaagtgtggaattgaatgattttacctagaaagctgtgagctagaagagaaaaatggtgtaaaaycctttaaagagaagaattttaaaaagtgaattgttagcttgaaagtagggtaacaacaacaacaagaaaatgattgaaaagttgtatccacagggatgggaagaaaaccaggagagtgtggtattcatgtaacaattttcttgtttcagggagggagtagtcaactgtgtttatgcagctgaaaaatgaaatgaagactgaaaatatttggcaataagggggtcattggtgacttcgagaagaatactggggcaggatggaaatgtctgggaatgaattgggaaatgaggtgaaagaagtggagtcctggtgtatagaaagatgaagtgtatacacaaggtgctacaaggacagaggacggggtgcctaactcattctggggagttaggtaaacctttccaaagaagatgaccactgacctaaatcttaaaggacgaataggggctttagggtctgataaaagcagacaaaaaatacgtaaggaaatgtagagagacagatagttttaggtagagcataaattttcaggacaaaggtagtgatagattaagctggagaggtaggtaggagccataktatcaatgaaccttgtcttccataattagttattattgagtacttactgtgtacagagactatgcgtggccttcatatatagtattcccatttagtcctccttgatgtcctgtgagttaagtttttaatccttattttatcaataacatacctgragcttggagtggtgaagtaacttggcccagctctcacaagggtgagtactagattcaagatttgcactgaggttgatccaactttagagccatgcccttaacttttctactcttctgccacgtaaaggaactttatcctttaagacagggcagaacattgtttttaattttttttctaaattaacaaaatttcaatattagaatttgctgggcacagtggcccacacctataatcccaacaactyaggaggataaggtgggaggatcacttaaggccaggagttcaagaccagcctaggtaatgtagcaaagatcccttctctacaaaaaaaaaaaaaaaaaattaaaaattagccgggcatggtggctcacacctgtagtcctagctactcaagaggctaagatggggatcacttgagtctagggattccaggctgcagtgagctatgatcaagccactgcactccagcctaggtgacagagtgagatccttaaaaaaaatttagtaaaattcatataatactccagatttccattttctcctgaaggagaaatgttgaggagggggaaggaagtagtaagtgcagctaggtttctattgttaatagtccatgccagatatgataaggaccaggtcctggacatagttatttgctcactctgtgcttttcctgtatttgacctataatcttttttttctgggcccgatcacattgttttataattattacctgtgatatgtattcccagctagaccatgagccctttgcatgtaggattcaaatcttgttcatctttgtatactcagtgctcagcactcggcatattaggaatttagatttgtaaaatacttgtcatgtgaataaacaagtaaatgtggaacttcgtagaccaagaaccacaggaacccttcacctagcctactttcctgccattacctttgtcattattactaacatatattgatcacttactatgtaccaagcgcttttctaagcactttgcatatctttattcctcatataacagtcagctgaggaaacaagcacagaggagttaattacttgcccaagatcatatatctagtaaatagaggagctaaaatacagtcaccggtaccaaattattaatgccatttattgagatcaacatggattttctactaattaagctcttaggcacttctcaaatctaggtttgcttttttgtggtgtcctttttctttatttctttcatttttcgaacactccctattccccacacatctttccatctcccttccaccaagactgattcactgagttagagtgtagtctttccagctgaccccaaagacagatacattatgggctctttcagtttagggttttgttttttgtctttaacagtttaaggaaatggagtaattaataacaaacatgagaaagttacagactgtgagacctctcactaagttattggtcctgactaattctgcattccttgccaactgatagctaaaatgtacagtagtgtttgccctcatctttactcccgaagatggccctcaacagacctccctgtttccaaggacccaggccytctagattcagctggtccctcttcacaacagcctggtcttggtttttaggtttgaaggtgagatcaaagcagtgaggaatgtctaggacctacttgtgtctacttggactttcatcttaattagcatgcattttagaaggcctgagcctcctgactttagaacattgtctcacaccagctaagactgccaactaatagtcacgtatgtgattttcttagatgttaaaaataacattgaaccatattttatgtcttttaggccttagaaaatttacgtgtatacctgtgtgagaaaatcatagctgagagacattttgatcatctacgtgcaaaaaaaatactcagtagagaagacactgaagaaatttcttgtcgaacatcaagtagaaaaagggctggaaaattgttagactacttacaggaaaacccaaaaggtctggacacccttgttgaatctattcggcgagaaaaaacacagaacttcctgatacagaagattacagatgaagtgctgaaacttagaaatataaaactagaacatctgaaaggtaagatatcttaattatctaagagctaatttaaatgtaataatgcttttaaaaaatgcagagcaggccaggtgcctgcactttaggaggccaaggcaggaggattgcttgaggtcaggagttttgagaccagcctgggcaacatagcgagactttgtctctacaaaaaattaaaaaattagccaggcatgatggtgcatacctgtgtttccagctactcaggaggctgaggtgggaggatcacttaagcctgggacattgaggctatagtgagccatgattgtgctactgcactccagtctgggcaacagagcaagaccctgtctcagaaaagcaaaacaaaaacagaaatgatcattttgctttcaaaaagtttaaacttcaaaattatattcaatttgcacttattttaccttatttgacactattacattgaaaaagtggaatatctctcaatatcctgtatttgtattcatttaataccatttatagaaaactattatgaaatccctgcatacataaggatttgtttctaaagtcagtagaatgtaaagttaatctattcaagagtaagctctgaaaatactgtacatcacacataaagaacagtatttaggcaaagtattgtaaaagtccaactctgctagtttttcttatgatcaccagttgatcacaagatgaagtaattggcatatgtttataggaatcacgttgcataaaatattcatgactttaaactagtctggcaagatgtgaaagcatggaaacagattaagagaatagcagattcacctgtcccatttcactctcactccagaatatacactcactgattggaatattgtgtggaattgcctacacaatttaaatccccaaccccctcctgcctctgttcctcactgtctctctccagagcacataaatgtgcatgtgatgttctacagctcttctaggcattagggatacagaaaagaataatttagggctctgcccttaaggaactcatagtctataagtgtccccttgctgggacacattacaagttttcccttttgagccatatctaagaaagtagtttgtatagcatggaatagacatgctgactgtactgtgaggttgaaaaactagtggaagaagtgacatgtaagtgccctttatagactatgcaggttttgcctaaaaattgtcaactcagggtttctgtgcctgtaggttgaatatttgctaagcctaacagaagggtaaattgtgtttgtgtttattctttcaatcctctggataayggttaactataccctttggatatcataaaattctttgatggtatctaagttgttttctgctgtagcaatacctgagactgggtaacttttaaagaaaagaaatgtattcatttcttacagttctggaggctggttaagtccaagaccatggcgccagcatctggcaagggtcatgcatggtggaagggcagaagatggaagagcaagggagggcaagagtgtgaaagagaagaaaaaggagtcgaactcccaaaataactaacccattcccgtgataatggcattagtccagggcagagccctcatgaccctgttgcctcccaaaggcctcagctcctaacactgctgcagtggcaaccaagtttccaacatgtgaacttttggcggatacattcgtaccacagctaatgggaacaaccactgtcatttgagtaaactgtgaggttgagaaacaggacattatctattgaattgtagttctcactttcccacaaagtagtcctggaatgttggacatgacttaactgtcctgtgccttttttttctctttttttttttttttttttgagacggagtcttgctcttgtcacccaggctggagtgcaatggcatgatctcagctcactgcaacctctgcctcccaggttcaagcgattctcctacttcagcctcctgagtagctgcgattgcaggcacctgccaccacgcctggctaatttctgtatttttagtagagatggggtttcgccatgttggccaggctgatctcaaactcctgacctcatgatctgcccacttcggcctcccaaagtgctgggattacaggcgtgagccaccatgccccgcccttttttctcgtctttaataataagagactatcctaggtgacctctaaaattccttttagttctaatatcctattattcaagaattagccattgtcattgatcaacagatagaattttagcatctgccgtttacatttttttattagctaatattttttgtaccagaatactaaagaatatttattgtgaaagctatttcttattttataaaaaattttaggtggttaagtttatatgtacrctgtaccttaaatgagaattacagcatgtcgtttaacttccacgagactattttgttatatagaaaatgcaaataatagtatacttcatggttgttgagaaaagcaaattagatttgaaatagattatgacggaaattacaagttgctatttaaattttgattgtggggtaactagcttgtaatctttaacaagtcacaagatggacagtgactccatttttttagttactttttcatttacatctgaataattttattgtaggactaaaatgtagcagttgtgaaccttttccagatggagccacgaacaacctctccagatcaaattcagatgagagtaatttctctgaaaaactgagggcatccactgtcatgtaccatccagaaggagaatccagcacgacgccctttttttctactaattcttctctgaatttgcctgttctagaagwaggcagaactgaaaataccatcttctcttcaactacacttcccagacctggggacccaggggctcctcctttgccaccagatctacagttagaagaagaagraacttgtgcaaactctagtgagatgtttcttcccttaagatcacgtactgtttcacgacaatgacacttyattgccttttaatttttaatgatgacaaaaaatgttttaaagaatatgactttttataaaatggctgtaatcatttgtttacatttgatgcatgtcttttaaaatgcaatgtaagcatactttgtaaataggatttttagaattaaaaaagcatacttctaggatagctaactgtaaatcatgttgatcatgtactttttagtaatttctttttttcctttttaaggtctttcagtacttttttaaatattttctattttaagactgattttaatagggaatatatctctatttgagaatagacccttactaggaagaacgttttttcctcagtgcatttgtgctagaaattttcaagagtckaatagtctttgccagtcattcagcagcaaattttcagcattaagctgttcctgttcagtaataaaaccggtcactgatgggaaaactgccaatatagaaaaataaaaatctcttttccactccattgtcgtataggcatgtaaacagcctctttttgatactggaggaacacttgatggagtgtgagccacctaagatctcggtttgccaaaattcatttctaattaaccttactaattatactactttgttaggattttcacattcttggcttaatcattttcattcctaaagaaaaatatcttggcctaaacctcagttattacatgtaatttgatgaggtattttttccttttttcttttttttttttttttttttttgagacagtcttgctctatcgcccaggctggagtgcagtggcgcattctaggctcactgcaacttctgcctcccatgcttacgtgatcctctcacctcagcctctcaagtaatatagctgagactacaagtgtgtgccaccatgcctcactaatttttgtattatttttgtagagacggtgttttgccatgttggccaggctggtcttgaactcctggactcaagcaacctacccagcgtggcctcccaaagtgctgggattacagacacgagccacctcacctagcctgatgagatttttaaaaaatattttctctgtacttttcattctcttttaatgaggaccaatgtacagttgaaataactggaacaaattatttttggtgtgtgtgacaattctgtttttaatgctatttgaacaagtgggycattagccagatttgtctttttgttgtaaaacaaaatttgactaattttacrtgtttataaatcttaygctctcactgtttgtttttatttaaattacaattttatctgtttcctgacattgtctcctatatatttctattattaattgcaaaaacatagaaatggaaattttgctatcaacaataaaatttttttaaagtagtgagtgctattttggagttccaaattttcagtaggaagtatctaaaactttttttaatacgtgccattatctatagaaaacattacttcaggttgtgagattgagttgcatttctggatggactgatgaatttatccgacatgaagaagattggcatattagctttaaaaatttttaaagattggattttttttagtataagcactttctaaggattatagagaaatgtttcacctccaatgcatagcaaaaatagtggtgttagaaagaaaataggttacatttaaggaaggtgctttaaaaagcagaagcagactttaaaattaaatttgtggacacctttttaaaaattgaatcaaagattataatttagatatacaataacacctatatatagataagttttaacactgagttttctttcagactgttttctaactacatagacaataaaattaagctttgcataaagctaggtttgtgggtttttgacttctacaaagtcattttttttccttttagccctgaaaactagccattgccaaaagtgtgtaatttaggatgacttgacaggatgcaatttgttaactaagttcattaatgcagcagtgaaaaagttacttttcagggataccatattatcataatacaaaaacacgttagttcatttttatgtatatgtatatatttttaatactttatttttggagcagttgtaggtttacaaaaaagcagaaaatacagagtgtttccaaatacccccttctccctcagtttcccatactatcttgcactgatgtggcacattggttataattgagtcaatgttttgttttgtttggggttttgttttttgttttttgttttgtttgtttgttttttgagacagagtctcgctctgtcacccaggctggagtgcagtggcgcgatctcagctcactgcaagctccgcctcccaggttcatgccgttctcctgcctcagccttccgagtagctgggactacaggcgcccaccaccgtgcccggctaattttttgtatttttagtggagacggggtttcactgtgttagccaggatggtctcaatctcctgacctagtgatctgcccaccttggcctcccaaagtgctgggattacaggcatgagccaccacacccggccaatcttttttttttttttttttttttttttttgagatggagtctggctctgtcacccaggctggagtgcagtggtgcaatgtcggctcactgcaacctccacctcccaggtacaagcgattctcctgcctcagcctccaaagtagctgggattataggcgtgtgcccccacgcctggctaatttttgtattcttagtggagacagggtttcaccatgttggccaggctggtcttgaactccagacctcaggtgatccacctgcctcagcctcccaaagtgctaggattacaggtgtgtgccaccacacccagcctgatgagtgaatcttgatactattattaatccaaagtccgttgttcacgttagggttcactttttgtgttatacagtcctgtgggttttgacaaatgtgtaatgtcatgtatctgccattatgcagaataatttcactgccttcaaaagctcatgtgctctacctattcataccttcctccctctcatctcactcccaaccctggcaaccactgatctttttattgtctctgtagtttcatctttcccagaatgttatacagttggaatcatagtatgtagcttttttcagactggcttctttctcttatcaatatgcatcagaattcttccaggtcttttcatgatgagttcactttgtttacttttaaaaacttgccaagttcactagtgagagggggagaaagagtagagcaaggagttctgtctgtgactgaacaatcaattgagataattcactacttgctggagagcgagagttcacttttgaagaggtgattcgtctttagtcagcatgtcactcattgtgtgcaatgtcaaacactggtaaaataggggcaggccaggataatggcagttttttgtttatttgttttcataaatagttttttattttaaatccaatttatcacattttttctcatggctagtgatttttgtctcttgtttaagaaatttttcccatctcaacatcctgatgatattctatgctttcttctagaagttgttttagttcctcatttagctctatgatccatttcaaagtaatttttgtgtatggtatgaggtagaaatcaagtcttacagctaccatctttttacctaagcaatgtaaaaaggaggtggaagtttcacactctagtcttatattgtatcactggataaatatgtccactgttgactttggagaaaaagcaaaccaagaagcaaactgatctaaagtttttaaatgtaatcttatgagggctttctgaaaggagagctgaacttaaggatagataatatataaaaaaacttgagtgctgctgctaaaatcatgctgaacttgccatactatttaattaccagaaatagttctttattgcaatggttcccaaattttgctgtccattttacaatcaactggggagtgcttaaagatccctatctccaggctgtaccccatacccaataaatcacaatgtttggttgtggaagccaggcatcagatttccaggtgattttcagtggcaacaaaatttggaatccacagccttactagatgccaaataatgagtttagtgtttccgcatgtgtgatcttgtttcttgttttttaatcctaataaccctgcaaggaaggttttattgtcacttttttttttttacagttgagaaacaaaactcaaaataaagtcaatgatttaaaatcacacagctctttaggattaaaatccagggctgtttgattcttaagcctgtgttctcatacaactcatgttttcattgtgggagagagtccaaaaataaagaaaactaagataattctagttaccatggagacaaaataaggcatgagttaaaaagtaacttgaaagatacttgatagtattattgtagaaggcttctcagagcaggtgaggctttgagcagagacctaactcataaaaaaggagccagccatgggaagttctagagggaagagttccaggcagaagtaacattgaggtcagaagccctgaggtgggaatgaattagtgagagaacctggaaacattaacaccttattagcaatgagctcacctagcaccgagaccttggcttctaaatacccattctccattaaaaggaatcaaagttccttggaaatggctaattccaaggcaaagtataagatgagcctgaaacatcttgttccaggaagcagacaagtgatcaaagaatcttgaggaggacatgtccaaaggacacagaagcctgcttgaaggggctcccattggccaaatcagagacaatttcaacatcaaaataaataataatggattataactcatttgataagccatgggtcaatgctaatataaataaatgaacagtctaggcatgatggctcacgcatgtgatcccaacgctttgggaggccaaggtgggcagatcacttgagcccaggagtttgagaccagcttggccaacatggggaaaccctgtctactaaaaatacaaaaattagccaggcacagtggcaggtgccttaatctcagctactcaggaggctgaggcacaagaatcatttgaacctgggaagtggaggttgcagtgagctgagatgactccagctgagtgatggagcgagactctgtctcaagcaaaatgaataaataaacaaataatttgaagcagaatgtgatgttgacatggtctttaaatacctccttacaaaaatacttatttacaaaggaggaaaaaagtaactacagtggagaagcctggcagatacaaccttaaacaagaaatcaaaggtaaaatcatcagtgccacgacaaactgaaatcatgtgccttctgatagaagacaatgagaagactgtaataccactttcataatattcttgccaaagattcataacctgactcaaatcattaggaaacatgagacaagaggaattattggcagcatctttgtagacaatctgctacaaaaatgctaagtttgaggagcttctgagacattgaagtaggaaattgcatgcaggagtttggtgttcaggaagacttgtggaccagttacgtaaatgtgggagttattagcataaactaatatttaaaaccttggaacttggtgagtttgccttgaaatggagggtagacaaaaaagagaggaaggctcagaactgagcctgaggtgcttctgcatctagaggtgatacagagaagacaacagagaaaactgaaaagggccctgtgaaataggaagagaactaaagtgtatgatctagtgaaaggcaagagaaaagcatttcaagaaggcacctatcttgttgaaaggtcaagtaagaagtggtctttggaccaagtctcacagagaccactgatggtttgataacaagaactcatgttgctcaaactgagtacctcaatctccgaggcattcaacagtgagcccattttaaaagtcactcagagtgtcagttttactcagtaataagtaagtctaaatatttttgtctattaaaagagctttattaaacacaaccatgcaaaatttccatacattttcaagatcttatattaagaaaaataaatatgtatgcccatgggactttgggtcacaatgtatcagctcagcttctggaggaactggagactgaggtcactcgtgggcaattaactgtgcctatatggccaagccccaataaaaactctggacaacaargctcaggtgagtttctctggatggcagtattccatgcatactgtcacgtgtctctgccacgagaagttcatactgttcacaattccactaggagaggacaactggaagctttgaatgtggaactctgcaccatgtgcctcttcccttggctgtttggttttttccccccgcctgtattattttgctgtaataaactgtaaccatgagtataatgacttgcagtgagttctgtgagtccttctagtaaattatcaaaccaacctgagggcagtctgaactttgcaaaacctgaaattggtgtcaggagtgaggatggttttggggactcccaaactttgcactttgagaccatcattttcctctgccaacataggaacctggatgggaaaactcgagaaacacttatctagacccataccatcataaattattataatccaaaaatatttattaaccatctgctctgtgacaagcactgcgctgggtagtaggaatctaaaaatgagcaaagcacagtccagctcctcccctcaaggagctcatagacatcgtaccacagcaaagagggagtgaacaagatagttatataactctgccctggagcctacttccagggaggaatggcaagttatgtgtgagtgtgagtatcatctaaacgagcaggcatccttaagtgaaatctaaatacactgataacaacttcatttgggtgtcattcccatttagttcaccagaaggaatcaaagagttctagtttccctgaatactaggcatatggttacaccatttaccaaaagaaggaacaaaaatgcagagaaaaattatatgaaaagacagattacggttccaataggtgggtgtttgaggccccagaaggataccatatggaaaatgtaagatccaggtggtggtcgggtctagagtttgggtggaaagattgggattagacacccagatttgggaatcatagcataaagtagttaatgcggtggaaagggatgggctgacttgcaactttgtaatgccctttaaaatgttagaagcatcactgaaagatagtacaatatgttgggaaacaccaacatttaagggccatatggagcaaagcaggcg

SEQ ID NO: 12345 - DNA, 59100 bp, Homo sapiens
acattatgtttttttacctttccttacccactcaaatgcagtaacttagcaggaaaacaggtttgggattttaacattttgctccagaatgtgttcatcagatttggctcttgcatgacttttggattgtcccagaaatcagatttattttttaaaaataattattttctttcttttttttttaaccttgcaactccagctcaaaggaaagcattattttcaacaaattcagtaaataatgatgtgataccttttgaatatgtatacatgggaatatgtatacagcctaataaagtgcttactttgaaatgaaaaacatttatttgaatttataaatttagtcaccaaataattattgagtaccaaccacaaagcatcaggcactgtttcaggcactggggatacattaatgaaccaagtagaggaaatttattttcctgctgagtttatattctagtggagggagacagaccaaatgaacaatcaaaataagtaaaggatctatcatggtttaagattgtataggagcaaagtacgagaaatttggaaagctggaagggagttccgattttaaacaatgttgtcaggttggcccttaccaagatggtgacatttgagcagactctaaagggaggacgtaagtaacaaagatgctaaggggatgaacattcaaacagaggtcctgaagcaggaatgtgcttggcaaagttgaggaacagtgaggtggctagtggttggttgagtgcttagttgaatggttgacagattgtaggacatggagtcagagaggtaaggtggtgaaggtgaggttgtaagagccttgcagccatggttagcactttagctttaacattgagttaggggagccaaagaagagaagtgacaggatctcacattttaggggaattactctgcctactgtgatataaatagactacagaggagcaagggtggaagttttgataagttttggaaaacaacaacagcagcatttcatagtcacatccctttaattttgctaaaaaaaagtggaaagcaaactaagcatttttaaaataaaattttcatatcttatctttcctttctgatatagttcagatatgtgtccctgcccaaatattgtgttgaattgtaattcccagtattggaggtggggcctggtgggaggtgattggatcatgggggtggtttctcatgaatggtttaatatcatccccttggggctgtcctccatgagaatagtgactcctcatgagatctggctgcttaaaagtgtgtggcacctcgctatctttctttcttgcttctattttcgccgtatgaggtgcctgctcccacttcacctactgccatgactggagatttctgaggcctccctagaagcagatgccagtgtcatgcttcctgcacagcctgcagaaccgggagtcaattcaaccgcttttcttcgtaaactacccagtctttacagcaatgcaagaatggcctaatacacttaccatagtaaagttctatcaagcccaatttcttttagccctgggctaaaaatgttcttaggcttaagcctacaatggcttaagcaataggccatttactgtctcacatgatatgcagtgtagagatatacagagccaaggtaggctaatgtagccactcagtaacatctgggcttggggttgccttttctgtacaggcacaccttagaggtagtgcaggttcggttccagaccacagcaatgaagcaaatatcacaataaaggatgtcacatagtattttggcttcccggtccatataaaagttattttatactatactattgtctattagtatgcaatagcattatgtctttaaaaacaaggtacatattttaattgaaaaatacttcattgctaaaaaatgttaacaatctaaaaaaatcttgaagccttcagcaagttataatctttttgctagtggagggtcttgccttgatgttgatggctgctgactgatcaggatggtagctgcggagggttggggtggctgtggcaacttcttaaaataatgcaatgaagtttgccacatcgagtgactcttcctttcacaaaatatttttgtatcatgcaacgttgtctgacagcattttacccacagtagagcttctttcaaaattggagttaatcttctgaaaccctgctgcttatcagtttaagtttatggaatattctaaatcctttgttgtcatttgaacaacgttcacagcatcttcaccaggagtagattccccctcaagataccactttctttgttcatccataagaagtagctcttcatctgttccagttttatcctgagattgaagcaattcagtcacatcttcaggctccacttctagttctagttttattgctatgtctaccacatctccagttacttcttccactgaagtcttgaacgcctcaaagtcatatatgagggttttaatcaacttcttccaaactcctcttaatgttgatatattttgacctccttccgtgcccatgaatgttctcaatggcatctagaatggtgaatcctttccaggttttcaatttactttgcccagttccatcagaggaatcactatctatggaagatacagccttatgaaatgtatttctcaaataagacttaaaagccaaaattactcctttatccatgggctgcagaatagatcttgtgttagcaggcaaagctcttgggtaaccaggtgcattattaatgagcagtgagattttgaaagtaatctttttttctgagtcataggtctcaacagtggacttaaaatattcactaaccatgctgtgaacagatgtgctgtcagccaggccttgttgttccattgatagaacacaggcaaagtcaatttagatatttcttaagggccctaggatctttggaatggcaaatgagcattacctccaacttaaagtcagtagctggagccgggcatagtggcttacagcactttgggaggctgagggaggtggagcatttgagctcaggagtttgagaccagcctgggcaacatggtaaaaccctgtctctacaaaaaatacaaaaattagctgggcatggtggtgtgtgcctgtagccccagctacttgggaggctaaggtgggaggattgcttgaggatcacttgaggctgcagtgagccgtgatcgcaccactgcacttcagcctgagcaacacattgagaccctgtgtcaaaaaataaaaaataaaaataaaaagtcagcagttgcattagcccctaacaagagtcagcctgtcctttgaagccaggcagggacttctcctctttagctagaaaagttctatgtggcatattcttctaatagaaggctttcttttggtctacactgaaaatctgtttagtgtagccaccttcatcaatcagatcttctagataaattgctgcagcttctacagcggcacttgctgcttcacttggcactttcatgtgacggagatggcttctttccttaaacctcatgaaccaaactctgctagcctcaaactttttaaatgaagcttcctcatttctctcagccttcatagaaatgaagaattagggccttgctctggataggcttttgcttaaaggaatgctgtggctggtttgatctcttatccagaccactcaaactttctacttatcagcaataaggcagtttcactttcttttcatgcctgtgttcaagggaggaggacttttaatttccttcaagaactttttctgtgcatttataacttggctaactggaacaataggtctagctttctgcctatctcagctttcaagatgccttcctcactaagcttaatcatttctagcgtttgatttaaagtgagagatatgtgactcttcccttcatttgaacacttagaggccattgtagggttatttattggcctaattttaatattgctgtgtcttagggagtagggaggcccaaggagagggagagagatgatcagccagtcagtggagcagtcaacatatacattgaattggctgtcttataagggtgcagtttgcggcacccccaaaataatacaatagtgacatcacagatcaccgtaacatatttaatggaaaagtctgaaatatttcaaaaattaccgaaatgtgacagagacaccaagtgaacacatgctcttagaaaaaatggtgccactagacttgctcaatgcagggttgagcaacaaacctttattaaaaaaaaaatacagtgcctgtaaagtgcaataaattgaagtataaaacgaggtacgcatgtatttttcttgcttttctctcgtggttgcagaatatgctgccacagctccaaacatgtctggcttactggaggatgtccaaggcaagaaggaaaaaacttgtccttagtctgtcaggataaaatccttcccctgaagctcctcatcccccactccccattatggactgagcagaattaggtcatatttttagccccttaaccagttattggttaacaaagagggacagagtacaaagaggtttagaccagtggttttcaaagatctgctgaaccttggggcggcaagtttccaagacccttccagggagtctgcaaagtcaaaactatttttgttataatactaagatattatttgcctttttccctctcattatgagtgcacagtagagttttccagacgctacctgaaatagcacaacagatcgaatgcacaaacagatatgaaaatccaaatgccttctattaagcaagacattaaagatatgggcaaaattttaaagtaacaccattcttttaactaattttttgaaaatagttatttttaattaaaatgcgctatttgacatttttatttttattcattattattttaaaaaatagcaatttttaaatttctgttttaatattaatagctgtaaccaacataaagaaaagttcttggggctctcaataattttacaagtggaaagcggtcttgagaccaaaagattgagaccgctggtttattcaggcagatcttattccttcccggggttgctgaggtcagagctaaacttcccagagctcaactaagcttggttcaaaccttttaaaaatgtaactgttaatggtaacgccacctgggctcaacagcagctagacgggcctctgattgcttggccaaaggaaaagaggaggatttcgttgggccctgaagttgtcaccgtggcgtgcttcttctggccctgatctttcatccaggattggggatacgtgcatgcaaactgggaggtggacattcctcccgctcttgtttttcagtgttagcatcttcactcatactgttttggtttcaaagtgctctcaggagtctccttaaaacaccaaacctgtttttcgccttttgaataaatcccttggcttcaccaaaactaaacaaaacaaaaatcaaagaacatctttgtgtaacctatatgcctgtgatttctccatctgatctcctttctctggcctcttttcttttcttccccagtgaattttaggctgccatgaaaccagggaggagacagcctgaccctggccacgggtgcagcaggcatacattttcatcgcacatactttgtcgagtgggtgtaagacatttttgcataaactgagttcacgaatgccatttcttagtctttcctttgcccgcggtcttctgcccagatccatttcttcgccctaattttacatataactttctcccggctggattgtttgcatccacgactcccgacgcttgaacctcccgttccttggacctgacctaattctaggtgcccgcagtttatttctccactttggcaaacgcacgtggctctcctggaagcttcacttttgctgctaggctgggtgttggggttcagtggggctcggaaaacgtgctctaaagtagccacgaccccggtccctgcagagtcccggcccccacagagccccggccccggacgctgcaggcgtcagaagggggcggggagcagaaaacggccgggtgaatcactgggcgtaacaggtgccgcagccgcagctgcgcccgcagcgcgcgcggaccgcagggataaggtcttctttttctccgggtttttttggaggtaaggaggagactaccgaggcccccacccgaccaatgcaggccacggttgttcatcgcctagcaactggcggagccaatgggaggcggcggggcctgcggcgccggcgcgcgggggcggggtgggaacctcggaaacctgcggaggccgggaggcggctgcaaggggcggggaaggcgggagcccgcagcggaggaggggccgcgggcgggaggcgctgcgaggcgctgctggccctcgggctgcgggagccgggctaggacgccgagcggtgactccccgccgctcccgggggccgtgacggtgagcagcagcgcctcgcgtcggggattgtgacgcgccccgccagggaggggcgggcgggggtgggcgccggcaaggggcgggcgcgcgcggaggtgagagccggcacctggctcagcgccccgttgttcggcgggaggctccgcgcggctgttggggccgttgcagggtgcgggcgagcgtcgacccgggccgctcctggaggaggaggtgggaggtaggtgctggccccgggaccgctctcgctggcgttcgcggagctgcgcctgcggagcgctctgacccggggagccccaaaccctctctgggatggagcaaggttggcgcccggcgtkgggggacgagcagcgcggggacgtgggggaggaggggatggccgatttggggctgcagagtctcagcagcggccgtggggcatgcggggtttggcgatttgctagtgcagccgcaagaggcagtctttaaaacgagttattgggtggccgctgcagtggaagagaaccccgatagtggtctagtaaaaagtctaggggaagaatttacatcatccaagaggcaggcatgtgtgaaaatactttggwttataattttatcatgaaaatactttggtttagaattttatagtcaacgacagtaaactgaattgtgagctccctgcacattttttgagcctatgctgattgcccagttaggcatatcgcttgggcccaggacatagaatatactaatttgctgtctgcacgtataatgtaggaatttttagattattacccagtttcaggacccatagttgtaaatgccaaactgcgattactagcaacgctgataaagttcttgaatctgagagaattgagatttctcttttctggacgctgtaataggttgaggattagaaaagaaggtgatttagaagtgtaagggtggaggcttcttgaacttcctgggctttctaacaattcagattagagtcaaggtgtagagttagctgtgggtgatggatgtcatggaccttttcatggttcatgggggtttggcttactgtggggtagaagaaaattctggtgatcctacagtttgatcctgaactagaaaggttggtatgagttgactcatttaggagagtgaataaaatttgtaaagaattagaaatttggagaggaaagaaatgcctttaaagttcacgtcaagctattttgaaatttagaagttagaggtagatttatgaatttggatccagtcggcaaaacttgatccatcagatctcttatcctaaaactatcaacctacaggcttaggaagcttaggttattcattcacactaaacaagtaaggaaagctaatagctaatttaacactytgttctgcctgctgttaatgaaggtttctcaaacaaaacggttctttgagaagagggttaggaactgataattaaaacgaaggctcttttagtgactggctgaacctcttaggccaagtcattttgtactcttccttcccttctctttccccaactgtacagggaagataaaaagctcatggattacgtaacatgggtgaggcagcttgaagataactgtgaagacttagttattctaggatgaaatgtggagatctcataacacattgtgccttgtgacaagacttgttaaagcacattatgttctaaacataatgaggcagatatatgagaaaactaaaatgttacgctgaaattgtttgctaaagacctcaagtccagcacagtgtccaattgtatacttgggatctcctagtacttgacagtctgctttttggccaaagcaggccgtgacaccggttttataaagtaggcgtttgagtgccttytatgtagtatacccctagagaaattaggtgcatgaaaagacaccgcccccaaattgtgtgattttaattcatttaacatgcttaaattggatcgatttcaaagatttttaagttattttttccatatcttttacaatagctgtgaatatgccttactggtttcaccatttgctcatgacgcaaagaggttttgatacgatgtgggtttgttttgtggctttggtaatggtgatatggttagctagtagtgaaggtacaagttatcttgaattcacgagtttatgggatgagatagaatagagaaatgcaccattcattagtagtaatgaaaaacatcctagaattgtgccttttgattgtgggccaatgttttatgtagtaccagcagatttactgaattattctttagtaattctttcaataaacattcattaaacgcttagtaagctgctacttgcctgacctgaggataaaaagatgagtgttgccttgaggaatttgtattttrgaaattatcagcatagtgaggcaggaagcaaaaaaacctcacaaaaaacaaatataggaaggctttcaaaaagaaggagaatttcagctgtgtctggtagaggcagtggagttcatcaagcagctggtgcattctgcagcagtgtacagttgagttacaggtggcttggtagagttggaccagggtggggttgccatattaataaggctgtagaacagtgctgtgaacattgaccagtaggttacagggaaccttcagaaggttttatgaaggggaattatattttatttttactttagaaggatatttccaccaaaatcagtaatttgagtgatccaaaatgtattgagtatagtgcaaataatatctgaaagacagtcccacacagcagttagacttgaagtatattttgctgaagccctcagaaactccagaaaagcagaaataattatacaacaaacctttcttaagtatcttctactttgaagactggaagaatagggatacaaattaaataagatacttccccattttcaagcaacctgcagttcagtaggagaaataacacagttataatgcagtacagaatctgggtgtcagacataaaaatgtcagactctagcaatgtaggattctgagatgagagaaraaatagtctttcaaattagcaaaaataagtttttaaatagaaatgaaactacaagcagttaaacattcagaacaatcttaactccagttgttctcatcttttaactcttgcttcacacatatccttttctcatattctcttgagtcacattttcggtttgatctaccacactactagctatgtgatcttgtgccctggttgtcgcatttatgaaggataataacaatacctgcttcgtaggggtgtgattagaaaaataggttagtatccagaacaatgcctggaaaaatagctcatacttactgagcacttaatatttctacttgatataaaaatgctgtaattgagtaagaacagactttaaagacaggattttttttttgtcatgctagatctatccatgagcgtctaataaagcctctacattcagagaaactaacattcttttaaactgagattcttgaacaagtgattttccttttcttatttggtgatcatctttctgaagtctgattttcatttttacccctcagctttgtcattaagtcactaatcaccgaattcaacactttttaaaattcaaaacctgcccattctatggcatttgctgctgtgtatcaccctttctctttaaaagtcttctcccttggctttcctgaagtccgttcccctgtctctttgtatctcttgtgtctgggtctgcttcactcgcttatgttgatgttctttggggtttgttctcctgccccttttttctttatgaattcatctatctaaatgtgctcggatgtcttgtgagttctaggcctagagtttatccccatgtgaatgtctcataagggcatctccaaacccagtaagctacacaaagctcattatctccacacatttgcccaaacccagttttactaactttactcctctgttccctttatctaaatgacactattatctgtcaagtgccaaagacaggtttttatgtgagagagtagatgcctcccttttgtgtacttgtcaccatgtcctgaattatttcttacctgttcttcactatcctcagtcactgactaagtcagccagctggtccctgaccattaattgcccagtttactataatatctgtctcaaagatttttttttcagattataaaagtattgtatgctttttgtaaaaaaattttaaaaattaagataaaaagcaaaaaagtatttaagttacttcatgtgtagttcttggcatacagtcagcactgagaatatatttttgtgccacggtgctacaaatagaacttattttgcaagcattaagtttggaggagatttgtagagaaatattgttctaaaagaattgtaggactaaataattttgaaatcgtatatagagcctaaatagtgtaaagtagatacttaaaattcaagatgggttccagccactgcctatacttttcatttgcctgttaattgtaatctggttgtgctttcctatctattttattctctattctatagccttcgattttattttctattctatagccaaatttcaggaatatccccctgcataggatctagactataaaagcaagccaacatcatagaaataatctgtaagtacaacccatcattagccatgttgttttataatgaggcgataggctcagagaattgatatcatttkctcagcatatttgttgaatgtcaggaggaaaccaggcctgtgaggctttggaatcataaatagctagtttttagtctttccaggttaaatagctggattttatttctgtcttccaggtttgtaactgtaagttacctaatctgttgcctcagtttcttccatcaataaaccagtgctatctttactccttcctagggctagcgtgaggattaagtgataacagctaatggagccccatctggcatgcattaggtgctcttgagttcatcatcagcttctctcctaccagtttcacataattagctagtacaggagttattaacttgccatccatggatcctttgcaaatggatggcttcatagatcctctgaaactctagcccaaattgcctgttcttgtacttttaaaggaagagggtcattggctttgggttttgggacccaaaacattttaacccctgagttggcagtaaggccaaggacccagggctcttggtgcctccacagccaaactgactgggtagaatttagaattgtttgaaatattggaggaacattttatatatatgtatttaaagcattttaaaggacttcaggtgtaaagaattagtttatattccttggctcatgacacgtttgtttaattggtccatttatagttttaataatacagtaagtaccacctaaccctgtgcataaccctgtgggcccctccattcctttttcctctgtccctcacctgaggcagctatttactgaatcctatattcatcattctctcggtgtcttttatagttttattgcatcacataatttaaaactgtatatattacatgccctatcttctgaaaattttttcattttataatactgaaatttatattatgtgtcactgaagttttctgattactgcataatattccattttgtgcatatggcataatttatccattctcctgttggtggtatatgggttgtttccagggtgatactcttgtgctactcgctattgtgaagaatgctgctgtataggtgcacacctcctggcatacgtaggcaagagtttcgattgggtttcactaggagtggacttgctgggctgtagagtatgtgaataggataaatgaatattcagctgatgaactgtttatttttcagagtttccccccatcctctaaggtttaataagctgcttagccaggcattccctaggactgttattttcagcctccatttagtgctttggaacacttttacatcattcttggaatccattttgtaggacccttagataagaattcctttttggtgttctctaattgaaagtgcatataaatagaatactaatttatactgaaccacattctatagaacacagcagtgattctcaaactttgtcagaattacgtggaggttctcccaccactaaagtttctgaatctgtaggtctgtagtggcacttgataatttgcatttttattgagtcaggtgatgttgatgctgctggtcccaggaccacacgttgacaactataaccaatgattgaatttgggctaaatcattgaaaaaacgatgagtagatttattaattatgtttggtttctttgttatttccaatgcctttagtagatgctattaccatttcattatttgaggagtgaaataccaataaatagtaattttaaaatttgatttggacttcttagctgacttttaaccttaaaagttgatagacttctaaaagtgcctcttttttttcttgtttcttaataatcttctaagaatatgattgctgctattcctgtgtgtacattggaagaatttgaaactgatacactgtttgtaaattgccatgctcttgattcataccctgaatcacctttctccttctctgagctgttaccaatcaagattacgttgaaagcccttccaaattgcagcatggccaaagtgttgacttgtctatcatactaaaacagcagcaaaccttacactaatacatccttgaacttggacattcattcagcaatcttgactgggcwccaaccttggagtgagtgatgatgcctgttaccgaagtggggtacaaagaatatgctgacaagcctgccaaatgagaactcagttgtggtgggagagaaattttattcctgttagatctgtgctgtaatacagttcatgttaagtgttctagaagcacagagagaagggatggcagtgcagggaaagcctggcaatatatttgctaggtttttcaaaatttttttgaattgctacatccagaatttaatattttgtctgcttttgtgtagttcccattccagttattcaattggcataattatttgattataatttagtttcaggtgaggtggtaaagaagagaatacttgttcggtttgaaaaagcagcttgaggggaggaagagcattaggacaaataactaatgcatgcggggcttaaaacctagatgacggattgataggtgcagcaaacctgcacgttctgcacatgtatcccaaaacttaaaaaaaaaaaaagcagcttgaatattgtatccttccccctctcctgtactaaagatagtagggtgtaatgttaaatgtgctagactaccagggtttgaattttggctttgtcatgttccagctctgtatcctaggtcaagaaaactccaggcttcagtttccttatctgtaatgggggaaagtatttggatcattgtaagattgaataagttcgtacacataaaatgcttagaattgttccaagtaattgctacatgcttaataaattattttattgttattaaaattaggtagaatctcatttgctaaacattgggttgtaaagacaatgtgtgcacattgttataaaaatgtgaagaaaaggcagtgcgtgatggctcacacctgtaatcccagcattttggaggccaaggtgggaggatcacgaggtcaggaattcgagaccagtctggccaacatggtgaaaccccatctctactaaaaatacaaaaattagcaggtgcggtggcatgcgcctgtagtcccagctactcgggaggtcaaggcaggagaattgcttgaacccaggaagcagaggttgcagtgagctgagatcacaccccactgcactccagcctgggcaacagagcaagactccgtctcaaaaaaaaaaaaaaaagtgaagacaaaataattttgatataaatagctgtactcagttccatattgggtcctatgagaaatgtaaaaatcaaaagataatagaacttgaaattctttaaaggtcatctagtttgacttcataattgaaacccaaagaaattatgaccggttcaaggtttctcagtacataacagaagtgttgctgagaaccrtggcctctgatgctactcagtccagcgctctctcagtaccctgtgcagcttccctgaagtgacagcgccctggaaaactaacagtttaattggcagccaagtccaaaacaggtgaaaacattagcaataaaaagtcagtatataatggaatatcagatggtgtacatagattaagtccctaccgtatttaactttgtgagctgctctcttgaagcggaaatgcaccttcttagtaatttcattcattgaaggttgaaagatgaagagcatttgtttttgaagagggtgttaataaagtcaatttccctctttcctcctaccaaggttggattgttcattaagccaggrggagagtccacttttgccaggtctgccagtactccatggctttgcccttgatgatagttggggaaaagtctggcctctgtatttctgttccctgtcttcctgatgggccagattcccacagacattccctcaggtatgaagactgcattacccttgctcatgggtatgcgtacatatgtggaacaggtgctagaagtgtacctgattggkgggatttgtctaagtcgagatttccactcaaggacagggctgctactttttgggattgagctaagagtactttcacacattatctcatttaattgtgcttgaatactctgctgctaaaaattttacagaataatacatgctcctataacattcaagctatataaagatatgctatggaagaggtgaaagccctgctcttctacccctccctgtacccaaattattccatcccaagaagtgtcatttgtgacattttgtaacttttccagaactttcccctaaatatatataggtagtttgagttaacaaaaaatggtgatcatactgttctaattaacctgtaacttctttttttgtgctatacatgcatatgtgctttaatctttaataatcccagaatagcctggctgtaccatatgtgttggtttttaacagtttgtccatgatggatattaagattgtctctagttttttgccatttcaaataatactgcaattcaacaatgtcctcaatatatattatgcttgctctcttatatgcctagaagtatgattgtttagtggaaagatttacacatttcaaatatttgtatactgttggaattgccctttaaaacaacaaactactgatctctggtaaagtgctatttcccttacataattgactatcttaaaaaactgtaggasatttgtataattttctaaccagtttttgcccaacaagactgcttgctgttttattttatgcattttttatcactcatgccattctaccattggttttggtggttcagaatggtgctgtttatccccatttcctgtgcttatcatcaccataattgccttttaaaaacataaattttttttcttaatatgaaaaacactttcatttatagaaaatttggaagacacaataaaataaaagttatatttttgtgcatgaaagtacataaagaaaggaatgaaagtcctgcccttgccttttccctattttttaagttggtttttccttgcaattttttctgtccttataccaacttttgtgtttatagagcagaatttatgcctgtacatatctactgatayttgtttttttttcctgaggactaaataagctcatattagatatggttttgtaacttttttacattacttaacaaaatatcatggaagtctttccaagagtaaaatagctaataatagctagcatttattgagcacttaccatgtacccatgacctttttttaagccctctacatgcataagtttatttaataaaattattaaagaaatttggtaactaaatttactgtttaaccacataattttttgaggtaaactgcttttactctccttttgcagatgaggaaagtgaggcccaaagaagatttatgttcaggaccatttagtctgtaagtggagaagccggggtttggaaccagatggtctggctttggattttaactcttttactgtactgtttctcatactgcagcaatgatcagttcaaagatatataaggaatttaaagaacagcatgtagctccctgctttctaagctgaggatggctttctaatggcagattttggccaggagcttcattgagattatatccctcaacccagagatacacatgaattattgtaccataatttatgtgttcacactattttatgcagtctgagcccaactgggagatagattgagttctgttttttctggttcttaaaggagtagtcgtaggagatgctgcttcctgagcccctcacccactgaagcaacaatatgtgatggttaagagaatgggctctgcagtccaatgtggggttggggggttggaatcctgcctctgccacttgctagctctgtgaccttgggcaaattacctaacctctctgcctcaatttccttacctgtaaaaaggaaaaaataacagtgttgttgtgaagattgacttaattacatacgtaaagcatttagaatagctcctggcacatgtgttattaaaccagtaccctatgtcctagttatagtgtacttagttttccacctcttactctgttaaatatccacaaccttaagaagtagattatcatcaccccattttaaggtgaggaaaccatcttgaagagagcatcttggaaataagtgtcttcgtcaagatatgaatcagtctgttgacccgggcctctgaggctggcattgtttgcactgtactttccaactataaatcctctattggccacaaaacatcaggaaggcacattattaatatcagtttttgagtttgcaccattcatgtgtatttaaatttatgaggaagagtttatttctgtggaaaatatctggaaaatggcaccactcagaagaaataatttagattttaaattcataaagagtagattttctaagaggttggacttaatgtgtttctgtactgatgtgcgcatctgaacaattttaaggtgcagagatatttctaatggaattcaaagctacggtctcctttataacaaaatcatagttgaaggtggtattacagttttaaataattgtaatatatctagtttttaagagtcaatatgatgactaaattgttaagttttaggactgaatttgtaaaataggactaatgttaagtgacttagttttatcttcttaacccaacacttagttttatcttcttaacccaacagtgtggtaactctaactttgtgagattttagcaaagacttcagttagctctatttgtgaaaaattctgtgcaatatttagaagcccagatggtgtaaagttaccatgtccctctataatggaaagctattattttctgtcgactgaaattgttttagaattctgagtaggtaggcaattgtaccttctcaagtttgactttcaagtgaccttgaaaagaacacttaaagtactgtactttgtgagggaaatcttgtaatcagaatactgtgtttctgcagagctctctttcagtttgtagttgcagagatttgggggtgaagaggacaagacaaatgggaattgagagtaattcttttctgtaaaggattgactcttcttttgctacttttccattgctcttttcctttctccacctctacctgccagaatgaacatgttaatttgttatcagttatttgagtattcattgattatgccatcctttaagcttagtgggagggaggggatacagaaatgtaaaatgtgtggtacttgagagtgtggttgggaaagatgaaacaaaccaataagtatatggagggcttagagattgagctttgtgggctggagtagttggagaaggttatgtgatggggatggcggttgtgcactgttttgtaaaagcattagttttgaaatacgtgcaagaagraagcacaggtggaggcacagaggctgaagtgagtgtgccacaagtgggactcggttcatattgtaaacatttactgagcacctgctatgtttcaggtactgttggctgcaaagatgcagacattccctgccctctagaagttcataaactagtcgggaagacatctaaccrtaatactatagaatgattaattgtaatactggatgatatcattgttaaaaacctgatcagtggcatttgtagtgtatggcatcatttttagttatgtttcagtaaattatggtttaagttttagaagggactccgaaatttctcaagaaatttatgtatatttaatatacatacttaaaaacttgtatgagttatctgttgcttcataacaaattactccgaaatttagcagctttaacagccagcttagaacagatgagtcaggaatctgagcacagcttagctgggtgctctggctcagggtgtctgactaggctgtcaaggtgttggacagggctgcagtcatctcagggtttgaatgaggtaaaatctagttctaaactcacttgtatggcttttggcaggcctcagatcctgctgacctcagacgtcagttccttgccacacggacctctcatagagttgcttacaacgtgatggcttgttttccccaggaggagggatttaagagggcaacaagtaaaaaaacaaccttaaatggaagccacagcctttttataacctaattttggaagtgaaatcccttcacttctgctatattctgtttgttggaagctagtcaataaatctagcccatactcaaggaacagaataacccaagagcgtgtccaccagaaggcagaaataactgagagccatcctagagactgcttacctaaagttctacaaggtattgttgtgtattgagaacctcttcgtctttggggtagaaggaaaaagatgagctagccaacgaactttactgatggaaaaaacagatgtgattaaccagaaaaaacaagatgtttttgctaaaggtctataaagttagtttcaatattgtgttgatatttacgatagagaagtataaacaagaacaaagctattgtttgtggccaagcagagaccaattttacaagtatgcctcaacttaattagtatataagttccagtgagaattgtatgctctgaatggactcattttaagtggattataagaacacaatcttctaaataaacagtggaaatcattttgattatattctattttcagttggatgtgcatgcacgatagagatttatgtgtacaaagttgaaaggttgaatagtgatagaatgaaaagagcacagagttgactgggcatggtggctcacgcctataatcccagcactttggaagtccgaggcgggcagatgacttgaagtcaggagttcaagaccagcctggccaacatggtgaaacaccatctctactaaaaatacaaaaattagctaggcatccgcctgtaatcccagctactcagaaggctgaggcaggagaatcgcttgaacccgggaggctgagatagcattgagctgagattgcgccactgtactccagcctgggtgacagagcgagactccgtttcaaaaaaaaaaaaaaaaaaaaaaggaaaagagcacagagtcttgaaatcagatttgtttcctggcttcacaaccaattagaaatgtgaccttgggcaaacctgttgatctctctgagcactagttcctgtctataatacagaaagcaaaagagaaaacacttggacatgaggaatgatagatttaagctctgcatgattttacccagaaaagaccagagttccctttcttattttatacctgaagtgtatggcattggtactttgcaacccatagtgacatatagggaagacagtgtactaatacttaaaaagtacttactacttcaaaagtagtaaggtaaagcttttactaaaagtattataagattttctattacagtataaagacattgattggaatctatgttgagaagtactttgaacaaggaagtttattagatggctatatacgtgttacctaccgctaatgaacaaaactatgtctcttatttatggattactttatacttttgctttgatgtatttcargwttgttccctgacaatcttaaatgaatgaaatgccttttacaagatattttaattatttaatgttcaaggtttgctcataaaattcactcatgaatttgatccatcttggaatttgggtagctgtatcttggaatttagaaagcttattttgccaaggttaaagacacatctgtgacacagcctcaggaggacctgacgacatgtgtccaaggtggttggggcacagcttggttttatacattttagggagacatgagacatcagtcagtatgtgtaagatgtacattaattggttcagtctggaaaggcgggacaacttgaagtggaagggaaaggggggcaggggcttccaggacccaggtagatgagttgaaaggttgcattcttttgggtctttgatcagcctttcactgaatacgcaatttacatgtgagagggaagtagaggaatagccacttagaccttagtctggttcattgaatctgcatttttacgtaaataatagggcataggaagcaatcagatgtgcatttgtctcaggtaagcagagggataactttgagttctgtcctttgtcccacacgttggaaaataagctatcagcttacactgcaagagtgaaatccaacagaactgttttagggtaaaaaccttgaggcccacaaggaattttggacaaatgtagctttttaatctttgtagctattttatttaggaataaaatgggaggctggtttgcctgatgcagttcccagcttgacttttccctttggcttagtgatttcagggtcccaagacttacttgcctttcacatactctaaccaatcatattaatagatagaattttaggttacacattacttgaactaaaacatgaatcactgcttacttttttctcctaaggtaactatggtaacagtgctagaaaactaagtttgttctcatccagttgtgaggaataatcatgtccactatacaatggcttactattatttgattaatctataatatgaacgtgtgttcctgcactgactttgtaatggagtccttcttggttgcatttgatgctttcaaattgaaatgggcttgtgatggtattatatttatgcaaaacagatatggttctgttacctttttcttttgcttttgaaattaacattgaattagcttaacatcttcataaaaaatgctttgcaaccttcagcaaggcagttttagctatatttgagctgaaatacaataatatgcttaaattcactgcttagtttagggtatgtattgataaagagtcgtaagtcccctttcttggaaaaactggtcgggtaacttttcttatatcgcaagtctcctagcatgtaattggtacatcattgaacagaagagcattcatggaagcttttagattgtgtgaaatcatatactgttagttaagttttttgtttcataggacttcaaaatggggttttggttttcattgtaaacattttacaaagtttgttggtattaatagggcagggaacaattcactgtctaatctatagacaggagagccaaattcgcagagagaataactgacttacagttttaaagaatggatatataatagacacattttggtgttctttctgtataaggagaaaagacacttaaggcactattgtcttacttacaaataccttaacaagaacacaaattggaaaggtgcctattactgttttcttctgaccttgttttttccccccaaccagttgattatgaaattagctcactgcttactgtgtttttataaagatatctgtctctagatcatttaagaatatgtgttcaacctttattaagagcagcggtacattttgttataggttttagaagcctgtcatttataccaaatagccctgtgtctagataataatgatgatgatgattaatattagcttatgtgtgtcttctatgccaagcagtgtgctaaatactttatgacttatctcttgggataagtacattataccttatctcttgggaaacttaggaggtatgcttcattgttacggtaatttatcagagaggtatggctcagagaggttaaggaatttacccaaagcagagttctattagaataggtttattgtcccttggattctgttttacttatagtgattatctcagaaagctagaagtaaaatcagtgtctttcttagttggtacagtctttatccttctcatcctgttgctaatacccatttaaggacagtgggaagaacaaaatagttcaaggtgcccttccttaccaagcacatgagtagaaaagtggcaaaagaccattgccagactgaattacctcctgtgtctgtgtgtgtgtgtaacatcataacatgtaatatgacatgtaacatcatctgtcttagtatatattatatgcttctctacaacttagaaatcatccttgatttcttttttgcccacatttcaatccatctttgagttctgaaggttctgtctccagaacacatccctaattcatctgcctgtttctgcttccactgttagaactgtagtttaacactggtcatcttgcctgaactattgtagtagcctcctgatttcttccagcttctacaattgcctacctatagtctactcacagagtagccacagtaatctttcttaaagcataaaagagaacatgctactttcctacctacaagaaacacatcaatagattttcattgcagtttagaggaaatccgacttcctacgctgtagccttgcttactgtgcttcaaatatactggccttctctctgtttttcatcgttaacacattaatatccatcataagtctttgtatctgctgtttcctttacctgggctgctctggtcattgattttcttgcggctgactccgtatcatttaggtttcacttcagatgtcaccgtttcagtggaggttttctcactgatctagatgctccctaccttaatactctctcatattaccatgttttattttctttttagttatcactctgttaagttgttgctcatttgtttagtatttatttctatctccatcagaatatgaacttcacttcttgagaacatggcctcccctgtgcctaggaaaacgtagtagcacatagtaggagctcaattagtatttattggatgaatataaatttcttttttctttttgagatggggtctctgtygcccaggctggagtgcagtggcacgatctcagctcagtgtaaccttgcctcccgggttcaagggattcttctgcctcagcctcttgagtagctgggattacaggcgcatgccaccacgccggctaagttttgtattttcagtagagacgggggtttcgccatgttggccagactggtctcaaactcctgacctcaagtgatccacccacctcagccacccaaagtgctgtgattacaggcatgagccactgcagccagactaaattttcatttaacactatattttgaatattttaccacagtcttaaatattcagaactgtggttgtgaactcttgatccacagtccagatctggcctaaagacacattttatttggcttattacatagtgctgttgtttgaggtataacttacagtcaagtgcacagatcttaagtgtacaacttgatgaactgatcttgtgtgtaccagtataaccacatctcagatcaagatgtaaaaagttttggcaccccagactcactcatttccttctctagccactcccctttcccacaggataacttaatacatagagttttttttttttttaattagctactagcattttaaaattgggagacttcacataaaaattcagagttccagtatctcataaaaacatcaaagatcaacacaaccgctttccccttgaccacaayttattgtagccgagaagcagctgtccacagtattgacatgtgttccccaggctgcctgcagtcttcacccttcctcctcttccccctgaccttgaaatcaattgccagttgccacttacaatttcatttgaattgtttttcttatgatggagaaatatttatctcttccattgtctctataaaaaagtgaaaacataaatgaaaacagaaaaggtgtcttatacttagtccataccattcatttgtagttttggctgtttgtttgccatcctaattccacacagttacgtttaaatgctgtataaatatattgtttatttactcattcttctatggaaacataaacacattatttttgttcttttgatattgtaaataacattttagattatctttgtacacagcattttattaggataatatttttgaagtagattttctggatcaaaatatattttaagacttgaaacatattgtcagctttcttggtagtagtgtaaattgctataatctggagggagtatatggaagtttcatttctctacatctttgccaacactgggaattgtaatttacaagttttgccaatatagttggtaaaaacaaacaaaaatgaaaatgctggccaagaagaagtttttcatcatcttatctatataattgtattttattttagaggatataatatagaaatattacttagtacaatgctataccttagatgtatgttgagtcaaatcgtgtaccatgtatcttgtatataaastaatatgaatacctcagtagaacttgggargcctttaaccttgatccttacatattatttatatttctatgtatatacacacaccatgttctatatctgtgcatgggaataggtattgcaaaatccttctgttttgaagcacatacaactaattcttaagcattgggtttatattggctttcatattttaaattagatgctattattctataatctgctttttaaggagatgcctacatagaagagtgacagcagctagactaaatgtttaactgctgaactagttcctcaggtatcctggctctagagattgctatgggagattggatgactgttacagatccaggtctgtcttcaggtaattaagtctaaataattgtaaacaaaagcagaaactgtaaaggtgaatttttcaatgaaaatataaaataattactgcagatgttgaagatgtgactaaagagagacaaatcgttgtaaaatacttattttcatgtctrctgagamcaccactgtatttgtatctttttggaaaaaaaagtrtatcattttcataaagaggctttgccctaatttgaaaataccttaaaatatgtatgtatatattatatctatgtttatatgtatatatgtaattcaaagtctttagtaatggcgattatgttagctttacatacgtttttctaaattatttatatagatgccttttattctttcagaaagcaaaactatctctcaatatacctcagaaacaaagatgtctccatcaagtttatactcacagcaagtgctatgttcttcaatacctttatcgaaaaaygtgcacagttttttcagtgccttctgcacagaagataatattgaacagagtatctcatatcttgatcaggtaacatgtttttgtaaaaaacagtagcataaatcatgttatataatagaatgtatcaaaattatgagaaaaacatttgtcaaacacaagtttgttgtttatgtagtgcccctgagacttagattttcagagaaccttggtgattatctcatctagagatagcaagtctaacttttttgtgtggagcaccttggcctcctcattgtcccaggggctcctccactgagagtccagccatcactttatggatgcagaaacccaagtgccttgctccatgtcacagatttatagcagagactaaaagagccccgtcctcttaactctttgtcctttgggatattgaccattttcttaactatttcaagatagttttctatttttctaagaaaagatttctatcttttgattttttttttactaagttgcccagtaaccaaccttttaaaataattcacatttatttttaatttttgacaaaaattatatatatttgtcatgttcaacatgatgtttcataatacacattgtgaaatggctcagtgtgcatacctcccatacttatatcattttttktggtgagaatttacttgctcagcaatttcaggaatatagtacgtagttattagctgaggtcaccgtgttgtacaatagatctattaaacttattcttcctatctaactgaaagtttgtatcctctgaccagtatctcctcaactgtaaccaactttaagaaaacattttctcctaccaggaattgactacttttggttttccttcattatatgaagaatccaaaggtaaagagacaaagagagagttaaatatagtagctgtactaaattgtatgaatgagctgcttgtgcttcagcggaagaaccttctagctcaggaaaatgtggagacacagaatttgaagctgggaagtgatatggaccatctacagagctgctactcaaaacttaaggtagaaattgcagatccatattttaatgccataattatataattgagtactataaatttttactgactttattaaatatttcagggttttcttaagctttagggttttctttttaaacaggtaagtaaaagtgaacttataatttacacacatctgcttcctaatacctacagtatattgaaggcattaattttttgagctgtttaatgacttgccgaatctgtaaaaagttagattaggaaatatttatgctctgggaaaataaaataacaattctgtcaccccatccaatcttggttaagaaagtataygcttcatttaaaagtcttattgtaagaggctgcacaggttaattccaagaaaaatattattgaggcatctgtgatgccaaatgagctaaggctcaataattaaatcagactagataacttcccttagaagccctgggtctctggaaaagactatagaaaaatgctttagtaaacttgcttttctcttaaaaaaaaaaggaagtatttttcacaggaccattgaacctactaactttaaaatgtagaatatttgatgctggtttctattttgatttctttctttttcttccttttatgttttcatttttatttttaaaatgtttatccaaggagaagggaacaaggtgttcaaaatcgtggggtggttgggacttatagttgtatattattaagggtataatataaatcaatccaagtcaaattttttcctaaatatacaattctatattgggttttgttatttgtgaaaatcaaagcctttgcatttgcatactgtcagatgatcagctttcttttagtttttcatctgttggtccatgcccgtttacttttccttatttttctttgtgtacatcctcccccaccccacgccatctaagaaaacaataaaaaaaacccactcagaatcttgaatctttgagctctgtgagggaataataggacctgtctatagaatatttaaaaaccccctagcaggaaatgtgctgtaatgatgtggcatagagttggcctacatgggaacactagaaacacttggggattggttkagagacatctttgctctttacgagcacctgtgcctaccatcctgtcattgataatgctgtcttatgttgtcttcttggttcatacacaatgataaaagtgtgttttctcttaataatgtttttaggcttttgtgcatcttatattcctaagggataaagatgatccagctatgtgtcttggctgactggggaactgtggtagattggagagggtatttggtgccccctaggcttgtgaaaaggttatgagttatggatgctactttaatccagatcagagagacctatggaaggtcttattaagtactgggctgatgcagagttgtaacccttggccacatgtcttataagtagctagtaaatcattatgataygttggtgatctgaggctattgagcctttacttcaaggagtggtcccatttattaggactacccagagcagagactgtttcttcaggatgtcttctaatatgggatttgacctgggccagaatcttgttattttgggtcaactatggacagaaatgtgtattcagtggggaaagttgccaatctatctggaaaagtttctagatctagcatatgattaatccaacttgttgaacaaaatttattgagtatatgctaggcactgagtttcaaagatgagtgaaaccccagtcctaggtcaygaggagattgcagtccagggaarggagacatattgaaacataactgtttgcttcattaattgttcttggggtaggacgcaagggaaggcttcatggagaggtaacacctgatctgagattggaagaatgagtagaaatttgctagtgtttggaaatgtcattctaggcagagtatatgacttgtgtaaatgcgtagcagcataagagatcactgcactttagaggaaccacaaatatctctgttggggctgcgatgggtatgtgatggtatgaagagtggtatgaggtaaggctggagcctcatctcctgatggtgtaaaaggaattgtacaaaaacagggaagcactgaggagttgtaaacaggaggaagacaatgtgtaaatattctggcagtggggtggagaaattataggggaattgcagacttgtatttgggatggagttagggggctcagaaagccctggtgataaagatgcctgttagcgaccctttgctgaggttttggacttgaactaaggtagtgctaatgggaatagtaagtaagattgagatctgacgaacacttaagaagtagaatgggtaggattttatgaaaaattgaatttggagactaggggtcatggattcaagaccccattcaggtttctgycttgagttactgaggatgrcgatgtgattcactaagaaaggaaggaggggtgtgtgcagatgttcaggggtggtgctgagttcaggtaaagtgttgataatcatgctgagtgaatttctgatttgacatatatgctacatatcacctggcctagtgcctgtaagttatgtcatgccaactgatctaccctagtagtaagttttacacattcaaaaaaaaaggktgccaaaaactgacaaccttagagttatccaggttatactcctacattttctgtaccttcttgagatctgttcttacagaaattgtgcaagttattatttatggtcggttaagacataatttgattggcttttgaattttataaaaatattagtacaattttaaaaatattccatatgggtggcctcatgcagaactcggcacagttcctcagatgcgataagttgaaaaggagcatcttgtttcatactaattctggctttgctgccattccgctctgggaagtaccttcagagactttaccacttgcagggagaagtggtgtcacacagaagtcccatttctgtgacttgatgtgttgccactttgcttggtcacccatctttttcttcagacttagctccaaatcacttttgcttctttttcaaagccaagtatactctcgaaggatgatgacattgctgtacttgaggagatcttcaaaagtgtggtatagaagtgttaaaaagtattaaaaataaactttaaaaatattcaggggcagcatcatggagtgatgctctttccagggatccattttgaagcacttttgtatatgtgtacaaaatttgatatgtagattaaaatttgatgtgtaagtttaaatgttattttatagtgtgctttgtaataattcctttaaataaacatttcatgtgccactaacatttgattttgactaataaacactaggatgtataacttcttgttactgatmttttaaggattcagttattctaaatcctttattaattttaagcaaaattgcttataaatgttttaggaacaactggaaacctccaggagggaaatgattgggcttcaggaaagagacagacagttacaatgtaagaacaggaatttgcatcagctactaaagaatgagaaagatgaggtgagttgtcagttattgcagatgaagtttaagtgaatttttgttttctttgtaatatgagatgaccataagagccactttacttgaaaaaagaaagaaccatttattcatctttccccaaattgatatggtggacctttgtgtaatagtatttaactggaagstcaggaaccctctccactacagaccccgcccccagtggatccatttggcttagatattagttcatagctggtaacagccagtgtcctggactgcccttcctggactcatgttcactgtcactttttcttaggcacaagagtgctttaaatgcagatcttttattctctgctgtacctgtacgtgatagctgaggtgccccttcttgcatgcactgtcttaaatattgacattgttygtctagtcaaccagtttcttcattaaatgggcacagaagcagttcacattaaaaatctaatttctgacacaaaagatacaattctgatttctgctttaktggttacttagcagaattctaatttctactttagtggttacttggacctatagcactaatgcatttcaaaatatattttttaatttgtgtagaaagaaactattatgtttttattgctctaaagtatgacccctgaccatgtaataactataaaaatataatacttagtttcagtgttttatatgttgttttaactacaattaaagacttctgaggagtgtatttctttaaagcgccctggagtggtttagatagatttgttttaccatatttgtttatttagtagtatatttagtaagtagtaggtaattagtatttaaactgtaaggttgcttgtacgtgtttccttgagttcacagacaattttgactagatctgttgattatatttaaacggtttgaatacagctcatcttcggtagggattaagttaatcatgttgatccctagcagggactgggaatggctttataaaagaataggacatactctgtcaggagttgcctgagaaactataatagatctaaattttgaacagcagtgtctggcacctagtagatactcagcaaatatttggactggattattctgctgtttggacttactcttactcgagaattgtttttaattagaaaaacgagcctgcttacctgctgccatgtgtcacaggcttaattcactttgtcacagattaataaaaagtataagtgattgtaagtcagtaatacaaggagttcactaaaaatgatcagatgaattctgtttatctcagatgaagttttaatcgttttaatacttccataagaatatctggtttttaaatgatcagagtctatatgtaaggtaaaaggtataggagataatttagaaaattagcgcttctggaaatttcagaattaaaaaaactttatgtgattcatataatatttaaaaaagtggtttctactggttacaaataaggaagaatcatcctaggattttaaaayctatatggggagatgaattttaggatttttctctttcaaatttgtgaatcgttactgggcttataatagcaaatgcctttttcaggtgcaaaaattacaaaatatcattgcaagtcgarctactcagtataatcatgatatgaagagaaaagagcgtgaatataataaactgaaggaacgtctacatcaacttgttatgaacaagaaagataagaaaataggtaaacagctggcaaagatcagctaagagaataaataagctaatactatgcttagaaataattgtaaaaggattgaacacagtaactcacgaaatgttattttcatgctttatacaattgattttcagtggtgtttgtktatataaaaaatgtagacaactggttagtggaaagtaagtcattctgccttgctttatttaattgcatgtattttttaacatgaccagtgtagaattaatccatagaggaaaactaagccagaggacattctaattttccatagcaaagaactgataatattaaaaatcagtgtcagtttctgagtatcaaaagaagtattttagagtaaacctcataaaatttttcatcagaccaaatcgttcatgtcagtttgagttcctttaaataagtttagctgtacatttttggagcagctagtcaaaaggatggactataaaagttaggcgtgtgtgtgtctaaggtatacttttttcctaatagtagtctttttcaaaactttaagccatttcatccaaatatgtggataatttcaagtagatagtgtaaattaaaaagcaaagaaacacgaaagtagagctttacaatacagttttgctggcctggtataaatacgaggcacaagaagtgtgtgtatttatttattgaagagtggtttccwagtgactataggtagtcctctaacatacattataccgtgacacccctaaactgtcttaccttagatttgaaaaacaggcgatgagcgtacgtttcaggctgtcatgtggtagactctgcctgctgtcagcaagcagtttagtgttgactacatcactgtcattctgcagcagagctgttggaggtatctgaatactttattttttaaattgttgaaaaatagaaatgaagattcagtaatgcgccgttaagattggaaatctttaggtatcctgagttaatcttactcatttggagaatcattggtttttaagtttagttagcctcatattcattcatgaaggaaaaaaattaaaaagcaggatgaaatgctgaaagtataaagtgtaacacagagaagtttattaaggatttagttctggaaacagagctcttccattatagyggtctggctgtttcctggtccaatcggaagtgacagtttcataatgattttattaactctaagattataataatttactctttttcctttttacgccaaatgtttccatgtccacctgcagcagaagatattactactatcaggrgctttgactcctttgatgaaaatgatgatgttaatgttaacaggacatggcaaactttttctgtatagatccatatagtaaacattttcagctttatgggatctacaacttatttgttgcacctacttatctctgccattgtaacaagaaaagtagccataggcagtatataaacaagtagatgtggctgtgttcccataaagctttatttacaaaatcaggcagccagcctgtgggccattatcaggcaaccctgataatgaaattaataatgataaggtaacatttattaagtacttactgtgcgccagatactgtgttcactctactgtgttgggtgctttaatagttatttctttgtcttctcaacaactctttggtagatacttttgttattcccagtgtccaagaagaaacaggctwagcagttaaataatgtgccgagatctcattgcttacaagtggtggaactagaaactcgaaaattaggctgtttaagcccaaatcctaacctatataccaggttcactttcaccacttacgtgtatagartgcattagagttttagaygcttaagcatgtatggtaagaattaattttatgtgttcatgtttgtagctatggacattttgaattatgtcgggagagctgatggaaaaagaggctcctggaggactggtaaaactgaagccaggtaaagtccagtttaaattgataaatgtaatcagacttccttctatcctgcattttcatactgacagtttctttctcaggaatgaagatgaaatgtataaaattctcttgaatgattatgaatatcgtcagaaacaaatcctaatggaaaatgcagaacttaagaargttcttcaacaaatgaaaaaggaaatgatttctcttctttctccccaaaagaagaaacctagagaaagagtagatgatagtacaggaactgtaagtggctctttcctctctaatacagtcttcagattgctaataagaataattaaaatatgtggtaggcattctcaatggggacactattggtattttgaataggacactcaactgctatgctactttyaattactgtgacaactgaaaagactgttcctatgtgttttcagacatttcctgaaaaatgctggagatgattttccggggaattaatacatgtcaagcactgttaagaagtgctttataagcattgtctcattttataatattcctcataacatatgagattatttcatatattataatttgatgatttagatactataaatatccccattttatagataaggaaactaaggcataatatttagtagcccagtatcacacatgacagtgctaggatttgaatccaagtttctcactccagagctcacaatcataaccactatgtcaaatatcctttcagttgttttagtattatgtactctacttttcacagagtgaaacttctgttaactttgggaaacaaatataaatttattgggtgttctttatgttctagtctctggaaaggaaaggctaaaaagattttgactttttccctcaagaagctctttttgggaaagacagacgtggagaagtgattattacatgtgttaggtgctgtaataaggtggtacaatgtgcagaacagaatagttatggcaatcaaggcatcacagagaaagtgacattttcactgcttcttagaaaataagtatttttgaggttaaaaaaaaaaacatggagaaagcattccagagaatgggagtaatatatgcagagatctgaaaaaaaaatcacataatggtgaaaagttcattttacttaattgctttacgtataagttaaaatcgtaggtttcagcaagttcacattagtgataaaaatctgaaaataatgttgatggaaaatgctagttaacagcaagataccagaacttgttttttaaacctgtatttgaggattatttattttgtggtatcacaaatcagtccagctgataagccyatcccagcacttacctttttttctccttaacatttaaaaaaaaaaattacctaaatttttttttttttttttttttaagagacggagtcttgctctgttgccaggctggagcgcagtggcacaatctcgactcgctgcaacctctgcctcccgagttcaagtgattcctctgcctcaacctcctgagtagctgggactataggcagccgccaccatgcccggctaattttttttttttttttttttttgtattttagtagagacggggttttaccatgttagccaggatggtctcaatctcctgacctcgtgatccgcctgcctcagcctcccaaagtgctaggattacaggcgtcagccactgcgtctggcctttttgagagagagttttgctcttgttgcccaggctggagtccagtggcaccatctcacctcactgcaatctctgcctctcgggttcaagcaattctcctgcctcagcctccagagtagctgggattacaggcatgcaccaccacccacggccaattttgtatttttagtagagacggggtttctccatgttggtcaggctggtctcaaattcccgaatatcttttacattctccattttgaggcctgcttgacctcttatatgtagttaacctcttatctcaaactctgtcacttctagtcagttcttarcattcactaatacttcttcaaggttagcatagtgtccattactactgcagcatcttcagtttttggtccaaccttaacgtctcatcatcagatttcagttagcaaaagtatgtggtaagtcagggagatctttcttcagtgattaaaccctcctcacccccattactcagccagtgggtagtatcctgtataattcttcataattcacatgtttaagtggatgaacaatgacctcttaaatatatattctagttttaaaagatccatttttctagctcccttttctctttaatttttgtagggaaagatttttgaagcattatagcaagagaaataagatgtaatgttggaatgcctaggtagcatccacatttcatttattatttgacctacttacttgtaaaacatataccgaaaattcaggtaaaatgagtttgttgttttgttttttggttttttagaggcagggtcttgttgcccaggctggtctcgaactcctgggcttaaacagtcatcccaccttggcctcacaaagtgttgggattacagacatgagccactgtgcccagccgaattttttattttcattttgtggttagagagttctgttcaatctgagaaatgtgcaataattattcatttttctttcttttttttttttttgagatggagtctcactctgtcgccaggctagagtgctgtggtgacatctcagctcactgcaacctctgcctcccgggttcaagtgattctcctgcctcagcctcctgagtagctggaagtacaggcatgcaccaccacgcccaactaatttttgtatttttagtagagacagggtttcaccatgttggacaggatggtttcgatctcttgacctcatgatccacccacctctgcctcccaaagtgctgggattacatacaggcatgagccaccgcgcccggccaataatttttctaacagattggtagtattctaataggctttaaaatgttcagaagagaagytgtgcttccttggaagagttactggcaagtagcttttgagtattggcaggrgctagaatcaccatgagccggatcctgggccattcccctgtctgctccgcctcagagaccctgacctctgctagcccattgctgacctcaactactgatagagttcttcagactcagttgctccctcatcctgctgatctccatgtgcgagcagtcgaatcagcccttctttcttttcatcttttatctttcttttttccccagcaagatttttattgttcaaattagtgaagtatatctctctgccttcctgaatattaatgacaaattagaactactttatgtagatgtgggttattatgacatatatcccttttagtattgtttccccatgttctttatcctgctttgattctgtgtgatcatatatcagtaaagtttgctacttctttatgatttcatgttttggcagaatacaaagaaaagtatctcccgttatataaaaaagtatatgaggaaaatagaattaacagttgcttttattaaatacttcagagattatttcacaagtgcatttctttaagcagcctaggattagaaacaagttgatctaatgtcaaatatcagttctgcctcttagttgtaatgctgcttctctaaacctcggttttcccacattgtaatgagctgagggttaaataacgtgaaaacatccaacacattagacaggtagtgatatctccttctcagacagcttcatgactcttgtcattaactgtatttggattcaaattcaggtttagagagagctgaatttaggagtctcattttttttctcaagacatttaaatactgggccatatatgcataagacacagcacagaaatgattttgatgtggcttcctctggtaatcaaactgaagactacttgcctgagcatctaaagccattgtaaggtactagcctttcctcttcatctctctccgcttgtaggttatttccgatgttgaagaagatgccggggaactaagcagagagagtatgtgggacctttcctgtgaaactgtgagagagcagcttacaaacagcatcagaaaacagtggagaattttgaaaagtcatgtagaaaagcttgataaccaaggtaaccactgcttctatgcatgtaaagtgagttgtgacatttggtaaggtgttgatttttagtcacttagaaagccgcattataggctcagagctaaagtactatacttcagtttggtggtttgaaagcaagattttgcatacatttattttttcattttattttattttattttacttttygagacagaaccttgctcggtcacccaggctagagtgtagtggtgccatctcggctcactgtaacctccgcctcccaggttcaagttatttctcctgcctcagcctsctgagcagctaggactataggcgcacatcatagccagctaattttttggtgtgtttttagtagagatggggttttgctgtgttggccaggcttatcttgaactcctggcctcaagtgattcacctgccktggcctccccagagtgtctggattacacgtgtgagccactgtgcacagccgacattttacatacatttagatgtgaggtttgaacctcactgagaaaaatacactttggtctcagagtgaatgtttgaaaagaggacatcatggatccatctgctctggatgcagtatacaatcaaataaagataactgagttgggataaaagactacacattgggtgtagtgtacactgcttgggtgatgggtgcaccaaaatctcagaaatcaccactaaagatcttattcatgtaaccaaacaccacctgttcccccccaaaaagagaaaactgagtctcttttactgactctcaaaaatcaagaaatatttatcgtagtatagataggaacattttgcttatttctagatgcttgcagattactatgttcctagtaattcacttaaaattatttttaaaataatagatgtttaatgcaaaatattaatttggaagtatataaagtagaatatcctggtctctattccatacatataacacttaacagtttggtgcatatttttctatactttcctctatggatttgaaagatacttacttttttttaaattttaaaaattgaatattacctatatttttctttagtgtgcttttttcacttaactattatccttatacatagctctacattgatgaatatattcttaatattttctgcttggtaaagtttgartgcttttaaactaggaaaatgaagatttctgctcagtaaatgaagcctatttaaagaaaaatttaaattgtcaaaatatgaactcagtgccattgtgttaagtattagtaaagagcaatcagcaaaattattattacagcaccaaaatgaatctacatgagattttgttcatttgagtcaatgctgtttattatcaaatagcaagtatgtttggacttcgtatttgttgaatttaatatttgagagcaagatttgtgacacttcattgatctttgaagcagtgtcaacaaaaacatgattttatttttctcttctctgaatatggccattttgtctgtttttaattaggacataatcatgaataaatatggattacaaattgttggcaatagagctctgtttgtaagcatatcatttagtcttaaaattgcacaaatgtgtaattgtcgtcatgaactcctgtagttgctttgcttaaacattttttataatgttaaaataatataaatttaattttgttatagcttatgaaattttaaaaagtcaaaggacgtaactactttttagaaaacctataaaattctagaaagataaaagttctgagagcccttgttttaaagatatgtgcaaaacactgtaaactaagtggtggctataagacctatgtcaacttactgattttgtcttagtttcaaaggtacacctggaaggttttaatgatgaagatgtaatctcacgacaagaccatgaacaagaaactgaaaaactcgagttagaaattcagcagtgtaaagaaatgattaaaactcagcaacagcttttacaggtgaatatgaattaccttttaaagctgttctccatgaaaagccagaaytgtgctgaaccttaccagatttgtattcctttatttcataaggccctggtatttgacagatttctagtctgtgttccctgctaacagatacattgtgtaccactccttaaatagtccatactttgctagttggggtagtaggtttcgggaaatgagaattctcatttgactttttgattcttaataatttctattcctgccctgaagtttgactggccttcccttgctttcatttcaactcgttggagtgtcgcaaggtccctcaggaacttactatgttttaaattttaatagcagcagctcgctactgcatatgatgatgataccacttcactattacgagactgttatttgttggaagaaaaggaacgtctcaaagaagaatggtccctttttaaagagcagaaaaagaattttgagagggagagacgaagctttacagaagccgctattcgcctgggattggaggtattttaaacaattgtagtgcttttgaaaatactgggggtgggtgggcctcagtagaatgcttctaaggtctcctttttttcttgctatttacttattttctaaaatatttactggtgatctcacaaataatttgaaatgagagggaggctgagcatatagaatgggatcatttccccttaccagatttgagaattgaacttaagaaaaaaaaacgctataagcatttattactgctttcagattggctttctcctgcyaagtgttttacacaagaaatctcttttgggtatccatcattcatccacggtcagtaggtgtggtgtcagaagacagtgcaaccaagactatatttgctgtttaaaaaggaagtataataaaaaattaagttctcttctccccagtccatcattgttatatatacgctctacagcttgctttttttacttagcaatgtgtcatctacatattcccccttcaaaaattgtagcagtaatgtctgaataaggttaaaaaaaaaaaatcaacaaaactcattaaaaaaagctacaaagtaagaaagtatcctcctttctcatcctcagtttcattccttagaggtaactgctgttaaaaagtatctgttggaaattcttctaggaagtactattttaacttttaatgtatttcaagttttcttgtttatcagttcattgattccctgctatgaaagataaggaattctgtgtccttattgtacctcctacctacacccttcctcattcacatctcatgtcttcataatattgttcctcttgttcgtctgcttgccttttttttgctttaaggaaataataaaaagcttccatttcatgtttgttcaacttcagtcagtatcagttcatccctgcagtgaaagctgaggactttcttgttgttactcttgttctacctctcttgctgtactactttgcaatttttgtgatattatttttcattgttatcacattcatagtttgtcctctaatacaatccaggtataagtactttgtctaaacttgagacttaaaagttggaaaaccaggaaagaaaattgataatactacaattatgtaaatgttattctataaccaaatatgtttggacacagaaaatattctgtattattaagactttgccacccagagagatatatcactatctagtgaattctttttctctgtagcttcctttgtgatttcctgaatcagatttcagctgccatgttgctcatatctcatgttactgtctttcttgggtttctgttcaattcgctatattagtaattgagtaattactaattcttgagtaattttttttttataaatagtgcatgagctgtaaacattctgaattctggaatagtcaaaaatatattcatacttgattggtttggctgtgtatagaatttagattccagttttttttcyttcaaaactttgaattattccatttctcctagtgtttagttttactgatgagaagcctgattgtaatatacctgtgttactttgtagataactgtgttttgttttctatctccctctgtggaagctttggtattttcttaaagtttggaaattttaccaggatacttctagagagttcctttcatcctaaagattctgtatttctttaatttagggaaattttcttctttattttttccttctttgacttctctgtgttctggaacttttgttagacacacatttggccttctgaatatatatctacaggttgacttttgttctcaattctgggatattctcttacctttatcttagagatcacgaaactggcctttcagggtcagttttattatttgctttagccactgagtctttgcttcagaatttatctttaaatttttctaatgtccttaatttttgcttttctttatatagcatgatggtattttacagatgtttattaatctgtctgataatatttgttacatttttaaaaaagatttctttcatctgttgaattatctcttatccatggtcagttttctatttatcttgaccttttttctatattagttttctcaatgtttggtgatgcgtgattctgtatcaatatttatgaatgaaagactgtgtgttgcttgttttcagtagctgacgtggatttcctcagttcacagtgtgaacgtctgtttcatcagtagctatcttcagggaacaacacttgaccagcattgtctcctacctgtttccaagcccttattccccacattactccaagagagtaattactcttgctactttgcatattgctcccagttgccaggtgcctttccctgcaagagaatttttctccgtctggtcactgggacagtgggcatagtgagggatgggagggaggcatgcaagacctgagggctgatggagaatttagtttaggattcatcagctattcagaagggggaggtttgacataatttgcctatgccctcttgtggtttagtggtggtggctaccagtactggtagatggctagaggatgagagaaatgcttgatgaagtcataggtcctgtttttcaagtgactaatttacaatatagattatttttcttttgtttgtaactttataatgttttgtatgttcaaaagttatgctaatattctgttccattttttgcattgtttatttgaacttaaaattgatatgaagacagtgatggttggtttattaggtgaaacagatgaatttctattttttaaacataattttttcgtaagtgaaatttttcttagtttttttgtttttgtttttttttgagatggagtctcactctgttgcccaggctagagtgcagtggcgtgatcttggctcactgcaggctctgcctcctgggttcatgccattctcctgcctcagcctcctgagtagctgggactacaggcacccgccaccacacccggctaattttttttgttttgtatttttagtagagacggggtttcaccatgttagccaggatggtctcgatctcctgacctcgtgatccacccgccttggcctcccgaagtgctgggattacaggcgtgagccaccgtgcccggccgtgttttgctttttgagatggagccttgctttgttgcccaggcaggagtgcaggggtgcgatctcagctcactgcaacccctgcctcctgggttcatgtgattctcctgcytcagcctcctgagtagctgggactacaggcgcacgccaccatgcccggctaaattttgtatttttagtagagatggggtttcaccatgttggccagactggtctcaaactcctgaccttgtgatccgcccaccttgtcctcccaaagtgctgggattacaggcatgagccactgcgcccggcttttttttttttttttttttttttggagatacggtcttgccgtgtcacctaggctagagtgcagtggtgctatctcggctcacttcagcgtcaacttcccagcctctagccatcctccctcctcagcctccaaagtagctgagactgtagtcctgtgccaccatgcccagctgatgtttgtatttcgtgtagagacagggttttgccgtgttgcctaggctggtttggaactcctcagttcaagtgctccaccaaccctcagcctcccaaaatactgggattacagacgagtgctgaaattatttttagttttttaggttaactcatttgacataagaagtacgaatagatagccagagagcaaacaaagatagctagagcaatcatgtgaaatggcaactgtgtggatgttgaaatattgatcattatttctttggctgtttatggtagagaaaggcatttgaagaagaaagagccagttggttaaagcagcagtttctaaatatgactacctttgaccaccagaactcagaaaatgtgaaacttttcagtgccttctcaggaagtgagtactttataaactctttaatttgaacatgcatataaataaaattatttacatattacaaaatactacatattattaatacaaaactttggaaatcaccaattagagctctctaattataactaaaagtcaacttttttttgtttgtttttgagacggagtcttgctctgtcgcccaggttggagtgcagtgacgtgaccttggctgactgcaacctctgcctcccagcttcacgcgattatcttgtctcagcctcctgagtagctgggattacaggcatgtgccaccacgcctggctaatttttgtatttttagtagagacgggtttttaccatattggccaggctgttcttgaactcctgacctcaggtgatccacccatctcagcctcccaaagtgctgggattaggcatgagccactgcgcctggcctaaaaatcaactttaatattttatttactgtagtgaaagtgaggatgagagggggactrtgcatgcccaaagtaacttttgttgtgagtttgtaataatgcgaagtttttgaaaatttacattgagaatttcttttttcaagatgtagtcttgctctgtcacccaggctggagtgcatctcggctctctgcagcctcagcgtcctgggctcaggcaatcctccttgcctcagcctcctgagtagctgagactataggcacacaccaccatacccagataattttaaaaacttttttgtagagacaagccctcgctatactacccaggctggtctcaaactcctggcttaagcagtcattccgcctcaccttcccaaagtgctaggattacagtgtgagccaccccacccagcctagaaatatttttaaaactagatccttttggctgggcacggctgcacgcctgtaatcccagcactttgggaggccgaggcaggtggatcacgaagtcaggagatcgagaccatcctggctaacacagtgaaaccccgtctgtactaaaaatacaaaaaaattagccaggcatggtggcgggcccctgtagtcccagctactcgggaggctgaggaaggagaatggcgtgaacccaggaggtggagcttgcagtgaggcaagatcgcatcactgcactccagcctgggtgacagagcaagactccatctcaaaaaaaaaaagatccttttaaacatgggtggactatgcaacaaagataagcaagattaatgataattaatttgaatttgttccatctctttcctcactcagaaccgcagatgaatcatcctgatgatttaccttcactatatttaatgcctcaccatatgtactgcctttttctcttacttgttttacaacaggttctgattgggacaatcttatagtgcactcgaggcagccgcaaaagaagcctcacagtgtgtctaatgggtctccagtttgcatgtctaaacttactaaatctcttcctgcttcaccttccacttcagacttttgccagacacgttcctgcatatctgaacataggtatttgtctataggtgatcttttcacgtgtttctaaaaattgctaaagttgcactgctaagggaaaggtggcatgtctgtagtattagcaacaatagagattttggagaggaatttagtagatgatttattcattctacaaatattgagtgtccagtatatatagacactgtgctagatgctggaaatacamtagtgaacaggtagatctgttgtcttcttggaggtaaatcatatgatgtgtgtctttttatttcacatttaagatacaatttagaatgtagtcttaattataggagttaatattttaagcactttaattgtattaaatggaaggatattgttttgacagtttttgtagagtacatatcttaacacttttttccggcatgcccattttattgttgttgaagggcaaagaactgagaaaagcctgttcctgttgagtgaaaaagatttgtgcccaaggatgacagtgtaaaaaaacatggctctccaccctgggaaacccatatgttgctcttaattgctacattttggtgttttcctgtatctcaagttattatatcattttctaagataagatcaatactctgcttcagtgccaattccaagattagttttaaacgaagaagaggaagcaggtagaacattcctagtaagacagagaggaatagaaaagatcagaggggtaagttggaaagtatggtggtaatctctttgctcttaattaaaagtaggagataatggccttggaaaacagtcagagctgaagcaaactcggcctgtgttagagactggagtggaactaagtgtcgaagaagccagctggcccttgggccaagaattatgaaatagatggagtttaaaacaagaaaggaagcttttaaaagaaggaggagaacacactataagttgtagttgacttttaagaggtggggggattaggactccaagtaaatgttagargggatgaaaaagagctaggtaagagcactctagccaagtgtaggaaccctgagggtgggacacacctcatacatttgcaatggtgaccaagacctagaggtgtgagatgaggatggagagatgtaaaagttcaaatatacagagaggataagatcgtgaacccacgtgtacctatgactcaggttcagcaattattaactctgatcaatattgttcatatataatcccactctgcttgctctctccaccccagccccaacacatctgggatttcatttacagaatattttagtgtgcatttgcaggtcaaatattgttctaaggggaatagaaaaaacactagttttaagcaagagagtgaaaaaaagtcttaagttttaaaaagattactgttttataatattgaaaacagattgtaggagtctgtaatataaaccaggaaatccagttaggaggcactattggagtggaaacgaaagacaatggtaattggactagggtcataatatgaaggaagaaatgcttggatttgggatctrttttgaagttagaccagtagatgagttgaatatgggaagtgaaagtttatttattttacaatcaaaagataatgtgtaagcttatagtattttcttacatagaatgttattcaaacttctaaatttgaccagtcagaactatctgtatagatatagacrcaaattctagccaccattcacaaataatgcattttatatctaagagatagcataacatagttgtctcaattgtttttatatattttaaatatttagctttttacatcatttttagttgtgaaatatttgacataaacatttcttgaagacattgttttatgtttaataaagttcagcatttagtacctaaatcatagggtgttgcaagttaaatgttaatgtatgtaaagcacttaaaaacatttagtgacagactataaaaataaaaatatatgtaaacaaatataaacatgctttttttgtttctgagtgctccactaaacaacatccgtggcatagaaacaattttggagcttaaagaaattcaaggtattcattgttaactagcctctaagaataaaacaaacagaaaaaagttttataactaatagagaagctgtgcagcctgacttggttcttcacattttaaattatttgataaacttggttctcttgctcctgaagcattttggatctcggtttatattaatattgcaacaaaataattaggagtatttgtagctaatttctacaacatcctcattgttccttcactgtagaatggaattttatataaaggctgtgccttagattccaggcaaggagacttgtgcgtaagttacctaaaaaacttagtttgatcatttgtacagggattctgatgaccgaattactrtaagtattggtaaataaatttatagtaatttggtcatcagaatcccttgtacaaatgattaaactaggcatgcactactactcccagctaattttttgtagagacagggtttcaccatgttactcaggctagtcctgaattcctgggctcaagcagttcggctgcctcagcctcccaaagtgctaggattacaagtgtgagctactgctcccagccgttttttttttccaagtaaaattttaaattatatttttggcctagatttttagaattaaaaggaacttattttttttgaagagtgccacattatgaggttaaagtacaaaagaaggagaggatagtcactaagatctgcctttcttttcccaacagttcaatcaatgtactgaatataactgctgaagaaattaaaccaaatcaggttggaggagaaygtacaaatcaaaaatggagtgtggcrtcaagacctggatcacaggaaggttgctatagtggatgctccttgagctacacaaattctcatgtagaaaaagatgacttaccttagacatgtggactggaatttttttcattaatgtgttcatcaagtttcacatctaagttgaaacagggtgtgtcataaagtcagttatctctaataacttaagatggtctgagttgtttgtttggacttccctgtcttcccccaaagagttgaaatcttaaatctatttaaaaggatataaaagctttggatatgtatttttagtaacagaagcatctggttctgtgaataaaggaatgtatagatgtttggatggaaacaaaagcactagactgagtttcctcttataggtattaaaaatagcacttttaggaaactgattattgtaaatgtttaattttgtctcaaatatagttggcattggaagtttagcctttacttgaatgtatactgtagatttttaacaaagcgagttctatatttattatgtttagtgtggtttgaaattacctctttcatatgttttaaataaagtgaaatttatgtatgttttgtacatagatacacatgattatgttaagaggctttaagatttaaaagtttcacacaaccataagtatagtatttcatgccagtaaaatttttttagtggtattctgtttacagatrtattaggaccattgatgcattacatttaagaattctctttaatacatctgggcaataaatattgaaaggtattccatgaagctgagttctttagataatcaacactactaacattacatttttgagatttttatgacattagatttttattttgtatatgtagaatattataatttttaaaaggactattgatgatagaagaataggggcaagacgacaaaagtacctttgaataaaacaatttaagaarttggtttaagatattggatgatagaagatatttaagatatctagatggtgatattttccttacaagatgggtaccagtayagtaatatctgtatactaactagggctttgtattgtcaataattttttaataattttttaatgaggtatttaccactgaagaaatatgataatataaaaccatcaaattttataattgagatgatactctggaaaaacatgtcatttcattttcagaaaactcttaagctctcttcagtctctgtaatgtttctgattgcatgtttcttcatgaaaagtatgttgttgttttgatagtaataataataaatgtaggctcagctctttcccaggattttcatcaaaaagctttaagtgcctaaccctgcttgtctctgtacatagaagcctgcacagatccaacccttgctaggtatcatagtttaggcccatttaccttcccctgtactggcagttcagccgcttacatgcactcaccctgtttgtggctattttaaattcatattattaaaaaacaaaaaaaacccacctatttgtgttgtccattcactatacgtaactatgtaactctttggagttgcatagcagcagccattttttcagggctgataggatatcattaagagtgtcttatgagacattagtggatatactcatagtaaccatatttatagttttaaagagctagctcttgagcattagtcactaccttcagcttgatgcatggtcacttctttactatttaaaatactacacattgtacaaaatatcgaagacactaccatatgctaaaggaagaaatctagctgggatataggatttttgttgtttttgtttttgtttgttttgctatttagcaataacatggtcaaaaaggcaatcagaaattttaaatacagttaatggatacatttggcaacaattttcccccgagggttttccatggtgtactttgcaagaaataagcactctaatttttaaagtaaatctcttattttagcaaatattatatttcatgacaatggagttctagaaagcagcatctgttttttgttgcgtgtttccattttaaagtgagttgagttctcaaattggaaagaaagattccttgagacktacttttaaaatctaaagtgtgaaagaaacagcagagtaaaagccagactcattgcaccttcaatgtctgcatagatccagaagttgtacattttacctaacaacatcacttttgttgaacattccaactccagaatgatccccaatcaccctaatctcagaatgctggaatgatgtctgttggaaaacccaggactccacacacaaaactcctgggattttgtttcccatctctttctaggtgtttgcaatgtacaaataatacagctgtgctaatctcacatttagccatgatagatgatggttctagagtgtacttccatttgtaagtcctcctgataagtgctttcttgtttatcactatgtaaatctgaaatattttgtacttcatttgtttttatccattctgaattttcaaagcataaaaatgtcaaagaaaaattgagataaacattttgttcaccattaaatgtttgcatctgcagtctatgatgagaaacaatgaaattatgactaaaatttaacaaatagtattttcttatagaagcaatgtattaaatgattagatacacaggacagttcacagcaaattgtttacttacatggcataattgaaatactgttatttgtaaagagttctatactgcctaccttagctaaccagaattgttcatagacttgtgataatatggtgttatgggaaaacacattttgtgcgcatgatgaagagagcaccgtgaatctagtcttgactgcccctggtggaacatttgaaagcccttgggactccaggagagakgtttttgcagcatgtatgctaaatttgtgagttagcaagaccctgctgtgattactatgttgtacagatcttcaaagtatattgcctaatatgagtcatgttatttctagattgaatttaaagtaagtatggattatggaagtctagtaaatatacttttccctatttttgtcctttttcagtcttttggtaagcatttattaagtacctgctgtatgtcaaggcttactactgctttccaatccttggtgatatgaagacagataagcacgctgcctgctattaggaatctgagctgagtggaaggccaactattaaacctacattgtaataaacaatggtggatgctacggacacattcagtctgttcataaaacatggactgatgggtctgctccaggccacatttgttttttaacagtaacgtggctaggcttccatttataagtcttagcattatttcctttgtgaagtactatgtaacagatgattgtttgctagattttgttttctacaatcaaaatgttgacctgcaaagcagtgtaggattttctctcctcaagagcgtgtattattatctagtagaaaaagcattcccaaagacttggtccatgcagataaggataatgaaattgctcactctaatcctttttctaaatacagtgtttttcaagctggatgtaaattagagtgggtggatattgattaaattatttgatttatatgaaatcaaatgactggttgaggtttttttgaacatttacaaataatggattcctgagagctcaggaagtactgtaatgtcagtgacatatgaagctcctgataaagatccacctcattcatatatttgagcttcagaaatacatgtacctagtataatgcttaacagcacataatatttgttgatgagaaatacactgatgaaacaacacatttttttactggaatgaatggactataagtttggggttagaatcctaaaactcctctttctcaagagggtaagaaccttgtcatgaatctatgcatgtgtacttccaaccctatctcaattccttgcatatagagtatcatgatagagtaggttatgctgcaattaaacattaagtcggtgtggcgtaataaaatttatgctcatgaaatgtccagtgtcaactgggcaatcctccatttttagctatgccatctggacgcatggtctccaacatcgccaaatcagagcgagcagactagcagatggtgtaggatatttttaagggccagacctgaaagagacatgccttccacctacagcctcactgcaaacaagactgggaggtatagaacatgtagctatttggtgagcacttacaatctgctatcaaatgtagttgatgctaggtatttcgtccatgcatattactctgcaaggggtttactgctgattattaaagcaaatattcttaatttttggaaggaatgtattttaaagctcctcacactttctaacctttttataatacaagtttctgaatgttcaaatggtagttttactcatttagttattaaagtatcttacagtgcacagaacacttttatttttcaactgtcagggaatcttaaccttcctatttttagagttgataacagactcaagtgttaaataatgaacccaaggtcacataactgctgttaagtgataagaccagactttaacccatatcttaggtttgctaaatttccaccttttcccacactgctgcagtgcctgcttgtagggctttctaagtgaaattattcacccattagctgccacctataatctacatcaaaagtagtgatcatttggtccatgttcaagacttggcctcatttttttgtgattggttaccatggcagatctattcagggttggaccactacctttctgcaattaagatactaaggatttcattgaaatagctaatttagtagtttatgatactctaaaggccattgagtaatctgaagatatgtctagatcacctgcaatttgtgtgtgtgtgtgtgtgacagtgtcacccaggctggagtgcagtggtgccatcttgcctcactgcagccttgctctcccgggctcaggcagtcctaccacaggcttccaagtagctgggactacagatgtgcgccactacacctggctagttttttgtattttttatagagatggggtctcaccatgttggacaggctggtctcgaactcccaggctcaagtgatccgccccccttggcctcccaaagggttgggattacagacgtgagccaccgcctctggccagcctgtatttttctgccctgccattttgttcactcttggcagtttgtgtgccgtgtcccaactgtagctrcagtcacagtgaccagaaatacttcattttgtccaaaaggttcagtcaccttttgcagacattttatcatgaaaaataaagtagtagaattaacaggaatatttttactcagttttagaaggaaaacggctgatgtagggcagctggatattttctagtttctctgttgcatctgcatttagatagattttcttgtttctggtctgtcatgacagtttcattcctttttacagtgttctattaaaccaaaccataccccagcccagtgtactcattagaaaaaagtaaacatttgcatattccctagaaccctaaaactgataacaagaacctaccctccattctggcttttggatccaattttctattatgtatgatgtctaaaccgaggtggtcaattgttcatcccagccaggcataggatcagacagctgagttccctaggattagactgctagtgcttagccatgactactatggctggttttgttaacctgtaagtatagtttttacttgactaaaacatgctgtaatttatttaccctaccttgagatttttttcttctgtaattctcagcccagaactattatttcaaactaaacttgtatttcacatttttaattagtgaagaggctcaacgaaatgcaattttcaaatagtcacccaatagtataaagcttttgtggaatatcaatttaatttctagccacttttagtttcttttatcttgaaaatcttttaccttaataactagttgatttggttttgtaatgttattccttttaagcaaagaggtattaaataataaggaaggctgggtgtggtggctcacggctgtaatcccaacactttgagagaccaatgcaggcagatcacctgaggtcaggagtttgaaaccagcctggccaacatggtgaaaccccatctctactaaaaatacaaaaattagccgggcgtggtggcaggcgcctgtaatcccagcaactcgggaggctgaggcagaagaattgcttgaacccgggaggggtaggttgcagtgagcctagatcacgccattgtactccagcctgggggacaagagcaagacttcgtctcaaaaataaataaataaaaaataaataaataaggaaaatctctataaattagatctcagtgaaattaaacttttccaaacaaatagtttttcagattctgtgttaatgccccaaagaaaactagaaatccaacaactagccacacaaagccttggtacatatgttctaaagaagctattttgatcttaaaccatgaaaaattttaactggaattttaaaaatcacattgcctttttatttccaaagcacttgtcttcatttttatcaagggcaaatatctgaggaaacaactcataaatgctttttgttgttgttgagacagagtcttactctgttgcccaggctggagtgcagcggcgtgatctcagcttactgcaacctctgcctccggtgttcaagcaattcttctgcctcagcctcccaagtaactgggatttcatgcatgcaccaccatgcccagctaatttttgtatttttagtagatacagggtttctccatgttggcaaggctggtctcaaactcctgacctcaagtgatctgcctgcctcagcctcccaaagtgctgggattacaggcatgtgctgccacgcctggcctcataaatgcttttaattgaaattctttgataaggaacgaaaagactatggtaaatctcagaggcaggttctggccttggcagtgagggccagaaaggggtgtacatcagagacacagttgcttgtggtgtggtttcccaaaatctggaggtgcacattcctgttgactcaaacttttgatagtgaaatggggagctattcatgattaggcctgtaccacaatggaaattgggacaaatgatcaccctgtgtataatggaagccctgtccaagtaagcataactctgacttgagttttgattgttgaacctgtaaacccaaaataaaatcctaaggccccccaactatttgggccccttctctcagccaagggcattccaaagttaacctgaaaaactagttcaggccacgatgggaaggaagggtgagacatgcctgattataccctccttcctcttggaattcaggaaaagttaaccagcattaatatcaacacagaccttaagtcttataagagacatttacaacctatgctccctgaaggctgttacctggaggctctatgataaaactttggtttccacagccgcttatcatcataacccatacatttctttgtactgattccaagtctttagataataactcattcaggctaggcgtggtggctcacgcctgtaatcctagcacttcgggaggctgaggtgggtggatcacgatgtcaggagtttgagaccagcctgaccaacatggtgaaactccatctctactaaaaaaaatacaaaaattagctgggcatggtgttgcgtgcctgtaatctcagctactcaggaggctgaggcaggagaatcgcttgaacccaggaggcggacgttgcagtgagctgagatcgcgccattgcactccagcctgggtgacagagagactccgtctcaaaaataaaataaaatagaataaaataaactaactcattcaacaaattgccaatcagaaaatttttaaatctacctctaacctggaagccactgcttcaagttgtcccacctttccagattgaaccaatgtacatcttacaggtattgattgaatgtattatgtcttcttaaaaagtgtaaaagcaagtcacacccagaccactttgggcacatgtcatcaggacctcctgaagctatgtcatgggcctgtccttaactttggcaaaataaactttctaaattgatacctatctcagatatttttgggttcacaaaccctaatccctacaaagcttcttcctttaattcatgcctcaggtatagtttctaaaagatggaatcaagttgtggtctaacctaatatagtcagctttcctataacactcataaacaccatgtaaaaaaggacaagtttgtctcaatgcagttgacatattagggaacaatttgagcataatgcaaaatttgtgtttgcttatgtgtgattctgttagtgagaaacactaagtgaatgcagaaaactgtgcccagctgatccaaactaaacagtaacacacaaaacaaatatacatctcaaatgtctactgttacagtagataggtaggcatgagcagggcaggagagggctcccccaccacccaccaggatggtcaggcaaccatcagataatggtatggcagttatcacactgcctctctaaaaatgatcattggcagccaggcctaggagaggcaatttcctgatggttcacagttgtcatactaacatgataattgattgcaggcaccagggagaggcaatttcccaaacagattaaaaacacttgaaattggtaatcagcttccaataaaatctcaggaattgggtgagtgagcttgaacatatgcatgaagagacaaaatggtggagtatggcctcccgggggcatttcactagaagagggaagaaagcctcaggtgagcatgctacaacttcctaaacacactgtgcatgctcacctcccaagcacaaggagggcactgtgcatgcaaggagcccaccctcagggaagaattatgggaaaagggatgcaagaccccggaagtatgccagcatattcaaccccaagtcaaaaggtcaaatgtcgcacttatccttcaagtcgcctgcttgtgtccttccatgtgtactttcctttctttcctgctctaaagctttttaatacacttccactcctgctctgaaacttgcctcagtctctttttctgccttaagcccctctgtcgagttctttcttctgaagaagcaagaatttaggttgctgcagacccatcggtaatttggatattcaccaccactaacactaccatctatctcagtttcccacatatgttataaacaatactcatccctatctgacattataattttcccctgggatttcagacaactctccttctaccacttcacaacatacaagctgcaacccttccaacccctacttccacaagctaacttccagtttttttcaaggtaaagtatcatgtttatggtattgtttatgcatttcttaaccacttaacatgtataaaactctgctaccattttttattaggatattttttaatgagtcagggatgactttttttttttgagatggagtctcgctctgtcacccaggccagagtgcagtggcgtgatcttggcttactgaaagctccgcctcctgggttcatgccattctcctgccttagcctccctagtactgggactacaggtgcccaccatcacacctggctatttttttgtatttttagtagagacagggtttcaccgtgttatccaggatggtcttgatctcctgatctcgtgattcacccacctcggcctcccaaagtgctgggattacaggcgtgagcc

SEQ ID NO: 12346 - DNA, 47130 bp, Homo sapiens
cagcccagagccgccctctagagagaaggtccggagtcccctttgaacaccaagggtcaccccttatgacctcttgccatcaacctgggctgagatttcctctaagaaacccccataccacagcatgggggagaattcccatccccagattagggccccaagccaggtccgcaaccaagggaaggagaggtgcccccagagttaaactcaagtgtccccaaaggctttcagccctttcccccaactcctcagtcccacaggtggccagataaaaagcatggattttggcaccagccagatccaagtccaaatgtcagtctcatcattctctggctgtatgattatgtgacttaacctgtctgagccacagcttcagagggaggctgtggcatttagtgatgatatatctggcacataaaagatgctcaataaatgctaacaatgatcagggctgccaaagacagttaagcaagctgtgcacagcaaaagcacaccacactttggaagacatccacaccacagaccttgtaggtgtgtatatttgttgtacaagtttctggcagatgacacgaaaatctcttgttctaacaaagttgctataatatgacaattttctcatagatgaaagaaagagtgggagaagtttttttttgttttttgtttttgttttttaatgtacaaaattcctggtagccctggctgttattcaacctcatttccaaccctgaatctttttctcctctgctttcataggccctaactcttgagcaaactccagtcctagagccctttctaggctgtggctatggccaacccattccccagggcctgtctcattctggcaaggaaggggtgccagaagcacagcacttacagccagacagcctccctcttgccttttctcttttgcaggttaacatggtggtcttaggcaagtacctgggcatccccaagccctacgggcccatcatcaatggccgctgctgcctggaggagaaggtgcagtccctgctggagcctctgggcctgcactgcatcttcattgatgactacttgtcctaccacgagctgcagggggagatccactgtggcaccaacrtgcgcaggaagccctttcccttcaaatggtggaacatggtgccctgagcctgcccccacccgccatcctctctgccctcttgctagggaaccctgccagggtgaaggcaaggaacaaccacctggcctccattctcttgggggagtcttggcactttgcaaacatcctggccaccatgggcaccaggacacagggatggataccacctaccctcgcctctggaatggcctacccaacccgagaagaatgcacctcattcttccctggcctctttcccacccacagcccccagaggctctagatcaacaatgttagcatgttccagaatggctgtgggaggcctagggagatgggccccacttagaattgctcccccttcattctgatgcctccctggggaacaaggataatgactttgcatctgcacctggaacggggcctgggggacctggggtctggtgtgccaggcaccaggctgcctctgctcttggaaaactaggaaaggggatcagaaacatcctctccccgctctaggtttcttctcccaaaggggacccaaggctgtgacacttacctccacccccatccagcacccttcagctgtgtgtggacaaacaaggacagaaaaacccagtgtccaagggccaatttaaatagaaaaaaagacaacaaaattttaatagctgactccgacctcagaagagtgattgctacctttctggaaagactttaattaccagagctggcttctcccagctcagaaatgctgagaagccaacgtgaggcctgaggacacacaaaggatgacggggcaggaggggatgaggtcagggtagcagagtgtgtgacgacggatttgggggcctagaggtgtccgtggttcctgggctgggattttggactctggatttgaagggagctggagcttccagatgtagcaggggtagggggccagatgttagaagagggtgtgtgtgttgggaggaaattaggttatctctgaaggtggagtttaatttcctttaatagtctttaattattccccttcattctgcaggcagtgggaggggaaggcttgcccggtctctctcagcaacccagggaccctgcacatagcttaggtttcatccctgaataaaccgctgtgcaggcccatgtcccctcccacagtagggaagacagctgccacgggaggttaatagcccggagtgaggtcactgagacatgcacaggcaggctggttcagctgggctgcagggcacgggcaggaggaagccagcctaccctcttcccccactgccagtgaggccattgtagggcagttggccctagggcttcggtccatctaggttttcagtggcccctgctgagacctcacactgagccaactactgtcactgttttaaccaacaaaagctagcctggaactgctatggttaaagtgggtgagcgggaacctgaaaatccccttctggaaggttctacagaactctatttgcaagctcctgctttaacctgagcgtcctctgctcaggatcataccccagcctgcactgagtcaagaaggagaaggaggctctgaaggggccgggggtgtgagctggggttgggactcccctgagaaagagctgtgggtaggaagggagtgagcattgcagagatagggctgggggtcggggccacactgagtgtgggaagctctggagttgctgctgggccatcgaggggccctggtgttggctctgagaatgttctgggtgaccagtcacctactttctgatcaataaaaatgtcgacatgcatttcttacagggctgtctacccagcctgtttgttgggttggggaggaggggaggaaagcggagaagactgcttccagttccatccactatgaagctgcttggctcaatttctgctgccacaggcggcccctgctcagctaggagagcctcacagtgccacggccagtgccacggccagtgccaggcaggctgattcagcaggatggctggcacattgcctcttgctctggggctgatggccctgctaagatggagatcagatcaggggagggatgggtcctgcctcttcatctcttctctcttccttcagcatcccctccatctctcagggacaacaggtcggggaggcagcccgggccctattaacagaggtgagagttccccagcagggctggttcccagggccacaggccactacagttccctttctggttttcgttttgttttgttttcttttcttttgtttgagaccgagtcttgctctgtcacccaagctggagtgcagtggtgctatcacagctcattatagccttgaattcttgtgctcaagcgatcctcccacctcagcctcctgagtagctaggaatacaggcacaggccaccatgcccagctaattgctaatttattttttacggagctggggttttgctatgttacccaggctggtctcaaactcctgggctcaagcgatcctcccatcttggcctcccaaagtgctgggattacaggtgtgagctactgtgcctggcccaattcccttccatttttgtgtctgaagcttctaagttacctggcttcagtggtctgattttggatgcctgaaatcatcaccctctcatcctacacatttgctgctgcctcaaattacaccgtttgatactcactcactttattttagcttttgttgtggagtaagagggcaaaaagttgctgcctattagtcattgacactttagtctgaattaaccacaaacctgtttctaaaagttggtattaacagaggagaagtgaaggcatgagtctccttccaaagacatatacagttctccgagaaagaggcaggtagtgggccagcaccccagggaaagcccctactttctgcatctattccccatctgtgctcacaagaaggctagggagactaaggcttcctcctgagctcgaactcttacccagggctcccaaggctgactcagccatcaagccattccacagctgaaaaaagtgaagctgtcccttgacccagaagcccagcagttctccttgaaaagaacatctttcccaaaaactgagacatgggaatgacaatctcagggtcctgttgaggcccttgaactggtgcagatgtcccagctggagatgctggggagcgggtcctggtccccatcctgtctcaggctgtcagcactgccagggagaagggaggaaacctctattcagcacctcctgagcctccgccaggcagggtgcgtcttcactattatctccgccagggccagtgattagctgcattttctacagatgaggaaaccgagtctccaagaggggggacactgacacccaaggccctatagtgggtgcacggtggagcctgcctctgaacccaagacttctctccccagagcccttgctcctgctcttccaggagcctgaatgcccctctgacttcggtttcccacctgacgactgagctttcctactctgacatgccaagctccccctggctggagagagttctcaccctcatcatttaccgctttcagaggtttttgggacctaataacagcaacaatagtaatacaataacgccaagctccataccagagctctaccaacgctggcccctgaggcctcacagcaaccatttttcagacgagaaaagtgaggcacgaacaattaagaaagttgcccggccgggcatggtggctcacgcctgtaatcccagtactttgggaggccaagtcgggtggatcaagaggtcaggagatcgagaccatcctgactaacacggtgaaaccccgcctctattaaaaatacaaaaaattagccgggagccgtggcaggcgcctgtagtcccagctactcgggaggctgaggcaggagaatggcgtgaacccgggaagtggagcttgcagtgagccgagatcacgccactgcactctagcctgggtgacagagcgaaactctgtctcaaaaaaaaaaaaaaaaagaaacttgcccaaggtcgcccatccaggaagcagctgaggcagggctgaaacccaggtctggctctaaaatccattaaaaaaaaaaagttggtgtttctcaaagggcaccaaaatgctttgggggtgcttattaaaaaatccagagggccgggtgctgtggctcatgcctgtaatcccagcactttgggaggccgaggtaggtggatcacctgaggtctggagttcaagaccagcctgaccaacatggaaaaaccccgtctctactaaaaatacaaaattagccggaagtggtggcacacgcctataatcccagctactcgggaggctgaggcaggagaattgcttgaacctgggaggcgaaggttgcggtgagccgagatcgcaccattgcattccagcctgggcaacaagagtgaaactccgtctcaaaaaaaaaaaaaaaaaatccagaggccaggctgcacccctaacctgctggatcagagtggacaacagacctgggaatccgcattttcaccagcttccccagcagagtaagaaagctccccattatagtctctgaaaatgcagaaaatggaggtgaggaagcaagaagcgtccgagatcaatatcatatatctctgcaccccctcaacagcacctgcccccaacagttcctggtgcctagccaggtacctgtggggacttgcttcccaagaaattaacttcctgggtgccggggtcgggacaacaggttcgtatacaaatactgggtcccttccagccaatcctgagctctcagctctgggaaggggctgggctttcatgactggagccaatgaattggcaccctgggctggaggggtggggccaggggcttttaaacctcatcctaaggggcctcaggggcagtgttgrggttggcggccacagctaagtccaacaccagcatgtcgctgcagmgaatcgtgcgtgtgtccctggagcatcccaccagcgcggtgtgtgtggctggcgtggagaccctcgtggacatttatgggtaagagtcagaggcctagtggtttgcaggcccttggtgctgatgcccttggaccttcctccctgcaggctgggcagggcttcttcagggcccactccccagccttggcctcggaacagcagccaatcagggaagcttgggtcctcctcttgctctactgagtttcctgaagaccttagccagggaatttgaagtttgggaggctgagccaggtagaagaggcttcagtgactgagctccagaccgggggcttggagggggctggtgccgcgaagagatggcacttttctatgtccaagggatgctgcaggttgggctgaggatctgtctggggcacacaagaataggaacaggcagatatccccagccccatcctgagcctatgagcctagaaacagagcatgaatcatttttaaaaaataagttaatacatagcacttaccatgtgccaggcactattctaagagcttcacaagtctcttgagttaagttttgaactttaatcttgaatttaacccttacaacaaccctgtgagctaggcttattattagcatcatctcatcagacaaatgagaaaaccgaggcagagagggcaagccattygctcaagtcacacagttactaagtggcaaagccagggtttaaacccgcttgtggtcttactcaggagtcttatggttttagctgctctgatacttggaaaataaagatttccaacctggtttcctctagacactcaatgcccatgcattatgctcctactgtgtgccaggycatgcctttgaggcccatggtagagggaggtaaggccttatcttctctctcttaggaagaaaagagggttagggtakggttttaagagctgggctctggggaccaccagggagctggcttcttaggcttttggggagamtccagggtcctggcttggaggtaatcaggatactgggaggggagggtgcagaactgtgggacagctcycacctctcaagtctcccagccctctcctcaggccaggtttctcaacctcagcactgctgtcacgatacctctttgtcatgggggccaccctgtgcactgtaggatggagagcagcattctgggcctctctttgctagataccagcagcacactcccgagttgtgacaaccaaaaatgtccccagacattgccaaatgtgccctggggtgggaagaaaatagcccacccattgagaacgagtctccaagactaagactcgaaaaatcagggcgaacttagtcgggagcagcgatggggttgatccagggcattggatgagagggggtgaggagctggtcatgggagggaaccaagtcgggagcagagccagcccaggaaataaatcctggtattggtgggtgggcagtaggaggaggaaggggattcagtggttcttgaaggaaggggcagccacggaggctgtgccaaggaggtaatgaggaaggaggggtatctgccacttggcaccactgcctgcctgccatggggtgactgggctgcgtgccatggggtgactcacctgcccctgctgcctcgtgcccgttgggcagatgtgtctccggtttgacctgycccaggaagcctgggcctggctcctcccccgcagagcttccttagaggatagaggatggattggggcaataagagrtaaaggccatagcttcctggagtcacctgagccacactggaggtttgcagagaaggccatcggtgggacagccacagggtgggggatggaagctctgataccttcaaatgagggattcttgggccctggtggccaaaccccccaggggtgggagtggagagctcctagttcgttcattcacatattcttcaagtatttcttttgggtctagtgtgtgtaccattcagagccttgaaggatgagcacaggctctggggacacatacaggggagaacaagcagctcctcctctctgagaagccagcagaggctggacaaccttcttacaagggtgccacagaaaggactcctttctgggaaggggagcaggactgagttagttctgaggtccctcccggcttggaggtgccatgatgtaacaatcctgggtcctcagcctgcgggccaacaagagaaagggcagtaggtgttgtggctcagtcctggctctgcaacttcccagctctctgaccgtgggaaactcctttaacttctctgagtctctgtttcctcacctgttgcctggggatgataataatatcagcaatggcactgaatgccactccccagcagtgcctgtaagcgctttccatatgttaactaatyctcacaaaattctcaagtgggcactgtcatcatcgtcattttatagataagaaaacaaaggcmcagagaggttaaacaacttgtccaaggtcacatggccagtgagtggcagagccaggatgtaacccagtttggccttacttcaaagggcagttaggggcattgaatgagattgtgtgtgcaaagcatgtaactaatactgatttgtggtgaacattcagttatgttaactgtcaccattatcatcatcatcagtttaaggctttgtcctgggcctgtggacagcctcaagcatccccaaacctgccatatgcaggatgtctgggraacagtctctggaccgtattgggagaaggagttgagaaaagagaaatttacatytgactcatggctgagtcagggcagtcttcctggaggaggggcaccaatcagacccttgaaggatgaggacaagcaagtctgttgggcctctctatctgtggcagtggattcaactttatcttcttgcctttccatgaattggagatgacccaggcatggtatgggggcttttctttcttgagcagtgagtcttaggatggggaaagggaaggaagggtaccctggtgcactgagccatgcactgggcgtctggtggctgattaactcctccctgcaactggaggcaggctcagcgggatggtggtctgacaagtgctatcccacagggctrtagggcttgaacccagatcccatcaagttccacagcccaggtggtttgcttggttccacacagctctttctcaaggctcaggcatcagcacaaaccttagcacaaagtcttggtgcaggaagaaagctgctttcttttcttcttcttttttttttttttttgttgaagacagggtctcactctgttgcccaggctggaatacagtggtgcaatcttggcttactgcagcctggacctccccaggatcaagctatcctcccgcctcagcctcccgagtagctgggactacaggcgtgcaccaccatccccgactaagttttgcatgttttgtagagatggggttttgccatgttgcccgggctggtcttgaactcctgggctcaagtgatctgcctgcctgagcctcccaaagtgttgggattacaggtgagagccaccgtgtctsgcccagtttcattcttaatgggcaaaatcaaaatcccaggatgacctctggtggggagggccatcctcagggcctctgtcattggcccagtggtaagaacagactggacccattcccactgggctttcccataacatgtggagatgcttcctggagtctgttgggttgtggctgctcatgtggctgaggggcccgygaagctggtcacctttgggattcatcacagrtgggcttggagagcagtccccaggctggttcagtgagacatctctggggtctyacacgccacttcattttttagttggggaaactgaggcctggagtgtgaaatgacttgctcagggttacatagtgagttagggacagagctaaaactagaaactaggtcttccaattcaaacgaaggatctctgactattggtgaagaagaaactgagtcacagaggtgctgagactcgcctggattggaggtcctggtggggcttgtggcgcctctgtgctggcagacttggctctaagggccccagagctccaggtgttctcagatgcayggctgtgtaagccctgcagtcagaaggtcctggaagrgtcaggtcccatctgcatggctgcagaggggcccagcgcacacagcagcctagagggcagctgagtctgttctctaagacacctcgaagagggggcaaccttgacctgagcgggtgcacagctctcgcacctcagaatgacctcaagtaacagcacatggaaaagacagaaggcagggagcccatcactaaggtatcccgggcaggtgtctcctaagagaccacacctggcaatgagccatgaagctcctcttttctccagctcagaggttctcaaccctggmagtgtgtttcaatcacctggggatccataaaaaaattgatgcccaggccccaccttgggaaacctgattcaactcatctgtgaarggccccagcaccctaggttttcaggatccgctggggatgaatgtgcagctggggctaagaaccgctgccctcactgggaagacaaacaactcatgtcacccctttctctgcagaggctgcctaatggagccaggactccaagttttggtcctagttctgtggtcactcactatgtcatcttgagcaactttctactcaaccctgggcctcagtttccccatatggaccctgaaggggttggcatagaacagtgggtttcaatttccactcatggaggcctctgagtcccctccctgatttgacaaagcagcttccattctgtcaacatcggattttgtttgatgcgagagctctgacctgcctgtgcagagagctgggcccttggggggattggtgcatttctgctcttttaaataygggggatttggaaaaagggtatacggggctgccactttccagtggtggggtggggcagggccacccagattacagtgggaccrtgatttcctgaacctgattctattgatgaggctggcagcgtcggcggatctgggatcctcgctgactggggaggggcrgctggaactgccacccagaaacccagctgcctgggtcttggtctcctctgcccccacatcccagctcggtggagacctcgttggtcatcttgtcaacctttcggtgttcagccatggggaactttcccawcagtttctcagctcctaaaatgtctgattttgttctcccagaagtccaggccctgagtccatgaagggagaagatgggtttgggtttgcaggcgagtggggacagagctggccatgagtcctggctctgtcacttgctagctgtgtgactttgggcaaatcacctgccgtctccaaggctcagtattctcatctgtaaagtggggataatagcacacaagttatgtggctgtgggggataccttcctcaccaatgccccgtcttcctcctcaccattgaagggggtgatacacgagggggatgggctcacactgagtcaactctacacgggctggagggaccaggctccagcatttttttttttttttttgagatggagttttgctcttgttgcccaggctggagtgcaatggggctatcttggctcactgcaacctccgcctcccaggttcaagcaattccctgcctcagcctccctagtagccgggattacaggcatatgccaccacgcccggctagttttgtatttttagtggagacgtggtttctccatgttggtcaggctggtctcgaactcctgacctcaggtgatccaccctcctcggcctcccaaagtgctgggattataggcgtgagccactgcgcctggcccaccaggctccagcatttctaagacaacctactctaagccgtgattctcagatgtcagcaaatatcagaatggcttaaaatgcggttccaaggccccacctggagcacttctaagaatctgcattttcaataaggtgggtctgaggttggctacttttagggaggccaactgttcctgtttgtctgggaccttgcaggttttagcacagcaaattctgtatccaggaacagccttagtcccagcaaactgatgctgttggccaccctaccacattttacccccaactcaccatcttaggctggctgtgccagaggagcagttgagttctccggctggcttggggggtgtggggctgggagagccctggacaggcctgtgcatggaagcctcagcggcgagggtccaaggccctgagcccaggactggaccagaagcactgcctagaaagcccagaagccagcatgtgacagctcagccatgctggcagctcgaggtggcctggagaggaaggactttgtccaggtgaggctccaggtacttcccctgttctctaggaaatgggaagctagatcctccygtacctgatgcaggttctcctcccagcagctgcccctctcattctcctaacacacagctttcatgacaggcatgagcactggactggaagtcagcagccctaccttctagtcacttatcttctgggcctcagtttccccatcagtgaaatgagggcatgacttttgctcatcctgagtgctttacccacactggttcctttcatcttctcctcatccccaccagatagatgtcgatgctgcggctgagggaggcagtsactcgctcaaagtcacacacctaatgagtggtgggactgggatttgaacccagttgtctggccccagggaccacaggctcaagtaccttgccacggctccatcatgttgcccctcctgatcaagaaccagcgctggctccccattacatagggatgaaatgaaaacaagctcattatagcctgagtctaaactagacctcttaaggttccacggtgaaaacaccttcccctcacttgtgtctcctcttggtgccttccctggggaacctgccccagccacccagcccactgtctcatcctgcctccagacccgtttcctgcaccctcatttactttaataactccttccctgtcctgggccaatggtgttgcaagcctttcctgtctattatcacacttgagtttcatgattgcccatgaggttggccaagtaggtgtcattatcccactttaaggtgaggttaatgggcccagagagactaagtgatttagtcaagctcagctggccgatgtgtgacccagcctggtctaaaacctaattcttgactctggtcccagcaccaccygagccctcggcttgcrgcccctcccttccccaacctcagatgtagcttgttyacctgtgctaagcccttgttcagaccgtggtcctggggaccctcctgggcaggggtgcttcagtcttcactggggatcccccagcatctcacacagagcctggcacatggagaggcaggggcgctgggctgaaacaccctacacccaggggctggagcctgggractgagtggggttttcataccagaaggaccatcaagggcgctcagcccttgcccatggacactggaggcccaaggaacagctttggggttgagggagttccataaaaagtgtacaggcttcagccaggcgcggtggctcrcgcctgtaatcccagctgggaggctgaggcaggcggatcacttgaggtcaggagttcaagaccagtctggccaatatggtgaaaccctgtttctactgaaaatacaaaaattagccggacacggtggtgggctgtgttgtcccagctgcttgggaggctgaggcatgagaattgcttgaacccgggaggtggaggttgcagtgagccaagattgcaccactgcactccagcctgggcgacagagcaagactctgtctcaaaaaaaaaaaaaaaaaaaaaaaaaaaaggcttccttgggagatggaaggcgrgtgcctcaggagcgtggctgagggtgttcccgagggtatgagaggctgctcttcctacctgggtttgtcttcctgtgtctctttccgactccctgtctctgactctccatctcgctgggtctctccaagtctctctgtccctatctctctgtctctgtgtcttcatgcctctctccctggttctgccatttcccctgtggggggctgcccagggccaaacaggccagagggctccaccagccctggaaattacaggctttgggagtagggttgccagataaaataaaagatgcctagttaaaattgaatttcaggtaaataattaataatttttttagtataagtgtatcccaaatacttcacgggagtaccaaacaatgattgactgttcacttgaaattcaagtccaactgagctttctgtatttttatttgctaagtctggcagccctgcttaggaggagaaacaggtgtgtctgtccctcccaactggtgaggacacctgacaggggcccagacaccagagtgggacctgcctgatggagagaagcttgggcttggtttatttcccttttcataaaaaagctgctttgagatgtaagagaatcatgttggtggaagagtgaagaggttgttttgggggaggtctgccttactctgagggaagatgggaagcggggggagtggccagctgtggaaatttggggtagtcccctacgtatcctgtgcctcagtttccccatgtgtaaacaggagtaattatctcatcctggggctgcagtgaggatcagatgagctaatgtacaaaaaggcttaggcaggcctgccgtgataagagtgcagaggctgggggctttttatgttatggtattgttgttattattactcctggggaggtggtgggcaagagtgtggactgaggagccacatggctgggtttggatcccagcccggccacagaccttgggcaagttacttaacctcggctttctcatctgtataatgggagacaataatagatagtgcctcccttctagggttattgagaggattgcatgatgggctggcacacagcatgagctcagtaagtgtcagtcactgttatcccccaggggcatgcatgccgctgcctccaggaggccctccaactcgcagtggcctctccctacatgggttcccactgagctgtgatcctgtggccttgagccccatctggctgccctggacaatgttggtcctcagctccccagcgggatcaacagtggggagagcagtgggtggatctgcccgccaggcagtacctgagtgcacagtgggcaccccacagtcaaaggatgcatagtctggtttccaaggaggaaccccaggctaggtggaatgagggaaatgcaatctcagggccagataacatcacagatactttaaacctgcaattaatttctggttgtttgaccaaatccggccaagtttcccgggtgacactgcagagctgtggaacagcatgggcttggagtcagacctgttgcacatctggctctgccatgtgatgcaacctcaggcttgtcacgaggcctccttgagcctcagttgctaatatgccaaatggggatgatattgctcaccttacagcttgtaagagtggagggagctgcgtgcgccaggtgcctggcatgcagcgggcactcaaccagattgaattcccttcccagggaagaattcaaggatatcttcccacccactaaggagacatgtgatgggatctggggtgagaattgctctttttaaagctctcagaactgtaaggggctccacccaccaatggctggtgttcactgagctcttcgtgcccagacctgcactggggatttatcgagcacatggctggcttctgacttccgaagagctcgccattctggtgagtggtaaagaaactcacaagggaaatgttaatgaacacaggggcttagaacatcagactgtgtgtatgtttttttgttttgttttgaaacagggtcttgctctgtcgcccaggctggagtgcagtggtgcaatcttggctcactgcaacctctgcctcctgggttcaagcgattctcctgcctcagcctccccagtagctgggattacaggcatatgctaccacgcctggctattttcttgtatttttagtagagacagggtttcaccatgttggccaggctcgacctcaagtgatccgcccgcctcggcttcccaaagtgcctgacctcaagtgatccmtccgcctcggcttcccaaagtgctgggattaaaggagtgagtcaccacgcccggccgactgtgtatatgtttgtgtggggtccaggcttgactcgcaggagcttactgtgaggatctgaggggactgggtggccaaggaaagcttcctggaggaagcagggcttgagccaaarctcaaacatctgagcaaaatatatctccttcggcaccgaccatggctctctgccctgcccaggtcagtgcctgagggcacagaaatgtttgaggtctatgggacgcctggcgtggacatctacrtctctcccaacatggagaggggccgggagcgtgcagacaccaggcggtggcgctttgacgcgactttggagatcatcgtggtcatgaactcccccagcaatgacctcaacgacagccatgtgagctggtccctggtggggtggggagaggtttcgagggaggcagctgtctagctctaggagggcccaacattctctttctccagagcgcagggcaacacagtgggtaagtgcctggccttggagccatactgctgattttgaatcccagctctgcaagttacagacacataccatgtgtccttggaaagccttatcatccccttggggcctctgtctgccatctgtaaaatgggataatcataacccctgyctcctatcattgctgtggagtgccataggagccagtgttgctccttctcttgcttcccaagaccccctggagaaggagttgtcccagttctgctgagttgggtctcagtttccccacatgtaggctgagggttgactaggggatctytgccactttgaatgaaagagagaaagcagggacaggggagggacaccggtgcctgggaagacccccttcctaggtgacagcatttccccaaggcgctttgctgtccgtaatccactctcttcctgaccctatttgcagggtaggggacatttaacacatgggagaaatgggtggcctttaagcttggcacaggtgatgtttgcttcgagggctgatagggaccaggacttggagtgtgggagtagtgggatccactccatgtcaggagcgatgtttcagaaactggccctttaaggagcactgaccacgtgccaggtactgggcagccatgacctcatccagccctcacagcagcccagagaggtgggggactgatgcccatttcgcagatggggcaactgaggttcagagtaactgtcccgggaccgcacactaatggtcaggagagctagaattcagtgcagacccctgggggcagtctccctccatcacccccacctctgttcccagccatgcatccatgaggcacttggggcaggacccaatgaacccatttaataggcaagaaaactaagaaggagaaggggtggctttcctgaagtcacatgatctagcgagcggcagagctggtgagagtcaggacagagtcccaggggtagtgcaagaggactggccagcctgtgaggggccccaccttggtgccggttgaagtggcgatggtgtgggtacccccaccttgaattccttggccatgatggctggtgggatggaggaagttcagagtctctcccactctttccctcacccgccatatacccctgctccctatcctgcctttggccaggatcccagtaattgtatgtttgaggcaagcatcactgctggtgattgacacatggaggtcagtaattgcaggatttaggggctcccaggactacagaggtgagtggcccctgcaagatcctcccctctggctgagattcggacatgagaagcagagagttgagacacccatgtcaggagggaataccccaaggggagggtcatgctttaaagggaacttggatgccttggattcatctgcctccaactaaatatcatccacgccatcttcatcctcaccctgtaacagttcttgagtgctcgctgtgggccgggcaccgagctgcatgtgccccatacatgactcctttcatcttcacagcctctaattagtcctaaggggtaggaactattattatccccactttacagttgaggaaattgaggcccagagaagatcagtaacttttcctgggatattcaaaagtgggggattcagaatctgggcccaggccatctgacctcagagccctgcatttaaccagcccccaccccacaagatgccacctgcccactgataacagtagctagtatttcttgggcacttcctatgggctcagtcttttacatgtattgtttccaagctgcattacaagcctctgaggtagagacctatagaggtagagrccttttcccattttgcagaggagaaaactgaggtggctcaggtaggtgagaggccttggccaaggtcatagagtacccagaggtgccgggctcaagcccgggcctgtctgagtcccacagacaagaatgttggcttggagagtgtccccaaaccctgcccagcccaaaccctttattttacaaatggcaaaactgagacccaaaggggagcaagagcttgtcaaaaatcacagagtaggttattggagggactgggacccaagtctcttgagaagctctcacaaatagctcccattttacagatatgccaaccaagacacagaaaaataaatggcacagaggaggttaaagaaagagcaaggttccttgggccccctcccctccttaccagatccccgagagctatcttttggggcgggagctcttggcttctgctggtattactctgcrcccaactctccacaggttcagatttcctaccactccagccatgagcctctgcccctggcctatgcggtgctctacctcacctgtgttggtaagttgggggccatgttgatggtgtggccaagggcacatttgaaaaattcaagcagtacaaaagagtatacgttgaaaattaaacctccttccctccaactcaagacttctagttccccaaacccagcatttttctagagatacgctgtgcttatatatgaaagcacatacatacctgtatatcccccctcttttgtaagcaaattgaagcatactatagacatggaactggaccttgcttttgccagcttaaagtttttctgctaagcctccacaaatggatacataaactccgtgcaagatggctcagatgttggagctatcagacagggcatgcaaagtaatmgtgattaatatgttaagggttctagtggaaaaggtagacaatatgtatgaacagatggggaatttcaacagagaagaaaatcaataagaaagagtcaaatggaaatgctagacataaaaaccatagtaataagagattttaaaartgcttttgaaggtttcaccagtagacttgacacagctgagkaaagaatcagtgaacttgaagataagtgaataaaagttacccaaactgaaacccaaagagaaaaaagaataaaacaaacaaatgaaaaaacataacagatctaagagctctgtgacagtatcaaacagtctaaattcaatgaaattcctatagaaattccaacgtggcttttttktttgtttgtttgtttgttttaaggagttttgctcttgttgcccaggctggagtgcaatggcacaatctcagctcaccgcaacctccgcctcctgggttcaaacgattctcctacctcagcctcctgagtagctgcaattacagacacatgcctccacgcccagctacttttgtatttttagtagagacagggtttctccatgttggccaggctggtcttgaactcctgacctcagatgatctgcctgcctcggcatcccaaagtgctgggattacaggcatgagccactgtgcccagccccaacatggctttttaatataactttacagagctgatcctaaaatttgtatggaaaagcaaaggtcaagaatagctaagacaattttgatgaagaataaggttgagggattcacaattccaaatatcaagacttttttttcaagctatagtacttgaggcattgtgaaattggtatagagcaatagagcaaatagagaacccatagacagacccatgcttgtgtggttatcatgtggcaataaatgaacttggagccctacctcacaccatactcaaaaataaacttcaagtcagttaaaaatcttaaggtgaaaatcaaaattgtaaagcttttagaaaagaatatctttgtaccctcaaaatagtaaagattttctttaacaaggcaaaacaaaagtgcaaagaccataaggggaaagattgctaaattagactgtattaaaattaaaaatttatatgcaacagacaacaagtaaaaagtcaaactgtgaactaggagaagaaatctgcaatgcatacggctgacttggtgcatatagaatatgaagaactccaatcaataagaaaaggacaaaaataatagaaatgggcaaaaacatgaataaacaattcacagaagagaaagtcccagtgatcaaaacccaaattaaaagatgcctaaatgagcattgccaaggttgtggagctgggaaactccttacaaaggagtgggtgggagtttgctttggctcacacacttgagaagcaattagcaaagaagttgaaaatgctttatctgtaggaggcattttttagaagcagaacttctaggtyatagagaatctatattttttaacttgatagatattgccaaactgctctccaaaaacactgtatcagtatacatgtctgccaactgcatatatgctttgccaacactgcattagcaactttttccctttttgccaatcagttggcattgcactgtggttttactttgcctttctttagttaggagtgaggttgggcattccccatctgcagcccaaatacatacacacatgatcattggaaaataacatagacagaaaagtacataaagctttattttacatacatatgtgcataaagcatatgtacacacacacacacacacacacacacacacacgaataattacaaagcaaatcaaagaatagctcagaaaataaacccaagagtagcccaagaaatgaaacactaccagaaccccaaagtccccctcaatgtccgtctctgatcataactccctccttctcctacaggtaaccactatcttgtgataagtattttcttgcttctcctcatggttttatctcttgaacgcaatacccaaataacatggtctcrttttatcatctgattttctgtggatgcagtcatatcatgtatgttcttttgcgttgggcgtcttttgccctatgctatgtttgtgagatttatccacttgttgcatggtggttgagtatcttttcacatgtttaaaaatcatttcaggccacgcrtggtggctcatgcttgtaatcccagcactttgggaggctggggtgggtggatcacttgagcccagtagttcaagaccagcctaggcaacatggtgaaatcctgcctctatgaaagatacaaaaattagttgggcatggtggcatgcaccagtagtcccagcctcaggaggctgaagtgggaggattacttgagcccaggaggcagaggttgcagtgagccatgatcatgccactgcactccagcctgggcgacagagaccctgtcttgtctcaaaaaaaaaaaaaaaaatcctatctaatgtattctttcttctctccctccctgcccctcactgcttcttctttaagaactaagaagactgcttttttttcagagcagaaagattgattctgacctcctgaatgctccatttgcattatgaaatctcacccagtgtctagggctaaaygttaagaaggtgggatgggggtgggatttggggactgcgagtagctcagaaaggacacacagccaggaggcggcagaacctgggtttgtgttcacatctgtttgacaccaaagtccaggcttgctaccccattccaaggagatgaggcagctttatatagacaagaatgttcctggagacctgggctcagttcagggcatgcctgggactgcaagggctgcagggatgcagataggaagtggtcagggaagtctccctagagggggcagcatttgtcctgggcctttgctgtgaccctgcttcttgcctcaggcctctttccccagcccagagggtgcagatgccctcacctcttggatggtgtctccttagaaatgacttgcctttgctcagccccagacaagccctgagatcaaggcctgccctgggctcctgggaaccytgtagtgacttaccctctgcctcctcttgcagacatctctctggattgcgacctgaactgtgagggaaggcaggacaggaactttgtagacaaggtaagcatctctgcctgggcccaggaagcaggagtgcagttggagcttgctctaggttgggttaagaaggatgaggccattacagatatccccctgcctcccagctgaygccgaraccaagggccaaaaacagaaaccaggcatggctggggatcttctttcaccaggagaaaaatcatcgccaggaattatcaggcatggaggtacccagccctgagctaggccttggtttgtgggatcaagaccttctggactcayaaactaggtcaggagtgggcaaactttttccgtgaaaagtcacatagcaagtattttaggctttgtgggacatatggtctcaattctgccactatagtgtgaaagcagccacagttaatacagaaatggatggatgtgactgtgtgctaataaaactttatttatacaaacaggcagtaggccagatttggcccacagttcataatgtgctgatcctgacctaggcgagaagagaaaccaaatatgaaactgttgaagaacttgggactgaattatgttggaacttggtgccctgggagttaagaggagaaggtcgaggtgggctgggtgggtgaggaaggcttcctggagggacgtacccttgagctgagctctgaaggggtgcaggagggaggacgttccaggtgcagggaatggcaggagcaaaaccaaggagggtttaatggaggaatgagcacagagtgaggcgtgtggtcctataatcaggttgcctattgagaaagaggatgttggctgaaggcccatcacagatagccatgaaagacagctctgtgctttggactggatggtgtgggcaacagagagccattgccattgacatgtcttgagaaggaggtgcttcgagaacgtggacctagcctcacagggttgggtggttacaggccaggctsgggttcctgggtagggaggcacaggtctcatctgagccctcatcactggctatgttttgtcattggcagcggcagtgggtctgggggcccagtgggtatggcggcatcttgctggtgaactgtgaccgtgatgatccgagctgtgatgtccaggacaattgtgaccagcacrtgcactgcctgcaaggtgaggccggggcagcctgagtccctgggtgtccagggtcactgctcagttaccccatgggagttccaacccacaggcgagactctgaggccagagtccaggggagagcgccagcctccagacacacctcgatgctcctcaaaacccatctcaggctggcagctgcccctccctagtgtctctagggccagtgarcactcacatgccagggcagaagctctggaaatgagccacctcgccattctcttcctccaggggagcagaggatgctagcattatttgagcacctactgtgtgccaggccttttccccaaattctcattgaatcatccaagtgggacaatatcatcaccccaatttagagatgaggatgctgagactcagaagccaggagactccctgaagactgtgtctgatctggggcctcccctctcaaccccaaatctgggcctcctccttcagcacctctggcctacatttctgtgactcccccacctcttgctaagtccatctgtcctgaattccagccccatggagaatgagctgcaatattccagggtatgctaggtgctgtccacgggagatgcccacggttgccttctgaagtgggcaccattggacatggggatgctggggctccagaagggaggggcttgtccagggtcacagggagtgatgctgggatggaggccagaacccttacctgcacgacgcccacatggccttaccctccttgcttctctggagcacctgttgtgtgtcagacaccagctggctatgccacacttcatgtttctctggscaattgaggaaacatgagtccaggagagcatagatgtcttcatggtttgttcttgatggcttccagggttttcacaaagctagggctgggagacccaggtcttgatacccactgacctggggagggagcygggcagcagaggaaggggccaggggccaggactcccttgagtcactaccactctgtctggcttcacagacctggaagacatgtctgtcatggtcctgcggacgcagggccctgcagccctctttgatgaccacaaacttgtcctccatacctccagctatgatgccaaacgggcacaggtcttccacatctgcggtgagtttgtgccactgccccttgccatctgtgccctgttgccaggttgcctaccagggaacctcctgttcctgccttgggccatgggcaggtcctgcttacactccgggagatgccctggtgggtggcgggtcrcagtaagaacagtcagaagtgggggctttggaactgatgaactggtgcccccrgcacaacacctggcctgaggtcattttatttgatgaatgaccttttcaaatacattttaagcatgtgtagaaattcttatcaaaaatttcaaacatacacaaaaagcagtgctgtgaatccccatgtgcctgtcactcagattaaacaattatcactgttttgtctgtctcgctgaagttttgtaaaaccaaccccaaacaccatagatttcacccaattaattcagtttgtattccccccaaatatagatggctgttgttttacatagtctgccaaaatcacaagaaatacaagtaaaaatctaaatgcctttgagaaactaaaaatgtatacaagtaataagatgcttttttttttttttttttttttttgagacagagtctcgctctgttgctcaggctggagtacagtggcgtgacctcgggtcactgcaacctccacctcctgggttctggcgattctcctgcctcagcctcccaagtagctgtgactgcaggcatgtgccaccacacccagctaattttttgtatttttagtagagacagggtttcattgtcttagccaggatggtctcaatctcctgaccttgtgatctgcccgcctcggcctcccaaagtgctgggattataggcgtgagccaccgtrcctggccgcttattttttaaataatcagacaatatggaagtatagaaaatgaaacctgagagttctctacccgtctctaaatctgactttttttttttttttttgagtcaaggtcttgctctgttgcccgggctggagtgcagtggcatgatctcagctcactgcagcctccacctttcaggctcaagcaatccttccaccttagcctcacgagtagctgggactacaggcatgtaccaccacaccctgctaatttttttttttttgtaaagacagggtttcaccatgctgcccaggctggtcgtgaactcctgggctcaagcaatccacccgmtttggcctctcaaagtactaggattataggcgtgagacgccgcacctggcctgaatctgattgtcactgttaacgagttgggatgtgtgcttcccaactttattctacatgttctccagcgtgtgtccatatgctgctttccaaccggcttctttcattaagtaataatcccacacacctttyctggtatttattgagctctacttcattcttttccactgctgtataatattcctaagcatagaggtgctgtgacttacacagttctctgaacatcatagtggtttgcagtgttttgattttataacaatgcaggttgcttgaggtcaggggctttgttcaagtccakaaccgtgccccatgggtgcactgtagttgcacagtaaatatttgatgaattaatgaatatcgagcactcttgtacagaaatattatgtgactttgtacctattattgtttgtttgttgttgttgttttgttttttgttggttttggttttttttgagatggattctcgctccatgcccaggctggagtgcagtggtgtgatcttggctcactgcaacctccgcctcctgggttcaagcaatcctcctgcctaagcctcctgagtagctgggattataggtgtgcaccaccaccgcccggctaatttttgtatttttagtagagacagggtttcactatgttagccaggctggtcttgaactcctaacttcaggtgatccaccgccttcggtctcccaaagtgctgtgattacagacatgagccaccgtgcccagcctgtagatgtatttttgtaggaaagatacctagcagtggaattgctgggcttggggtaaacattactttgttggatgctgccaaattgtgctccaaaaaggtatgagcgccagtcttagaaaggaagaccctttcccccagccgtggcccccactgtgtattacctgtcctctcctttgccagtggaggtgaaaggagggagttgttggaggacttggaatttttggtgaggctgcagacctcttcctgtgtccctcatactcatgctccctgggcccacagggagtcacagccaccccgtccctccccttccaggtcctgaggatgtgtgtgaggcctataggcatgtgctgggccaarataaggtgtcctatgaggtaccccgcttgcatggggatgaggagcgcttcttcgtggaaggcctgtccttccctgatgccggcttcacaggactcatctccttccatgtcactctgctggacgactccaacgaggtagggacagagggggttcaagaggagctccactcgggaccagcctgggcaacatggtgaaaccccatctctacaaaaaaaaaaaaaaatagcgaggtatagtggtgtacacctatagtcccagttacttgggaggctgaggtgggaggatcacctgaaccccagggaggttgaggttgcartgagccatgatcaccccactgcactccacagcctgggcaacaaagtaagaccctgtctccaaaaaataataataataaagggcagtggggaggrctccattcctggtaagtctaccaggcaccactggtgtgaaagaccccagacttcttgaccacccctctggttcatttccatcttgcagagaagcaaggggttttcttatggaccacagtggtggaatcagagtccccccaggcctctggactccaagtccagtgctctttctcccctggtctgcccctgcaggatttctcggcatcccctatcttcactgacactgtggtgttccgagtggcaccctggatcatgacgcccagcactctgccacccctagaggtgtatgtgtgccggtgagtcttggggcagtgggtggtccctctggcccccaggccccggctccatcctgagcccctcttccctgggcttgtccgtagtgtgaggaacaacacgtrttttgtggatgcggtggcagagctggccaggaaggccggctgcaagctgaccatctgcccacaggccgagaaccgyaacgaccgctggatccaggtaaccacagccactgggcagggcccagcaaggacgccatcctggagrgagaggccttcatttgggggccaycgagaaacatccaggaggacctgggtgctccccagggaacttgctgccgtttctaatgtgagacctagaggcttctctccagaaccttctggagacccacgctgatcctggattcaacacccattcacccaccggatctgggctaggcactaggctaggcccacaggggtggcacaggtgtgagacacacactccctgccctcaacagctgagaccagtggttctcatcaagaggcgatgtgtccccaggagacgttttgcagtatctgcagacagtgcgcaggacaagcccccacaataacatatcatccagtcccacgcctcagtagtgtcgaggctgagaaaccttgatgtgcagaatgattgctacaaaaatacctactcctactatctagtgtgtagctggggcaacatggtgaaaccctgtctctgcaaaaaagttaaaaaattagcagggcatggtggcgtgtgtctgtagtcccagctactctggaggctgaggtcagaggatcacctgagtttaggaaggtcaaggctgcagagagctgtgattgtgccactgcactccagcctcagcaacaacaacaaaaaaaaaaaaaaaaaaaragagagagagagagagaaaaagaaatatctagggtgcagaggctataccagcaaagcaccagtagggtttgggggatgcagcatcacctctgcccagggaatcagtgaagacctccaggagggagagcatctgagctggaccagatttggcagatgagggcacatgacttctgccatttatgccccattttctgcaggccaggcatagcatcatttcatcttcttgataaccccctgtaagtcccccataattcaggagctcttaggggagcatgactgggccacagagctggtaaaggcagtgctaggactcaggctgccaagcaccaggctgtacaggttggtggtcctggcagagaccgagcatgcgcaaaggcccgggggtgggaggcaggagagagaaccttgtgtgttctcctctgtcagggcactggttctgagaaaggcaagggttgaggtcggagaccttgaattccaagttaaggagctttcctcttggccggaggtcagtccagtgagagggtttggggcaggactctggggcacgatgggctgggtttagagcctggctgtgccaccaactaactagctgtgagctttgggacaaatattttttaatttttatttatttttttaaattaatatattttgaatttatttttctttttggagacagtgtctctctgtcaccctggttggagtgccatggcatgatcacagctcactggcagcctggaactcctgggttcaagtgatccttctgcctcagtctcccgagtagctgagaccacaggtgcrgccaccaggctcagctaattttttgtagagatggggtcttgccatgttgcccagggttgtctcaaactcctggcctcaagcaatcctcccgcctcaccctcccaaagtgctgggattataggtgtgagccaccgtgcccggactggataaataattagacctcttagttcctcattttcctcatctgtcacatgggataattatggtgcccacgcccaggcatgtcatgaggatgaatggagttaatgtttataaagagtttagggcaggacctggatgtgaagttcattcacaytgggccatcttttcctccagaaccagaggggtcaggactgacctgggcacatttatggatccaactcaggccactgtgagkgcttctctgtgtccacctgccttggcccagtactcacagggacacccccaaggtcatgtccatgttctcgttcacctccggcctctgtcttgctgtgtgaccttagacaagtgcaccccctccttgagcctccagcccctcctccagtcagcaggcaccctgacctcggtcctgtccgcctccaagcacaaaacatgcttgggccaggggacttggtgagcagtctgccccacagggctcagagccgagccagcaggggcagctgttgactgtcacagctgtgcgtctctcgcctctcctcacttgcaggatgagatggagctgggctacgttcaggcgccgcacaagaccctcccggtggtctttgactcyccaaggaatggggaactgcaggatttcccttacaaaagaatcctggtgagtggtcccgrccgcagcccacccctgagagctgagaggccttaccccaggggccacaccggggtgtggggtacagagggcagcagtgggaaccgtgctctttagggatgagggtagggttgccagataaaatgcagggatgcccagtcaaatgtgaatttcagacaagcaacaggttaactttttggtgtaagtacgtcccaaatattgcatgggatatacttacactaaaaaagttgtcgtttatctaaaattcaaagttaattgggcatcctgtatttttatttactgaatctggcagccctaaataggggaggcaggatggtgcacctgttcagagcacaagctttagggtcagaccaaccctgttcygttacttacatgctgtgtgatgttgcgtgagttactaccgytctctgagcctcagtttcctcatcagtaaaaatgacattttggccctggcctcacaggggtttgtgaagcatctcatcmtcacagtacctgcatggagggagtgtgtgtgygcgcaccactattagctagtatcattattttaagaaaaaggataacagggaaggtgatgattgctaacgaggacctcttgagaaaacaagagtgacttgcctggtgccgtaaagaacaagagacccctccaaccccctcactgatcacacagatgctaggagctctctctcctgacccttgatgttgtcgaagttgcttctgagagatagccctggggaggtctccccttctctagagttcaaagacagaggcccacatcagcagcctcttggttcccacaattggccacttgagctgctacttgcccttgggctgaacttgcaggaaggctgtgtaggtaaggggrtggagtggccatggcctcaggctccatgtccgatggggagtgcaggagcaaccggagcgccccctgctgtcttgccgtgataaggcagcagggccagagagtccgagcacttcccgactttgcctgctatgcgtgcatgaaatattgactgggtcagatcccccacccaccgccaatgactctgtatttccacctgaagaatggatggcctttcccaccctgtcttgaaggagctcaaagcccagcaagttggttcaggcycttcctggtaccctccacccccgcctgacttggtttccctctccagggtccagattttggttacgtgactcgggaaccacgygacaggtctgtgagtggcctggactcctttgggaacctggaggtcagccctccagtggtggccaatgggaaagagtaccccctggggaggatcctcattggggrcaacctgcctgggtgagagagagacagggaatggagttcctggggtggaggctgagggttgrgggtggtgatgatggtggagcagrggccattgcactccttgaagagagccagaagcaaggaatgatgaaattatactcccggatgtgstggggttggtgggtgttcaccagacacagtccacacttacctcggggactctgaaaccagagagagcagagacctaagagatcattcagtccaacactttcattttacaagtgggcccagagagggtaagtgagtcacatagaaagcaaagttataactagactcaagttttctgattctgaaaataaatagatgatactagtaacagtcaattaatagtaacagaagaagagtgggcatggtggttcatgccgtaatcccagcactttgggaggccaaggcaggcggatcatgagatcaggagatcgagaccatcctggctaacatggtgaaactccgtctctactaaaaaaaaaaaaaaaattagccaggcgtggtggcaggcgcctgtagtcccagctactcaggaggctgaggcaggagaatggcatgaacccaggaggtggagcttgcagtgagctgagatcatgccactgcactccagcctgggcgacagagcgagactccgtctcaaaaaaaaaaaaaaaaaaaaaaagtaacaaagaaaaagtttccattcccaacagtcctgggagaaaatgcatttaggtcaaagcttgttcatactaccatgtaaatgactaatataagatcttttcctgagagcaagagaagtgaggtacaagacwtgctaagtgaaatgacaataacatacagagagagtaacaaatgatgtgttgttcagtagtgacacaggggtgctgatggaaaaggaatcctatcatattggttrcttgctgtggactagaccaagacattgagctaaccaaatgcaacaaagctgttagaacagacttgggatcaaataatgaatgaatccagagtcaagctttggaagggactactgccctcaaatacataatcccattgaaagaggaagctggaccatgcccttagatacattttcstaaaaattgaacatgggggwgaaatctgtctcttggagaataagaacctggtgtgagggtggttctgaagattttcctggatggtgggacctggtaggtcattgccctggtgtgactgacctgtcctgagtctgcctcatgcagaactcaccctaagtggaattttaaaatatacgtatctggctgggtgcagtggctcatccctgtaatcccagcactttgtgaggctgaggcgggcagwtcacttgaggtcaggagttcgagaccagcctggccaacatggtgaaaccccatctctagtaaaaatacagaaaaattagcctggcctggtggtgcacgcctgtaatcccagttgcttgggaggctgaggcaggagaatcccttgaacctgggaggcggaagttgcaatgaggcgagatcacgccactgcactccagcctgagtgacagagtgagattccatctcaaaaataaataaataaataaaatgaaatatacatatttattactttcctgtttataaaagtaatgcatgtttttttgttttttaaaaatcagatattgcaggaatgctaaactcttgtcattttatttctgcatggagtctttttagttaagcaactttttttttaacctcgtgggtcccaggtcaagtggccgcagggtcacccaggtggtgcgggacttcctccatgcccagaaggtgcagccccccgtggagctctttgtggactggttggccgtgggccatgtggatgagtttctgagctttgtccctgcccccgatgggaaggtaagaacttcgtgcatgacgtgtctttccctggcatctggggcaagaactgagctccagggcgccatgccaaggcaggaggctcagctgaatctgttctctgcaygcagggcttccggatgctcctggccagccctggggcctgcttcaagctcttccaggaaaagcagaagtgtggccaygggagggccctcctgttccagggggttgttggtgggtaacagtgccgtgtccctccttgcggcttgcctgccccttacccaaattaagacacatcrtggcttgagagggggarggcaagttttaaagcaggkgtgtgtccccaaattcagggcttctcactcctgcccctgcacaccttgcttcaccagacaccactgcccacagctggggccgagctgaggtgggaagcggggtgatagaaggtggacatggactgagcggggacatagtggcttcccaggcaggtgaccagtgcagtcacggcgtggagctttaatgttctgcagtcactatcctgaaatctcccttttttttttttcctttttgagacggagtttcactcttgttgcccaggctggagtgcaatggcgtgatctccactcaccgcaacctccgcctcccragttcaagcgattctcctgcctcagcctcctgagtagctgggattacaggcatgcgccaccacgccyggctaattttgtgtttttagtagagacgggggtttctccatgttggtcaggctggtctcgaactcctgacctcaggtgatcagcccgcctcggcctctcaaagtgctgggattacaggcgtgagccaccacacctggctgccctgaaatcttaattctgttttgtgaggtctgatggatcagtggagcatctacggggcttggagcctctgctcaggcacagtcctgtctcccagcctccctgcctccctggcacagattctctgctgcctacttctgtgctccctggagcctcagtgcaaggcctcccccatctctgtcactgtcctgagatgctgcagcactctgcccccagcaggagcctgggcatggggagggctggggttgggcacatgtgccactcagcatcttcatggcatcagtcgtccctgccctgcaagggcatttggtgggcaacttgggaggggtaagtgtctcacccaggcttgctcaggtacccagcacatacccagaggccacaatactctggaggtcgcccatttgccttggcttggggtggcagtcctgtgggaatgagagatgccaaactggacctgccagccccgttccagggcacagcatgtgggtctcatagcagaggcatgcccaagcacagccccctgggagctaggcctccgctgtgaggcccacagggtgggccctgacaccagcaagggactgtccagccccatgcaagtccccggcaaagcgcaatgtgaaatagcaaataaaaaccaccctgacaagtcaggagagagactcggggacaaagaaacaactttatactgtagcacttttaatggtactcttttstctgctctttaaacaaggagctggcattttcttttcttcttttttgagacagggtctaycagccaggctggagtgcagtgacatgatctcagctcactgcagcctcgacctcccagacttaagcgagtctcccaccgcagccttgcgagtagctaggaccacaggcatgcaccaccacgcctggctaattttttgtattttttgtagagatggagtctcaccrtgttgcccaggctggtcttgaactcctgagctcaagtgatctgtctgtcttggcctcccaaagtatgggattacaggtgtgaactactgtgtctggccagggcccacttttttttgttttgttttttgttttgcactggaagaattttgagagagagagagctggctggactggagtcatctggcaagcttgctggaagcgttctcaaattcactccctttccagccccactgagactgcatgaatcccagaggatcctccctttctcagtgaccccagaggtcccagggcaaagaccctttgacacgcaggatcatagattttcttggtcccatggcctcagggaaggcagatagcatcctagaccaaacacagctcagagagaaaaaaagctcctgtagaacttagacgcccccaagtataataatttccaaagtccccttgctctctgtttgctagcgttaacttcttccaacacaaccctggagccttagcaataaaatggaagagaaatagtctttcttgaccctgttgctcccaaacgcaccctaactagactccggtgaacctagagtaagtcttagaaatccttaaatccaaattatgtaccaggcagggagaartgccaccttcatctttcctgggagaacttatggtgagcaagacccaggaatgggttgagcagagttattccaacctgcccagctgggagggagcgtgggagaattcacagatggcaggccacaagcagccaccccaccctcgagggctgacactcaggcagtgactgtggcgattaattacatagacacagaggccagacacagaggccagagcactgattagacamctcagtgcgccaggcctmacgctgtgtgcatcacacgtgttatctcatttgatctcacgagagatcaaatgggatgactctcacccacctttattcccaagaatgtgaggctcagagaggggatgtcactggcccagaggcctcagcaagattgcagtggagctgggactggaccccagcttcctgccttaaactggggtgaagcgggcgttagacctgcagatgggtcaggggagccctctcctttcccttggtcaaggcttgaggccctgtgcgagccctgggcttgggtttgaatcacaagcccccacatatcctacctgtgtgacctttggcaagtcttctgacctctctgagcctcagttttctcatctgtaaagtggggatcataatgcataccttgtgggggtcaccgtgagggttaaatgagatgctgaacctgggcactcccctcggggcctgctcatggtaagcgcttactaagtagcagccatgaggattgtgtgccattgactctagcctccgcttccctgtccagtctcatctgcatgggcacaccatcaggctgagaaaatctggacccctgggaggtccccatttcacgcagtcaccccctgaagggcaggattggggctggatggtgtctgaatcccaggactggctggttcgctgctcagtgaacctataaaacctgactgatggtgggtgggtgggcagcaactgacccagctccccgctaagccaaagcaagaggattcctcatccagtgccctcgggcagttgtamatttccagtgamaggcgttaccacttccagtgaactcaaataaaggtctcagttcattccactgtggcaaccagaccctcccactccttataccccaagatgtgcacagtggccaaggcaagctcagacaggtggaacccacccaaggcctgggaaagtcagaggctgctgactcggcaagaccattagctgtgaacttggctcctgcctgtctgcttccctaagcaggtggtcctcacgttggtgctgtccctgtccttctctttcatctctctccttcacagatgatgagcaggtcaagaccatctccatcaaccaggtgctctccaataaagacctcatcaactacaataagtttgtgcaggtacaagggctgtggtgtacctgtgggctgtgatttgggagtaggcggggctggaggcaaggatgggatacagacatctgaggctaactgttcatgaaagctcaggttagaacaggcccagacagaggggtcccaacaccctcyyttgacccagaagaagtgaggggagcracaggatgccttggtgcccccaaaacacactggcaaggtgtccccaactctggccctcccctgcccccagagctgcatcgactggaaccgtgaggtgctgaagcgggagctgggcctggcagagtgtgacatcattgacatcccacagctcttcaagaccgagaggaaaaaagcaacgrccttcttccctgacttggtgagggcactacccatgactcctttgccaaatcaggctgcaaacctctaagctcgagagaggaaaaatgtctggtcacagtcatatttaggattgtggtggccagtgggggtggcagggagaatcaggggtcctatggtgctcctcagaagggcttctagctggctgaccaccatggtccctgtggaatgcttgctggccaagccctgscccaaggggcatcagggaaggggtccacttgacatttgtggagtgaatgaatgattgcatgaggtcacgtgtgcaaagcacatggcatcagctgggaacccagatgctcattctgctctcttcctcccagcttgtggctcttcatccatcccacrtgtatttagggtgtcctgtggcagatgcagagatgattaagaatgccccctgctctcaagggactttcagtctaatcggttgagagggaaactcttcccttctctgaggacatgtcccagtgatctattttgtaggataaggcgatgtggcagtttggaggtgagacaaagcacttccagcctaagaggtagaactggagatccaggaagtcttcatggaagaagtggcttttgactgagccttgagggctttgcctctgatgcttgtaaatctttttttctttttttcttttttttttttttgagacggagtctcactctgttgcccaggctggagggcagtggcacaatctcactcactgcaacctcagcctccagggttcaagcgattctcctgcctcagcctcctgagtagctgggattgtgggattgcaggcgtgcaccaccacgcccggctaatttctgtatttttagtagagatggagttttgccatgttggccaggctggtcttgagctcctgacctccggtgatccaccagcctcggcctcccaaagtgctgggattacaggcggaagccaccgtgcttggcctgcttctaaatcttgagcttgcctttgaaacacctggacaggtggggccccaccccagcggtcctgattcagcaggtctaaagcacggcccgaggcactgctgccgcgctaacaaacacccaggtggtgctgatgctgccttttagaggaacacagtttgagtagcactgctataggtcacccagctcccctctccactcctccccacctcatcccctaaaagaactcaatttgcccattgtcagagccttgtggggaacctgtccacaccaccattgcttcatgccccgctttttcsttcctcttttcaggcaacattttgccctccgcttgcaaagcctcttttcactccccttccttcctgttcgaggctatcttgtaattatatatgtgccccaagaagtttgtgcaatgattcaggttcttgtgttcrcaagagacagagtcctactgaagccagcttcagccagagggagtcttaatataaggacaccagaaacctgagggcaggatagctgcagcagagcctggaaccctctctgtttctgtgtctacatcattcattctctctctttctctcaccctctccacctcctacttcttctccctcttcttccagcttggcttcctttgcttctctgttcctggggacaaagatgagtatggccatgcacagagacactgacacgggcagagaccaactagacgctcccattgtcagtttcaaattcctgggagagggactctgattggtccatcttggaccagctgttctccctggcccaatcagttatggcctagaaggttgggattctgcagcacaaacatggcagctgccacaatccacaattccaaattcacattagggcagtttccagagcacgttgccagagtgagttctgcggatgctcccaaaggcacctggctaaccggttcttcccagcccctttagccagttaccttctcattgcacaggaaagggtgagtagctattgacaaggctgtctaaaacacaaacctaggtcctgcaggtagagtagaggtgtggkgtgggagcccagtgatgaagtgctgcttcccctttggactgcaggtgaacatgctggtgctggggaagcacctgggcatccccaagccctttgggcccatcatcaatggctgctgctgcctggaggagaaggtgcrgtccctgctggagcckctgggcctccactgcaccttcattgatgacttcactccataccacatgctgcatggggaggtgcactgtggcaccaatgtgtgcagaaagcccttctctttcaagtggtggmacatggtgccctgagacagctcccacccaccatcctgtccccctggggcgggcattggcccaggtggtggagacagagacaggcccctgaacgataagcaccaagagaccccaaggctccagatggaacactgagggtgaccgtccctctcagaagccttttccctggaagtgtccatgcctcacctgcaacccatgtggttctcagacttgaatcttctcggccccccaaaaagaaggacctcatttcttatagcctctcctgtgattcaacacaacccatggagatgtccccttctcactctgaaatcatccatttggggacaaatccacattggggtctagaaacatccacgtatctcatcagccatcttgtcctgtgcatcctaacagaggaaggatccatgattctgctttggtccaattgcttcctctctgcagaggaacaaccctaaaaccagaccactccacgcaggacaggcaggagagattcttcctaaagcctcccccataaaaagggagctgtggatccacttagatcagggcggaaccatctttcacccggccaagctcctgcccagatgttgaccctcacccagcgtgagctgtcacatagtaggagcttctagatgcatgtggaagcaatgagagttgtcccttagccttataaactccccatgatctgacatgcagaaatccagccttgtccagaatcctcctggaatttcttggagacgaaagtatctgggggattgttgggtactagggagactgggtacaagggtgaaaagtagttcccataatacacatggttgactatggtgatccaccttgtgatggttaatattaggtgtctggagaaggttgcttcattggccctgggacttctctctgcaggaggagagamcgctgcctctcctctggattggtctcaggctctctgttggcctttggtcagcgtttccacatcctgctctgctgcaggagagggggctaaggggctggatccaccaaggcagctcacagcgggaaaactctgggamtgaaccactgaattcaggggatgggggtgggggggcggttctcgaggtgtgtgccagctacacgtgtgttctgtatgggtccagctgcgtttccatcactcgctaataaatcaacagaaacacaaatggcttggctctcatgttgacccttctttgagcttagaatgagacagcaaagagagaggactttcttgcagctgaagcatttgctttcttgacccccaagaatttggggctgacatcccaaattttgataagactgagattgccttgtcttggccagaggatgggttaggactgccatggacacctgtaatgatatggacacataaaagcaagcctgggggtaaaatgccaggctaccaggacaagtgagcatggcaaggctaggggccgggctgtggctggaggttgcactgtggaaggatgggcaatggggagcatgtggaggccttttgtgtgtccttagcagcatcctccttccgcctgcaagaggctgcgggaagccttacttcagagcactcgggcactgtccctctgccctccaccctcccaacccctttattttccctcaaggcgcaaaacacagaaacacactcaagctcaccccgggctgggtggctagagctgtgtaggtttctccagtgctgcctccttgccgtggcttacttaggttctctgaacagattcccggtgtcccctcacatacccatattttgacaaaataagctccctccctcatttctcccagcaggggaagctgagacagatgaagacgctgagaacatcctattttctgaaagggtttggggagggaaatgtgactctctagaaggcaagtgcctaaaattcggagaacagggatgagtttccaacaggcttttctcacccccaagactggccacagggctctgggcagacccagcataaagccctggaaacagattgcctctcaaagttgctccctgtgctctaggttggtgtgggtggggcaactgagcagtgaaaaaccyaaccccaaggcggacgagaagcaaaacacagttgaacacggcatccacctgtccacacagcaaaggacagggtcagtgcattactttttgaaggctactataacaaattaccataaacgaagtggcttaaaacaacacaaatgtattatcttatggttctggaggtcagaagtctgacatggtgtcatgctggacctctactgacttcagtagtagctgggcatggtggtacaggcctgtagtcctagctatttgggaggctgaggcaggaaaattgcttgagactaggagtttgaggttacagtgagcaaagatcacaccactgcactccaacctgggtgacagagtgagaccctgtctcaaaaaaaaggatagggatggcaccatgtttgagagaccaaagaagagaccaggagccagtgaccgagacataaggtttattgaggggactcatatacggggcagtgcagtggtggtgggctggacaggggaaccacctctgctcgtaaaaagcatgcagttrgccaggtgcagtggctcacgcctgtaatgccagcactttgggaggccaaggcgggtggatcacaaggtcaggaattcgacaccagcctggccaagatggtgaaaccccgtctctactaaaaatacaaaaattatccaggcgcagtgacgggcacctgtaatcccagctacccgggaggctgaggcaggagaattgcttgaacccgggaggcagatgttgcagtgagccaagatgatgccactgcactccagcctgggcaacagagcaagactccgtctcaaaaaaaaaaaaaaaaaaaaagcatgcagtttatatagcattttgacttagcactctcaccctaataacctcctyctggcaatcttcatttcacccataacaaagggcctcaatcccctgtacagcctgcattctacgagataagtggtgggtcccaatgttcctcatagataagaaatgaatctccgggttggcactttccatagctgggaatcccaaatgcacattcatcagagactgtaaggtcattctcagggtatgctccagtttagctattgctggcggtgcgtctgccacacacatgggtctcactgagctaaagtcaacatcttggaagggctggttccttctgggctctagggaagaatcctttttcttgcctttgccagctcctagaggctgcctacaccccttggcttctgggcttttcctccatcttcaaggccagcagcatagtaacatttttgtatcttcctctgatggattcttctgcttccttcttccacttgtaaggacccttgcgatgacactgggctcatctggataagcaaggctcacccaccctctctaggtcagctgatgagtgaacttcattcaatctgcaaccttcattcccttttactaagaaggtcatatactcacgagttccgcagactcgaacgtggaaatctttggaggaccatttttctgctgactacaagcaaccaggccctgactgccgtttctggcctccaagagtgagaccatacccggtcccctctgaaatccacagaggcagcagcagaaagatgcagtcaatgaaccctcactctgggactggtgttcagttctggaccctccgctgggctgagatctgggatcccatggatgcaggctgggtggctccaaaaagcactggaagctgcctccatcaggcctggggtcaggggtcacctccgctggccactgccttcccagacagctgcccatgccacactgcctggtcccttccggggcctggctctcaggcctggaaagcccagggagactaggatgaggcttgggttctcgtagggaaatttcccttcaccctattgtggttcccctaacacagtgggcaaccttgaccaggcctgaggataagggaagatacccaaccgactcacctactcccagctggctgcctgaaacccctcggagttggaccatcagatgctgaactcgtactctctagctgagcacataacttgggtgagcctcagtttccccctccataaaatgggcaaaataactgccgcttcatagagcttgcatggggatgaagtagggtaactcacaagttatacttagtgtcaatagcacagtgcatggtgcatagtaagtgctcagtaaatgatgactgctgttacatagcatcccccagcccttcctcaagcatctgctgtgtagaacactcctaatctccgcgctttaatagatgacaaagaccctttgagacccagaggtgaratgagggaggtagggacaggacagctgtcttggctactctcagatcataccctgcttgtctcagctgtgtaggactggcccaggtggaggctcctgcctggacaagaagctgacaagaaagcctgtcttttttgtggggatttgcagctctgggtggccctgactcatgctttattcagaatttggaataagtagctgcagggcttccgcaggcattgcccaactctgtggcctcctgcggcttccagcagcccaggaaggagggccctgggtgaggatggctggaaaggaattctggatggctggacagagtccatgggacctatcacttcctacaaagtcactgtcatcccaagtcccctccagcataatgacggcaagtgcaagcattgtgccagcaggtactgaatgcttcctgagcaccatctgatatagccctcacagcatgccagcaggcagctattactattgttctcactttatagacagggaaactgaggcacagccacatgaaagcgcttgccctggtcacagagctattaagtgggggaaacaaatttgagcctagacacgtgacctctgtacccagtcacaccagtggttctcaacccatctacacattagaatcacctggaaggctctcatgaaaacctagcagggccaggcccccaccatcagagattctgtctggacattgggatgttacacaaagcaactcggtgactcaggtgtgtagccaggacacagcaacactttggaaggccaggcgggcagaccacctgaggtcaggagttcaagaccagcctggccaacatgctgaaaccccgtctttactaaaaatacaaaaatttggctgggcgtggtggctcacgcctgtaatcccagcactttgggaggccgaggtgggcggatcacgagatcaggagatcaacaccatcctggctaacatggtgaaaccccatctctactaaaaatacaaaaaattagctgggcgtggttgcacgtgcctgtggtcccagctactctggaggctgaggcaggagaattgcttgaacctgggaggcagaggttgcagtgagctgagatcgtgccactgcactccagcctggtgatgaagcgagattccgtctcaaaaaaaaaaattagctgggtgtggtggctcgcacctgtaatcccagctagttgggagactgaagcaggagaatctcttgaaccagggaggcagaggttgcagtgagccgagatcgcaccactgtactccagcttgggtgagacagagcaagattccatctcaaaataataataataaagaaagctctgcatggggaaaagcttagcatgaaattttggggtgagggatgggagcagggagacaagtcagaaggtggcagctagttcagccgaagagaagccaccacattcaattcactctttgtggggaaaccggaagggacgggcttactggacaggacgtggggaacagggaaaaggcagggacaagagtccctcccagagtttgagatttatttactcattgatttattatgaagtaaatcattaatacaagacaagttttttataatgtttctgaatgactaaaagaataattatggaatgaaaacctgtatactctggctgggcgtggtggctcacacctgtaatcccagcactttgggaggccaaggcgggtggatcacaaggtcaggagatcgagatcatcctggctaacgcggtgaaatcccatttctactaaaaacacaaaaaattagtcgggcgtggtggctcatgcctgtagtcccagctactcaggaggctgaggcagaatggtgtgaacccaggaggcggagcttgcagcgagctgagatcgcgccactgcactccagcctgggtgacagagtgagactccatctcaaaaaagaaaaagaaaaagaaaacgtgtgtactcagcatcttctctttaagaaagggaacattccaaactcctctgcaaccctatgggggacacttcccactccccccatacccaggattcgcgctcatctgaaatttgcgtttatcattccttcgctcctctttataatttccccatgtgagtatccctgaactgcatactgtttagttttgcctgttagaaattttttcacagggccatgttaatggtggtgttctgtgactctcttctttcattcagcaccgtattggtgagtttcattcacgttgtatgtcaccataattcattccttcttattgctacaaagcattccattttatgaatggaatttattatattattattttgagacaaggtctgggtctgtcacctaggctggagtgcagtggcacgatctcaactcactacaacctccgcctcctgagcttaagtcatccccctacctcagcttcccgagtagctgggattagaggcgtgcaccaccacacatgactaatttttgtattttttgtggagatggggtttcactatgttgcccaagctggtctcgaactcctgagctcaagcaatccacctgccttggcctcccaaagtgctgggattacaggtgtgagccactgcctggccagatgaatggaatttattatatacaatttattcatactcttttgtcaacagacacttgggtcgtttccattttttttttttttttttttttttttggctgtaacagtcaatgctgctgtcaacattcttagggatgttcctggtgtgcacattcacaagtctctctagaatatatatctagatgctttctggcttcatgaacaaggagaatggtggtgccatggagaaaaaaggcaaaggatc

SEQ ID NO: 12347 - DNA, 83743 bp, Homo sapiens
gaacctgaggccagactggggatggggagacaatatacaatcaagggtatagatgtaggagctagacagtttgcattcaaatctctactccatcacttgctggttacacgaccttaggtaagtcccttcatctccctgagtctcagcgtcttcatctgtgaaactggatgtgctatccagcttccaagatggcctccaaagagtgtcattccctggtatttatagccttggtcaatctcctcccacattgtcccagggttgttctgtgtgacccatagaatatagcagaattgatgttagtatctttggaggtgaggttatgagagatgctgtgggttctgttttaggttctctctctctctctggccattcactgtgggggaagtcagttccatgccctgagtccattcaggcagcttgtgaagaggcccacatggccaatagccagtgaggaactgaggcctgcagtgaccacttggatgagcttggaagcacgtcctccagccccagtcaagtcttgaggtgagaccacagtcctggccaacaggtgactacaacatcacgggaaacccaaagccattcagctaagccactctcagattgctgatccccagaagctgcatgagataataaatgtttgttgttttaagctgctaagttttggagtaattgactacacagtaatggataaataacatgtggggataactatcttgtaggtttgttgtgaggattaaattcacgtaagcactttgtatagtacacgatgtatgttgaaggctgtgtgaaatgtaagaaaacaatggcagcatagaaaatatcgtcgatgaaccccagggtcatgtagccagggtgtgacagggctgatgatgctgcagttcctagctgcccggttttaaccatttgtgccccctaatccttattgattgtggtgggcaccacaggctttgccagaaatggaacaacagtgtcagagggtggggagcagaagaggaagtgatggtgccagtcagtgggcccctggggtggggagcagccccagggtactgggggtggaagactgaggcacaggactggagtgagtgtgtgtgtgtgtgcgtgtgtgtgtgtgtgtgtgtataggtcacctctggagacccttccagcccaagactggctgatgatctgatttgctgcttgtttctggccctggtctgtgtggaagactcagaaaaaccatggcaaccacgggataattaatgatcagggatggaggaggccaggaacctggtgtccccgaggccacgtggagagcagcttgggaggaaggtccactgggctttctctccgtgaccatgtgggcttccttggaagagagatatcagagagggtccaggtgggagataagcccctgggcctgtagccctaacagtccaggaagcacaggcctctctgggcccagtagatggttcctttggggtcgttggctcccaggccctggactgctgaaattaatgcattgttttcaggaggccgtccatggcttccaccaggttctcagatgggtctgggacccaaaccatggagactgtctagatattacccattgtaaagacatggaaatggaggcacagagaggttaagagacctgtccaggccatacagcaggctgtggcaaagtcaggcctggaatccaggcctccttgctgaacactctcccagggtaggacccacagtgggtggaccagaatgtgctgtgcatgtgggcccccctggctggcagaactcccgtcaggacagctgggtcactcctgccccctccctgggccagatgggcagccctctcctctgctattttctccacctttgccttttcacagggagtgactggggtggaaaattctaggggagcacaaagtctgccaagtttaaacctggcaccaacccaggcacctggctgccaggcacttggaaatagaactggtaaaggggtccctgggggactgggctgctgggagcagcttggcaactgcctctcctggctccttccagaccttctatcccaggaatattccctcctcgctagaacctgctgccatgtgccaggaacatctggaagagagttttctggcaggtctgggggtacagaaatgggttacagggggcttggtcatgtattatatcacaaacatctaccgtgataagcgaaccagtgtgcgtctgcagcgcctgctgcaagggactgagcgaggcccccgcacatccttcatttccctttgaatcactcctgtgatatggggttccccattttacagatgaagaaactgaggcttgggaactccagaggactgcccaagttcacctagcttttcagtggcagtgctgagacttgaatccaatctgtgtgactccaaagcctgcctttttccatggtctctccctgtgccctctacacccaccatgtccaggtaccagtctagatgctagggatatagagataaacgagccatgagccttgcccttaaagcacctgtagtttagtgagtgtattagctattgctgctatgctaatgccccataacaagcagcccccagctcccacatctcagttgcttgcaaccacaagcagttatccttcttgttcccagctggctgggtcggctggggtggttctgcttcaggctgcaggttggccaggttggcttcacctgtctctcattctccttgcaccagtgaaaaagaaaaatactcaggtcctgttttcatgactgggaaggaacacacaatgtctcctaagggttcatcttagaactggggtactgtcatgctgcccacatatggagacaggttacacgggcaaggcctacatcatcagtgtggtggggaaatacactttgcctcctctgatgtgaggcactgcaaaatcacatagcaaaagcaaggatgcctaattctctaacagggaggcaggaagaataggtcacaataatccaatcacccacagtgtggacgagagacttatgataataatattgtactgcattctatcaaacctaagctgcaagacacaccattaatttatgtaccactaagaaagaaaagtggctgtgaacgaaagtatggcatgatgctttcttagcccatcatatttttattttattcttactgaaagagctatttgatgctgaggcatggaagtgtcaacaatgggaacagttggaaccaggtttgctcttgcagagacaatgacgactgtcacaactgtcactgtccaaggagattatgagatgccatcgattgtaaaacacattttgacttcaaggatgtgaaaatgtgaaaatgtgtgtcttagaacggatgaaatttgtcatttactgagagtaagtggttgttctagggtggacattgtggctaaaatttctatgtggacaggctcatttgtacctcaagacaacccaagaggaaaatattattatccccatttcaaagatgagtagggcaagattcagagtgatcatgaggtgggaggcaggacttgactcctgatgtggggcttggacaccggaccaaatggcggactagctaaaatagagggggcaaagcagctttctataagacacatccaccagtaggccatgtcagtttaccattgccatggcaacatgcaggagttaccacccctttccatggcaatgacctgacaacccaaaagttaccaccctttccctagcaattgctgtataaaccactgcttaatctccatgtaattaaacatgggtataaatacgactgtgaggctgccctgagctgctgttctgcctatggggtagccctgctctgcaggagcagtcaaagactggagctttatcactggcccttcaataaagctctgctttcttctacactttcttctcgcccttgaatttttgcctggaggaagccaagaaccctcatgggctaagctctgttttggggcctgcctgccctgcatcagtcagttgtcctgcccaagactcatggttagtaagtggaagagctgagatttgcacctaggatggtctgacttccaagacaaagtgataaagagtgtgggccctaggacaaactatacttcagtttcttcatctgtaaaatggggatgataggagtaactaccgcatagattattgtcctatgagagtttgaaaagagtgtcaggcacagagcactcaagacatgctgggttctctggtagaagcagagatttttgcctctctgaagctaacattagtgtaataaaagctgcaaccggactaagaggagaggactatgggagcccagaaaagcaggccaatagcttagtaatttgggggaaccatcagaaatttgctgtgagggagcaaaaagaatgtgtgattcatgtgtgcacttatttattcaacaatatttgtttacccactgtattagtctgttctcatgctgctaataaagacatactcaaatctgggtaatttataaaggaaagaggtttaatggattcacagttccacttggctggggaggcctcacaatcaaggtggaaggcaaaggaggggcaaagtcacgtcttacgtggcggcaggcaaaaagcttgtgcaggggaactcccgtttataaaaccatcagatctcgtaagacttattcactatcatgagaacagtatggggcaaacagcccccatgattcaatgatctccacctggccccacccttgacacgtggggattattaaaatacaaggtgagatttgggtgaggacacaaagccaaaccatatcacccactgtgtacaggtagtacacagtgactggatttgaaaccaagtttgggggctaatttttaaaaattgaggtataatttatctacaatgcaacacacagatcttagtgttcagtatgatgaatttttacaaatgtatacagcaccccaattgcaatagagagtatttccattgccctagaaaattccattgtgccctcttccagctaaatacacccatctccacctgtttttttttttttaatttctgtcactgtaggttgctttgcctgttcttgaacttctgtgaacaaatgtgaacctgaaagggccagaccttcaagatggatcctgagtggctaagtgggctaggctccgctgttcttgcttgtaatcccatcactttggtaggccagggtgggcggatcacttgagcccctgagtttacgaccagactgggcaacataccaagaccctgttctctacaaaataaataaatactacccccccccccaaataagaatgggtaagtgggcctaaatttaaaatagaatgaagcagccacttgctgactatggttacacaactaccctgacttccccagaaaacctgcacctttttatctttggtactttctcagctcacctgaaccaaccaatcagggctcaagtgtataaaccaatcagggtttggctgtatcaaccaatgagagctcagctatattgaccaatcagaactaagcaagtttcaatccttcatttgcacatcttgatctgattgggaacctgggcaggaacttttgcgcaaaacttgatgcttccctcattcttgggaactccccttcattttccagtggagggtgcatctccaagtttgcaaactgttttctgtactaaagtctctttcctctaaatttcttttcagagaattttgtgcataatgtaaatggaaacttacagattgtgctgctttgcgtctggtttcttttactcagcataatacgtatatgattaatgcatttgttttatgtatcagtagttattttctttttcactgctgatatttcattgttgctggttgtcaaattattgcctctccgctccacattcacccttcttgcctgcttggtaaaaatggatctgggccctttaaattttctccctggccagcaggcatgctgggctttgccagtagagggcgctggggagccccagcagcggggaggttccgcttcctgcttgccacgtgctcacagagtaggctgcggcaccacgtgcagccgctctcgtgcaggcgtttgcagtgtgcagctgagttcggcagctcacacagcacccctttcaagttgttttgcagtgggtgcctcttgtgagacactgtttctgagagcagcttttgtggcatcttacagggcagatttctggtacgttctaaaagttgaatttctaactttggctggttgtggcccctgactgtttttttttttttttttgtccttcctgtggcacagccatgccctcttaagcaaggcctggctgtcagcccccaagggtttgtgtgtggggcacttctttgtggggttggggagtgacaggctctacctcagaccaagggcttttccttagggacttgatttcagcttttggaggagactcttccatagcggctgtacctcagccacatgtgtgggactgggggcccttccttgggggcccaagcttagccccttgtgggggcaccgcctggagggggttatctcagcctggtggagggtcccttccctggggtgaggggctctttctggaggtctctatctcagcctgatatgggggtctctttttggggctctatttcagtcctggggtggggggctgttccttgggggctccacgtcagccctgggagggctctttttttgaggacgtttactctgtcacaggtggcaggagggtgtctcttcgggactctaccgcagccctcaggggctttttctttgtggactttatttcagccytcggaggggactcttccttgggggatcaatcacagccctgggtagggggccccttccttggtagctctgggagctcttctttggggctctatcttatcccttgaataggggctcttcccagggggcctcagccctgggggcctcttcttgggaacttttttttaaacctctagtgggggacttatctttggggawcctatgaaagcccccaggggctctttcttggggactctaccttggccttgaggggttcttccttgagagctttgtccagctctggtttgggggattcttagcggggggttgtttatcacagctctggatggggtctggtcttcagagactccatctcagctctgtgggttgtggttgctccttgcgtctgctgtttctgtattaattatcgttctctttactccttatcagtcaatttcttgttaattcagttctctattataagttaataattcttcatatgaaactttccctgtaaaaatcactgtatggtgtcctttccttgactggacccaaactgatacagaattggtgtcaggaataggtatcaggagatggaaccacagaggtaccattttgggagtggttttctggtgattttgggcttgggtgtagtgtcaagttccttgccaatgggaaatggggtgctagttacccaaggcatgtggtgacattatatgagtctatcatttgcggttaagacaaaatgccacctgaggcacgtctgttgggagccagagtgatgctgcacttgactgtgtggccataatgaggactgtgagaactgtggggtgggatggatccttttgagggctcctgtcttcaaggaaccagatactatgctctatttaaaacatacataggcaggccgggcacaggcatggtggctcaggcctttaatcccaacactttgggaggctgaggcaggcggattgcttgagcccaggggtttgaggctgcagtaagctatgattgcaccgctgcactgtagccaggtgacagagcaagaccctagctctaaaaaataataatataataagaatttgaaaaatgtgtagataatgacatagaaaatgacaagcccaggtccattaactcttccttcgagccacagtctgagaatcagacagcttccatggcagcccttaaggaagttcttatttcttgcagccacaaggctgagactgctgaaaataaaacaaaaaatttaattgtgctggttgctgaattatgacaacagttggaatcacatctggacaaattagggcatgaatcgtgaaagaatggggtcctgaaacatggaatgggggcagttgttggactctgatgaaactgacaatctaaactgcaagtcactctgagcccaccccccccacccccaccccaacttatcaagtggaaatacctttccctccgcagtgctggaggagactgctttttctctgttaagaaaccctgtgataatctcggctggagcagatgctgttctcaagactcatcacagccacctgctgttgtcactagcccctagctgtggtcagatctcagcatgttccacggtggcgggtatacacagacctaggaggaaacagaaaaagaacgacaagactggtgacatgtatgggagtggattctaagggttttagatccaggaaggcagaatgtaacactagcctgggctggaygcattgatacgggcacactcattagaggttctgaatttggctgttagcttctgcagctggaggtggctctaacagcttggttggttgactgaaacttggacttgacagtaacctgcagttaatgagggttgtgatgtcatgatgtggaagagggaatccaaaggcttggggagaccgcaatgttggactgcatgtatcatgtctaatctgcactcccctgctgccaccacctatgttccacaagaaggacccaaagacagagacatagagagatccattagtgagggagcccctttgtccttgaaatgcacagtggctgctctcttttgtaggccactgtgaatatagaggctgcctccattgagatgggctccctgatttcagtggggataagggggtcctggagtagcagataccgaggggcagcacttcactgtcaaggacaaggtgggcacacattggagagggtagcaggaatgtatgggaaggcagaatgcctttgcccacagggatttctagtggtggtgaattgattagagtgtctctgggaatgaaataagtgggcagcctactagagtattatttcatgtatttttatatgtgatagaaagttctaggcccggtagccaaaacctggcaattgatagtcatggcttctcattcagtttccagaccctaagtcaattcacagacccagaatccctgggtggccgggtccccttgaggaaggagcctgcatcattgccataaatacttattgtaaatcttcctccaaaccttcctccaaagggacctgtgaccatttaccaaaataatrgggaaatggacatacccagacagttctggagttacttggcactaactctgaactgatgctgtttcctggggatctaaaatgccactctggctcataagtcaaagtggggcttgtgatggtcagggatagagtcttagctgtagtctgactctcagtagatttgcttggtccatgcccaccccraagttattttctgagctcctgaataaacaattagagtaagcacacttggtaattatccattttcttctctcttcttcccatttttgttttatatgcaagtttttggaagtcgactttatagtctttaggtgacagaatgttccatggaactgtgatcggtatttaagtcctaataaatatagtccatgacgactcctgggcctattagtctccttgttttggggagtgagtgagaacttacaaggatgatagctgcatctttttagatagaaatacrcagttgtgttgttgtacaggacttcagtggtgtgcaggaggattcatatggaagctaagtagtcaaagagatgggcttttctggttatcaattattgcttttctgtgtccaatcacccttcttgcctgcctggtgaaaatggatctgggccctttaaattttctccctgtccaggcagcaagctgggctttgccagtagagggcgccraggagcctctgcagcagggaccttctgcttcctggttgccacgtgctcacagggcctgctcctgcagcacgtgccgctcagtgctggctgctgccgtgctcagcagaggccagcagcaccttattttaggcagttttgtagtgggtgcctctggtgagacacctcctgtgagcagcttttgtggcaccctgcggggcagatttctggtaagttctacaggttggctttcttgcaagttctgctggtgtgcaccagaccaactttttttctcccccaatgtagtgaggcacagccataccctcttcagcaaggcctggatatcagccctcaggggtgtttgtgggaggatgcttgtttctgggtggaggctcctccttgggcactctgtcagctcaggttgaagaactgttctttaggggctctgccataacgctggagtagaagcctcttccttgagggctggatgtcagccctagagaaggtgcgtttgcttgatactctagctcagcactgggtggggtgggggacttttgcttctgagggtctctttcagccctggggggcagcagctgctccttttgtctcctaaacctatattcttcagagttccctttactttctagccagtttcttgttaattccacctcccattatggttaataatcctttatatgaaacttacctattcaaatgactgcgcagcttccccctcctaataggatgcagagtgatgcccattgtgcatactggccacagtttgtccacagttttcctgtggacatttccaatttggggctattatgaataatctgtgatgtgtattcttgagtggatgggcttttttgtgttatgcgttttcatatctcttggataaatacctcgaatgaggttcctttgggaaggccaggccacagggctttcaatttgtctagagggtgctgaggagctgctggaagttttgtgggtctattttaagtaacactgatggattcgatgtgggtcttagaaggagtgaatgggaggggagatgccagtcttcaattccccagatgagggtggcagctcaaactggtgacttggtgtgggactttgctccattgtctttttcctaaactgtgaaatgggtttttcacaggcgtgcataggatcgttggcaggactgagtgggatgaagcatgaggggcacttggcatggggctggcatggagcagatgcacagtggtkgcagccaacaggactgccatttttaggtgtttcaggcaggatgtcctagcttccccctggtgctagccattatgtgttcacagtccaagagcccaggggggtggcaaagggtcttggtgccctgcttagagacaactctggacctagaaggtggggcacagctgcccgttgctgtgcagtgctgggcactttctgatgccttcttgtggcatccctcagaggartgggtggacaaggtggccttgggttctgggcactttgcccagccccctgacaatcacctcagctggcatcttgcctgtccaagccccgagctgctgtgccccagcaagtcaagcggccatgattagtcaaataaaatttccatctgttgaagaatttacgagagttattactggctataaaaccgatctgaggagaaagatggatccgagggggtaagtgcctctaattatgtgcggcagtgacgtttaaataaggtagcacaagtccttattggagggagccaggtccctatccctctctgggcccagaatgtggccagactggtgggggtgggtgcttcactgcagagggaggaaaraggagctaccctatgcaaactcggggacaggggtcattgcggcttaatttttttttttttttttttttggtagagacaaggtcttgctatgttgcccaggctggtctcaaactcctgggctcaagcagccctcccggcctcccaaagtgctgggattacaggtgtgagccactgtgcttggccactgtggcatttagaaagatcttagatgccaaagggcctagcgcagtgcctggcatgcagcagtgacttaataaatgcatgtttctgctttacctgcttccctcctacctccggggactgagctgggccgcttacaggatgcaggaagtggtctccctgggccaggctcttgttggcacagactctgtgtgatccgcccaggtaatcttgctgggtcttcatagcttcgactttaaagtgggacaattaattaccgaaggaacacggggaaggcaggcttttgggtatgtgggcccaaacttgttctgttttttttttgggactgagtctcgctgtttcacctaggctggagtgcagtggtgtgatcttagctcactgtaacctctgcctcttgggttcaagtgattctcctgcctcagcctcccaagtagctgggattacaggcacccaccaccacrcccagctaatttttgtatttttagtagagacggggtttcaccatgttggccaggcttgtctcgaactcccgacctcaggtggtccgccctcctcggcctctcaaagtgctgggattacaggcgtgagctgccgcgsccggccctgttcttaacacatgacttagctctaatgcctccagcatctagggaaggagatcacatcgtgggtttctcctcatctcaggtgggaaggtctcgggggtccatgcgctcacctgaggtcacctggatcccagatgctcctgccttcttggaggaatgtggctttaaaaggccaacccctaaccttcaccttactcaagatactgagaacaagaccacttgggagcaaatgtggcctcctggtagctggggagagccgtgagatggttggtgctggaaattctgcctggagtccggcataactgagttcccgggacccagggtggagacgaataatcccatcccagagagtccgagccttcagatatagggctccggggcctgagactctgaggtcgtgcagcaaattcgtggcaggtccactgactgctaggccaggggtcttgtcgctggtccacgcagaaaggaaggatggctactttctgttcctcccctgaccaccaccccatcaagcacagaccaggccccaccccctgggccatttaaaaccagaggcccaggtgctgtggctacgctttcagaccgagagtcagctgttaaaaggctcacacctgggccgggagccatccgaattcagtcttcctgaggctctggctcacctccaggcaggtaggtctcaccgtgggtccctttctctcggccaggcagcttgagtgtgactgtttggcagtggttgtgcactgtgtctggagcccctggtccccgatatcgaaccccagggggttgggctgcaggtgggagcccaggggctggcgtttgtggtggggctgcaggaaaaaccaagcttctctggtcaggttgtggcctgtgtgggtggtcttctccttggtgccccccgccccccaaggccttgttccccggtgactcctgagctgtgggccccaggtggcagtggaggggctcccacctctggcgctttctgcgtggcctcccggggactcagttttcctctgcgtccatgggggtggtagggctgcctggtggggcccgcgcaataatggaatgagtgtgtgtgagagagggggaccccaggcctctgattcctcgttcgccttttggggccaggctaggagaagcggtggggaagtgcttaccttgccgtggcaagttgatgtctcttggactgagacctttgggccagagtagcctaggtctctgggaattttcatttcatcctgcaatgaaagagcctggcctgcgggtccccagacactgtgggctctgggacagctatggaatttctgtctttggatggcttctatcgtgctgagggattcattctgtctgggtttcacgttgtttaaaaccaggtgggctggggagcgggagtgtgtgggggctgtgttgatgcacccctgtgttggccccgagctggcccaacgctcctctgacctcgctttcagaccgtagagtcaagtgacggggtagcgtgggggtgctttggggtgtggtctttagaaagcctccccggaggtgctggcatccctggttccctcttagtcataatatgtgacctccatggctttcccatctcaaactcggggtggagtgggtccctcaacccttttccccacttctgcgggaccctcggcccctccccgtgtcccctgcctccagcctggaaggaggttmtgacgaattggagggctgcagatccccctgctggctccacagcctttgtaagcagctcattacgtcttccccatcctattcctcattagccgcaggtgctctccatgagagggttgccaggatttctgagttttagtggcacctrgggcaggggaaggcttatggcaaaatgttccttagtcttttctcccccattccctccccctgcagaaaaggatgagcggttgggagccttggggctgacaggttttgtgagtgtgcagtgggggcttccgccctcgggaaacaggggttggccctctggaaacaggggttgcgatggagctccatgctttaccggctgatgactcagcaggtctgagcctcagcttcccatttactaaatgggctaactgggacaatgattgatctagtgccttctatcatgataatcattatttttgataatatgtcccagacaagaatagcaaaggttggaaagcagctctgtgttgagctgagcagggctcgggaaaccccggtgggggtgggggtgggggtgctggtgctttcatggaggcagaagcctctggctggtcccttcccttggtgggcagctatggtccagttcccggctgacagtggggctggccttaggtgtgacgcaaggggtgggtagaggccagggaagctgctctgtatcctgcagtgcacaggccggcccctgctgcagacagtcatcctgcctcaaatgtcaacagtgctcaggttgagacaccctcaagctccatgcctggcacatagttggctctctataaagcttggatgaacaccagtgggcaagccaggggggactggtcataaagtcagcctgaaaactgggggttcacttcyttccagcccaatgtttcttcttattgctctgttaggcatggtcaggaatgctacgaggttctgacaggcagcttccagtcctgggtacccttggaggtggggttggtgatgctgtgacttcagcagcctaagctyctgggcmcccccccacagcatctctcatcctgatgcctattgggttcagcctcgtcctccttgtgtcgcccccacgctgttgatgatcctccagccccacttggcatgcctgatgtggcctgagagcctgggttttaatagctgaatatttctttaaaagaaattccacttgtcttgaggcccgcgttcctccagcgttgcctgcctggctccccgggggagttcacgcagaaactgatgtgttaacaggctgcagtgtctccctttccatctctccatttagcctcccttggagatggcctggtcgctggctctctgtgcccttgcctagtggctcaagatggcacatgacttggggcccccggatctgggtaggggggctgtatagacaccagatgttggaatccacccaggtaaagccaccatgatgcacaagtcccaggtgccaactgtgcagcggttgggggctccagccagagtggagttggaagggatgctgctggaatccagcttgtggggagatggtaccaactggaggtgctggacgcttccttctttgagatgagcaggcagcgatcaccgggtctggggctgtgtggagcaggttggggctggccttcctcctctgggtccctgagtgtggtgggcctgaaggaagagaaacatgtcaacttggctgtccaggccaagtgtactaaagagtaacctccacgtgggcagggatttttatctgccttagttcactgtggtgtcctggtgcctaggagagtgcctggcatggaggccgcactgtcccccactccttgcctccaaaccacctctgcttgagctctacctacagacaggaccctgtgctttttacacattaactcatcagacactcgcaataaccatatggagttggtgtgataacatacccatttgacaggtgaggaaaccgaggcccaggaaagtgaggtaacgtgcccaagcccctctccatggcaggctatgtagcatctcttaggtctcagctcagggttcccctcttaagaggtctgaccagagccctggctccattccacacatgatgtcattgttgctccctcgtagcacgtcacccggctctctataaatgtctgattcactcacttattcacgatctgtctccactccccggaatgtgaggtctctcaggacaatgtctggccccttgcagggcagagctgactggtctgacctgacatctgtgctcttacccaccaggctttcctgcctgcctggtttgatgagctgtgggttcattacatctggcatgggcgccatttcccgggtcctaggatgtgaggcagaggttccctcgagacctctctcaactcccagggagttaaatctcaccccaggttttagagcagccaacttcctgtggcctgccctcctgcagagtaattactgtaattttcccagtgtcaccctcagcctttggatgatattgtgaccaaaatgtgagaagcaatgacaccctgtgacactcccagcccttgtaattgaggctttgaaagcactgctgaygtctccaaaggcatctgggtgctccacggctgtgatggaggtgggacctctgaaccctggctttttgactttggctgctttgcaaatgtagtgactaatagatgtgatgtgttgattcactcccctgtcttcccaaaattgtgttcacatccctgatccaatctggagccttgtagcagcctcgtgaggctgggactggtactttggccctgacttaatcggcagagaacttgtgcattccttgaaattgtacagcgtatgagtggcagagcctggctcaaacccgggtcttctgctcccatgtcacacacactcggtctgggacctcttctgtgcaaatatcccattcaagagggcctcctgattattctaccactatctaaagttggttgcagagtagcaatagcaaaagcaaaagtcacaaccttgggcgctgacagcctgtcaggcaccgtcctaattgacttgccatgtgttaatgcatttattcctccctgaagcccactgtggtgggggctgtgattatccccactttacagatgaggaaactgatgcccagagagggtatatttagcccaggactgggagccataatgtgatggagctgggattggaacccacgtagtcttcagagaccaagctttgaccatactgccatataaatcatctagaaagccataattcctggaacttactgcatttttttctcaggggtgttcatttgttcattcattcytaagctatggttgaatgaatgaatgaatgaatctattatgtactgaccattgttctaggtgctgagsattcagtcctgggcaaaacagacaaagttttgcccccgtgcagttccattctagttgggggagacaagatatgcagatgatgaatgtggtttcaggttgggagaactatggagaacaatgaatggaacgggaacagagagtgatgaagaaggtgactttggccacagtggtcagggacgggggaagcagacacctgagggggaagcgagacgggtgagcatcatgaagaaggggttccaggcagagagcagcgtctgcaaaggccctgcggtgggactgtggaggcctgctctggaaacagtgaggagggcatcaggaggtgaggtcagaacggtaagagtgaggagatgctggggttgcatcggatgataggatccgacttcgctgctggagacagagccgggggatgaggcggaggcaggggggccagtgtgggggccgtccctgtggtacaggggtgagacgatgctggcaacttagcctcagggtgcttctaaagagtctcttcttagatatcgctctcttccctttcctcccggactgacgtctgcacatccttctctcccggctaagaccttccctgctctcctgggggttgagtttggccttgtctaagcccgtggctgggtgcatggctcccgggcactgctcttttgtggctgccttgtccagtggttatttggtgcgcagtaagccctttgctttttgggtattgactgtagatcagtgctcaccatgtttatcctccataggtgctttattattatttttggcatctgcagaaatacctgctttatgtgttgcctgctcagttatgtctcattgttgcctttatttacttatttcacacgagacaatgtccctgcttggcttctcggctcagtctgatgccgtgactgctgacacgggaggaatgacrctgcgttactcaagcaggtggcagtgtggcttttctcgaaagcatgaggccccagcctccctgggtgtgcagaatgggtgctcgtgaatccctctggtgggactgggtgtctgtgggttcagtcctggggggcaggggtgagcatatatgtgatgtggggttttagagaatcagtcagggctccgtgtgtgtaagcaatagaaattgcctctggccaactgcagcagaaaaggaatcatcagaaggaaactcttgtatctgaagttgggccaaaagactggctgggaaaaggtgggaacccagctaactctggttgggaatagggtggcgggcaggtgggggtgggtgggtggtgtttctagcaagatctgctcaaggccctctggggaccccaccaggatgggtggctccagccagcttgagaattttgcaagactggaaatccatgtacccagagagaggggacctaactggtggggatttgaccttgtggcgaggcctggcctggcagtgtgcagggctcatgttcaacagtcctgccaagactgcagtttggggagaggatcactcctggaaaggaattttggggtgctggtgtcagaagaagagaggctgggcacttggctgctacaagtacctcctgtaccctaraagagccacacatgtgagctgtgttttggtcttttaagatgctaaggatggaggatatcatcaaatggaatgttaaagtacaggaccgagttcctctgagccagtgaacgggctgggctcagagtgcagaggggttcccaggtctggggaagttttggacacagtgatccggctgggcctctagggctgggttgcctggaataggaggggcgtttggggaatggagctctgagtcaggctcactgcaggggcgaaggcctggaggctgggtttggtggagktgaggggcagagttgctgactcactgctagggagtggggagtgaggctggagctgcaggctgaagatgtctttggacaccaggctgaggagtgtagtcttgggagggtaattgtgtcaggaagcagagcgggaggagtggtccactgcttcatgacatccctcctatgtgcctgacactatactaatagtgctttgttgtagcctgtttaacctactgatgctgctatttcccttttatacagatgaagagacggggggtcagagaggttaagtgacttggacaaagtcacatagtgagtcagtcgcaaagaaggtcctgcttcttgctacgtcgcccaggcctggccaatattctccactggtctgtgttgcagaatcgccagctgtgaagtcaagcagctgctgatctgtcctgttgagcgccttgattcttttccttcagccttcccttccccagtatccctagagcacattgggcatggctgtgggccggcaggggtggcagagtgtagggagagggtctggggagactttctccttgtcactgcagagctgtttctcttctctccatttcctctgtaaagagctggtacaaagctagcaaaatcagagtcagcagaaaaatctaattttcaccttagacacgtttgtagctggtagatagtaacccaccttctagactttccttccagacagggctgagctgagtcctgccctggacattggggacctgctctgtcacgaattccctgcctcttgttaggcaagacagttcttctctgtaagcctcagtttgtccaccagtaaaaagggggtggtggtgatcgtggcagggtgttacaagcccacatgcctgcaggggccctccaggagagacagaggcatgaaataaaccaggcgcagggcagaagagggcatgggaatacaaggggcctggtgggcacgtgctcagctcatagagtcaaccccagctcggggccaaccagctgttgctgtgtagggcttcttgggccacatctttggattattttcaagaaaatccagaaatctgaactatgctccaaaataattgaaattttaaatrttagcaacttatttgaaatttttgaaagatagtataggccaataatagtagctccatggcctgaaactggcctgtggagtcaccagcttgcagtgtctrgattatttgggtctcctccagccagatgagctatggctacatttaataggcgtataaataaaaataaaatatttgccttctagatatgttgatttgtatttattgatgaggtctgtggtttataattggcatctgagctcagagttaataatggggtagaagcctctttgagaaactttaatcagagatgtagaattggtgtgcttatacctctctctccagattacttcctcctcctgacatctatctttaatccttcctgctgcagacttagcctagcctagtttctgtggcaacagagtatgctaccttttctctcctcgtagattcagagagaaggaagcagggagggtggccttgagattttcataactcagacagcagttccagggacctctactttctacacctgcaaaatcaggggcaggacaggtttatttgaagccagtgggcagcccaagagcaagatttattgtctctcataaatttttagagacctctggctaagagctaccgactttatcacattagctgctaccttagtccccagtctggagggtgttcgtggattagtttctttagtatccagagagcagtgagtttataggcccttttaagggtgggcttgggaaagacctataggaaccaaaggcttaaaagaggatctaggggtcatactggccaatgtgctggtcatttctaccatgcacagtgcagagtttgggaaagacctcagagagacagtagtggcagaagaggatctagaggtcatagtggccaatgagctggtcattctcgccatgcacagtgaaaccaagatggactgtatagtcaggaaagggaagtggctccactgagattgtggtgctgatagcagttgtcagtcctgggctctgaccgggaagaataggggaagtgggtaggatacagacattggagtcaaatgcctgggtttggatcctggcttcaccgctgtgaggctgggggcgcgggtaatttacttaacatctctgagcttctaagaactcatctgtaatgggaagatgacagcagttaccgcctcataggttatcgtgaggattgagatgatacttgtaaagcgtatagaacaggggcggcaaactttttctgtaaaagaccagattgtaaacattttgggctttgtgggccatatggtctctgtcggacgctgcaactcagctgttgtaacttgaaagcagccrtagatagataatatgtaaatgatgggcgtggctgtgttccaataaaactttatttatagacactgaaatttgaatttcagatacttttcatgtgtcacaaaatagtcttcttctgattttttttttcaacatttaaaaatacaaaaaccattcttggctctcgggccatataaaaacaggcagtgagccggatttggcccgtgggccatagtttgctgactcctagtatagaataatgcctattatgtgtttattaaatgtcagtcactgatattaccttgatctttatcattattctttttatctcaggagggcgggttgaagacagtcagatatttggctcagaaagaggtgacttggtttgggggaaggagcatataaaccgttactaccaggaagggaagatgggatttgtcctgcactgtcccagaggtgtgtcctccaggcccgattggcagaattgacagggaggtagatttttggcttcgaggcccctagcagctagaggtactgaaagttgctatagactgccttgggcatagttgagtgcctgtcactgggggtgtcaagcagaggacagatactcctgacatgctgcagtggagggggcgtgctcaccggctggacaaatggacactgagrtgctggggtcaccaccgtttcttgcagcaccatcaaggctaatggaagagggggtgttttcctattcttccacggtccttttcttaattcgtgaagtatcttgtcctcttcctgccttctcaaataatccagtgacatgcacaggccacattctccccatttgaacaggagagacagagacagaaagcaggagaacagggaggtggtgggagacaggatgcagcgctaaccttcrctgtggaccttgtgcagtgcatgcgcttcgtgtatccccgtgaggctgagctctgctgggtgtagtcttccgtgttcacctagtgtttctaggggaaaagtcctgaatcaacacatgagaagtttgcataatgctcagattattccctaatgtatygattgcattggaacaaatacgcattttaaaaattagtgttatggcagcatgaactgcactttggatcgggagttatgagcggtgggagggtcttttctagatagggacttccttgtaaggctcacctcaccccagaaggtgggctgttactcggcacttcagggcctgtgaaggtttctgggctttcggtgaggttgatcctctcctaaagtcggtttctcccccagaccccagcagcttgtcttttgggatctcaaggcaccatactggatccctcataacttctgatcccacccattatttgggggaaagctgacaccagggatgttggggcagctccacaattctgaccacacaaactcagcaaagatgtagtttatgcaggatcatgctggaccggagagagggagcccaatagtggtgggaagaggttggggggctcccttttgaacgagaggggagcagtgatgtttagcaggaattggccatgcatccctagctcccagctccctggagcctctgccatttgaccagtaagtcccacgtgctctggagctacagggacccagaggggtgtttctggggccagacccaggcagtctaagaaccgctttcttttgcatcaaagcccaccatggggcctctgtgtgggtaatgaggtcttgtgagtacctcttccttagagcaaagaggaaaggaaaaaaaaaaggattgcctggaatttattagtctaattacattttcctaatgtggttgaccctcgctcacagcagcgagcttatcaaagcagcaatcataccagcattattggagttttaataagagtcaattggttattgtcctcgctgcgtcggacactgtcgacgtaatcctccgaagcccctcgrgaagatagggagtttgctttctttgctggaatattatttacgttaataacaaggattagaggcttgttctatgtgtttaggagaagcagagcttttctttgttcgagtagctcctggctgccggctgtgtacctactggtggcccctctgaagtctagagagcaccaggctgagagtctggaccctggggccatagctccagctcctggctcaccgatcgctgtgccttgctctgtgagcttagccaagctgtctcacctctgtggtccctcctttgtgaaatgagaagacacaagtaataacaattagcgagaatgcaggggaagcctttcctagcacgcagcaagcattaacaaatgcaggctcttctaaaatagccaaatacagtggtaggtgccggcttagctctacccttatgcgtttatttatgatgccatagagtggagcagctttgtatcaggattgagcatttccagastgcccggttctgtcctagttacttgacacaagctggggagcaatttagcctgatgaagaggaggcggggctgcaaggctcacatttctgctctccccttagctgtgtgactttgggcgacattcgtgacctttctgtgcccaagcaaggataatcaaagggtctctctcacaggcctaatgagaggattaggagaggcaattcatgcagagtccatagaacagcacttggcccatgccgaacagatgctggttattgtgagattaacaggatttctgagcttccgtcttctactttgcgaagggagggagaagaggctgtctgtgcagggccacagagggtgcactagagtgacgtttatgtaatgcctggcacaagagggtagccagaggtggtggggtgggcatacaggtgggtagactgaggccagatggtgcaggggttggcctgagttcaccttagcaaattagatgcccacctgtggacattgctgtcatggcctagaggtagcgccaccttctgtctcacacttgaggactgcagagtcggaactaaagcctggggtcctctgaggccaaaatctgggctcgtttagctccagcaggggcttggggggtactttctgtgaccgaggactcggcagcctgacgaataatcgcttcctgcctttccctcattttgctaatgaggaaagctcttccaccagctgaacagctaggcgcccttgcccacgctggggggtgggggcggggtgtaggctgctgagtcccagggccagacccagcaccaggcacatagtaggtgctccgtaaatatcagccccacgtggagcttacagtatgtcagaatggaatggggacaggatactgggggactgggggtagggggtgtttagggagccttgaaaattcaactcctcaggggccagggaaggcccactgagaaggtgccatctgagtagagaaatccaaggttatgaaggagcagggtgtgccactgtcagggggaagggtgttcaggcagcaggaagagcaggtgcaaaggtcctggggtaggcatgtgcctggagtgtttgaagagcagaagggagccagggaggctggagtgcagcgcgcaagggggccttgtggacaaggccacagccaactctgggaccacagcagcttgtcgggccaggctctgagctgcggtagaggtgttgacagaggcacctgacccctggagccgctggaagagggctgagggccgcctcttttgaaggtttgactctagcatctttgtctacgtctcccaggagatgatgctcctctctcagctgggtggatgtacctgccatgccaggctcccctttcatctctccagtcatcttcatttacctgattcctagacaggaggcgtgggctctggaatctaggtgaggagagagaggcctggaggttcctgggaggtgctccttgctccttcccaaaagttctaggaggacacccctgctggctcagccttctgcagctgccctgtctgtactctgagaggactccttacatcagagcaaaatttagcctgatgctctctaaatacaggtgggtaggctgaggccagatggtgcaggggttggcctgagttcacccagcaaattagagaccgagggctgatgtcagccagtacgtttggagcccaggggtccagctgggcagggtcccaggaatagcctgcagaggccaccccatccctccccactcagctgattgactcctggggcctgagtcctcactgcctggaactggaggaggaggaggagggttggctcttaggatgggaatggccaggaagcttattaaccaagcaccgggctggggaggtggaagattccggagggaagtgaagagagaggtaccagaggccaggaggtccagccagggctgtactgtcagcattagaagctcaggcagacccagaggtgacatcacaaggaaaccatcacaggcctggaccaggtataccaccaaaaggctatcgtttcctgccaaggtcacctgtgtcccatggtagttaaatctaacagccacgtcagtcctcatcctgatctcagcagagttaaagatattctttcttgaaacgctcttgagcttttggcttgactccactccaggcacctgcttaactttgagaatgtcccttttggggctccttgaggcctctcctctcctcccccatcctccttccctcctaacattcatgtgccctaggtgctctcagtctagtagagtagacagaccaaggctaatgaacctagcgtgaggcaggggcttcttagagctaggacagaagattcccgggacagtataaggaagcatctattctacctggaagagtcagggagggcttcctggaggaggcctcagaccagatctgtcactgtttgtgctatccagatgctgaggttcagggaagtgaagtctctcacccaggtcacatagcctgtaaatgatggggacaggatttgtcccccttagccttgcctccccaaccaaaacttgtgacctgcctctgagggccacagggagccatgggaagctttagagcagtggtcagaaagcagctcaggatgaagacagcacgaaggtcctaggcaggatgggacttgcccaaggagccttcaccctgccccttccaccaggctttggtgacagctgtcctctctgagaggacctagaagacagtcagatcatgggttcaaaccagatcctgtgtacagccactccagggtcaatgagtttggttgctcggtgcctggagctgatggtgaggactgctgggttggtcctgaacttgccttcctcctgttttggccctcccgctgtgcccctggtgtacagctagttccaggagttgcggggtgaggctcactcgcttcggctcctctgcagtctcccaggagcttggacggctgcttccttgcagaccccctctctgtgragctgagtctgcttcygttccactctgccgtcgtcccttcttcctgccatatgttcctaatggcctcatttttcctcccaggcagagtcagtggccatctgcaaacttggcagtgtcacatacgttcctgtacccagcttgctcagaagggttttaaataaggccgattctagcaccggtccctagggttacctcctgttttatgcattccttccagaggaccttatttgatcctattgtttgtttcctctttcctttttctttggacagggtctcgctctagctcccaggcaggagtgcagtggtaagatcatggcttactgcagcctcgacctcctgggctcaagcaatcctcccacctctgcctcctgagtagctgggactataggcatccaccaccgttcctggstaatgatttttttttttttttttttttttttttttttttttttagagatgggggtcttgccatgttgcccaggctgatcttgaatcctgggcctgggcccaagtgatcctcctgccttagcctcccaaagtgctgagattacaggtgtgagccgcagaacctggctatttcctttttctaagccaataacctacctgtggcagaacaagcgcctctctttgaaaaatgccaatcatgtgtctattgtcctgggtcagaactttcagaaagtccaaggtcccacatcctgattctccaggaacattttagcctccccggagcgccacctggttgtttacatcgtagaaatgctacttcctctaccagcaacttctcctggccagcagttcttgggtggcacagcgcccctgaaatccttcatccctcagccccaggctcatgctgttcccacttggaagcgtgtccccattctctcgcacattccaccagataaacacgtgcctggtggtggaaggtgtctgagatccttggccggtgatagcaggtgtgagacggggtgctcatctcctgtgccaactctgatagattggccgttgcttaccagagtatggtgtggagccattccaggctgtgcttgggctcgtgggaaagaatccatctgctgattgattcgtgatgtctgccacctctgtgatggaaaagattggtggtatgtgtgctagaaagtgccatctgaggccggctgccttttgttttgaaacagtctcactctgtcacccaggctggagtgcagtggtgcaatctcagctcactgcaacctccgcctctggagttcaagcgattcttctgcctcagcctcccgagtagctgaactacaggcatgtaccaccatgcccggctaatttttgtgtttttagtagaaatgaggtttcaccgtggtggccaggcttgtcttgaactcctcacttctggtgatcctcctgctttggactcccaaagtgctggaattacaggcgtgagccaccgttcctagccccgccgcctttttctcttgggttccttgtcatgccatgtactgtggaaggtgacattgctggatggtggcacatgttggctgctttgagggctgaatgggagacaagctctgctcgtcttaaccagtttggggaacagttgggaattgctctgtgcttagcagcaaaaagctgtgggttggcccctgcattggggtaggctggggcagctttggtaaacagaaagggtttatccaggcatggggctttgggatccctccagccttggtgcagggcctgctcttttcctggtggcatctcactggccccgaggggctgtaaggctgaagcatttcctaagctgtaggccagggtgtctttcaggatcctgggtgggggagggtatgaaggggcccaagctaagctgctcccactgagaccctgaatcatcatttcattcccttctgtctcaagactagaactgatgtctagttggctgaaagcatgttgtcgggtgtggctcctgattcagagaagggccacttttggtgaagcaaaaatcccaaggaccctgggatcccaagaagcagtagtaaaagaaagaatagtattctcggggatgaatctgcattctagtcgcacagctgtaccttggatttgctgtgtggctttagggaagttaattccctactccgggcctatctttcttctccgtacaaggaagaggactgactagagatctaagggccctttttgccctaactgatgagatgggctgtcttgggcacaatgtgtctgattagctttcggtggggcttgtttgagaatctgagctcagggatgatgagtcctggaggctgctctcccagacatggatttggtgctcgtgtgttgggcgatgagttgaagaagagatgctggagttgagtggccagtgtgggaatgatagaggggctgatgacacaggcccgacccgggtcatgagaagccaggccctgcctgcctctccccaggactgtttttgcctrgaggtgggataggcacccattctagaaatgtccccgtccctggcctccccacttaccttgtactctttctctgcctctccagccctgttcctcctatacatacccgagattccagatgtgctaaacgactcacaggctcacagctcagtgtttgatttctcccctgggcatttgtacccatggaccctctccctcctggacccctctgcctcctggacccctctccctcycacaaccccttctcacctccttcaacattcagctggggcaagccaccacagaagccttctctgaccttcgccttgtaccttgcatctggcttgagtcagaggccatccaagactgcctccctccccattaaattcctttgccaccctgtccgggtttgattgctgcttccccacattatagctgtgtgaatttgggaaaatccttttatctttctgcctagatccctcatcatcagatctgcaaaaggagacagtacttgtgttagtcaggataggccaggctgtgttgcactaataaatatgtcctgaaatcttggtggcttaaaatacccaagtctggttcttccccctgcaaagcgctaagatgagctgggtgcctctctggagtggctctcttccatgcagtaactcagagatccagggttgctttcatctatggctccaccctctcaacatggggcctccgtgtttaccgctaaaggggacagaccacaagcacacagacgtcccgctgctttttaacagtcttagcatggaggtgatcacttctgctcataactttataggctaaaatgtctcatggccctacctggagtgggtcttccatgttcctggggagggagacctggctaggggtaagcactaaggaatctactacagtccatgaatccataaagcttaagaaccttttggctgggtgcagtggctcatacatgtaatcccagagttttgggaggctgaggcgggaggattgcttgagtccaggagtttgagaccagcctgggcaacatagggagaccctttctctacaaaaaataaccaaattaactggttgtagtggtgtgcacctgcagtcccagcctcttgggaggctgaggtgggaggattgctttgagcctaggaggtcgaagctgcagtgagctgtgattgcgccactgcactccagcctgggcgacagagttgagaccctgtcttgaaaaaaarccccaaaaacaaaaaaccctctggtttagtgaccggcttgtagcaaagaagtggcattagcctgggaagaccttaggatgctcttgtctaaagaccaggtgggagaactgaggctcagagagggctggggccttgcctgagatggcatgtggagtctgcggaggggctgtagatcctagttctcccacagtccaggccatattcttccttccttgttctgctcactgtagcctggcctcctgctgtgggatgcaggcagggatgggggcgtcatctctggggctcttgtgaaattattttaagaccrtggaaaacaaattagaatttcaaaccatccagccctcttgaaagcagactgggggtgtgttcgaagtaatgtaatttttgctttgttttattaataggatgtgggaggtgaggggagggtgtgagccgatggtgactgaggatgctggcttcagtgccttggttgacagtgcagtcctgaatcgggaacattggaggaagagcaggggtgggagtgtgttttgggggtgggggtggggaggataaacccaatttgggacacactgaggctgaagggccttgagatagttccgggtagtggccagggagccctggcctggacattcagatttggcaactgctggtctgtatccgggaggttctaaactggagtctgtggtctctctgggactggggggctgtgttaatttcctttggttgccataacaaatgaccacaatctgaatggcttgagagaaatgtattctttcatagttctggaggtcagaagtctgagatcggtcagcagactgagatcaaggtatcagcagatccccagtaacctccgaaggctctggcagaggatccttccttcctcttccagcttctggggaatcctgttcctggcrtgtggctgcatcactgccatctccggctctgtccttacatggccttcctctctgtgtgtctgtgttctttccccttcttagaaggatatcaggaacattttctttctttttttttttttttttaatggagacagagtctcaccctgtcacccaggctggagtacactggtgcgatctcagcttgctgcaacctctgccttccaggttcaagcgattctccttcctcagcctcctgagtagctgggattatagtgcctgccaccacgcctgctaatttttgtatttttagtagagacgtggttttgccatgttggccaggctggtcttgaactcctgacctcaggtgatctgcctgcctcgacctcccaaagtgctgggattacaggtgtgaaccactgcacccaaccaggataccaggaacttctaagtcattgggcttagggcccagcctaaatccaggaggatttcatcttgagatccctagctagttacacctacaaagatccttatttccagataaggttacattctgaggtcctggggtagacatgaattttgggggacatgattcaacccactacaagggccatttatgggtgggcttcgggagggctgcacaccacctagatccatacgtaaaatcccatgcatacatttcccctggaaagacacacagctctctttgatttgttagggcccccacagatgcggggacccatgctcctccaggacccatctctggcagatagggctattgggacagaggacaggccacaaacacagaaagaaggggaatgtggagaatgggccatccatgaaggagccagatggagccaagaagatatggcagaaagatgttttggagggtttgggagactggccatacctcctaggtgttacaggcatctttaagaacctgatttttttggatctattcccacaagaatgtacataatgaacacacacacctttggtatacagctctggtacacgagcccccgctaccccaaagcccatccctgggcctctggagaccctgattcagactccagttagggtaccttgctagaggagaagagtttgaggacagggggagggaacagcactaaatgctgcagacagcttgaggcagactgacaattaggaagacaagggccattgctttcgcttctggcattgaggattacaagagagaatacgggcgaaagtgctctgtggttttaaaagttaaatgacttatcttgtcattttttttttgttaaacgctataaagcaatatctgtccatggtaggaaaaaatgaggaaatatgcagataagccaaaggaggaaaatccctttaatcatattatgcatagatcgccacggcggccacctgggtatatgaccttctgaaccttcttctctgtattttatttgacatgaatgggaccataacatacgtaacggtgtaactcacattttcacgtgaagaagtgctcatgaaacgtctttaccagccacatagagttctgttgtctggttgtactgcaccttaaccagtcttctgcttctgaacaaattgttttgcatcgtttccttcttggtaaacaattctgtagtgaacatccttggagtttcttttgtgcatctgcttctataggggaaagtacgccacagactctaaaccgtaaagcactttactgatgtacacatctcaaacgccttttatttgatgctgaatctgtgtgaagctagtcctcagctatcccatcccacatctgggaactggctttaggcaagttaattccccactcaatcaatggcacattgcagaatggaacctttccagtcaacatggctcaccatgtgtttgccagcacacacccagtatgccaggccagctgctgattgggcaaatggggccagacactgaagtgggccccataggcccaccaagaacaggtcttgcttccagtttatggatgagggaacagagatttaaaggtcatacaactagtaagtagcccaacaatcattcagactggctcttctgggtacctgatatggtttggctgtgtccccacccaaatctcatcttgaawttccacatgttgtgggagggacccagtgggaggtaattgaatcatgggggcaaatctttcccatgctgttcccgtgatagtgaataattctcatgagatctgatggttttaaaaagaggagtttttttttttgttttkttttttttttttaawaaaactccagggcctgtgaccctaactagtcccatgtgtcggatgatgcctggaggctgtctgtgtgaaggtggtggtccgtatttaaagcattcatcacttgtgctcgctttggcagcaccacatatacgaaaacattgattacttaatacttgtgttccatgccggactagaatagaggaaaaggagttccattcctgctgccgtttggctctctagcttcgcaactctggcctccttgtgtgtccctgaggtgagtttatttctcgtgatgttaaagggatctggaactgcacggtcgtcgggctggagatgtcacctccaggcctcttctgcagacaagctgctcctatgttcactttcattctaaggaagggctccgttttctggggaaagcttctcttaagctccactggcctacaattctcaaatgagaaatagctcttgccttgagttggtgtaaaggggatatcttgggcccttggctgaaagcctttgaattgttagtagcttggagcttaagagtctctaggatgggtctggcatcatcaccctctagatctaaatggatatccaccttccattctgcctctcaaattgcagacttggccgagctgcttaagcatgttgagccttagttgtctagtctgtgatatgggaatcgtattagtccattttcatactgatataaagaactacctgagactgggtaatttatgaagaaaaggggtttaattgactcacagttctggaggctgtacgggaaccatggttagggaggcctcaggaaacttacaatcatggccgaaggtgaaggggaagcaagcatcttcttaacrtggtggagtggaggagagagaaagagtgaagggggaattgctacatgcttttaaacaaccagatctcatgagaactcactatcttgaggacagcaagggggaagtccgcccccatgatccagtcacctcccaccaggtcccttctccaacattggggattacaattcaacaggagayttgggtgggacacagagccaaaccatatcaggaattgaacttctaccttccatgcctcataggaacattagaaagcgagttccattgtcctctgtgggtgaagaacaagtaccatatgtttggaagaatgatttgtcataacccactttcccagaagttgttattgttctgaaattgaacttttgttatttttgtcctcatattttctgagagcagtatagaatgttaggaaagagattcagcatcttcctatgctgggtaccatgaggtgttcttctcaatacaatgctataccccatttattcctcatgggataagcaccacgcttcttcccgttttataggtagagcagactgaggctcaagagatagcatggtgtgttcaaagcctaggttgtggagtcagatgagacacaacatgggcttgggtactgtattagtccgtttgcacactgctgataaagacatacccgagacttggcaagttacaaaagaaagaagttgaattggacttacagttccatgtggctggggaagcctcacaatcatggcagaaggcaaggaggagcaagtcctgttttacatggatggcagcaggcaaagagagaatgagcttgggcggtagaactcctctttctaaagctgtcagatctcatgagaattattcactatcacgggaacagcatgggaaagatttgcccccatgattcaattacctcccactgggtccctcccacaacatgtgggaattcaagatgagatttgggtggggacacagccaaaccatatcaggtacccagaagagccagtctatatgattgttgggctacttactagttgtatgacctttaaatctctgttccctcatccatagactggaagtaagacctgttcttggtgggcctatggggcccacttcagtgtctggccccatttgcccaatcagcagctggcctggcatactgggtgtgtgctggcaaacacttggtgagccatgttgactggaaaggttccattctgcaacatgtctctgattcttgataggaacatttggactatccccttttgtcctgggagrtaagaggacgcacctaataggttgttgtgacaatgaaatgagcaaatgcaggtaaatttcctagagcagttgacagcacagatgtacactgccttgctggtccttcaggktcttagatttcaaccctctcatcccaytgtgacagggatgcttgtagggtcctttgccctaactcactatggctccagatagttgttagctagtttatatctgctattcttcatctcaatcttcacttcttacagttattagtatctttttttcactccactcttttatttcttaatttgatgggtgtgttagttttttccttgttgcataacaaatgactacagatttagaggctgaaaacagcattaatttgttatctcaccatttccttgggtcgggagcccaggcaaagcttagctgggtctcctgcttggatctcacaaggccacagtcaaggtggtgactgggctgtgttctcatctagaggctggagttgggagagaagtgcttccacactcatctggattgctggcaggattcattccctgtggctgtgtgactgagggctccagcctatttctggctcttggctgggcctgtccttgggtgctgcaggtggccctgagcccctaagaggctcccgcaggcctctgccatgtggtcctctccataggcagagcccagcatggtgctttgcttcttcaaggtggacagggtgtctctctccagcctgttcagacagagtctaacaggaacaggaaatagaatgaaacgccatcacaggagagaggatttatcacctctgccttaccctattgattagaaggaagctgcagctctcacccaccctcaaggggagggaattatacaagtatgtggatcactgggttcgccttcaggcgtgtctgccttggtgagtttagtaagctgacagcttattgaaatacaaaataagagttattagtttaaagcagatacaatgcattttgaccatcagatgtctgtttgtcttgtggttctaggctgtgttctggagagtgaagggtgccagataaataagttayttagcctgttacttagcctgttactgtttgttttttgtgtctaaatggcctgaagtgagaggaagaatggagaacaggggaggaaagtgagcaggacctcaaaagggatagaggagagaggggacatatacatggaccttctttacgtacatatgcaaatgccttttgatagacaattttatttttaattattatttttttagagatacggtctcactctgttgcccaggctggagtgcagtggcatgatcatagctcagcacagcctcgagctcctcaagcaatcctcctgcctcagactcccaagtaactgggactacaggtgtgcaccaccatgctggcctatttttttaaatgttttttttttgtagagacaggatcgtgctttcttgcacaggctggtcttgaactcctggcctcaagcaatcctcccaccttggcctcccaaaaccctgggatgacaggtgtgagccatcacgcctggccctgacagttttagataagtgcataaatgttacatttataaagttcagtatattttttcccttgttttgtttatctcctaaccctccttcagtgacatcccccctcactcccaccctggaactcatgctaatgatctcatatagatctctttcatacttttccatgctcttatagtcagttacaaacatatatgaatgctttcctggatcttttcttattcaaccatgtcctatggaaatcctcccacctcaatagctgtagatctagtgcattctttttttttgagacagtctcattctgtcactggggctggagtgcagtggagttatcttggttcactgcagcctcttcctcccaggctcaagcaattctcatgctcagcctcccaagtagctgagattacaggtgtgtgccaccacgcccagctaaatttttttctgtatttttagtagagacagggtttcaccatgttggccaggctggtctccaactcccagcctcaagtgatcctcctgccttggcctcccaaagtgctgggattacaggcgtgagccacaccgcgccaggcctctagtgcattcttttaacagctacataatattccagtgcgtgggtgtgctgtaattcaactgaccattccctattgatgggtatttgtttcatttctcattttttttttttgccataataaatagcaccaagataaacctccttgcacgcacatacatcctacagagctagttttatttctctggggtataatcccaggcattggattgctgggtcaaaaggtttgtgtgctgttaattttaatagctgttgccagctggatttccccagaggctgtaatacttcacatttaccctggtaatttgagagaggtcgttttcctgtatcttgccagcaagagatgttattggccttgttagttttgtgggggctgagaggtataaagtgatctcattgttgctttccattttcatttccctgacaagcaggggggctgagcagcctttcatctgtttggccctttggccgtgctcttgtgagttgcatctgtggatcctttgctcatttccccgttgggtcctctgccccttcttgtccactgtcagccctgtgtatagcatagatatcaaccctctttttgccttctgtgtagcagttattttgccagagatgttgtgtgttcattttgtttatgatatcctttgctatgtagaagttcttattgttagtcagtttaaaaaaaatctgtgtcttcttctgcagtctctgggtccccaaggttggttaagaagcctcctttccaccccctgctcctgccacatgcctaccttcctttcacatccacagctctggactggggccgggagtcaaggtgggctgctgcctcagctcagagcttcccagccaggatacaagygtgcccagctctgatgccctcagccctcggagcagccaggcagggcctggggtagccaaagcctgaggaagatcactgcctgccatggacggcctcatccctttaccccgtacaaatattttctgttttccaagtttgcatgcttcaaggatgacagctgagtcagccaggtgcagaggaggagggtggtatgagagaattcctggaggaagaaacagcaagaggagtggggtggggggtcttgtcctacctgaggagtcccaccctgggccataggaagaggtgggcacaggggagcaatgggcatgtggggaggtgtaccaccaggctgcagaaggcccagtgcaaaccagaaaggaacccagagtgggtgcccaccatagcggggatgttggggagaggagagttggacactttgcctcctttttagtacatctgaggtgggaggggcagggcccctgtgtgacagctgacctcctggcatggctcaggtcatctctcctggctgctcttgatcagtggtcatcaaagaggtatacacgaatttgcaggagagtttgagaagacctgcagagtgcaggagacagaattagaactgcatttctatttatgttctcatttcttcctctaaaggtgtatttttgtgtgtgtttaatgatgtacataatattaagaaggcagtgcatgttcttaattataaacaaatatgtatcaggacatatacataatcagagtttggagacaactgctcttagtggcatgatgtatggcagcccttggtcctcttaccttcagcgactcccaagagcgaggggatcccctgacatagaagggagggatgctcgtgtgggcaggggaggactgggaaagtgattgctgggaagggaataacttctcccatgctcccagaagggccatctccttctcacatatcaccccttagagcagtccctctcagtgccccttgcatgttattctagcccccttttttctttccaagatatcttctaatttgtagtgattttgcctatttacctttttcctatttccccactagactgtaagctctgtgagagcagagatgggatgtttcagtcttggtggtgtccccagcacttagcacagtgccaggcaacaaaactggccctcaatacagagttggggagcgtaatgagtggatgttccaagcacatgttagtgttttccataccttatttatttctatgtccttgaaggtagacatcatcatctccattttgtaggtaagaaacttgggttcagagaggttgagtaatttactctaggtcacacagctgtttgtgcctagaggtgggagaaagagagataacattttccaagtacctgctaaatgcctggctctgaccataccgttgttataggacctttggggtgtcatttttctggctggaaacctctgtggctggtggcacctttgcctgagttttgcttaggcctgctgggctcatttcacgcactcagcctggaaggctgcacttggctcatgccactggcctgggtcccacgcctgccaagggagagtcaagtgtggaatggcaaggggtgtgtgagcaagcgtggtgtgtggccactgcacacagtcagacatgccagctgctgcagtggggcaggcagctctgggtgccagcacaggtgccagctctctgtgggtctgtggctggaccaggtgtaccacaagcagcttccacggctggcaccggggaacacaaaggcactcggaagcttggagatgccaggaaccacagggccccagtgagggagtcacagccctggcatggggagctcccaggtctgggctccctgaagggccacagctcttctcttcttctcttcacctgcaatgtggtgagcaagggtcatgtttcagccctgtttgtgttacagctcttttagcctcattcagtggttcccaagttcttgtcccatgccctggaagaatgagataggcagacaaacagaaggtgagcaagacgaagaggagctttattgagcaaatatagctcagtggaggccctggagtgggtaactcctctctgcagcctgttgtcccgatgtctgctcagctctggctgatcccagggcttttatgggcctcagaaagtgcatgctgattggtccatgggcacccatgggcgggcccagaaaaggcaccacaagttcccactctgtgagactggcatctggcccccagccttcaggtcctccctgatctgaaggtggggcctcaccagggacccacccccttctacccaggaaactgtctgcctcctgctgctgttcatagtgccccaggctgtaggtgccaaggggcacctgcaggccagtgccaagttgcccttagccctcccttggcttccctcctgtgctcatcagcatccaaaattcagagggggctgaggcagcaggaggctggtgtgtcagcactttcctgaccgtgtgcacatctggctgggctgtgacagggcctgggcttggccttgactttgctctgagattggagcagatgctaacagcagggggaagccaggcagtgggagcaggcttttctgagcctatgagggttggggggagggggccttcctgggcccctaagagtgcagagatgactgggtggctgcagctgtgcctggcagggggtggggccgggctcctgcctactccatggagcaggaggcctgggtctgctgccatagttcagacagctgcagcggcacccagggatctcctgccccaactcggaaggggcaggcctcctgcttgtccccagctcccgccagctccacggagtgtacagccctggccacgcctccctgctgcagcaggcgtgatggcagcagctgcttcagatggctcgctgctgccatcaccttgataccacctcattggctacgaagaggaaactgtgttcacagaatagtaaactgagactcagagatgagaagcagctttccagggccacacaattagggagtggaagatccgggatttgaacacaggtctgtgtgaatcctaggcacattctcttgccaccaccccagcagcaatttcctttattttgagtcagctcaagtgcctggtggtggctctgaggtctgcatcgggcacatcggggtgcagagtgaatgtgggttcccctggcagatgcctccctgaggggccatcagcatggtgaggaggctggctagatcaagccgccctgcgagtgggcaccgggccatgggcaccaggccccgaagccagcctgatttgcctgtggaacgaggagggtgatgttttatgcatggtgcctaattttgccctggcagtctctggctatatttaacaccattaatcattattgttggctcccagggggatggatccctgattagtgtcagaaacacatcttatgaggaagagagagggaaaaaataagagcttcacccccaacttgatttcttccaactgaagccgggactcccattcctgccaccatctctttgctatctgcagagtttgtgacttgtggcatccttggcttgggatcctgccccccctcatcaaccccatcaggaacccttatcattggggctggagccagggcctcttaaccccaatgggcccctctcagttcaaagaagaggagcccctctttgcatcaaagcactgtgtggctcagccaggtcaggacagctgccccaggtggagctcaagaaagggtggaccaggcgcttattaggctcttgcagtaggcaagtctcgctgctcagtaccttacctgccttattccagtcatcccgactctgaccttcctaacggatgtgtttttaacccttcttgacaaatggggaaactgaggcttggagttagctttcataggcccatggctggtttgatcaaatgtgtataatcaccccctctccatttataaagtaccatgtgaacattgtgtaaccctgtggttttgccttcaaatatctggaagggtcttcagaccatatccaatacaggcaagcgtccatctttytgataatcaaacatcaccatgcatatagaccagagattcgtgtacaacattcatgttctgctgtcttcgggcctcagataaggagcttgaagccccttctgcttatcttcatcctcctcctaactctgccgtttgacccccactcccttggggccctgctcatcctgccattacctttgtgttgacattgggacagtggctccttgtctcctcttggagatcgtgaggctctttcctgagcagagtgtctgccctcctgctcatcgtgatgacttttcttgacatgactttagggctcactaagaaccttccctagcaggggtgtatatgggagaccaaagagaaggcaaggacagaagaccctgttatcatccagggaggtggcagactgaagatcccagagaactagacagaggtcagtggagagtggagacaggaggacataggctctctctctggggtgtgggaagggacaggaccaccatcaggttcacatctgcattttttgggraccaaaggcttcttgccctgggagagagaaagcaggggcgggacagttggtcccctcccatccaccctgcccaagcctgtcctgagtggtgtcttctgactttcttgcactgtcgaggggacrataaccacacaaatgacaacagatgccggcctgggaatggaacagcatttcctaagcaagggctggacttccctctcttttgtgccagatctagtgtctccaggttagactgcattgggtgctcttggtctgaaatgttcaaatcctggggctccctggaagggtctggagtggccatctggagccctcttactcttgcatatgtggagctgatgcactgtgagcacctactgtgtgcacagcctgtgcaaaaggttttatctgcgcagctagttaactgaggagtcttaatgctttatgggtaaaaccaggatatggttttcatttttccacttgttgcttttaatggaattccttcaagttctcctttttttgagccttaaggtcctcaggcagatttcattattttccggccatttccagttaaaatataatctgattyattttagaacctgggacctcacatctcatctaaagcactctaaacccttcccctacagcttttccaggctgctccaggagtggggagaaggaaggaatctcactctctattggacaggcaggttgcagagggtgagtggccacctaccctggtctgggttagctctgcctactctggtgatcttctgctgtggtggcacctcctggctcctgttccctgacaacctccacctcccggcctgtgtcacctctcctggcccatgctctgctctctgcaaggttggcatcctttgtgtagaatatgtgtggggagaattggtattgggggtgattctgttggcttgcggtcagtgctgcctggtagaggatgggaagggggcaggtctggctccagttgtgagtagcttcttgtcagctctctttagaatctcgggatacttggccctccttgtccttcattttggcttcagctgtcattccagggcaccatgaaaagtccctctcacattctgttatgtggcaatctctcttgctgacgcctcacaatcaccctgtttatgggattattcctatggacagatggggaaatagaagctcagagagatgcagtcgcttggccaaggctgctcagcagtggagagtgggtaatatctgaacctaggtctggctgaccttwwagcccgtggttaagagcccagtggagtggaatcacagtactgccatttcctagctgtgtgaccttggacatagttacttaacttccttttcctcatctataaaatgaggaggatgactagcaacaatatcctgggtttctggggcgattcaatacattgtataccataagactcatgattgcattggctaccaggactgttggtggcattgtccatcagttacaccatcccctctaggctccacaggagaaatggctttcaggccatgatgtctggaaaatagatgttaaacaagcaacagttaccataaattgattgtgttttcctctttgctttggctactaggaagctcagtgaaattgctcaaagtatataggcctccctggtctcatcttatttttttactacttttctctttgcataatttttatttgtgtcttatttcctactgtatgaagttgtattaacattttaaatttctgtatcaagctcttgttgtcataagccaatgttgccatcagaggggaagttgagggcaacgtagagatcccacagagagttgctctcccagatcgtgtccagttcttattccttaaagaaaagcacctttgaaaacagaattgcccttgtgggagtgggagagggggctggttagtgagactggactttccttctaactctttggatgctgaggtgtgtggtaggggaatctgctgatgacatctgcagaaggaggaatgcttagcagctcactgtatcagtttaagattgatgcagaaaatccccaaatgagaggcttaaacaatccaatagttgatttcactttcatgttcaaatagtttagaagagggtccattcctggggtggcatggggccccagagtccaggtacgttaatagcattctcgctcgcactgctgtgtaatagcttccattctcaaagtcactcatgttccatgtccagagtcactgtcgtttgccctcacaccctgcatttcagaagggagggcaaagcaaagaagggcacttcctagaagttgcagaagacagcccctccccaccgtactttgtcctcattgactagtttcaggaccggcctagcttctagggaggcctgggaaaggagtcctcattctgtgcaaacttgggcttcttwgagcctatttcctccactataaacagtctgactgccttgcagggttcgtgtgaggattaaataagaatgtagtaaaatataacaggtgttctgcaaatgtaaatttgcttctatttttagttttcccttccctcygttacttgggwctaagagagaagctttagctacacgaagaaagatttaggagcaataaaaaaagaaaactctttragaggaaacgttgcagcacacaccaggaagctgggataacagattccctttggctccaatcagggaggcagtaaaactgaaattaaacagaagggtgggggtcccgcgtcaatcactagaggttagataggtgcagaaatggggtacagaccctcagaaggacctcccgtgccgtttgattccaaaatcttgttgtgatcaccttccccgagttcgaggtggtgagtgcaatacatgtgcaaggcgggttgcgtttgaatgtgcagctgttttcatcctcaagatgagctcgggcatttccaagactgtctgcacaccaagcacactggcatggggtacagcattgctcagcatctcattcccctgatgcccctttctgccagggctgaaccctcaggaagtcccctggggcctttaaaagctgagctagggagggagrgagcccagctggtggctcgctctgctcagtgggggctgctgggaaatgctgctctttcctgggtgtcttaccagggtggagatgttgaagtcagcaatggggcagcaggtcctggggaccccagctgctctggctactgagcatgctcagacacggactctgctggggatggtttggttccctggaggagaaggaagaagaggaggaagaggtggttttgggtggggtgggctttaacttgatggagggaggaggatggctctgtgcatgcgtgcacctgtgtgtgtgtgtgtgtgtgtgtgtgtgtgtgtgtaggtaagcactcccactgttttaaacgttctctagcactgctggagtgatgggcagctggaggtgagttagctcatacatgcaggtgccttcagtatctcatttaatctttaccatcccaagaggtcggcatcacgcccccacttaccagaggtgaaactgaggctcgcatgggagaacaacttgtccaaggtcagtggcagccagcggtatatttggagagatacaaatccagctttgttaaacactcagctttgccctccaccccctctggggtaaatgggcataatccctacagggratgctgggactctccaacccccagctctcacagctaccctgtggctcataccggattcaaaccccaggtccacccggcttcaaaagccagccgtgtgcttcttgatctagtcttccgacctcttcaagcttcttcagcagctgagaggatgctctagacttagattgcaacgagtagggaggtttaggtggctacttgtyggagtgttaacttctaagctgggaatttctagaatgatagagtttgcacagcaccggcactgccgtggcaagtgggccagccctgagggcctcggaaggcagcagaagtctgctctctgctctggcacwttctagggacacgctgctcaagtatggctcgtacagggccttccctaggggtggtatccacactcctagcatggtgcttcctgggtttcaggccagtagctgagatctggggcacctgctastaagaagctcttgtttaagcagaaagagctcagacttccaaacccaccagggttgggatccaaatccctccygcctctctgtggtccctgctgcctgasagyttcagtttctgcacctctccaggcaggacagcagctgccacctgctagggctactgtggcagttcgcggtgatgccsatgttgtgcccaagccctgycatgagggcacttgatgcatggtagctattagtcataatttaggacctctctgtccctcctatgagaccacgtatgctttggagctaaggaccccacctctttgaagtgcctggagcttacttcatgccatatcggcgcttcccaggctgtgttctgcagacaagaatgttcccraaaggagtgttctgtaaccaccgtgcatcggaggcattgcgctcagtagccttctcaggatctttaatatggcagaaagcattgtgactctgcaggcggacagggccaggtatccagcatttctcaagcttgaccaataatcagaccttcctgtcctgccttcagaatgcagtgtagtgtgcagtcgagagaatattctggaagccyrcaggcctgggtgtggctctggcagcttcctgtacttgctgcctgtttcctctctgaaccctgaatctcatttcttcctctgaggagtggggagatgaatccccagccttccaggtggctgataattaarttgtgggatggaagtaaagcggtttgcacagggcctggccgtcagtgggcttccagcaaacgggagccaatgttcctggcaggggctgggtacagggcaggggagcaggaaatctgacttgrctgtaggaggcgaggaggtgggagcaggatcattgagaaactgaaatgctgtcgaatctgagtggggcagaggacggaactgagtctccctccataaaggcgttttgtcccggagtagattgacaatctgtgttacctccaccacatcttcagtctgggggcacctgggttctctcctaggatctcaaggaattagctaattaggctggtgtgcctagaaggcagaggtcatatgggtctgcgcagtcatcagtcccggctctgccttcccttttcctgaaatatgcagtgggagtgctgcagggtgtggcacatgtcatcacttcatgccacaaatatctaccccaagatattcgcccgaggtgccctaaggagctcatggtctaggtgggagctagaccagcaaatgcagaattagaataggtgactggggaggggccaggagggcagaagacccactgctgctgggagggaggacccagacgggagtaagagtaggtgatggcagaggtgctggctcttaaaggaagccacaacagctcgcctggcagatgctgggcttggagaaggacattttgggagagggagttggtggagggggccattcaaaaggaccagagagttttcttgggagttctgttttaagattttagtctgagtcacatcctaatttctaccaggatgattgagatgcatgagattgacttgcatttgttccaaacatgcttttcaaaagcaaaactgctttttaaaaaaatctatytttgttcccccaggtaaaacaagttcatgtcattctaccatttgtctggccaaggaccctctctggttttcacttttttaaagtctttccttctccattccagctcctggaccctcctggtgggaagccacgtgtgtgttgtcctcagatatgtgtgcatccgtgtaaaataagcaggcgtttgccttaaccgacatcactagtcttgtgctatttaagttcttgttttacatctttaccatatctaccccacacgctgtttgaaagctctgtctgcactgctgtgaagtccactcacgagcgagctctccacggatgcattcctggctcagcctctccctaagcgatgyccactttggtcccctctctggttttccactttactaatgatgctgtagagaatgcccttgtagagtcccatcacaagcttggaggacgtggtttctctrgggggtgtgccaaggtttgggaaatgccgagtcagcaggacacgcacatcaaattcaccgtgttcccagatgcctttccagccagtcccattgggctcactcccrccagcggggttgggagcttccttttcccacatctgtgccagcacctgttggcgatcgtctagttttgctaatctgatatgtgtaaaacatctcatccctttactgtgtgtgttgctgatcaatgtatgkttgaacatcatctccttatatgcttgctgtttggattgctggtgtctgaatggatgygtttatacactttgtcaatttcctcatctttttgtctttttttttttcttgttggtttctaagttcgttccatgtcatttttagatgttgctagtatcatctcccattttgatatgtttgtcttaaaggtgtctgtgttttcactgarcagaaatctatttctttgttgcttcctctcttttttttctctggccttagaaattgtgtgtgtgccttctgtcttgtttttagaagtccttccctttaccaagaccaaaaaaattctcccacaatctcttcccttagctttatagttttactttataaatttaggtctttaatccatctgggttctgtcctgtgttctctgtctgataagcacacaacctcgtttttctctgtactgtaaatcagctccgcccccgcccccaccacccacatccatcctttttcctccggtttcaggaaccacctttatggtgctgaattcagctcttcacacacaggaggttctatttctgagctctctctgctgttccgttggtctgtctgtttttatacgaatgycttagccgtttctattgctgtacctctgggacatctcttaatgcctcggaggccagaagttttgctcttctttttcatgattaagcaactggcagacccttttcttcttctagacaattttagaacttattgaccatattctctaaaaaccctgctgtaattattattgaaattacttgaaaatgtctacactactttggggagttaacatgtgactaatgttaacatgacagtttcccttttgggtcattttaataatgtaaaacttttctccatacaagtcttgagcatctgattcaattctaaaatagtgtatatgttttcgttgataatatgagtggggtgtcattttctgttgtgttttcttctagttggttattgctagggcaaaagaatgctgttaatttttaagttggtcactttgaacgtgttcagattctgttggattttttctatagatgatattatcttaaacgtgaacaatggtggtctctctgtctcttcttccagttattttacgtgatgtttctcctttgccctactgcccttgccgggacttcgtttgatgttgagttgttgckcagtggcaaacttccttgccttggtgkcaatctttttttttttttttttttttttttttgagacagagtctcgcmctattgttgccagggctggagtgcagtggcgtgatctcggctcaccacaccctctgcacccgggttcaatcaattctcctgcttcagcctcccgagtagctaggactaaaggtgcgtaccaccatgcctggctaakttttgtatttttagtagagwctgggttttgatatgttggccaggctggkctcaaactcctcacctcgtgatccacccacctcagcctcccaaagcgctgggattacaggcatgagccactgtgcccggccaccttggtgtcaatcttaagagaaataaggtgaaaattcccagctaagggcggcatttgctgtaggttttactatgttgtgttcatccagtcaaggaaattctcttcaattccttgagtttttaaaagtaaatacatgttaaatttggtcaaatgcttttgccaatctattaaaataattcttgcacttctgtgctaaactctgttctgcctaaaagtacttataaagctctgtgtgccagactgtgttgtaggtgctttgtaaatatttactttcttaatccttatgacagctctatagagctagatactgtttattatctcctccttgcagatgagacaagacacagagaggttaatttactcaargtcacacagctggtcaggcccatctctagcatttgcaatactggggaagagtataaatggacacacagcaattctagatatttaaagctgtaaaacaagataacaaactgttaaacatctatcctcttatctgagaaatatacgttgataaagataaaatctacaagataccaagatggccaaatttaatgattattgcacattttggcattccattgtaagtctgagatagttggatgagtaatagtcatacataactcataaattatgtattccataaaatttttcttgccttcaataaaataaattctgatgtaatcaagattttcatgtagtttgtgttctattatagtagtgatataaaagattaaaaataaaacataattatgctcaaagcatacaaaattaaacttttaccacctagaagtgaaagtaaatgtaaaaaaaacaatttctgaagctttcaaaaagtttttcatctaaaattgagaattatctgtaaacattaagaagcaaaatacaaatcagtatgaatttttaaattaaatgtatttaaaactgaaatttattcatgctttgaaaatacaatgttagcattcggtgtccatctagttaccagcataaatcattggtctcatgcttttacccttatatctacagatgggtatatgaagggtcatatgaattgttcagggtttcgaaatgttcccaagctgcagcgttgagctgttgtgaacgctgttctaatttagctgctaattcgtatacctctactaycccaatgaggagcatgaagagaaacaagaaaatggatgccctgcatttctaggaaatgagtcttcatttcgtgggaatctattgcaggagtgctaacaggaagatttgataagttggttaatttgtcttttctcttaccgaagtgcttttgcagctcaaatcctccctgcacctcagagctgtgccctccttctgtcgacagcactacatacaaccagcytccacggtgtgtggattcaggttgctgtttgtttctatgaagttgagccggggctgctggggagtgtttccctgggccctgaatggtactagtcatgagggtggacgtggagtcaggagttgcatcgtgctggcactgaacagcagatcccggatgactgtgcgtgcgtgtgtgtgtgtgtgtgtgtgtgtgtgttggagggcagtggtgcacayatttatcagatgatggggcttagggcagaatccccttttacctgggctgaaaggagttactmccgcgggtaaggaacagagctggggtgtgacctcaggctgcctgattcgagtcatatccccgatcataacatcatgtaactttctctaccatattgtctttaactcttagacttagctagctgatactttattttgcagaaaagatatcttcaaacagttagtgatggctgggcatggcggctcatacctgtaatcccagcactttgggaggccaaggcaggcagatcacttgaggtcaggagtgtgagaccagcctggtcaacatggcgaaaccccatctctactaaaaatacaggaaaattagctgggcgtggtggtgggcacctgtaatcccagctactcgggaggctgaggcaggaggattgcttgaacccggaaggcagaggttgcagtaagccgagatcgtgccattgtactccagcctgggtgatagagtgagattgtttcaaaaataaaaataaaataacaaacagtgatatctgctgctatggtttggctgtgtgcctatccaaatctcatcttgaattgtagttcccataatccccatatgttgtgggagggacttggtgggaggtaattgagtcacggaggcggttacccccatgctattctcgtaatagtgagtgagttcttacaagatctgattgttttataaggggtttcccgcccccccttttgctcggcacttctccttgctgccgccatgtgaagaaggaggtgtttgcttacctttccaccatgattgtaagttcctgaggcctccccagccatgcggaaatgtgagtcaattaaatctctttcctttataaattacccagtcttgggtatgttgcccaggctagagtgcactagtggtgcagtctcagctcactgcagccttcacctcctgggttcaagtgattctcctgcctcagttttctcagtagctgagattacagatgcctgccaccttgcctggctaatttttgtatttttagtagagagggggttttgccatgttggccaggcctgtctcaaactcctgacctcaggtgatccatgtgcctcggcctctgaaagtgctaggatgataggcgtgagccactgtgcctgggccttggatatgtccttatttagcagcatgaggayggactaatacacctgccaagggtataagtggggagtgagagtgtatgctgcattggtcatttctgacttaaatcattaaattcagcagaaggtctctatgactgtaaaggcagacagagtgagcgagggagagtgatagggagtctaagcacagagtaggacttttgagccagcaagacttggttcatatgtcagctttgccaatttccatcactatgcttctggacagtttatttttctagttctcagtttttgtacctgtaagttggaaaattggatatacgcttacttcctagggtcctcatatggcctaagtgacatcacatacgaaccctaagaattctgtcacgaatctaacctacccaaactggctcaaagaaaacaaggaaattgattgattcaacgaatttaaagccccaaaggtagttcatgcttcaggagcagtttgatccagaagttcacagtgatgtgccctggccatatttctctgtgacattcttggccctgtccttctccacaggcctgcctcttcttcaggctgtagtgggaaacactaaaggctgtggtggtctcagagctgacacccaccagctgaacacgagcaaatgggtctttgggggtcttgtgtgatgaggaatgagaaagcctctttcccagaagcccttagttagtgtctcctcctctgattggcttgagttgggtcacatggtcctccctgaaccttcactttgtcaaaaggttgggctgtacccctgagctgagagwggggtgaatacatttcatctaggccacaggctgacatggggaaagskcaggtccaaagcaagacctgggtgctgtggactggggaggcaacgaggacacagggacccagcaaatggctgcccctgaccattgcagccaccacccagctggtcgtcttcctttcatctttgtccccatctttttttttttttcttttgaaatggagttttgcttttgttgcccaggctggagtacaatggtgccatctcggctcactgcaacctctgcaacctctgcctcctgggttcaagcgattcttctgccttagcctcctgagtagctgggatataggcacacaccaccaagcccagctaatttttgtatttttagtagaaatggggtttcaccatgttggccaggctggtctcgaacccctgacttcagatgatcacccaccttgggctcccaaagtgctgggattacaggtgtgagccactgtgcccggcagtcctcatcttctatcctcaacccagcagccagtgtcattctcctaacacttgggacagacgggacccacctcctctctgctcagaaaccttcagtggctctccgtctccctagggaccaaagccgtattctttacaatttcctaacaaggccctagatgccctgcgcacctcacttctccaggacctcacttcctctccctccagctcccttccagccacacggggaagcacccacttcagggcctttgcatttgcccagaaccctgcctggaattctcttccccagatgtctgtgtgcttcctgccctcactactttggggtcttggccaactgggaccctcctcagtctaaaacaggaactctttcatcttctgtcatcttctacccctcacaagtcttggctttatttttctttatagctagtgctttataaaatagatatattttctttttctttttcttttttttttttttttttttttttttgagattaagtctccctcygtcacccaggctggagtgcagtggcgcggtcttgggtcactgcaacctctgctgggttcaagcgattcttctgcctcagcctcccaagtagctggcctacaggtatgcaccaccatgcccagccaatttttgtatttttagtagagacagggtttcaccatattggccaggctggtctcaaactcctgaccttgtgatccaccgcctcagcctcccaaagtgctgggattacaggcgtgagccactgcgtccggccaaaatagatgtattttctaacagacatacagacatgcatacacaccctccactccaatgtcagcttccttagggcagccactgttgtcttgttcatrgctatatctgcagagccctgtgcagtgtatggtacatagaaggtgctcagtaagtatttgttgagagctgtaactctaaccccactgcctcttcctaacagcccactgagggtctcctctctctcacctacctatccactcttgtcctagggacaggctgggaggccgtagggacaagatgtcacctaccctgatgatttgtgatatgtgtcctggacattggtgtatccattccggtccttgggagtggctgattaaaggcatcatcttcctgcttcctccttttcctcctctttctaggctgccaggatcttattagccctgtttacayrgccgggatgtcgagcgattaatttttaatggcttggtttattgcatgtttgaatggtttattgagtaattctcacatttaagtgattaattctccagagttcagaacgactggttagttttacattaatgggggtttytgaatgccaagagacaatcaatcaakccttcctgccagggagagtaatgttaagatacctcaaggtacaatgaggttaagaagaggcataattaaaaccctgtcctcccctcatgcaaatttgatgtctttctctgtttctccttctctttcttctggtactccccctgtttctcagtacagccctccctgaacccggttgctctttaagaggcgcaagtctccctctgtccctggaggctctgacttccctggtaatgaggcccagtccagctgctgctgggagtgggacttgcttagcgcttggtccccaggaaggggactttggagcagaagaggcctgtagcagaggttcctgatttgcagggaagctgagccacatcctcaggatacaatgtccggtcacaccttgtagccagmcaaagcccaggtgggcctcaggaggacrtccrcacagggagcaagggagggttttgggatggggttttgcctttagattcttcygcagagccctgcgrcctgctgcgctttgagcaggagagaagtgggagctgcttttgcatctgcatgaatctgctgttattactgtagcaaattaccaaatgcagtggcccaacacagcacagattcattatcctgcagttctggaggtcagaagcacgggatgcgtcccactgggctacagtcaaggtgttgtcagggctgcctccttttgggggttctagggaaatatccatgtctttgccgtttccagcttgtggaggccacctgcattgcttggctcatggcctcttcttccatcttcagatctggcagcgttgctgcatctgcacatctttctctgactctggccatactcttccacatttaaaggacctttgtgattactgtgggctcacatggataatccaggataatctttgccttctcaaagtcagatgaccagtaatcttaattccatccgcagtcttcattccccttggtcttgtaatctgacatagtcacagtttccatggattagggcatcagaatctttgtgctttggagaccgcagcattgacaggatgagaaacaagacrgctgacaggttggaggcacagaccctggagcctgataccctggttcagtccttgctcagctcctcaatagctgtggggacatgagtaagtttcccaactgtgcctcagtttccttatgaaactgaggcagatgatagtactgatctcctagagttgtgctggggaaacgaggagtgaagtagttggcctggcgtttggatcatagcaagtatgccgtgttatgtatgtttattgcggtactattcacaatagcaaagacttggaaccaacccaaatggccatcagtgatagactggattaagaaaatgtggcacatatacactgtggaatactatgtagccataaaaaagaatgagttcatgtcctttgcagggacatggatgaagctggaaaccgtcattctcagcaaactatcacaagatcagaaaaccaaacaccacacgttctcactcataagtgggagttgaataatgagaacacatggacacagggaggagaacatcacacactggggcctgtggggggtggggagctgggggagggataacattaggagaattacctaatgtaggtgacgggttgatgggtgcagcaaactaccatggcacgtgtatacctgtgtaacaaaattggatgttctgcacatgtatcccagaacctaaagtataataataaaagtatgccatgttagcagcagtagcagtgctgatacccataaaatgagatggaaactggaatgatgttgcctactttaagaggttgtctaggactcactgagaatgtgggtaaaagtgctaagtggaaagttccttgcaagatgtttacaatcacaaagcaattcataagggtccctgatggagtcttgatgagcaaactctggagagcttgtgtgtgcaaacattgcacagacttgagggacacaagaccccagggacacattaacaggaggcagatggcaataagagctcaacagaccaatgtgagtgaacacactaaggcctctaccctttttccttcaaatgttattgttagtcctttcatctgtgaaagatagttattytcatctgaagactacggtgtagagaggtgcttaacttcaggccacataattaatcatggcagtgattaagagcttgggctgtgaacccacaggtacggatttgaatcttgactacactcaaaggtgggtggcgtggggacaactctgtcacttctctaagcctcattccttcatctataaactggcaatgatactatgccctcrtcattgggtttttatgcggagcaaataagagagatactgtgtgagaagtaycatacccagtgcctggttcttagtaagcgtgctcagcaaggattctggattcatagtggtccgtggaggaatgaattcctgtttgcaagttgtctggtgttagaagctttatggggtgaaggtttggtgtggatcttgaaggactgagaggtgtgatggaagtgaattttaggcagagaggagatgtagaaaggacrgaattctccagcagcaaacattccagcgtggctttagcttcaggtgcatggagaagatggggaaagttggccagagactggtgggctttgtgtgtcaagctaagtttaggcttcatcttgttggcagtgggagctgttgaagagtttggagcaggaaagtaaccagaagcctatagaagaaacccatgttttagggacacgggagtgcagcccatatggagctatcatgccgccagcaaaccaatgtatttttaaaaatttattcattcaacacaaactgatttaacaaaaatatgccagttacgtggtagaratggggaagtaaaatacaaatatgaacttgtcttcctggagcctacgttctggtggtgcttgggagaggtagacaacagccagcaaacacacagcataattatgtatggtaataagtgctatgacaataataaaactagtcaatgcaatattgggttggagttgagtggtcaggaaaggctccagatctcactcaagctaaataagagtgatgagagctggtttttggaagggctagccrggggttccacacagagggtaaggcaaacataggggctgaggaaggaagaagcaggctgtggtccagggacagagagaaaggaaaggccgtggcctgttgggaactaggcaacaggaggtgagcagcaggcaggtgaaccagtgaggcttcatctgtatttacagccactccccattgctcacattactgcctgagctccacctcctgtcagatcaatggtggcattagattctcataggaacatgaaccctgttgtgaactgygcatgtgagggatctaggttgcgtgctccttatgagaatctaatgcccgatgatctgtcggtgtctcccatcactcccagatgggaccatctagttgcaggaaaacaagctcaggcctcccactgattctacatgatggtgatttgtataattatttcattgtatattgcaatatagtaatagaaataaagtgtacaagaaatgtaatgcacttttgaatcattccgtaaaccaacccctactccaggtctgtggaaaaattatcttccacaaaaccagtcactggtgccaaaaaggttggggatcgctgatacagtgtctagatttaactgcagtttgttctgattttattcaactttttcttccactggattattcccatcagcataaaaccttaatacattatttcttctcttgaacaaaacaaccaaaacctcctggggccccaattctctgcacaatctactgttgtctttctttgcttcctttcagagcagagctcttcaaagttgtcttgctgtctcccatatctctccccrcatcctttcttttcctaaaagcttttcatttagagaaggtccaagaatagttcaatacgttctccaatatccatcatatatattcactagttactatcttttgaccccatttgctttgacaccttttctatcgacacatgctgggtttttcttgatctatttgaaagtaaatctcatgatattttacctgtaaatactttttcatggatctgcttaaaaataagaatattctctttgaaaaccacaacatagtgatcaaacacaggaaatttaacattgaaaatataacccatattcaaattttaccatctgtccccaaaatgttctttcaaaaatttcaccttaaaatgtcatgtggcgagactcgctttttttgatgtatagttctcagttctgataaatgcatgcaggcatgtaaccactctggcaatcaagatatgagacagttccaccacctccaaaaattcctccagtcctgtatagttaactcttctcaccgccccagaaacgactgatctgttttgttactatagttttgccttctcctgaatatcatataattgggaatatgcagtatgtaagtctggtttatttcatgtagcatagtaattttgacagtcatggatgttgtcatgtatatcaatagttcctttttattgctaagtagtattccattgtatggatgtaccacagtttgttcatttaccagctgaagaacatttgggttgtttagtgattatgaattaagcctctgtaaacattggtgtaagggtttttgtgtgaacataagttcttatttctctggagtacataggaataggattacttgtttgtatggtaagtatatgtttaactttaaaagaaactcctaaactgttttccagagtgtacacttttatattcccactagcagtgtatgagagttscaatttctccacatccttgttagctcttggtattgtccttaaaattttatggttttaatttgtttttctctagtgactaatgacatttagcatctttcagtgtgcttacttaccgtctgtgtagcttatttgatgaagtgtgaaaatctttggcccatctttggaagtgagttgtttgctttcttattattgattattagttggtctttatatattctggatacaagtcctttagcagatgtgtgatgtgtgacttgcaaatagtttctcccagtctttggcttttcattttcattctcttgatagtgtctttcaaagagcagaattttaaaattttggtgaagtccaggatattaactttttcttttatgagtggtgcttttgatgttgtacctaagaaacttagatgttcttagatctaaggtcacacagatgttcttatgttttttgcagaagttttataattttctgttttatatctatattttacatgatccattttgagttaattatgttttttgtaaacaagtgaggaatgagtcgaggttattatttttacacggagargtccagtttttccagcaccatttgttgaaaagactakcttttcatcacggaattgtccttgtacctttgtcaaaatcaattgattagatttgtgtgagtctattcttggacactctgttcttttctactgatccatgtgactgtgcttttaccaatgtcacattgtcttgatgactgggttttctgtctttttttttttttttgagacagggtctggctgtgtggcccaggttggagtgcaatgatctgatstcagctcactgcagcctctgcctcctggcttggcctcccaagtagctgggactacaggtgcatgccactgaacctggctaatttttttmttttttgtatttttagtagagatggggtttcatcatgttgcccaggcttgtctcgaactcctgagctcaagtgatctgcctgccttggcctcccaaagtgctgggattataggtgtgagctaccacacccagctctatcttgattattataaacttatagtgggccttgaaatcagatagtgtgagtcttccaactttgttcttttagaaattgttttggctattctgattcctttgccttaccatatacactttagaatcaacttgttgatatctaacggtaatcctgctgggattctgagattttgattaggattgaatctataaagcagcttaggtagaaatgacattttaatgatattgaattgtctaatctgtgaacatagcatatctattttttttccttttttttttttttttttttgagacggagtctcactctgtcatccagggtggagtgcaatggcgcaatctcagctcactgcaacctccgcctcccgggctcaagcaattctcctgcctcagcctcccaagaagctgcgactacaggcgtacgccaccacgccctgtcaattttttttttttttttgtattttagtagagatggggtttcactgtgttgcccaggctggtcatgaacttgtattttagtagagatggggtttcactgtgttgcccaggctggtcgtgaactcctgagctcaggcaacccacccgcctcagcctcccaaattgctgggattacaggcctgagccaccacacctggccatctctctatttaggttttctttgatttatttcatcagtattttgtagttttaagcacatttaatgttttgttagatttataccaaagtatctctctcataatttttgatgttattgtcaatgatacttttttaaagaaacacttttcagckatttattgatagtatataaaatataattggtttttaaaatatttaacttgtatcttgtgacttagtcaaattcacttattagttctaggatcttttttgtagattctttggcattttctacttagacaattatgtcttctgcaaatagggatagttttatttatttccaattcatgtgtcttttgtttcttcagtcttgccatattgcactggtttaggactttcagttcaatgttgaatatgcgtggtgaggactgacatctttaccttgttcccagtcttagggagaaagcatcctacttctcactattacctatgtgagttgtaggtgtttggatattctctttattaggataaggaaagtcttctctgttcctagttaaaratttttatgataaatgcatgttgaattctatccattgattttttttgcatctgttgagatggtcatatggtttttctttttcagtctgttactcgtttgaatcatacagatttaaaatattgaaccagtgttgcattcctgggagaagccccatttagtcattgtgtactattctttttatatattactgggcttgccaaaatcttattaaagaataatatatcttcatgaaagatttttggtttgagttttgttttattttgtaatatctttgcttttggttcaaggtaatactggccccacaaactgagttggggtgtgttgcctcctcttttgctttctgggagagattgtgtaccgttagtattatttcttccttaaatgttgggtaaattctccagtgaaaccgtttagacctagagtattctttgttgaaggtttataactaaaaagtctatttctaatagttatatggctatttaaatatatatttcttcttgattgagctttggtactttatgtctttaaaggatttatctattttacctaaattgtcaaagtgtcaggtagaaagttattcctaatattctcttgttatcctttttgtgtctgtagagtctgaagtgatgccacctcattcctgatcgcagtcttttgtgtcttttctcttttttcttagtctttgatcttttcaaagaactagcttttagcttttggctttattgacttttcactatttgttttccattttcaatttcgattacagtcattcaccacatgacattttgatcaaccacagatggcatatatgatggtggtcccataagattataatattgtagttgtactgtaccttttctatgttaagatacaccaatacttactggctggatatggtggctcatgcctgtattcctggccctttgagaagccaaggcaggaagaacgcttgaggacaggcattcaaaaccagcccggacaacagagcagactccatatctaccaacaaaacaaaacaatacatacaattatattacagttgcctacagtattcagtacaataacatgccataccagtttgtagcatagcaagactctatatctaccaacaaaacaatacaatacataccattatgttagtcacctacagtattcagtacaataacacgccatacccgtttgtagcatagcaagactccatatctaccaacaaaacaagacaatacataccattatgttacaatcgcctacagtattcagtagaataacacgcagtaccagttcatagcatagcaagactccatatctaccaacaaaacaggacaatacataccattatgttacaatcgcctacagtattcagtagaataacacgcagtaccagttcgtagcatagcaagactccatatctaccaacaaaacaagacaatacataccattatgttacaatcgcctacagtattcagtacaataacatgccgtaccggtttgtagcatagcaagactccatatctaccaacaaaacaagacaatacataccattatgttacaattgcctacagtatttagtacaataacatgcagtaccagtttgtaccatagcaagactccatatctaccaacagtacrtactattattttacaatygcctgcagtattcagtacaataacatgctgtacccgtttatagcatagcaagactccatatctaccaataaaacaagacaatacataccattatgttacagttgcctacagtattcagtacaataacatgcagtaccagttcgtagcttaggagcaaatggctataccatacaacctaggtaagtagtaggctataccatatctttgctttcaatggccatacatattttgggaggagaaaaatatactttataatttttwaaatatttaccgtttctgtttctctttcttcattcctgagtgctagattcagcattattttccttcagcctgaagagctttaattagcatttctttttaaagcagttctgctagtaattttcttagttttccttcatctaagaatgtcttaacttcattcctgaaagattttttgctgggtatagaattctgagttgatatctcttttctttcagtcctttaaagatgcctgactgtcttctggactccattttttttttcccctggtgggaagtctgcagtcattcaaagtgatattcacctatatttagtgttttatttttctctggattctttgaagatttaaaaaaatatttggtatttagcagttgggttataatgtggttttctggatggtttgcatggttttctttgaatttattttctatggggtgtgctgagcttcctggctttgtagatttgtctttgaccaaatttgggaaatttttagccattatgtcttcaaaactttttctgagccagtctttttcctctcactttgaaacttcaatgacatgaatgttagatctctttatattgccccacaggtctctgaagctttgctcagtaaatttttttctctctgtgttttagattgaataatttctattgatatttgaaaatccccttactcattcctctgtcgtctctattctatggagcagaacttttctttgtttttattttttattctaaattaaraatttacaattgtataaatgtatgggatacaacatgttataatttatgaatacaaggtggaataagtaaatcaagctggttaacacatccattacctctaatccttaacattatttgtgatgagagctttcagaacttactgtcagcgaatttgaaatgtacrgtactctgttacgaactatattcaccatgctatgcaatagaactcaaaatattaatagcttttttttttttttttgagaccaggttttgctcccatagtctctaggctgaagtgcagtggtgcaatcttagctctctgcaaactccgcctcctgggctcaagcaatcttcccacctcagcctcctgagtagctgggaccacaggcacacaccaccacatctggctaatttttttgtacttttgggagagatggggttttaccatgttgcccaggctggtctcaaactcctgagctcaagcaatccacccgccttggcctcccaaagtgctagtattacaggcgtgagcctctgtgcccagcctaaaatattaatagcttttcaggctaaaaatatttgagcattatgctgtgagactctgtgttcttttaacatcctatggagaacatttatttggttgtgttttagccttcagtcacccctgttgcacgcagcctgcaactccgtcttgtcctttgtgggtggtgattccgctgtgagttcagtacaaaggcctgtgctctactgccatgggtgtgtcccagccatgcacaggtgagctgggacctgtgcccgttcatatatagaatctggggaatcctttctctgactggctcccatttcttcagtattcttccccaactctttgagttgcataggttccttttcttggtcttatgtccagagagacaggattttgctcagtcttggctgtgctggaaacttgtctcaggtcaaagtttgagagaaaacaggaaaataaaacaaataggaacctcaccctctgcaggttgcttctccaagttttgattctcttcagtctgcctgttatttttttcactcattgtcctcaggttgttgggttttttgttttgttttgttttttgttttttatttgttttttcattttgtctagaatttttagtcctactcagtaggaaagagggctgaaggaggcttacttcatcctggtgagcatcagaagcctgtggtaatgtaycttaatgccattttttttttttttctgatctgggatcagaaamtgtgcgtggtgttggctgccatgtcyttcaattttgaacacttctttaatatttcattgttgtgtatgctgtgatatttttgcagagcctgggccagtttggtagaattgctctcaatctctcaccctttcttgaatcaaccttttcaagctttttctcacctcttcaatggacatgctttagccaaggctgctggtaacttccatgttgctaaatccaatggatagtcctttgttttcctcctaatttctcatcccattcgattcttcccttcttgaaatactttctctgctcggycccgggacactgttccctctgggtttcttgccctcctccctggccattctcactcagtcctctttattggtgccttcccaaggcctggccactagaccttagaggccctcaggcacaaatctttgtctacactacatctcttcatgaccacttccatcccaaccacttttcttttttctttctttcttttytttttttcgagatggagtctcactctgtcacccaggctggagtgcagtggcatgatctcggctcactgcaccctccatctcctgggttcaagcaattctcctgcctcagcctcctgagtagctgggattacaggtgcgtgccaccactcctagctaatttttgtatttttcagtagagacggggtttcgccatgttggccgggctggtctcaaacttctgacctcaggtgatccacctgccttggccttccaaagtgctgggattacaggtgtgagccaccgtgcctgacctcaaccacgttcaattccatccattcaggaactcccaattacaccactagctcagagatctttacatacacttaataggcacctccaacttaacatgtcccaaataaatttcttaatttcctcccaaatgccaaactcttcccccatggtcttttccatcatagtaaatggatactttattcttccagcttttcaggctaaaaattgtggtatcttccttcattcttcttctggtctaacatttcagtctatgagccttacttaggtatatccagaatctgatcaccttgcaccctcttcctggccaccactttagcgcaggctacccacacctttcacctcctgtaatctttcttctgctctctgcagtctatcctttctattggccgaagtgatcctttcacaagtgaagtcagatcatgccattcctctggccargcccccagtggcctcccacatctgcaagcatgatacagaggcttgcaaggcccttctcagatctccagtatcctccctccactcaccgtgtccttgctacacaggcctgctggctgatcctagaactcatctgaccttgtcttcctcagggcctttgcacttgytgttcctttggggtggaatgcttttccaggtattcacatgccttattccctcacttcattcagttttctgctcagatgtcaccctagaaggaggcctttgatgactgctctgcttaaaatggcattgtgcctctgtgcctcttgagttccctgtccttaccaggttttctttttctccgctgtactgatcttccctgacatgctgtgtttgatttggtgcttatggatgttctttcttagtagaatgtaaactccagaaggggagaaatcatgccagcctagaaccggttttatacctaggtagatgctaatggggatttgtagaattggtggcttagtaaaaatgcttctgaatatacagattttatctctgtcttcaaagctggctccttggacccatccaaactttcttttacagtcatgtgccaggggaagaatggcccctgcctcccagcctcctcctcccaggtcaggtcacttgggccaccaacctggagtccttttccatcccctacccttgccatgcgcaccttgtttcacagccacagtggagatcactctgccagcgtctcccatgacaccacatgccagggccgagaagcatttatcagtcacctgctctcagcagggcagagcccgcttcccggaatgtcatgcagccggccagttctctgtcaytctggatgattgagtgtgaggaatctatcactcagcctgccaggaggcgaggcaggaggcccggtcaccacagctccatctccacgctccttcttggctctccccaggtctatgtcagagccgattaaaggcagataagcctgttctctgccctgcagccggtgacagcagggagccactggccagggccaggccatggctctcatgctcaatagtgatgggtagatgcaactgctgtccagaaacggaagccgagcagatagctgggggagcgacagccccagaatgctgccttcgggctgagctgcctttccggaggcctctcttacaggaaacacccacatacagtctaggcacccagtctgctgtctgtctgacaatttgtattctgcaagatgagttcatacacctttcattgaatattcccacacccgctggatttttcccttaaaatttttttttactagggccaggtgtggtggcttacaactgtaatcccagcactttgggaggcctaggtgggcggattgcttgagcccgggagtttgagaccagcctaggctgttgcctaggaaaattagctgggtgtgcatggcttgcacctgtagccccagctaccyaggaggctgaggtgggaggattgcttgagcccaggagattgaggctgaagtgagacgcgatcgtgccactgccctccagcctgcgcaagagcgagatcctgtctcaaaaaaaaaaaactttgtttttactaaaagtttactctaaaaataatatagttgcgggaatttaacaaatgcatacagaagtgtgcccagctccacaaacaagatacagcatagttccatcatggccccaaattctgccatgtcccctctggtcatcccctctcaccacctggctgccagcggccactgatctgattttggtccttatagttttaccttttccagaatgtcatgggaatggagtcatacagtttgtcgtctttggggtctggcttctttcagcctcgggcatttgagatttatgcacatattcatgttatggggtgtatcggttgttcattctgttttattaccaggtagtattccactgaatggagatttgtgtattcattccctagctgaaggactttgggttggtttctatttttggcagttaggaataaggctatctggctactatacgtatgtgcataaaggtttttgtgtgaacgtacgttttcatttcccttgagtaaatacgtaagagtggaaatgcaggtcatacggtaggtgtatgttgaacttttttttttttttttgagatggagttttgctcttgtcacccaggctggagtacaatggtgcratcttggctcaccgcaacctccacctcctgggttcaagsgaatctcctccctcagcccccccagtagctgggattacaggtatgtgtcaccaygcccagctaattttttttgtttttgtatttttagtagagacagggtttctccatgttggtcgggctggtcttgaactcctgacctcaggtgatctgcccgtcttggcctcccaaagtatgctgaactttttaagaaactgccacaccattttccaaagtgctggtgtcatttgccattcccaccagctgtgcatgggatttccaatttctccacttccttgtcagcacttggtaagggtgggccttaatttcggtcattctaataggtaggtgtacagaaatatcttgtgattttaactggcattttcctaatgagtaataatgctgaataccttttcatgtgtttatgtgccatccatctatcttctttggtgaagtgattcttcaaagcttttgcccattaaaaaaaaaaattggcttgtttctcctattactgggttttgagagttctgtattaaatatatgatttgtaagtattttctcccagtctatggcttgtcttttcattctctttgtagtaaatagcgtctttggaaggacaaaagttcctaaatgtgatgaaatccagtttatcaatttgttcttttgtgggtcagacttctaatgttctaaggaaactttgccttcgtggtttctcctaggtgttcttttagaagtcttatggtttcaggttttacatttatttctgtgatccattttaagttaattttttgtaaggtgtgaggtatgggctaaggttctttttttggtatatggacatccaattgttctttgctatttgttgtaaagactgtcctttctccatttaattatttttcgaccttgtcaaagagcaaatgacactttttttgtgtgtgggcctatttctggactttctgttccatggatctatgtttgtgactattcccttttttttctttttgagatggagtctcactctgtcgcctagtctggagtgcagtggcacaatcttgkctcactgcaacatccgcctcccggtttcaagcgattcttgtgtctcagcctcccaagtagctgggattacaggcgcactaccacaccagctaatttttgtacttctagtagagatggggtttcatcatgttggccaggctggtcttgaactcctgacctcaggtgatctggccgccttggcctcccaaagtgctgagattacatgcgtgaaccaccgtgcctggccttgactattcttttaccagtacctcccacattgtcttggctactgtagcttttgagtaagtctgaacatcaggtagtgaccatacctaccttttcagcaggggggctgctgttctccccactttacagatgaagaaactaaccacaatcatggagtcttcctgatagtctcccttatcatcaggtgttagatgcttagctcatgtttaacacctaatgcctggtgcctcgcatgcttgatgctcaggacatcgcctttgcagtctgggttgggtttgactcttagctctgtttttgttagttgtatacccctaggaaagtaatcttaccccctgtgcctcagtttcttcatctgtaaagtggacgtcacctgccttatacatcgtggcaaatattaaatgagtccatgtatcaagtgaaaccatgtgaaattgctgatctctgaccattttcacagacacaaatgacagttttacctagtccaacctaacatgcaaagcattccttgtagtactggagaaagagtaggttctccagaaaatggtccctgtagctgctgccatgctcactaatacaatgcctgcttctgctgctgttgctatgacattgttattactgaaggtggtggctctgaggctgatgtttcatgttccttgtgccctctaatcaggcagccagtgtctacaaggacttcccaagtggcaagcttcttgctgagtctgccaagagtaatccaaccctttgcagagttggattgtggggcagaagtgctcacctagcaggatacatgtgtgtgcaaagtgcagtgggagaagctgagtgggcaggaggggtgggggccacttcctggatgtggcccattaagggagcctggtaggatggttgggaatttgggatggggggagtgttccaggcacaggtaatggcttgtgtaaaggcttggaaggggcagtggacaagcttcagggggagcctgaggtttgactgttgggtagagggggaagctgcttatggtggcctaggctgcctgcacaactaaccccatcctttgcttccrcaggtcccacccacctctgcctccgccatggctkcaagaaccgttatcattgaccacgggtctggctttttgaaggctggcacggccggmtggaatgagcctcagatggtcttcccraacatcgtgaactacctaccgtgcaaggagaaccctggccccagctatgcccgtaggcgtgtgagcctgggcrtcgacatttgccatcctgacacctttagctaccccatcgagcggggccgcatcctcaactgggagggtgtgcagtacctctggtcatttgtgttggagaaccacagacgggagcaagaggtcccccctgtgatcatcacggagacacccttgagggagcctgcggaccgaaagaagatgctggaggtgaggcctgccggggcctgctcccactcgggagcgggaaacagactgacactatgtctggactgattgggcaccaggaattctgctttttaagataaattgccawccaggtgtggtggcttatgcctgtaatcccaacactttgggactcccaggcaggcagaytgcttgagcccaggagttcaggaccagcctgggcaatatagtgagacccctgtctctataaaaaatacaaaaattagccaggtgtggtcccagctacctgggaggctgaggtgggaggatcagttgagcccgggaggtcgagaatagagtgagctgagatcacgacactgcactctagcctgggcaacagagcaaggccctgtctcaaaaaaacaaacaaacaaaaaaacccaacagaaaccaacaaattgccccacaaacatttcccaagaacctagtgartgcctggtgtgccactaagcaggggagctcayggaggccccacctgcagacggacatgcagcaaccaacgtgcttggtggaaagggggttaccagggagacgtggaatatttgcttatggattccataattgctgatacaggccatgttctggccctcagagagcttccatgaaggggttaagaaataattccaggtagtgatgagttctagaaccataatgaaatgggatcatggtggactgttgggggtggggaacctgtttgaagagagcgctcaggaagggcttctctgacggaggtgatttcagcagcaagagcggcaagaggcaaataggatggtgaggttggaggaggctgggccttgtaggcctggtaggctgtggggagtgcttggattctactttaaatcaaggattggcaacccagtgagccaaatccggcccaccacctattttgtaaataaagttttattggaacatagccacacacattcatttatatgttatgtaagatagaaagagagaggaaagaaaaaagaacatatgctcattgcctggtaggtaaagccctattattattttttaaataaaaactttccaaacatgaagacaaaacaggaattctgatatttagggtttggcagagtgtgctttcatacgacagcatctgagttaagttgttgcagcagagactgtttgagaccatacatcaagttaaaggctaaaayatttactattgtaggtttactaggtaaaatacgtgatgcctagttagacttgagtttcagataaattacaaataatgtcttagtatttaagtatgtttcatattgcatggggcayacttacactacaatattatttattattgatctgacattcacatgtaactgggcatcctgtagttttatttgctgaatttggcaacccttactgtctatccctttacagaaaatgcttgccagccactgctctaagtgaataggaagttcctggggagttttaaatggagagttttaaatgggggagttgtatctgattttctatttgaaaaagaggaccttggctgctattttgagaaatggctggtggggggacaattttctgagagtagtaatggagggagccccctcccactgaggggagacgatgggcttgtgggggcttgaagaggtgagtaagtggctgggaccacagaagggttgactgttaggatctttctgcttctatgggattagaaccttggggaggctgccagagctgaggaatggggggcaggggggctttgtaaagattcagggggtgaggagcagggggagaaaaccagcccagggactctggcaaaccctaaataccagaattccgggtttgtcttgacgtttgtaaggtttttatttaaaagaaaaaataaggcttttcctgccaggcagtgagcatcttttccctttttttcttttttcttttcttttcttttcttccttcctttcctttttccttcgttctggcgtcttttttcttgtctgtcttatctttctggtctgtcttttcyagtcttcctccactgtttggagacagtggtgaatacgcaacacttgtttcttttctaatctgttcttccttctaaagaggcggttcaggctgcacatgtgacccgtggccatgttgctcctgcagccagtgtcccagaaccatttcttgcagccacagagctcttctcacctcttcaccgaagtggtcttctgaacagccacgaccagacaagctcctgagggcaaacccagctccccttctaatcctccagagctgctgcattatcctcactgcataagctccaggggccctgggcgcagcatcctggggcagcccgagagtccccccgaggatggggctctgtgctgacttcagctttgactgctgagcaggctggggggaaatgcactgagtgaattctccctcgttgcagatcctgtttgagttgctgcatgtcccatcggtcctcctggccgaccagctgcagatgtccctgtatgcctctggcctcctgaccggagtggtggttgattctggctatggcctgacccgcgtgcagcctttccaccagggccgccccttgcccgccagcggcaagacgctggagttcgccggccaggatctctccgcctatctcctcaagagtctctttaaggaagattgcgatagacgctgcctgtttcagctggagacagtcgccgtgactcagatgaacaagtgctacgtgccgcagaatctgggggaggccctggaytttcgtgagaggcagcagagtgccttggatgagagcaacacctatcagctcccagacggctccygcgtggagctgacccccatgcagcgggtggctcctgagatgttctttagcccgcaggtgttcgagcagccggggcccagcatcccacgggccattgtggaatccgtggagtcctgcgagatctccctgcgccccctgctggtctcccacgtgatggcctgcgggggcaacaccctctatcccgggttcacaaagcgcctgttcagggagctgatgggggatcacgtctcctccaccaaggccacagtctgggagggttccaatagaaactttagtgtctggctaggagcgtccgtggtggctcacctttctacctaccagtctgagtggatgtcccgagaggagtatggtgagcatatgaggatgtgaccctactggctcactcctgagaatgggctcctgttagatgggcacgggcggattaattttagcaaaatgttctgggtgggggtagaatgaggtggggtggggtgagctggctttggaattctaggggcatgagggtattttttaggttctaaggttttatcttgttgcaagagtgggacctacccaagggggaagacaagatgtcatccttggaaaycctgcaggggacagtttttccagggtggcctatcattggggtatgagtggctgactgccatctccatgcctgagagccactgatttttcattggcatttcccctggtttgtctcattcttcttggttgagtaggttttaactggggtagcactcctgctaggagtcccaattatttttgactaggggatgggggacagttgacatttctggtcctacaggccctttctggccagggaggcattgctgcaggtgagcctgggatgcccttgccacccgtggttggatcttgttttatatctgcaaataaatagcttgtttggaagcaatgctggctcctgtgatggatgggggtagggtgcgcagccccttggggagacttagggagtgtaagtgtgagagagccaggtgggggccagggcgggctctgaggtgtctggggcctatgaacagtggctgccactgagcagaataggcaagggtctggaccccgtgttctttcactgccacattctatccatccatcccaggtgtcccaatattctgtttaaagtttcccttcttattcgtatttgtttggtatatatctgatgcatattcaagtacctagcatgttttaggagctgtgctggaccttggggacttgagaaagatgtacaaggtttctggtttcaagcttacagcctcctgtgggatctattgtagacagtatataagtaaacatatttctgatgatgaagaatgaaatgaatcaaatgtgacacggtcatgtgatctggaggtggagggatggccactttcaatggagtggactgagatgaggttgctagggaccatcagtaactgtgtcttctccttccacggcacactgtgaggcaatgctcccaagtctccagcagttatatagggccaggtggctgagttctggctcagttggcatgcacctgaccttaaaaatactccttcacagcctgtgggatgggtcaatggggaggacgtgtaagccctaggggatggatggcaaatgctgcagatggaaggagcctgagtgcctaggtggagcagaaacccctgcccaaccccaccaacactagcctgtggcatgaggaatctatgttcagccactgagagtgtggggatgtttgttacagcaactgttttgcttactctgactaatacagagaagggagccacaatatactatttatttaataaaatgtgttttctgttaagtgccagaactggggtttgaacccagcctggactctcaaccacagtgttatccagctgtttctgaaagggattcttggctccttaatgttaagagctggaatagagtaacaagtgtagtttggaagactgaagctcaaggaacccagatatctcagggcaagtagaggaatttggagggcagagtccaactcaccttgtctttgaacacatgagccatattctcatgtgtttgctcccacacttgaagcatcagcagtccccagggaaaagagtgggggcctggaataacaattcttaggtagaccaactcagaaccagcctggtgcaagccccagacttggtgtcagattgagtttcaggctggccctatcatgagctgagctgccttgggcaagttatttaacctctttgagtctatcaagtataaaataggaagtaataaccaccttctctcagagatttggagttgaagatgaactaagataggggatgagaactcactttgaagctgtgacgtgctactgaggtaagagaaatgactttcaagcttttaagttgatgtcactcgcctattaaacatgagtgttaataacaatggcagctaccatcgcttgccaggcgttgtggtgagagctttacaaatggaatcacatttaatcctcacgtgcacactgtgaaatgagtgacgtttgtctccacttacaaataagaaaaccaaagatgagcgatgttaaacacttgttcaagttcacactcaagttcaagctaatcatgatttgtcagagttaggaatggattcagcattcctagaacactaggctaaaagtggctgaaacagatttatttgtctcaggcaacaagtagacactccaggtgaacagtgtcaaatctacatcaccaaggtctctctttttctttccatttctccaccttcagcatgtaggcttgttggattgtggtcacaaaacagctgtggcagctccaggcatcaccccctatatttcctgcaggaaaaggaagcatgaagggagtgtcttatctgggtctgtcacttgctattagaaagttgtcacctagcagatttctgtttggctcattacttggaggtagctgaaataggtgacacacaggtttgagtgagctgattcacagtgtctgttccttggcagaggagggctttgaatctaggtctgtccatactaaagcctgtgttatcaccgatagtggcaggctgccttctcagctttctgggccttcttggttcccttggcctgagatgcggatgtgtgattttttccaggcttgtgtgaaagctgctttcggatagcagtcgaggtgtgggcaccctgggcagaaatctttgcatttgaaacccctatatttgtacacacctgagccttaaaaggcagaagtgggggaaacttagaaatgaggacaaggaaaaggagggcctggagaggagatgggcaaggggcattttctttccttatttagctctgggcaactgtcatcagaacccttttcctcatttcattctgaatgtaacatttaacctttctgttcaagcatcaaatctggctgcctagtgtataattatgaacttttcttcactttctctcccccctcccccactcccaaagcttttagaactcccttgttgggtactatctctctcctctgactctccaattaaattaaaaatagcagctccatgggccgtgtggggccttcaacctaatgcggaactgctggcacgcctggcctggcggggtggtacgtggtgcccagaagatgcctgctgggctccagcaagtcctggcagctgctcagagctcgaggaggctcatcctctgtgagaggtctggggctgcctgccaggggcagccaggtgcagaggggagggaggcagggtcttggcagctgggtcaggggctgggtggggctggcagaggggacaaagggaaagagcccccaggcaacccatccccagttctgaggatacagtcctgccaatttctgctgccaaggctggggcttagtacccttgcatctgggtgtgggtagggtttggatgcctgagttccccaagataaccctggcagaaactttaggttctgctgatgcagagaaccaagtcgacattgacactgagcaccctcctggctctagaggagaagtgtgtggcctctcccacctccagggccctttcttagacagatggtaaaatggacaagggcatgagctctgaagccagacttcatggactgcagtccccgctctgctgctttctggctctgctaacctccctatgccttactttgcctctctgtaaagtgggcccaataaagatgcctacctcagggtggcttagatgattgccatatagttttagtgagttaacatacataaaacactaagcgaacaccaggcacatgaaggttagctattatttcgtacacaccagcctctattggccaaatccctaggcacacacctggctcattttatatgtacttgttcacaggcagatagatgctagtgatacaacatggttaaaacataaagtgctggcttagtttccccggggaaaggcattgcagggtaatttcttttcttgtctgaatgttgtggtctgaatgtttgtatccctacaaaattcatgttgaaacctcatccccatagtggtggtggtaaaaaggtggggccttttcggaagtaagtgattgtcatgagggttctgtcctcatgaatgggactaattccccatagaagagggccttgtgtgcctggccctccagtcttccacaatgtgaaagcacagcattcctcccttctggaggatgcagcgataaggcacggtcttggaatcagagagtggaccctcaccagacaccagatctgtgggtgccttgatcttgacctccagacctgtgagccaaacatttctaatctttgtaaattatgcagtctgtggtattttactatggcagcaggaacagactaagacatggagtgatggggtagaatcacattctggacacggaggtatcacaggtgtcggagggtacatggcaccagggagaggtaaacagccagaggtgtcttcttgtaggaaatgatgcctgaggtggctcttgccagaggaacaggactttgcagatgctgttccttttgtttggaatgcttttccccactgccacccccatggttgcctttgacaccttggtatggggggttaaatagatggaacatttgaagtggctggggaatgagagggagtagggaaggatgaaggtggttgttgacaggctcagctcttgaaggacatcaggggtcacatcaaggacagacttgtaagcagaattatgacatcactggagaacrcasggctctctgggtatagctcggagaatataggggctcagagagggatcagacaaagagtgataacatacaccataaaatagatatttcactagactctaggctaacaattctatatcacctgggaccttgttcccctctgatgtcttgggttgggaatttggcttcagtgatacttggggtcttggtgagtttgaggggctaacagatcttccctatcctccagcagtggttgcaattagttatcaattttggagctattttagtgcctgggttatggcaggaaaggcagcccagagtgaaagacttcggaagagtaatctcaaggtggaaaaatgagatgaattcacattgagggcaagaccagctcttcgtcagttgcgtacatctgtgcttgttccattagctcttccgttcagcactacaagtcttggacagctcccctgggcttctcacctcctctcccctctcattcatgatttctggttccaagaagccagtccctactgagaaagcaggaaccctggcggagaggacaaactctgttgtcaaagtcaggcagatgcaggccggaatctctgttcctcacttataagctgtgttgctttgggcaaagcactgcccgtctctggttccatggcctcatctgtaaagtggtgataataatacctaactcataaggctgatatgggaattaaagccatttatccatttagtgaaattcagtaagcactttctctgtgtcctaggccctttgctaggctctgttaaattgaagcatgtttgtaaagtggcttagcagagcttggcacatagtaggtgctcaataaaggtaatttttctccctgaatcactgcaagaaaaatccaggactaaggatgccaggagactccacgatgatgcacgggccccagcacacattcatgctactaggaaaggttccttttcatcctgtccttttgattaacttttccactaacgtgttaggatcttgatatacaaccatcttaggaatcttcagagttttaagaggccctaaaatcagagtatgagaggtgggtctactcttcttctgtaattaatacagagttaatgacactcgcccaaattcaggccattctcctgattacctagatctgtggttgtcccctctacaattacctccctccagggagaggacattgctttcacctaggaaggacaacactgatgaactgaagacacagattcatcttggcaagccttgctgaacaccaggtggggctgctggggacatggagaacagacctgactcccactccttagggtttgatgggagtggacatacccccagggaggtggggggcaggccagagccatctcctctgtaaccctgtgcttgtggggtcatgatcttagcccagctcttccagccagcaaatcagtctcctggagcgactgagagccttgccatgttgctcccactggagacattcggcagggggaaggggttggtcgtaatccgggtttaatttctccagggcctccattatgaattccataactctaccagtcaaaacatgactaattcctgggactgcaacccccacctgggagtagaaagctctgtgctgtttttgctaccttttgtcaccactaataaaggcttggcagtcggaatttagctgctgtgggtggttttcttacacatgtgggctttcccttccccctacggg

SEQ ID NO: 12348 - DNA, 67970 bp, Homo sapiens
caccaccatgcctggctaatttttttgtattttttgtagagacagggtttcaccatgttggtcaggctggtctcgaactcctgaccttgggtgatcttcctgcttcggcctcccaaagtgctgggattacaggcgtgagccaccgcacctggcttttaaatgaaaatttattcatttacaaatatttaagggcatatcagcctcctccagatacgttttgcaaacacctttttgaaccaaacttaatgctaatccctgttctgggtgctggagacactgagataaataaaatatagggtttgttttcttttttattttcctatttctgaatagatcacaaggctttgttttctgagagctccctaacttgtgagtacaccgggtgtgggcagacaccttttctctctgaaatcacacagcatagaaagcagcttgttgagcatcaaatcacaacaagggaggctggctggagggctgaacagtcagtagtgtctttgacagccagggataactagatgttagagttgaggtggcccaaccacaaccccggtacagttctgcgaccaagcactgcctcctgatactctttgcacttccatagctgagcaggacctttattctgtagacatttttcatctttttttttttgagacggagtctcgctctgtcgcccaggctggagtgcagtggcgtgatcttggctcactgcaacctccacctcccgggttcaagcgattcttctgcctcagcctcctgagtagctgggactacaggtacgtgccaccacgcccagctaatttttttgtatttttagtagagatgggatttcaccatgttggccaggcttgtctcgatctcttgacctcgtgatccacccccctcggcctcctaaagtgctgggattacaggcgtgagctaccgcgcccagtcaacatttttcatcttacgtgaaagctgtctccagtcctgggtgctaaatgattgctggcggcattcgcccggctctcacccatgccgcattgatcttactaacatatcactcaggacaggacctggtttccccagtttctcactccttgagggtccctcattcttgcctgcttgttgatctgtgccattttgatgtgattcttggcatccctctgtgagcttctaccttgctttggtcacttttctctcctctcagctgtttttttttaagcagttgtcaatttccttcaatcttccatccagtctctctcctcctaactcgtagcaggtatccttgccacctactttagttagaaaatgtggatgaggtgtaacttccttatacatatgtaggtataagctccctacagaaagcctcagtgcccgacatgagtgccccaggcacctcccagtttcctccttctactactctgtcccttccagtgcttggttgcttttgtgccatctgagtcctttctccctgctctgtccctgtggtggacagtgtgcttggctctcggttctggcctttcctcttattttcccttgctctatactctgcatggcccttgctggtgtgaaaagaaaccaaaaatatttcaccccaaaatatacttctttgacttgttttgatatggctattcagagggcctgcagacaggaatagccctgaaaagctgcttttttgtggaggagatttatatctgtagaggaaaagccacatttgtgaaatacacagacaggctttcgctgagccccacttcctttctccagatccaggaacgactaactcaaccacaggctgccatctattctttctgagatgacttttctttttctttctttctttcttttttttttttttgagacagagtcccactctgtcacccaggctggagtgcagtggtacgatctcagctcactgcaacctcagcctcccaggttcaagcgattcttgtgcctcagcctcccgagtagctgggactacaggtgtgtgccaccaagcctggctaactttttttgtatttttagtagagatggaatttcgccatgttgcccaggctggtctcgaactcttgagctcaggcaatccgcccgccttggcctcccaaattgctggaattataggtgtgagccaccgcgcccagctgacctgatatattttcatctgcagaataagataaccttttcttgctttcttctttcactctcccatcactctgtgtggccacctccctcagagcctggagaaacttggtcccagaccattgttctttgggcttattcatttatcctgaaaataattgactccaacaaccagccctccatccatcttttccccagtgaagagaatatttaaacctcaaccctctggccctcctttgagttaatatcttgtatgactcccttgcacaggtgtgcagtaatgaatctgttatgcttttctctgtgaccctttataatggggagggaagagctcacccattctgcccatacagcattccctcaagtcttgtcttaggtcctcttctttctctctaatttctctccctgagtgacctcacccactcccatggcttgagttgtcatttctgtgcaactcctaaatctcttttttccaactgtttgctgactcctcccccaacccccccatccattctctgccttgttctgtgccttggggcaccttggcctctggcttctggttgagtttagctaatgagaggaatcaggaataggaagctggagactaaagtaattgggatattccttcctctgtttccattctgctccagtgggggctgccttctccacaactgtggctctgccaggggcccttatccacagctccagctcccgctggattcagtgaatgttacatcttctccttgtcccttcaggcctaaggcttcccactgtcattcatccctggatattcaacatctcttaatgacttcctttacccttcccagatcttcaaatctagctgaagatgccttctccttcctgctggtaccctgactgatacataactcctgtctatccctggagcaactactccttgaacatctccgcaggtgcctctgactcaacaggtccagaacagaattcatttccccccaaattgcttttcttcctgatcctgaaattttttttttttttttgagacggagtcttgctctgatgcccaggctgtaatgtagtggtgccatctcagctcaatgcaacctccgccttccaggttcaagcaattctagtgcctcagccccccgagtagttgggactacaggcaygtgccaacatgcctggctaaatttttgtatttttagtaaagacggggtttcaccgtgttagccaggatggtcttgatctcctgacattgtgatcctcccgccttggcctcccaaagtgctgggattacagacgtgagccacctcacccaactctttttcttttgagacagagtctcgctctgtcatccacgctagtctgcagtgatgtgatctctgctcactgcaacctccgcctcctgggttcaagtgattctcctgtctcagcctcctgagtagctgggattacaagcattcgccaccatgcccagctaatttttgtatttttagtagagacagggtttcaccatgttggccaggcttgtctcaaactcctgacctcaagtgatccacccatctcggcctcccaaagtattgggattacaggcgtgagccaccgcgcctggccattcttcctgatttctcaatcttgtttgtggtcaccactatcaacctagttagttattccagctggaaatcttcgagtcatcctagattcctcccttactctttaagtcccatcaatggtactcccttagcatctcttgaatctctttctctcactcccacccccactccctagccaatgccttgataaggcctacattatcacttgccctgactcatgcaaccctgactggttttcttgcctctagtcttgcctccttcaaacccttctttacactgcaggtctcagtgaatttttttttttttaagacagggtctcactctgtcatccaggctagagtgctgtggtgtgatcatagctcattgcagcctcaacctcttgggctcaagctgtcctctcacttcggcctctggagtatagctgggactacatgtgcacactaccattgcccggataattaaaaaaaatttgttttgtagagacaggtgccactatgttgctcaggctggtctcgaactcctgggcttaagcaatcctccagccttgacctcccaaattgctgggattacaggtgtgagccaccacacctggctccagtgatctattttaaatgcagtctgatagtttgtgtcccttgtttaaggcctatctgtgagctagcagggtgtggtgtaccacctgtaatcccagcgctctgggaagtcaaggcgggaggatctcttgaggccaggagttcgtgatcaccctgggcaacagagtgaaattccatctctacaaaaaatttaaaaactggctgaccatggtggtgggtgcctgtagtcccagctacacaggcagctgaagtgggaggatcacttgagtccaggagttcaaggctgcttcaagctatgagtgcaccactgcactctagcctgggtaactgagagagatcctattttttcttttttctttttttttgagatggagtctcactctgttgcccaggctagagtgcagtggcgcaatctcggctcactgcaacctctgcctcccagagagaccctgtattgcaacaaacaaacgaacaaacaaacaaacaatctttctatgactccccagaacctataggacacagtccaaactgtttaccaaggcacacaaggcccttcatgatctgacactccctgctcacaattctgaactttgagtagttcctgctgaattccgtcccttcccatggccttttctgtcagcctgtgctccccttctgtgtgctccccgcttacaattctggaaaacccctgttcacctttcaaaacccatcttgtatgtcatgtcatctaggagcttttccagaacacttccacacagggggattcctctctggtcccttctgcctgaattttttttttttttttttttttgagaccgagtttcgctgttgttgcccaggctggagtgcaatggcgtgatcttggctcactgcaacctccgcctcccgggttcaagcgattctcctgcctcagcctcccgagtggctgggattacaggcatgcaccaccatgcccagctaattttgtatttttagtagagatgaggtttctccatgttgatcaggctggtctcgaactcccgacttcaggtgatccacccacctcaacctcccaaagtgctgggattacaggcgtgagacaccatgcctggccaccttctgcctgaatcttgagcagcgtctacttagagcttcattctttgtcttcctagtagagtaggaggtcagggaccccgttaatctacctcttcatcctcagggcctcacacaaggccagttattctcaaaatgctttgaatgaataatcagagctggcaaagctatttcaccaggggccatggtgtcaccaattcttctgtggactaaatctctgctgaggatcgtcaagtcacccaccctggtgcccagtacaggcctggcttcagactggagcataaccaaatgcagagtgatagagaccacccggttgaggcgtcagagagctgagagtggagagcaggggacccaggcatgaagcaggagggcaggacttggaggaggaatggagctcagtgtcctggagaaagagcagaggctgccaccggctccctggctaagacccaagcaggcgaagaggaggactcattcatccagggccagcccagkagcaagactgccaagcaggccggcccagcccagctgggaggggatttcctcagcctccctcctcctgggctgggcagctttggaacctgtctggaggatttttgtttggggagggacggaggagcgcctggcagagcgggatcttcagggcagcgggcaaccccttggcccaggaagcctggaacgcaaggaccggagggcgtgggctgggacgcccctaccttggtctttcagggtaagatgtgggagctgggagggagtggagggagtcctatgtcaggacaagggggcggcagcaggaagtgcagggccgaggggtgctgtgcaggaaggaggagggacatgtggggtgcttcgctggtaaccccccttctggagtgacctcctggtgtggccgctttggatcctgctactttcattttaaaagttggcagcatgttgggccaggagtcaggggctatcttcccgagggaaatggcagggaagggctgaggatgaggacagagtaattccattcctcttccctgcccttcacactggctttccctccagccatcacgttctcccyagcaccccctaccctcctaagtttttctaactccaactaagccagttcctagccctttgctgacctggacactggagaccacagccagggagacagtctccacttctacccgcaaggcggctcctccagagttatttgtttccttcttcctggtgtgggtatcagagagatttcactcaatctttcatttattcattagtgttcatttgtttattcatcactgtttgagcatatacctggattctctggagggagggctgcgcaatttctgctcctcttgggaataagaaaactgaaacttattgctcaaacatttgatggtcatctacaagctggtgggcagcatggcagagcagaaaattattttggagtcacaragacacttggctttttatcccatatctcctgtttacctcctgagcctcagtttcctcagctataatttttttttaaagagacagggtcttgctaccttgcccaggctgcagtgcagtggctgatcatagcttactacaacttcaaactcctgtgctcaagcagtcttcttgcctcagcttcctgagttaactgaggcacggcggccagctcaaaatgatatttttatgaagatgacagggaacaatgcatgttgaataccaagctgggtgccaggctcattgtggagccttcctaaacacctgtgcttttcccttcctctttgactgccttcttgccatgcctctccctaaccagcaactccctcaccttaggcttgtaaagatatgctagacaacccctggccttgaaagcacgtaggcagcgtgtaaacagaactggccagtgacgggtggagtggtgaagggagagggaaggttgggttccatggctcgctcccagtgatttgggaggccgaggcgggaggattccttgagtccaggagttcgagaccagcctgggcaataaagtgaggccttgtctttaaaaaataaaataaaaaagaagggagagccacataggcatgggattagggaaggtgtcaggtgctggtttgtggtaaaaatactggaccagggctgagtccagacatgctgtgtttctgaatttgcacactcaacactgagcaagtgatgggaaccaccaattcctaaactatggatgcaggctaagggcttttaaatgcattctcttatttaatcataatcctcttatgatattattattaaccctattttatagatggggaaatgaagatacaaacaggttaagggatttgcctaaggtcacatggctaataagtaatggatccagaattcaagtctaggtcagactctaaactccatgctttttgctctggtgcttgctgtctttcaagtttctctgtattagaaagaccmggctgggggcggtgactcatgcctgtagtcccaacattttgggaggctgaggtaggaggattgcttgaagccaggagttcaaagccagcctgggcaacaagcgagaycctgtctcaaaaaaaaaagaagtcctggcacggtggctcacgccagccgtagtaatcccagcactttaggaggccaaggtgggagaattgcttgagtccaggactttgagactggcctgggcaacacagtgagacctcttctctacaaaaaataaaacaaaattagcctggtgtggtggtgtgcacctgtagtctcagctacttggttttttttttgaggtggagcctcactctgtggcccaggctggagtgcagtggcggcatccccatctcagttgattctctcacctcagcctcctgaatagctgggactataggtgcacaccatcatgcccagctaacttttgttgttgttgttgttgtatttttggtagagacaaggtttcatcatgttgcccaggatggtcttgaactcctggactcgagtgatccacctgccttggcctcccaaagtgtggggattacaggcatgagccaccatgcctggcccatctcagctactttgtaggctgagatgggaggatcatttgagcctgagacgccaaggctgccgtgagctgagatcaggccgctgcactccagcctgggtgacagagcaagactgtctctcaaggaaaagaaaaaagaaagaccaaaagggcatcagcattccccaactacctctctagacactggcctttcacttcctgtagatctgctctgggctgctgcatccagactccttccctgattcgttaactcattcactcattcctacatcattcattaaatcaagtgctctgtttatcccctgagactacaaagtttcaagagggcagggatcataagcatgatcctgttcattcagttttataatcctgttcgttcagcacctcattcattcctgatacaaaaattttcaatgaattctttgtgagtaaatgaatttgacaaatatttactgatgcattccatggactaggtaatagggagtcaaagatgaataatgcggaagccctgtcctcagaatgctcacagccttgtagaggagacagttataatacaaagaagacattgatgctctagatgcaaacagaggttgctgatggaactaagaagggcatttaattctaccatgcatcctcggtgcctaacacaatgctaagcatgtggtagatgctcagtaaggctttgcagaggagttgtaaaggacagagtcttttagttttgtttttctttaattaaaaaattttcttttcttttctttaacttaatcccaaatgtgatagtaaggaacagagtcttaaagggggtgttaatacttccctgggacaacaaatggggagtgtgggaggatgttctagcagagggaggagctcatgaaaagacctcatggagagtgggagctggaactgctaggggctcagtgtggctggggcatagggtatatttggggaaatggaaagaaatgaaggtggataaataggcagggttcaggtcatgaggtctttctgtgcctcgttaaggaatctaggctttaaaccaaagacattggatacccattgaaaagattttggctgggcgcggtggctcacgcctctaatcccagcactttgggaggccgaggcgggcggatcacaaggtcaggagttcgagaccagcctgaccaatatggtgaaaccccacctctactaaaaaaaaaaaattagctgggcatggtggcgtgcacctgtagtcccagccactctggaggttgagggaggagaatcgcttgaacccaggaggcagaggttgtagtgagtcaagattgygccgctgcactccagcctgggcaacagagtgagacactgtctcaaaaaaaaaaaaattagcaatgagaatgacactacctgatttgcatttcagaagtgaggctgatgtgtaggggcctaggatatgaagacgccaaggttttcaggcctgatgggtccccacctatctatgaaaattagtcttcctttttaagacttcagcatggtttgttcatgaaggatctcttgagttggcctgttcctgatgactggtactttgccctcagctgtatactgggtcacagtgaatctgttcctcctaataaaagtttggaaatttataaatagtttccttttgtataatctggaataagttcaaggatactacttgcaatamcttgtgctttcttatgccagagagctagagatggaggtgtagaagggtttccaggaattatatctagctctgagtgtgcccagtgagggtgtgtcaaactagccagtggtcctggaactggggatgcgggggcacagataacattaaaagagtccatttccagattctcagcttctgcagggactcttgcctaaaagtcatctgcttgtctggattcttttaagttctccttttcaactctgttttcattgtttctcttctttggctttataagaaagttacacctctgtccatcccaaattcattgaacaaggtccattgttcaaaaggacagttagagaatgctgtgttcctgagagatagcaagtaaagagagattaggcaggagaaactaaagggtgctgtgcctctactacagactcgtagtatttgttttatttaagaatactcggccaggggccaggcgcggtggctcacgcctgtaatcccagcactttgagaggccgaggcgggtggatcacaaggtcaggagattgagacatcctggctaatatggtgaaaccctgtctctactaaaaatacaaaaaattagstgggtgtggtggcgggtgcctgtagtctcagctacttgggaggctgaggcaggagaatggtgtgaacccgggaggcggagcatgcagtgagccgagactgtgccactgcactccagcctgggtgacagggtgagactctgtctcaaaaaaaaaaaaaagaacactcgagaatactcggccaggcatggtggctcacacctgtaatcccagcactttgggaggccgagttgggtggatgacttgaggtcaggagttcaagaccagcctggccaacatggtgaaacctcgtctctactaaaaatacaaaaattgctgggcacggtggctcacacttgtaatcccagcactttgggaggctgaggtgggtggatcacctgaggtcaggagttccagaccagcctggccaacatggtgaaaccccatctctactaaaaatgcaaaaattagctgggggtggtggccagcatctgtaatcccggctattcgggaggctgaggcaggagaattgcttgaacctaggaggcggaggttgcagtgagctgagatcgcgccattgcactccaactgggtgacaagagcaaaactccatcttgaaaaaaaaaaaaaaacccaaaaagcaaaaaaccaaaaattagatgggtatggttgcatgtgcctgctgtaatcccagctactcaggaggctgaggcaggagaattgcttgaacctgggagacagaggttggagtgagccaaggtcatgccactgcattccagcctgggcaacagagtgagactccatctcaaaaaaacccccaaaaaccaacaaacaaaaaagaatacttgtttattcaacctgaggaagctgattaagtaaagccagaaaataaaacataaaataaaaataaagaaataaaaatatttgtttaggctgggcacagtggctcattcctccaatcccagcacttaggaaggtcgaagtgagaggatcacttgagcccaggagtttgaatccagcctgggtaatgtgacaagacctcgtctctacaagatttgctgggcgtggtggcatgtgcctgtggtcctagctatttgggaggctgaggtgggaggatatcttgagcccaagaggtcgaggcttcagtgagttgggtttgcatcactgcactccagcctgggcaacaaagcaagaccctgtctcaaaaaacacccaaatagggccgggtgtggtggctcatacctgtcatctcaatacttcagggggccaaggtgggcagatcgcttgagctcaggagttcgagaccagcatgggcgacatggctaaaccctgtctctacaaaaaaatacaaaagttagccaggtgtggtggtacacacctgtagtcccagctacttgggaggctaaggtggaaggatagcttgaacccgggaggcagaggttgcagtgagctgagatcatgccactatactccagcctgggtaacagagtgagaccctgtctcaaaacaaaacaaaacgaaaaatttgctcaatgctaattatgtgccagacactcttctaagaattttacagataataaactaattcaatactgataccgaatctataaagtagatatttaccaccctccttttacagatgatgctcccaaggcacaaagaggtttaataagttgcccaaggtcacagaggtgtcaagtggtgaaatcagaatttgaattcagacacctttgaattcctctagaatttgtgttttagccattatgctatattaaacttaagagctttagctctttatttatgtgttataaaattagaattgagacatgagccagttgtcatggggatgcaaattaatgcatttatggaaccttttaaaaataaaggtagattttcttatggacagaaaatctctttgatttggctaattggtttgacagtgaggacaggctttgccaactggattatgtggtagacattttccataaactgaacaagtgaaatctgtagctctaaggtttggatgaaaatgtatttaaaacatgtctctaacaaagactatgacaaaaaatttgatcttggagccgattttaacttgtaaaaaataattgtagttattaacttaaaaatgtatgagacagaacagagcttctttaaaaaaattttttttttttttgcgactgagcctagctttgtcacccaggctggagtgcagtggcatgatctcagctcactgcaacttctgtctcctgggttcaagtgattctcctgcctcagtctctcaaatagctgggattacaggtgcctgccaccacacccagctaatttttttgtatttttagtagagacggggtttgactgtgttggccaggctggtctcaaactcttgacctcgtgatctgcccgcctcggccccccaaaatgctgggattataagtgtgagccaccgcgcccagccattttttttttttttttgagacagtcttgctctgtcactcaggctggaatgcagtggcgcgatctctgcattgctcactgcaacctccacctcccgggttcaagcgattctcctacctccacctccgagtagctgggattacaggtgcccatcaccmctcctggctaatttttttgtatttttagtagagacggggtttcactatgttggccaggctggtctcgaactcctgacctcaygatcttctggcttcgtcctcccaaagtgctgggattacaagtgtgagccaccctgccgggccattttatttttatttatttatttatttttgagacagtcttgctctgtcatccaggctggagtgcagtggcacaatctcgactcactgcaacctctgcctcttaagttcaagcgattctcttgcctcagccccctgagtagctgggattacaggcacccgccataacgcctggctaattttttgcatttttcatagagatggggttttgccatattggcaggctggtcttgaactcctggcctcaaatgatccacccacctcagtttcccaaagtgctgggattatatgcgtcagccaccacacctgacattcttcaaaatttttatggggatttatgaagacttgtggacacagcacggtggataactcctgtaatcccagctctttgggaggccaaagkgggtggatcatttgaggtcaggattttgagaccagcccagcctacaagtgaaagcccatctctactaaaaatacaaaaattagctgggcatagtggtgggcacttgtaatcccagctacttgggaggctaaggcaggagaattgcttgaacctagaaggcagatgttgcagtgagccaagattgtaccactgcactccagcctgggcaacagagcgagactctgtctcaaaaaaaaaaaaaaaaaaattgtgaagacctgtgaggtatgacactgataaacatcgccggccatgtgtttgctggtggggatgaagtttctggttaggtgaggggaagtagcttatccrtaggtaagcaggggcagaattggagcaaggaccaggattttctgactcctgcaatgtcagagctctttccatgatacttcccttttccttccttctccattcatgggattgttaattcagcaaatacttgctgagaaatattttccactttygtggagstcatattctagcagaaagagacagacaataaataaactaactatttttagataatgataagtgctgggagaatataagtggggaaatgtagtagagcatataggggtgcgggaaggcatgggcaggggagacttcctagggacgtgctacaggttatgaaggatcaagaccaaccttgtgtgtatgagttgtagggaagggagagggctaggtagaaggaacagcaagtacaaagaccttgagacaggagaagatttggtgtattccagkaacagaaagacgtccctgtggctgcagcactgagtcgttgggagaaagtagtagaaagtgaattccacaaagaaggtaggagctaggtcatataggatcttatcatttgccattaggatcctatatctatcccaaagacaatgggaaaccattgaaggatttttaagccgagagttaatacactctgatttacggttttgttttgcttcattrttggagggaggcaggagtggaaacagagtgaagactaatttgggagggtaatttcgggtcagacatcagtaatctactcaatggaagaatacaaagatgaacaatgtgaatggaaagaaaggcagaatggtgtgagatgtcattctgtcttctggttctgatgaggcatgctggtagctattactgtgtaacagatcaccccaaaatttagtgactcaaaacaagaataggtgtggtggctcacgcctgtaattccagcacttcaggaggccaaggtgggtggatcgcgtgagctcaggagttcaagaccagcttcggcaayatggcraaaccccatctctacaaaaaatgcgaaaattagttgggcatggtggcgctcacctgtagtcccagctacttgggaggctgaggcacaagagtcccttgaactggggaggtggagcttacagtgagctgagttcgtaccactgcactccakcctgggcgacagagtcagaccttgtctcaaaacaaacaaataacagaaaaaccaagagccattttatttcttcataattatgcaagtcagggatttgggcagggttcagctgagcagttcttctccatgtagtcatcagctagggtcattcacagctgtattcaactggtggatgagctgggctggtaggtcaagaaggttccattcataggtctggcaccttggtgcttttctttatttcattttcacatgactttttctttttttttttttaaatcaggcaacctcctgagccagaccaggctcagagagactcctacttttgtgctcttctacatggcctctctttccatgtgggcaccttgggctttctcatagaatggtggcctccaggtagtgttaggttatatggtgttaggcttcaaagaggaagcattcccaaaggagcaaaagtggggaccacatagctgttaaggcccggccctgcaaagtatccagcatagcttctgccacgtagtattggtcaaaaccagtcacagggctggcccagacttaaggagaggagaaacaaacccaaaccatatctctcagtgagaggaatggcaaattatatgctccgtctttagtctaccatccttggcttctgggaactgaatagccctaaccatgctgatggtgctgacccacttttaaatctaaaccacagtatactatgttggaacaatttataggtctttattccccagtgaatagagagggactggagaacaggaggtggtttccttttctttctttcttttttttttttcccatgtgtttccagagcctaacacatacaaggcattcagggaatgctaccactggatgcacacatcacataagcattcactggtagttgaaacatgatgtatataagaatcccctgggagctgttaaaaaggcatgcagatttcttttttcttttttcttttcttttttttttttgagacggagtctcgctctgtcacccaggctggagtgcagtgrcgtgatctcggcttactgcaagctctgccttcctgggttcacaccattctcctgcctcagccttccgagtagctgtgactacaggcgcccgccaacacgcccagctaattttttgtatttttagtagagacggggtttcactgtgttagccaggatggtctcgatctcctgacctcgtgatctgcccacctcggcctcccaaagtactaggattacaggcgtgagccatagtgcctggccgcctgcagatttctgaacaagacctgagcccagaccctctgaatccaaatctctagggcagaagttttcagtcttggctgtacatgaaaagatacaagtgccaggccttcaccccagagacccagtttctgttgatccggggtgaactcaaacacatttaagtctcttcagatgattctgatgtgaggccagggtgaagaaccagtgccctaggattagaagcagccatctctgctaacctccccagatgattctgatgcaggtggtccatgacagggtgaccaacacccttggcttgccctgattttagcactaaaagtctcacatcccaagaaactcctagtcctgtgcaaaccagacagttggtcattatcagtggaccactattgaaaaaaaaattctacacgaagcagtgaaagccttttttgagaaatgcccacaaatatctactgaaagccatgattttgtctccttacttaagggcctgggccaactgtccttgaattaagggggaagtggctcagggtcactgttttccttcagccctgtgctctggtgtgctaggtctgttaactcatgtaaatagtgtgtctgtctttgggaattctttcagactatatcccttagtgcgcacaccacagctttgaaagcccaatcaccatcaacaaagatgatgtgtttaggataatacaagatacaggatgaaattcctatgtcttctgcaccattgtgtattattattactattacaaatactataatagggtacacaaatatatgtaatatgttaaatagctgtggggcggcccagactctggtctgagattcccaggtttgtgccycagctttgctgtacctaggtatgtaatcatggatgcctcttttttgccctagttatttacctgtaaaatgggaataataaagaggtcttcacagagcagacgggaggatccagaaaataataaaagcgaaagtggttctgtagagtgagaaggctgagtattatgatggtctttgaatgggaaggacttgaagacattattccgccgagaggccctgcatgtgactggggctctggtccccctaccctgaaccatagcccacctgtgaagtttcaaggaagaaacttttgacgcagagtggaccatggagagagctcaggaagcagagttctctaccttagctgcccttactgctgatgtcaagtgtgctttgcttcagcaaaaagcaaagcttttggaaacgggggtttgtgaaggcattttttgttttcaaatcttttgcctatttattccaagtgtatcctcagaaatgcagccaaaagaaaacaaccacaaccacaaacctgtaatattgaaaagccagttcttaatttctgtagctaaaaaagcatcctttcaggctgtaaccacagagagattgctgcaggcctctggcataatgatggtttgcagtgtgatgaaggaggctgctaagctctgtggcccagaagtccaatcctggcctctccaattacccaggcgcctagcaacaccaccgaaagtctccctggcagccccagctgggcagcaattggctacacccagcacagcccgctgcccagcctcctgagctccccagccacatcaaggcgggtctcagccccggcaggggcctgcctggtaccaatgaatgggtggggccagctgtttagaaaaaacaattcagatatttaaaacctccctgtttgaatgcagctaggcaagcggcacaagctcacaactaaaagtgtctgccatggaaaaggagttgtcataagggtgttggccttgccagggccttcctgggtgaggcgaagaagggaaggtgagcctgatttagtcctctggcttctcaaagaggcaaatccttttcccgtcctggacgcttgtgtccacctagagtcctcgtcgtagcagtggggatggtgggaattcccagccccatcttctcccaggggtagtgacctgccacttcctctacagcttccgttcgggaattcacagggtctagtctgggactgtctaggcagctggaggaaaaagagggagctaagagtacaggaaaggatgggatgaaaataaccaaaaagaagattcacacttcttttgtttaaatttttatttttatttttatttatttaggttttggagacagggtttcgctctgtcacccaggctggagtgcaagtggcaccattgtagctcactgcaatcttgaactccccgtttcaagcgatcctcctgcctcagcctcccgagtacctggaagtgcaggtgtgcacaccactgcacctggcaaactttaatttttaatttttttttgtagagaaaggctttcgctgtgttgcccaggctggtctcaaactcctggcctcaagcaatcctcctgcctcggtctctcaaagtgctaggattacaggcatgagccaccatgcctggcccattattttttatttaaaattttttttttacatggccaggcacagtggttcatgcctgtaatcccagcacgttgggatgccgaggcgggtggatcacctgaggtagggagttcgagatcagcctgaccaacatggagaaaccccatctctactaaaaatacaaaattagccaggcgtggtggcgcatgcctgtaatcccagctactcgggagggtgaggcaggagactctcttgaacttaggaggtggaggttgtggtgagccaagatcgtgccattgcactccagtctgggcaacaagagcgaaactctgtctcaaaacaaaacaaaacaaaacaaggccgggcgccgtggctcacccctgtaatcccagcactttgggagcccgaggcgggtggatcaagaggtcaggagattgagaccatcctggctaatacggtgaaaccccgtctctactaagaatacaaaaaaattagctgggcgtggtggcaggcacctgtaatcccagctacttgagagactgaggcaggagaatcgcttgaacccgggaggtggaggttgcagtgagccaagatcgcaccactgcattccagcctgggcgacaaagcgagactccgtctcaaaaaaaaaaaaaaaaaagaaagaaaaaaatttacattttaaaatcttcaatttatttatttatttcagagacaggatcttgctctgttgccaaggctggagtaaattttcatttttaactctaatcccatcacagttgaaggagtacctttctataacacttggtgcgtagaaatcacaggggctgtggaacatgtgggggctttggagtcaggcgcccgagactcttctcccagccctccccttattagctgtgagaccttgagtaagttactttgggagcctgggtttctttatccttaaaatgggaatattattaccctgctttacaaagtggtaaaaattaatgaagacaatgctcataaagtgtttagcctggatgctggcacacagtaagtgtttattattctagtacctctttattattttatttgattcttaccacaattctgtaagatactcagggcagaggtgagctctgttttacagctgaggaaactgaggcccagtggaaaactaaatgtggatgctgggagtagaattcaggtctttatagtgtcaaacacaaggcaggctattctcaaaggcagatggcaagccctttttttggtagccattatgacatggcagcttcacagtgatggtgcccagtgatggtagaatgataatggaagtggtgcggccttgcagaggaaaaggttggtaggaggctcttttcttttctttttttttgagatggagtctggctctgtcgcccaggctggagtgcagtggcgcgatctcggctcaccgcaacctcygcctcccaggttcatgccgttctcctgcctcagcctcccgagtagctgggactacaggcgcccgccaccacgcccggctaattttttgtatttttagtagagacggggtttcaccatgttagccaggatggtctcgatctcctgaccttgtgatccacccgccttggccttccaaagtgctgggattacaggcgtgagccaccgcgccctgcccggtagaaggctcttttcaacataaagtcacacaaagacttagtcaatgtgtggttggaattcctccttcccccttttccctcctctctttctctccctgtctctttccctccctttcttccagaagcattccttttaaaaaacattttaaaaaaaataactctgatgttttgtatggaatgcttcacgaatttgcgtgtcatctttgtgtagagaccatgttaatcttctctgtattggtccggtttttagtatatgtgctgctgaagcgagcaccacaagcattcttttattgattgattggttgagatagggtctcgctttatcactcaggatggagtgtagtgccacgatcttggctcactgcaacctccacctcccgggttcaagcgattctcctgcctcagcatccccagtagctgggattaaaggcatctgccacctcacctggctaattttttgggtacttttcgtagagatggggttttaccatgttggtcaggctggtctcgaatgcccgacctcaggtgatccgcccgcctctgcctcccaaagtgctgggattataggcgtgagccaccgcgccctgcccgagtcaggtttttttattgcaaaagatgggaactgattctggctaattaaatcaggaaatgaattttattgaaagcacattgagtaagttacagaatcacttgaaggctgtagaaacaaggcttgggaaaaaagcagaaacagagaccaggtacctagaattacaccaaattccatcacagagccagataggtgaggacagcctcagtgctgctgctgctgaacgcccmgtgctgctgcstttgtcacagccacagctggcgttggatgctggatgccatgctgaccccagtggcaaggcgtctggacactggatactgctgccactgctgcaaccactgtaaagaattttttccatcctcacctccagcctcagaaatcctaagcaaatgcagctgattggtcaagctgccctagctgcctagggacatgcaaaagtgaatattgggcatggttaatgtctgtagtgggatccgtttcctgctgcccaccaggagaagataaattccccaagaaaactgacaaatgacgactacgtacatgttgtcaaagaatccactggaagtctttgacatttgcagattcaacacttgcaattttggtaatttattagttactcccaaaggcccattataaatgaatatgagttgaatgattggctttgcctgttagtgagccaggcctactgctctgcctggatatctcacatgactgttatcctttaygtagtttgcatgcagtgattaaaatatttgtttcttgtttgcagagtagaaaagattcataaaataaataatccaatagtgccagtgatataaacaaagagaaagtggggaggtataagacagtaactttgttttttggctacaaatagaagttttggataaattggcatgctgtgtcaagttcagtggtgtctaagatccctgatatcattagatccaccatgtgtgtcactgagatacaaggaaaagttgttcagtgagtgcatcagccaggctgctcatcaagagagagattaaccttttttttttttttgagacagaatctcactctgtcgcccaggctggaatgcagtggcaaaatctcagctcactgcaacctccgcctcccactgcaacctccacctcctgggttcaagagattctcctgtctcagcctcccgagtagctgggattacaggcacatgccaccactgccggctaatttttgtatttttgctagagacagggtttcaccatgttggtcaggctggtctcgaacgcctgacctcaagtgatctgcctgcctcggcctctcaaagtgctgggattacaggtgtgagctaccatgcctggcctggctatactttacaatgtaattttgggagacactatgtggtatgtagtgcattagggcatctgaaaggtctggaaaaatctcttgcaaatgtcaggagtctcctatgtaaatctctttatagaaatctcttttcggctgggcatggtggtttaagcctataatcccagcactttatgaggcctaggtggatggatcacttgaggtcaggagtttgagaccagcctgaccaacatggtgaaaccctgtctctactaaaaatacaaaattagctgggtatggtggtgcatgcctgtaacttcagctacttgggagtttgaggcaggagaattgcttgaacctgggatgtagaggttgtggtgagccgagatcgcaccattgcactccagcctggcaacaagagcaaaactcaatctcaaaaaaaaaaaaaaaaagaaaaaagaaatctcttttcaacagattttttttttaaggtagtcaattgtcctgagtaaatgagcacagtcctgccctttcaagtctttggccaatacactggctctgtgattgttaacaagtaatgcttattctaggcaaagtcaggaagtagcaaagttccttccgtgtttccttgttttttttttgagacggagtcttgctctgtcgcccaggctggagtgcagtggcgcaatctcggctcactgcaacctccgcctcctgggttcatgctattcccctgcttcagcctcccgagtagctgggactacaggcgcccgccaccacgcctggctaattttttgtatttttagtggagatggggtttcactgtgttagccaggatgatctcgatctcctgaccttgtgatccgcctgcctccgcctcccaaaatgctgggattacaggcgtgagccactgtgcccagccctgtgtttccttttaagagtacttgtggccaggtgggatctttctatgtttcctcttgagaatacttgtggattacaggctctctcacacctgtaatctcaatgctttgasaggtcaagcagggaggatcccttgaattcaagggtttgagactagcctggacaacatggggaggccaccatttcaaaataataataataataaagtttaaaaactttttttttttgaaaaaagaatacctgccaaccatgaaggaaagggttttggttcttttctctccctccccaatccttagaacccatgaaagggttttggttcttggtgtgcataaggaacatttccatttttaaccagaaggctagagacattctaacaatctactcagttgttccctacctgtaggatgagaacttctcgcagcagtgccacccagttttgatctgtgtatgcgaggcctttcaaaaaagagtgggcagcaacttgctgcagataagaggtaggaggtttgcttagtgagtaagaaagcagagtcagtgcagtaaatctccacccagtgaatgacacccaataagtgagtgctcgagtgccaagtaaatgaatggacagatgttgatgcttgaatatttctttgagactagaatgtgttgtaatcattattttgttttgagactcctgmtccattcaattgggcttccaaaaattctggtaatctgacgtgtgtttctgaacgctgtatcccargtttgacctatagagcccatggagtttatatacaggccatgcccaaggaaggacaaaattaatgacaacatgaccttcgattagatttgctttgtgaggctccagggagggaaaccttggacccaggagctggtgaatagattccagcagtgtaaggaagaactacccatgaattagaactgttagaaaatacagcaaccccgctgaagtccatctaggttgtttataattcttcatggctatgaatagttctgcatgaatatccttgtaatataccattgtgtatgtgctcaaatacctttgaagggtggatttctagaggttggatgtttctgttgaaaggtatatgcttttaatagtttatacacattggccaattgctttccaaaaggctgcattaatttayacctcatacattgcacccattgccacacacctcataaatatgggatattctcagycttttttttttcttttttttgagatggagtttcactcttgtcacccagggttgagtgcaatgacacgatatcagctcactgaaacctctgcctcctggtttcaagtgattctcctgcctcagcctcatgagtagctgggattacaggtcttgctaccatgcccagctaatttttgtatttttaacggagatgggtttcaccatattggccaggctggtcttgagctcctgacctcaggtgatccaccgacctcggcctcccaaagtgctggtattacaggcatgagccactgtgcccggcctaagtctttttcattgttaccaatctaataggtaatatttcctcagaaattcaggagtggggcagaagataaacgtgagcgggagagatgaggaaatgttagagactggaaggagcacctgtgagcattatagcaccaggtattggagataagataaatcagagagaggcccctgttctcaggaaacagggtggagaggtatggaagttggaggatgatagtaattgagaagagaggtaaaaccaaaatgcagtggctcacacttgtaatcccagcactttgggaggctgaggcgggaggatcgcttgagcccaggagtttgagaccagcctgggtaacacaagaagaccccatctcaacaaagaaaaaaaaaatagctgggtatggtggygtgtgtgcttgcagtcccagctacttgggaggctgaggtgggaggctcacttgagcctgggaggtagaggctgcaatgagccgtgatcctgccactgyactccagcctgggtgacagggagagatcttgtctcaaaaaaattaaataaaaaaaccccaaatgtttctaattgctagtaatgtgctcatttggtgctagagcctgaagtagctagaactacatgtctactttacaaggcaaggcagaaagcagacatgcagtgagttttggctaaaccggttgggtcaactatctttgcagcacaggaaatatatttaggcactaacatatttaaaatggtggtcttgaagttgtaaaatttctggaactgttgaaatcccaagataagggcaaatgtaatccttatttttgtagctccttttatacagttgtattgttaacaatgtgacattttatttcctcataaaatgattatgtatgatayttagatacaaaaaggctgatttatacaatgtgaactgtccctaattgaacttatttttaaaatgctttaatatttgtggttaaaagctgctgatcttaaatccacattgtagttttgtcaattatgagacgtggcaaaaagtagaaaaaaatcatcagtcttcaagggaaattaataaaagagttatatctatggactgaatgtctgactctgggaggcgggtgagtgggtgggtgaaaaatgcaggggagagaaaaagcctttattttcagaaaatttgctggggaaaagaaaaataagatgtctcttcctcaatttattgaatataacctattctaatgtgaaaacttgcctaatgagtttcatttgaaaatcagttgaatttgatctgattcccagtaacatgcagtgtgaaaacaggcgccaggctcagctccatgccttccatctatccatccatccatctaaaactcattcatccatccacagccaataacaactaataattatagggtgtttactacrtgccagatacagttcttttctttttcttcgagacacagtcttgctccatcacccagtctggagtgcagtggtgtgaatttggctcactgtaacctctgcctcccaggttcaagcgattctcctgcttcagccttccttcagctggaagtacaggcacgtgccactatgcccagctaatttttgtatttttagtagagatggcgtttcaccaggttggccagtctgttctgaaactcctgacctcaagtgatgggattacaggcgtgagccaccacgcccggcccagatactgttttaagtgctttacatgcattatctcaagtaagcttcccggcaatgttatgaagcaagtgctatcattatcctcagtttaaaatggaatctgagggtttcccaacaagttaaacatagaattaattaccatatgacccagcaattccactcataggtatatgctccccctcaaactggaaactgatgtttaaagaaaacttgtgccaggtgcggtggctcatgcctgtaatcccagcactttgggaggccgaggcgggcggatcacgaggtcaggagatcgagaccatcctggctaacatggtgaaaccctgtctctactaaaaatacaaaaaaaaaaaaaaattagccaggtgtggtggtgggcacctgtagtcccagctactcaggaggttgaggcaggaaaatggtgtgaacccgggaggcggaggttgcagtgagccgagatcacaccactgctctccagcctgggcgacagagtgagactctgtctcaaaaaaaaaaaaaaaaagagaaaacttgtacagggatgttcacaatagcgaaaaggtggaaacaacccaaatgtccataaacagacgagtggataaacaaaatgtggcgtgtctatacaatgcaatagcattcagccattaaaaaaaggaaattctaggccaggtgtaatggctcatgcctgtaatcccaacactttgggaggccgaggcaggtggatcacttgaggttgggagttcgagactagcctggccaacatggtgaaaccctgtctctactaaaaatacaaaaattttctgggtgtggtgccgggtgcccataatcccagctacttggtaggctgaggcaggagaatcgcttgaacctgggaggcagaggttccagtgagccgagatcgcaccactggactccagcctgggtgacagagcgagactacatctcaaaaaaaaaaaaaaaaaaaagaaaacatgtgaaggaagccaaccacaaaaggccacatactggatggtacatatgtattgtatgatttcatttatgtgaaatatccagtataggtcaatctatagacacagaaagcagattagtcgttgccagggactgtggtaagaggagaataggaattaactgcttaacaggtatgggtatggggtttttgtttgtgatgaaaaagttttggaactagtggtgatggctgcacaacattgcaaatgtactcaatgtcactgaattgtacactctaaatggttraaaacagggccggcttcggtggctcacgcctgtaatcccagcactttgggaggcctaggcgggtgaatcacttgaggtcaggagttcgagaccagcctggccaacatggtgaaaccctgtctctactaaaaatacaaaaattagccagggagggtgaagcagaagaattgcttgaacccaggaggcagaggttgcagtgagctgagatctcgccattgcactccagcctgggcagaagagcaagatgactccacctcataaaaaaaaaaagaaaaaatatatattatatattaaatggcgaaaatggtaaattttatgttatgtgtatttcaccacaatttaagaaatatgtaatttgaggcttggagaatttaattaagtgatttatctgatgttaacttacagctgatacatggtagagctgcattttaatctcagtcatctggctctttttaaaacaattacagagaaaactttattttgggccatttaggaggtttagatcattttgatcatcttcagctgtcttctcttcacatacaggaaaggccttggaaagcagtcgttgcgccagacagcccagggaagagcggcagcctgaggacctagggccacctgctgttccctgggattcatgtccttctggggaggagggaggacccaggacaatggctgctgttcatgatctggagatggagagcatgaatctgaatatggggagagagatgaaagaagagctggaggaagaggagaaaatgagagaggatgggggaggtaaagatcgggccaagagtaaaaaggtccacaggattgtctcaaaatggatgctgcccgaaaagtcccraggaacatacttggagagagctaactgcttcccgcctcccgtgttcatcatctccatcagcctggccgaggtgaatggggagcrgggtgggcaccggggtaagtggcatggggaagctgggaacaaactaggggtcagatctagatctagagaagagactgggaacatgggagagagcttcgtggggatggggacagcacacacctcacctctgcctctgctctccccacagctgcctttgaggctttccctatactcacggtcactgccaacccagggtggagtttcatttgtcagacaaatctgcccagctgtggctgcaatttcagtggcttcctttcattttagttgtgaggtctttaggaagcaaatcattctggggttgcacaagggctttctctcatgaaccgatttaggctggttggtaaggcatttctgggaccccaggtttagaagtgttatagaattcttctgaatttcagtaggaaaaaaacgggatcctttaacaatgtctacttcaggcagcacgtggtgtgttttcaggctctgatctagtcagtcctcttgttttccagaaaagactgcaaggctcagagaggtgggatgactatcccaaggtcacatcatagtcactgggccaggatgaggctcccctgtacctcgtggcacctagttttttcccccacacttgatgtcctataaaggaactggccaaccatggctgcctgtggagtgtgacttcaggggcattaggaagttcctaatgtaacccttttagttcccactgatgcactgatgcctcagcttccttatcacaaactgtattagtcaagagttcttcagaaaaacasaatcaataggtgtgtgttccctgggggaagagagattaatatttattttaaggaattagctcaaatgattatggagacttggcaagtccaaaatcttcagggaaggctggcaggctggaggcccagggaagacttgccattcaagtccaaaggtagagttctgctggcagaattcccttttcctaacagaggacaatcttttctctagcaaggccttcaactgattagacaaggctcacccacagtatggtgggaaatcggctttactcaaagactactgatttaaatattagtataaaccataccctcacaaaaacacctaggataatgtttaagcaaatgtctgggtagcatagcctagctaagttgacacataaaattaactgttgcagggaccaagcctcttatggctcagacaaaggtaaggctaaggtgtaagcatcctgggagatgctgtggtcaagtctgtttagggtgaaggggcacagttctaatttttttcacaggatttcaytgtgagactgcttgcaactgggaagtcgtccggatctgagacatctgtatctgttttttctgcttctccttcctgttatccttctggcctatgggttgtcttgtgtttcaatcagctgtgtgtgtgtcttgtccaggtgaatggggaacaatgagataaggtatcgtggtacaaaccwcaattgcctaggcaatgagtgctatggaggagggcagtttgccataggaggctcatggagcagatgctgagatacctgcctctcacagaaagaccaatttttaaattaaaaattttaattttggaataattttacctctatagagatattgtaaagatagaayagaaagttcctgtaggccgggcgcagtggtgcacgcctgtaatcccagcactttgggaggctgaggtgggcggatcacaaggtcaggagattgagaccatcctggctaacacggtgaaaccctgtctctactaaaaatacaaaaaattagccgggcatggtggcgggcacctgtagtcccagctacttgggaggctgaggcaggagagtagcgtgaacccaggaggcagaacttgcagtgagctgagatcacgccactgcactccagcctgggctacagagcaagactccatctcaaaaaaaaaaaaaaaaaagaaagttcctgtatgcctctcacccagtttctcccattgtttatatcctacatttccatagtacattgtatttttttcttttttttcaaacccaggataatctctgtatatagtacattacatttccatagtatttttttttttttttgagatggagtcgctctgtcgcccaggctggagtgccagtagtgtgatctcagctcactgcaacctccgctgtccagggtcaagtgattctcctgactcagcctcccaagtagctgggattacaggtgtgcaccaccacgcctggctagttttttttttgtttgtttgttttttttgtatttttagtagagatgtggtttcgccatgttggccagtctggtcttgaactcctgacctcaggtgatccacctgcctcagcctccccccaaagggctgggactataggcatgagccactgcgtctggccccatagtacatttgtcaaaactaagaaactgacattggcatattcctaactaaactccagatttacctggatttttaccagtttctccattaatgtcctctttctgttcctctggtacccactccatttagctgccatgtctacccaggctcctctgatctatggcaacttctcagtctttgtttttcatgactctgatagtcttgagggggactggctagggatcctgtagaatgtcccccagctggggtttgactgatgcttttctcgtgatttaactggagttatgagtttgggagaagaataccacggaggtgaagggcccttcccatcacatagcctcagaaggttgaggacatcatgtggcatcactgggacattcacctccatcccttggttaaggcagggtttgccaggtctctcccctggcaagtgactatttttccctttccctgctctattattcggaagccagcattgacctactttcatagcaagttgtaaatgaaagatcagttggtgcgacgatgagggcagtgggtatttaagagggagagggtagtagagaacgtagtgccagagagcagggtgtccaagagcagggcaaaaggggttcagaaagtcttccttacaatgtgagctagcactgctcccaaccrtcagaggaagtggggtacggtggaaaccatcacagaggggatggtgaagaagtgtatttcatgtcaccttctggcactatggtgtggcccacttgagagctgaatcatctgaaacagttactgcccaygggcttggatggggcccctctctggagaaggtgtggttaataytcatgtctgctccctccatcagctggcagtgtttatttactatgctgtgtggaagcctcagaaacagtggatcacgttggacacaggcatcttggagagtccctttatctacagtcctgagaagagggaggaagcctggaggtttatctcatacatgctggtacatgctgggtaagcaatgatagttaagcccctggtatcagaggtgattatatcattgtaacctctaacatttgttgagtgctttattattgataaggcactttcatgtccataatcttcacagcaaccctaaggggtaggtattgctcccactgttttatgtctgaggcataggagatgtagtcatggaggctgaggtgggcagatcacttgaggtcaggaattcgagaccagcctggctgatatagtgaaaccccatctctactaaaaataaaaaaattagacaggcatggtgatgcatacctgtagtcccgggaggctgaggcaggagaattgcttgaacctgggaggcggaggttgcagtaagccgagatcgtgccattgcactccaggctgggggacaagagtgagactccatctcaaaaaaaaaaaaaagatgtagtcacttgttccaagtcacacagctaagttgcagagctaggacctcagcccactagtgctaactctaaggccagcatcctttcttacttttttttttttttgagatggagtctcgctcttgtcaccaggctagagtgcagtggtgtgatctcggctcactgcaacctccgcctcctgggttggagcgattctcctgcctcagcctcctgagtagctgggattacaggcacctgccaccaggccgggctaatttttatacttttagtagagacggggtttcaccatgttggctaggctagtcttgaactctgacctcaggtgatccatccgccttggcctcccaaagtgctgggattacaggtgtgagccactgtgcccttaaggccagtatactttatattgcattataactgcccratattagtatttaggaatattaatgagaagagatcaaatcattgcaaaaccaaaagcatgttcccctagttgtctaaygttgttaaatatactctttaggctatgaaaatggtggtgctgaataaccagtctcctcctccaccatcatacatcaaacaaaatttagttcatggccgggcacagtgcctcacacctgtaatcccagcactttgggaggctgaggtggatagatcacctgaggtcaggagttcaagaccagcctgaccaatatggtaaaaccccgtctctactaaaaatacaaaaactagctgggcgtggtggcatgcgcttgtaatctcagctactcaggaggctgagacaataaaattgcttgaacccaggaggcggaggttgcagtgtgccgagatcacgccactgcattctagagtaggtgacagagtgaaactctgtctcaaaaataaaataaaataaatttagttcatgaacatattgatgagtgtgggatactgttatccatctggaataatactggtaataggagatgcagtgcccgccatttagttttgcctacagtttctttctttcttttttttttttgagatagagtctagctctatcgccaggctggagtgcggtggtgcgatctcggctcactgcaacctctggctccctggtttaagccattctcctgcctcagcttcccgagtagctgggattacaggcacgtgccaccacgcccagctaatttttgtatttttagtagagacggggtttcaccatgttggccaggatggtctcaatctcctgaccttgtgatccgcctgccttggcctcccaaagtgctgggattacaggcgtgagccactgtgcccggccgcctatagtttcttaaatgccgatggcctttcatgaactcactcagcatccatgatccaccatgcccactgcagacagcgagcagcttcctgttggccccacctatccggtggactcttgtggtctcaggtggggccaaccttttctgtgcagtctacccaactctggacttgaaaacgacttgtagctggggtgtggtgatgtgtacctgcagtcccagctacttgggaggctgacgaaggaggatcgctttgagtccaggagtctgagaccagcctgggcaacatagagagtgctctacaaaaaaaaaaaaaagttaaaaataaataaaaaataaaatagaaaggatgacacttttgcttagtggctaaataggcatcaggacacatggctcagaggcttgacaaatcaggggcaaaatcaccaactgctcagtttccatttaacaagtatgttctgagcaaacatggctcccgcacacaaggactttaagatgataagaaggaacatgtcagttaaatagcaatgtaaggcagtacagtattatagtatatagtaggctgggtgcagtggctcatgccttgtaatcccagcagtttgggaagctgaggtggtcacctgaggtcaggagtttgagaccagcctggccaacatggtgaaaccccgtctctagtaaaaatacaaaaattagctgggcgtggtggcaggtgcctgtaaccgcagctacttgggaagctgaggcaggagaatcgtttgaacccaggaggtgaaggttgcagtgagccgagatcgcgccaccgcactccagcctgggtgacagagtgagactctgtctcaagaaaaaaaaaaaaatacacacacacacacacacacacacacgtgtatatgtaaatacacacacacacacacacacacacacacatatatatatatatatatggtatatggtagttacttagcttccttgtcctttagtttcctcaggtgtaaaatggagtaatatgaatagtacctacctcataaagttgttgtgattaaatgagataatggctataattttcactgtgcctaacacatagtaaggcacttaaaaagaatctgtggccaggagcagtggctcacacctgtaatcccagccctttgaggggctgaggtggatggattgcttgaacccaggagtttgagaccagcctgggtgacacggtgaaaaccccatctctacaaaaaaataaaataaaataaaaaattagatctgcacagggtgtgtgcctgtagtcccagctgctggggaggctgaggtgggacgattaaggaatcctcaggcccaggagatggaaatgtagtgagtcgaaatcgagacactgcactctagcttgggtgaagggagtgaaaccctgtctcaagaaaaaaaaaaaacgggccaggcgcggtggctcatgcgtgtaatcccagcactttgggaggccaaggcgggtggatcaatgaggtcaggagttcgagaccagcctgaccaacatggtgaaaccccatctctactaaaaatacaaaaattaggccgggcatggtggctcactactgtaatcccagtctttgggaggctgaggcaggtagatcacctgaggtcaggagtttgaggccagcctgaccaacatgaagaaaccctgtctctactaaaaatacaaaattagctgggcatggtggcgcatgcttgtaatcacagctactcagcaggctgaggcaggagaatcgcttgaactcagaaggtggaggttgcagtgagccgagatcatgccattgtactgcagcctgggcaacaagagcaaaactccgtctaccaaaaaaaaaaaaattagctgggcgtggttgcaggcacctgtaatctcagctactagggaggctgaagcgggagaatcgcttgaacccaggaggcagagattgcagtgagccaagatcatgccattgcactccagcctgggcgacagagggagacttcgtccaaaaaaaaagaaaaaaaaattagccaggagtggtggcacatgcctgtagtcccagctacttgggaggctgaggcatgagaattacttgaacccttgaggcagaggttctggtgagcagagattgcaccactgcacccctggctgggagacacagcaagtcacacacgcgcgcgcgcgcrcrcrcacacacacacacacacacacacacacacagaaaaaagaaaaagaaaaaaagagttgtctgcgaagaaaaattagaaaatggaattctagttaagcaaatccttaactagagaaaacacatgaaagtctgttcatctcccagggaaataactgcttggtttagtcataatatttgacaactattgtttgtctttgcagagttcagcacatcttggggaatctttgtatgcagcttgttttgggtattcccttggaaatggtccacaaaggcctccgtgtggggctggtgtacctggcaggagtgattgcaggtcagtgttctgaggtaacacagaatcaatacctctgggctcttaggattaaaagcaaatgaaatacacacttatagtaggcttctttaagtcaaggtttactgcactcctaatatgtgctcgggaacacattaagccttagagatcattgaattagagatactatcagcaagcaaagacaagtcattgtgcctgtcctcaggtatctcacactcaagacagggttttgcataattgaaattgcaagtatgcctggcgctcctgcctgtaatcccagcactttgggaggctgatgtgggtagatcacacgaggccaggagttcgagaccagcctggccaatatggtgaaaccctctctccaccaaaaatacaaaaattagctgggggtggtggctcacccctataatcccagctactcagggggctgaggcaccagaatcacttgaacctagggggcggagattgcagtgagccaagattgtgccactgcactccacactctagcctgggcaacagagcgagactctgtctcaaacaaacaaacaaacmaamaaaaaaaaaaaaaaaagaaaaggaataaagaaaactgcaagtagtttggtgtacaggtacgtatttgagtaaaggtctaaagccagatcatggaggcccttatatgtcagactactgattttgagaagtaacatgatcagatttgcatttaagaaagacaactttaagagaatgtagagaataaccaaaggggctctaagactgggtaggtaaaagtagcatacgtcagtgatccctaaatctgggtgtgcctaagatgatccattatggcatgggaagaaaatattagaactcccatccatccatttgtttatttattggaaacatttttttaaaaaattaaacttttaattttgcgataattgtagatttacatgcagttgttagaaataatgcctagaggtcttatgtaccctttaaaccagcgatccccaatggtgacatcttgcaaaacattagtactgtatcacaactaggatatccacgttgatatagtcagggtacaaaacattttcaaaccatatggatcccttatgatgcctttttatagctataccatcttctgtcccaccctcctttacctctggcaaccactaayctgttctccatttctataattttgtcatttgaagaatattatataaatggaataatccggtatatacccttgtgggattgattttcttcactcagcataattctccggggattcatctaggttgttgcatgtgtcaatagtttattcctttttattgcccagtattcattccataaaatggatatagcactgcttgtttaaccattcactcattgaaggttatctgagttgtttcagtttttggctattaggaataacactactccaaacacttgtgtatatgtttttatgaatataagtatggggttttgtgaacagagttttcagttttctaggataaatgtccaaaggcacagttgttggaacatatgatagtggcatattttattttttaatttaatttaatttaattcattaatttatttattttgagatggwgtcttgccctgtcgtccaggctggagtgcaatggtgcgatcttggctcactgcaacctccgtttcccaggttcaaatgattctcccgcctcagcctcctgagtagctgggattacaggtgtctgccaccacacccagctaatttttgtatttttagtagagatggggtttcaccatgttggccaggctggtctcgaactcctgaccttgtgatccacacaccttggcctcccaaaatgctgagattacaggtgaatttttaaagaaaattctttaaatattaaacatttaaagaatgttttctagaatgcctctcccattttacattcaccgtagcaatgcataaatgattcagattcagcatttggtgttgtcatgattttttattttacctgtgctcgtgatacggaagggtggaagggaagtgctgggtagaggagggcatagtgcctggctagggctccacccccaggcctgtgcccacggaactaggtgaggacggacatttttgttttcctgcccaaatgttgcattttccaataccaccctgacttgccacgcccccatcctgtgcctataaaaaccccgagaccctagcctgcagacacacaagcagcaggatgtcgagaggaacacatcgacagaagatgacaggacagacgccagcacgccagcaggccactgaccagccggaggacgcggagtttggctggggcagtcagaggagatcccgggctgccgagtggcctgactccaggggaaaaccatccgccttctggctaccccatctgctgagagctacttccactcaataaaaccttgcactcattctccaagcccacgtgttatccatccaattcttcctgtacatcaggcaagaatcctgggattacagaaagctctctgacctggagataaggcacaagtataattgagctgactaacagaagccacctacagactactaaactaagagtaccctgtaacacatgcccactggggcttcagctgtaaattcacccctagatcactgccgtggggtcagaaccccacagcctgcccgtctgaatactcccccagaggtttgagcagcagggcactgaagaagcgaacaacacccccatcgcacgccctgcgagggggacaagggaacttttcccatttcactcctaagtgggtagtgatatatgatcatggttttttttttttttttttttttttggagacggagtttcactcttgttgcccaggttggagtgcaatggtgcagtctcagctcacagcaacctccacctcctgggttcaagtgattctcctgcctcagcctcccgagtagctgggattacaggtgggcaccaccacacccggctaattttgtatttttagtagagacagggtttctccatgttggtcaggctggtctcaaactcctaacctcagatgatccacctgcctcggcctcccaaagtgctgggattacaggcatgagccactgcacccagctgatcatgatcttaatttgcatttccctaatggctaatgatgttgaatatctttttttttttttttttttcaaatttggaggaacattctgagatgcattgttgaatatctttttatgtgcttatctgtcatctatcttctttagtgaaatgtctctttatgttttttgcccattttctaactttttttaactgttgaattttgagggttctttatatattctagatgctagcccttagctgaatatgtagtttataaatattttcacccagtctgtagcttgtctttttatcctcttaccaaggtctttcagagaacatgaattttaaattttgatgaagtctaacatcaatttttccatttatgaatggtacttttggggttatgtcttaaaaacctttcactgaaccttaggtcctgaggattttttccaatgttatcttctaaaaattatagctttatgctttacatttatttgtttgttcacttttagagacagggtctcacttggttgcctaggctggaatgcagtggcacaatcatagcttactgcagcctgcagcctcgaactcctgtgctcaagtgatcctccggccttgggctcctaaaatgttgggattacaggcatgagccactgcaccaggccttatgctttactttttttctttaattttatgtatttatttattttgagacagagttgcgcttttgtcgcccaggctgaagtgcgatggcgcgatctcggctcactgcaacctccacctcccaggttcaagcaattctccagcctcagcctcctgagtagctgggattacaggcgcccaccaccatgcctggctaatttttgtatttttattagagatggggtttcgccatgttggccaggctggtctcgaactcctgacctcaggtgatctgcctgcctcggcctcccaaagtgctgggattacaggcatgagccactgcacctggcctttacttttaaatatgcaacccattttgagtttgaggtttgttttgtttgtttggcctgaagatatccaattatgctagaataattygttgaaaggaatttttcctcctttgttgaattgcttttacaccattataaaaaatcagttgcctatagttttgtgggggctattctgggttctttttattctatcaatctctatgtctatccctccaccaaaactacataggcttgattactgtagctatataataagttttgaaatcagaatgattcctcccattttattcttcattttgaaaattgtagctgttttaattcctttgcctttccatataagygttagaataattctgtttatagctatagaaattcttgctggaattttgataggagttgccttaaatctgtacatcaatttggggagaactgatatattttctatattgagtgtttcaatgtatgaacagtgtcttttatttatatctcctaaatggtgttgtattttaaatttcagtgtccataatttcattgctagtatatagaaacacaattgatttgtgcatgttattcttttttttttttgagatggagtgtcgctctgtcgcccaggctggagtgcagtggtgcgatctccgctcactgcaagctccacctcccaggttcatgccattctcctgcctcagcctcccgagtagctgggactacaggtgcccaccaccacacccagctaattttttgtatttttagtaggggcagggtttcaccgtgttagccaggatggtctcgatctcctgacctcatgatctgcccgccttggcctcccgaagtgctgggattacagggatgagccactgcgcccggcctgtgcatgttattcttataccttgcaaccttgctgaactcacttagtagtagggtttttgttttgttttagattccttgggatttttcatgtcatctgcaaatcatcatgtcatctataaataaggatattttatttcttcctttccaatctrtatgccttttgtttctttttcttgccttattgtgttggctagcacttcaagcactatgttgattaagagttaagagaaaagatgttcttgccttgtttccaatcttaggcagaaagcaatgagtatttcgccacaaaatgtaatgttagctgtaagtttttttttttttttttgagttggagtcttgcactgttgcccaagctggagtgcaatggcacgatcttggctcactgcaacctctgcctcccaggttcaagcgattctcctgcctcagcctcccaagtagctgggattacaggtgctcaccaccatgcccagctaattttttgtatttttagtagagatggggtttcattatgttggccaggcttgtctcaaactcctgacctcatgatctgcctgccttggcctcccaaagtgctgggattagaggtgtgagcaactatgcctggcctgagccactgcgcctggccttttttttttttttttcttgagacagagtctctgtcacccaggctggagtgaagtagcatgatcttggctcactgcaacctccacctcccaggttcaagcaattcttgtgtctcagcctcaaagtagttgggattacaggcatgcagtaccacacccagctaattttttttttttttcctgtagagacagggtttcaacatgttggccaggctgatttcaaactcctggcctcaagtaattcatttgcctcagcctcccaaagtgctgggattacaggcatgagccaccatgcccagccaactgtaagttttttgtaggtgctctttaccaatccatttattctaaaaaatgaacaagaaatctatcgagcagagtcctgtggatggcaaaaagaaaaataaggctgggcacaatggctcatgcctataatcccagcactatgggaagccaaggcaggaggattgcctgagttcagtagtttgagaccagcctgggcaatataatgaaactctgtctctaccaaaagaaaattaggccaggcatggtggctcatgcttgtaatgccaggctggtctcgaactcctgatctcaggtgatccacctgccttggcctcccaaagtgctgagattacaggcgtgagccaccgtgcctggccttattctcttaatatcttttggagaggagacgttataaatattaaatctataatttttatttttatttttattttttttgagacggagtctcgctctgttgcccaggctggagtgcagtggcgcgatctcggctcactgcaagctccgcctcctgggttcacgccattctcctgcctcagcctcccgagtagctgggactacaggcgcccgctaccacgcccggctaattttttgtatttttagtagagacggggtttcaccgtgttagccaggatggtctcgatatcctgacctcgtgatccgcccgcctcggcctcccaaagtgttgggattacaggcgtgagccaccgcgcccggccaatttttatttttaaaaatgttttactatatatatagtacacatattatatatatatataaatatatatgtatttttttatttctgtagagacagtgttttgccatattacctagactagtctcaaactcctgagctcaagtgatcgtctgcactggcctcccaaaatgctaggattacaggtgtgtgccatgatgcctggccttttatacattttcaaactttaggaattgtggcttttagtgtcatatcaaataattttttttttcttttttttttgagacggagtctcattctgtcacccagactggagtgcagtggcgcaatctcggctcactgcaaaktccgcctccgggttcacgcaattctcctgcytcagcctactgagtagctgagattacaggcgcacaccaccacacctggctaatttttttttgtatttttagtagagacggggtttcactacgttggccagactggtctcaaactcctgaccttgtgatccacctgcctcggcctcccaaagcgctgggattacaggcgtgagccactgcgcccagcctgtataaaataatttttacctaacacaaaatcaccaagatttctcctagaatcaccatgttttctcctagaagttttattattttaggctttccatttaggtgtatcatctggtatttttgcaaggggaaggactgaagtgtcatttttttgcatatggatgtctgttctaacatcatttgttgaaaagacagtcctttctccattgamttgctttagtatctgttgaaaatacaaattgcttttgtatctttgttgaagttgttgtttgtatatatgagtgtgttaatttctggaggttctattctgttccacttatgtatttgtatatctttacaccaataccacatatcttggttactgtagttttcatgacttttggtcatgaaatcaggaagggctagcactccaactttattctttttcacaaattttttggctattctaaatcctttgtatttccatataacttggtttgtgcgtttctaaaaaaaaatctgctgggatttggattgcattgaatctatagatcaacttggggaaaacggacattttaacaatattgagtcttccaacccatgttgaacaaggtatacctttctgtgtatttaggtctttcaaaattcctctcagcatgttttttagttttcagtgtttatgtcttgcagagtttttggtcagatttatctctatgtatttcatatttttgatgtattagaaagggtaatgtttttaaaatttctatttctcggccgggggtggtagctcatgcctgtaatcccagcactttgggaggctgaggcaggtggatcgcctgaggtcaggagctcgagaccagcctgggcaacatagtgaaaccccgtctctactaaaaatacaaaaattagctgggtgtggtggtgggcgcctgtaatcccagctacttgggaggctgaggtagaagaaaggcttgaacccaggaggtggaggttgcagtgagccaagatcgcgccattgcactccagcctgggcaacaagagcaaaactctgtctcaaaaaaaaaaaattatatttctcattcttcattgttacagcatgaaaatatatactttttggtatattttgtatatagatcttgtgttttccaaccttgctaaactcacttattacttctagaagctttttgtagattccattagattttctacatagattattatgttgtctgtacttgctaatttcccttttgatgttttctttgacacatgggttatttaaaatgtgttatttagtttttaaatatttgtgtgtttttycaaagatgttctgttgttaatatctagtttaactgtggttaggggctgggcgtggtggctcacgcctgtaatcccagcactttgggaggttgaggtgggcagatcattgagcccaggagtttgagaccagcctgggcaacatggttaaaccccatctttaaaaaaaaataacaaaggctgggtgtggtggcttatgcctgtaatcccagcacttggggaggccgaggtgggcggatcatcaggtcaggagttcgagaccagcccgaccaacatggtgaaacccsgtctctattaaaaatacaaaaaaattagctgggcatggtggtgtgcacctgtaatccaagctactcaggaggctaaggcaggagaatcgcttaaacctgggaagcagaggttacagtgacctgagattgcgccactgtactccagcctgggtgacaaagcgagactcyatctcaaaaaaaaaaaataataaaaaaaataaaaaaataaaatgaaataaagtaaaacaaaacaaaaacaaaaattagcttggtggtgcacacctgtagtcccagctattcgggaggctgaggtagaaaaatcacctgagcctaggaagtcgaggctgcagtgagctgtgatcatgccactgcgttccagcctgggcgacagagtgagactctgtctcaaaaaaaaaaaaaaaaaaaaaagaaaaagaaaaaagaagaaaacaaaactgtggttagagaacaaactttgtatgacttgaatccttttaaatgtattaagatttgttttatggtccagaatatggcctatgttggtaagtgttctttgtacatttgaaaataatgtgtgagatcagttgttgttgggtagaatattgtatacatgtcaattaggtccatttggttgattgtgttgtttgtcttctgattttctgtctactttttctataaattattgagaaaggattattgaaatctctgattataataatgcatttgtttgtttctcctgtggttctatcagtttttgttttatttatttatttatttatttatttattttattttttttgagatggagtctcgctctgtcacccaggctggagtgcagtggtgcaatctcagctcactgcaacctgcaccgggttcaagcaattctcctgcctcagcctctcgagtagctgggactacaggcatgtgccamcatgcccggctaatttttgcatttttagtagagacggggtttcaccatgctggccaggctggtctcagactcctgacctcaggtgatccactggcctcggcctcccaaagtgctgggattataagcgtgagccactggcccatttatttatttatttatttttaaatttttctttcttttgttttctttctctttttttctttccttctttctttctttctttcttttttttttttttgagactgagccttgctctatcacctaggctggagtgcaatggtgcgatcttgggttactgcaacctctgcctcctgggttcaagcaattctcctgtctcggcctcctgagtagctgggattacaggtgcctgccaccaagcccagctaatttttgtatttttagtagagacagggtttcgccactttggccaggttgtcttgaactcctgacctcaggagatctgcctgccttgtcctcccaaagtgctgggattacaggtgtgagccactgcagccgaccatatgcctgataatttttgattggatgctacacattttatctagttggatggtgcatatttttgtgttcctgtaaatacttttttaatttttaaaattttatttatttatttatttatttatctatttagagatggagtcttgctctgtcacccagattggagtgcagtgatgtgatcttggctcactgtagcctctgcctcctgggttcaagcggtgctcctgcctgagcctcccaagtagctgggactacagacgtgtgccaccacgcctggttaatttttgtatttttagtagagacagggttttgctatgttggtcaggctggtcttgaactcctgacctcaagtgatcctcctgccttggcctcccaaagtgctgggattacaggcatgagccactttgcccggccaatgctttttattttttatttttatttacttattttttttgagacagagtctcactctgtcatccaggctggagtgcggtggcatgatcttggctcactgcaacctccgtctcccaggttcaagtgactcttttttttctttttttagacagagtctaactcttgtcgcccaggctggagtgcagtggtggatcttggctcactgcaacctctgcctctsaggctcaagcgattctcctgcctcagtctcccaagtaactgggattataggcatgcaccaccatgcctggctaatttttgtgtttttagtggagatggggtttcgccatgttggccaggctggtctcaaacttccgaccttaatgatccacctgccttgtcgtcccaaagtgctgggattataggcatgagccactgcactcggcccagggggttcttgtgtctcagcctcccgagtagctgggattataggtgcacaccaccatacccggctaatttttgtatttttagtagagaaggggcttcaccatgttggccaggctgcttttgaactcctgacctcaagtgatctacctgccttggccttccaaagtgctgagattacaggcctgaaccactgctccaggccataaatactttttagatttgttctgtaactcagttatgttacttgaaagcagtttgattctttttggtaagatggtaattattcccaccactggacccttttgtgtactctgagcattgccccattaattatggcattttccagtacacatccccacactgcttgcaggaaaggacctagagaaaagtcgcagggcagaaaagcagaggaggacggccctggatttggcttatcagtccttggggccctcctgccccaggaagggcagcgaggaccatggtgttgctgccatcattatcaccctggccatgagattgcaggactggggcagacccagaggaggactggaagggccagagtcagccaggaacacagcagctcagctctcggctgttggcaggtggccttgatggcttttcaaaggcaatcactccacccaggacaaagctcacttttctctggggcaaaacacattggttcatttgttcagttcattaattcaaccagtctgtttctaagggaaacctggctgtggccagtcctgctcccacatccctaggtgcccagtgttcccaagggacctgaattccaaccccagttaggagttcaggggtcagcatccccatgccccacatgcctgttagggaggacagtgaaggctgagcactcttgggctcaccaaacaccagcattgagaaactgccccccatcttccctaggtaaggtgaccttgtaggacagttcatgctattgggatggtctgggtaaggtggccacgagggcaggggaccaaggtctgccccacctttgaccttagcgacatgcccctgattgcctggcccccctctggttgtcgtctgagtcccttctctgggggtacctgggccttgctgcacttcctttgtatgctaacttcatcctgatcaaacttgattttcctactgtgatttctttccaatttcttcatcaagttaaaaattctgtattgagagcagtttcctacattacctcaaatcctgttsaaacaaggattatccctagaagtcagaaaggagggaaaacaagcttagtcacagaagactactctatacttgagcttctgtttcaagggaagtgagtaactggtggtggagccctgcccctctgcagtgtgtggttttgtcctgatatattttaagattgagatgtaactyacctgtcataaaatgcccagacttatgatgtgtggaaacaaaagagttttccagtacagaaagttacttagcctctctggtgctgtgtaagcaacaggtagtcttcccacttcatttttggtggttctttccttggcttgggtaatttccttgcatgctcctttctggagttttctgtatgcagctttctgctctctggtaccctgtcttgtaaactctagcagtccagatctatctggactctaaacttcatctcatcaacttaaagtttgcygagatctgcctgggttcctgcttcatgcgctgtattctgtaatctccctcaaggtagtacctgggcaatcagataactcatctattaataactgattccctgtctctaagggtttactggttttgttttctgatgtctagtatcttgaagaccattctttcctatatgttgtccagtgcttttggctttttcaagtgagacagcaaatcctattcttgtgaccttatcatggtcagaagtagacatttgtatctattttaaaaataaatttctcatatgattatgatataatcaccccagccctagtctataggttagcatttgagaatcattgctctaagttgctctggactacttctttgttttttgagacagagtctcattctgtcaccaggctggagtgcagtggtgcgatctcagctccctgcaacctctgcctcccaggttcaagtgatcctcgtgcctcagactccccagtagttggaattataggcatgtgccaccacagccagctaattttattttttttcaatttttttgagacagagtctcactcttgttgcccaggctggggtgcagtggcgccatctcagctcactgcaacctccacctccagggttcaagctattctcctgcctcagcctcccaaatagctgggattacaggtgtctgccaccatgcccggctaatttttgtatttttagtggagatggggtttcgccatgttgcccaggctggtctcgaactcctgagctcagctgatccacctgccatggcctcccaaagtgctgggattacaggcgtgagccaccgtgcccggcctactggactacttctcactgatcttcagtcatccatatacctgtttgtatgccattgcttttccagttctctaagtcctgaataccttcttctcttttgtttttcttatccaatccttttgtgtgtgggggtgaggggagaggtcttcctctgtcacccagactggagcgcagtggcacgatgatagctcactgcagcctcaaactcctgggctcaagtgatcctattggctcagcctcttgagtagcaaggaccacaggcgggtaccaccatgcttggctaatatttttcttatatttttggagacggatatcactctgtggcccgggttggtctcagactcctgactttctggcctcaagcaatctcctgcctgggactcccaaagcactgagattataggagtgaaccacagtgtctggccaatcttaaagattcttcaaagtttaggccgggcgcaatggctcacgcctgtaatcccagcactttgggaggccgaggtgggcagatcacgaggtcaggagatcgagaccatcctggctaacatggtgaaaccccgtctctactaaaaacacaaaaaattagccaggcgtggtggcgggcgcctgtagtcccagctgctcgggaggctgaggcaggagaatagcatgaacctgggaggcagagcttgcagtgagctgagatcacgccactgcactccagcctgggcgacagagtgggactccatctcaaaaaaaaaaaaaaagattcttcaaagtttaatgaaaatgctatctcctcctcctcagagtagcaaggactccacccttctgctgagaaaatcactccttcctaagtgcttctacaataaatttatttttgtcatagtagttgttatattctgtactttataatagttgtttgctcatctctttgtaaaattactgaggacagacactttttcttgcacaaaataggtactgtattgttttgtatcatacactaaggaaatgaaagaagaccttgaaaggaatagaccaagtaatagaactaagcagtatagagagaatattttagtctttgcataaggtggtttgcaaagccttgttttggtccagtaaatctaggattaggttagcaattaggattcatcttgcttggggaatctgattggatcgtatgttgagaaggattctgagggcacattatggctcattgagaaagatagctattagataataaaatgttggattgtctcaggtattttgactgaacataggatattttgcaataatattaggttgatgcaaaaataattgcagtttttgcccttaaaagtaatggcaaaaccgcaattacttttgcaccaacctaatagctaacaaatatataatacacatcaagcagtattctaagcacaaaacacacatcaactcattatttaccctgacaatccattaaggtaagttctattaatagccccattttgcaggtagggaaactgagacatagagaagtcaactaacttcctcaagtcacactgctggtaattctggctccagacgattctgccattgtcactgctatgttgctgttctaatgaacattccatgttttcagaaacactgtggtagttagcatatacagctatgcttctatggtatgaaaggggcaaaatagatttgttgcttgctaatgtgataatagaccagacttcccaaatgtctaccttagattagaaagatttatctttcctgatccgtatagtcatgtctgatcctttgtgttttatttctttagggtcccttgccagctccatctttgacccactcagatatcttgtgggagcttcaggaggagtctatgctctgatgggaggctattttatgaatgttctggtggtaagaaccatggggatggagtccaygagtctcttaaaaaaacagaaaacagtaactcttctttgtttcaacgaaccttcatttatcaatatttactgagcactcaattttctgagaattgtatggcaatgccattttgtttcctttcttttctttctttttttttgagacagagtcttgcaccattgcccaggctggaatgcagtggtgtgatamtggctcactgcacttctgcctcctgggctcaagcaatcctcccacctcagcctcctaaatagctgggactacaggtgtgggccaccatgcctgactaatgtttttattgtttgtagagccagggtttcgccatgttgcccaggctggtctcgaactcctaggctcaagcgatctgcccacgttggcctcccaaagtgctgggattacaggcgtgagctgccgcacctagcttcctttcatatgttatcattttttttctcatttcaaaagtaatgagtacaacataaaattttaaataaaaaagtagaaagttaaggtcctcaatatagtatctgttaacagttgggtgggtggtgaaagacgttgttaacagttttatatatttttttcagccctttttattttattttattttttaaaggaaaccaagtttattaagaaagtaaaggaataaaagaacggctacttcataggcagagcagcccagacctttttctacatgtattcaaaatcctaccgatgttaatcttataacaatgacaccacccttatattgttctgcattttatcatagagcatcctgaccatctacccatgtcagtgcttagaaatcctcccagcttagagctgctccctagcatcctctatatagatgcaccatgatttatttaatgaatctctcgctgaaaaaaatttggggtgattcctgcttttcatgtttacaagtaatgctataagaaatgcccttggccgggtgcggtggctcacgcctgtaatcccaacactgtgggaggccaaggtgagtggatcatgaggtcaagagatcgagaccatccaggccaatatggtgaaaccccgtctctactaaaaatacaaaaattagctgggtgtggtggtgtgtgcctgtagtcccagctactcgagagactgaggcagaagaatggcttgaacctggaaggcggaggttgcagtgagctgagatcatgccactgcactccagcctggcaacaaagcaagactctgtctcaaaaaaaaaaaaaaaaagaaaagaaaagaaaaaaaagaaaagaaatgctttttacatttatctttttgcatttgtgtaaattttttttgtaggataaatttctaggccaggcatggtggctcatgcctgtaatcccagcactttgggaggctgaggtgggcggatcacaaggtcaagagatcgggaccatcctggccaacgtggtgaaaccccgtctctactaaaaatacaaaaattagctgggtgtggtggcacgcacctgtagtcccagctactctggaggctgaggcaggagaatcgcttgaacccgggaggtggaggttgcagtgagccaaaattgtgccactgcactccagcctggygacagagtgagactccaactcaaacaacaacaacaacaacaacaacaaaattctaggtagaaaagtgtaaagcaattataaaactgttccaaatatagaaatcactaagaaaagtggttttttcaactttggattgcaacccattagtggttgtagactcactttaaggaactgtggccaaaagttaaacccaagaaaaaaaaagtcagtgttattgtttgatttatgygtgtactgggttgttatgtaaattatttcttactgtaggtcatggtcacaagagtttgaaaataattgatttagagtaaacatgcctatttcagcatctttactccttgggragagagttactaatttgaaagtgaagggacaagtaattcaataaattatattagaaatgtctcgctcagcagttcgccactgacgcataagggacccaaagctaaaatccaacaatgagccaggtgtactggaatgcacctgtagtcccagctactcaggagtctgagacaggaggaaggcttgagtccaggagttcgaggctgcagtgagctatagattgcaccactgcactccaacttgggtgacagagtgagatcctccctgtcttctacctcccctcacagaacccccccaagagcgcccccaaaagaccctgcaataatttttgacgaatattttcaatgtttttgaaattacctcaaaaattaaggtaatactcaaatctcagttaagtctttgctaaatactactgggaaagaggatgaagaaacatcaaatgaatattaaccaaaaatcttatgaatatttcatcaatcttagtttaacagcatttatttatctatttatttattgacatgttaagtgctgattttatattacttttattgagattgtttctggctagcaaaattgtgtcatttatattattaaattaaatgtcttgtcattttattctccaaagtgcattgtacttcccaaatacatttaaaaactcggctgtgacactcatgctttgttttgcaaatatttgatactggaagattatttcaaatgaagagcagatgaagagggagtagagttgaggtttcatttgtccatagatagcttatataattattatttatctctttttaagaattttcaagaaatgattcctgcctttggaattttcagactgctgatcatcatcctgataagtaagtgtgttttgtgaatacttcatactgtccaagtgaaaataaaatatagagacaaatctctaaacatttyatttgggaatcacaggattgcaatttggggcatacacacagacctgggaggtctatggtatgtctgaagtacaaaagaaaaggctgggggttttattagaaagataaattttacatattattttgaaagaaagctcattggcactagagcagcctttgggagytggttggtgagtgatggtagtggggagaactagtcttagacttgtgttgtttagacctgattcttagactcaatttgtttcagcagctattaggtaaaactagtcttatggttagaacaggtagtttcggcagctgggcttgtggagaattcaattgttggagcagtgctatgtgctctgagtgcttttgtcccctggcccctcaactctgatttagctgggtttgacaacaatgacctatttcacataatcatctcacataatattttcaccatgtgattggtttaggcttcagaaggcctttccacatttcccagacactaacatggagaataactgcaagcctacagttagagaaaaattgtccacttcacagcactaagcagaaagaagtaaacgaaggagttttacaggctctcatgggtggttcttagacatgcctacgtgatgtattttkgcttttagtatctttatggagtgggggaagccaagagaatagagccctaggcaccccctctacttgaaccacaatagcttcacttatattttatatactggactttttcatatattggaagctgtatgtgattttgtctgcagagggaaaacttggaaaccactgatataatctcttttcttcctcaatttctaaattttcagattaaaaaaaaaactgatccagtaagtattgagtgatagctgatagttgaggattaatgatagagagwtgggggagcggggggcaggtggcagcgggcaaccgttcaagaagcccagaccaagagggtgactaatgtggcttttgaaatctccaagcattctagaatcacatgctaaaggaggttaggaagaatgctgtctggagaggggatggaagtgcagctgagtctgagagtaaaggtagattccagatgacagcaggccatagagcatggaagaaaacaagagcaaagktgggggtggtaactggtgttgacagacctgctccagttgaagttctctccacctggagggctgtggaagaatgacagaccctggggtcagacctgaaagccaaggcagaggttatacctgataaagcctaagatgtttttggctgtccacatagtaagaaaacaggattttgcaatttctatgaagggttcgattatccccattacaggaacagaggcaactatgtctgtgggaagggactctttagtttattgaccatttaaatataagaacgctaatatttcactctgagataaaataattcacttgtttatagtttatactattcttaacttttttcttcataacaaattcaaaacctaagagaagggagagtgagtatctgggaggcagcagagctgctgcaggagctgagctgcctcctcagttgttcagggtcacacccagaatcagaggacacattgtttgggcacagaattgttgtcaccygagatacggggtcttcagtcagtctgcttcatttctaaaagttctttggcctggtttacctactattgaaaatgggaagagttacaacacataccagattaataaaatataagtgcatctgtatttgaaatgtgtttctttggaaatgtatataattttgtaatatgtaatatgtaatgtgkataaagttgtaaatattcttctttttttttttttttttttttgagacggagtctcgctctgttgcccaggctggagtgtagtggtgtgatcttggcttactgcaacctccgcctcctgggttcaagcaattctcctgtctcagcctctcctgtcwacaggtgcatgccaccatgcctggctaattattgtatttttagtagagatggggttttaccatattggtcaggctggtctcgaactcctgacctcaggtgatccactcacctcagcctcccaaagtgatgagattacagccgtgagccactgagcccagccaagttgtaaatattcttcttaattgtaaatggcaattgccctaaaaaacattccttcatcaagcattatgtttgagaccatcctgtgaaacatagggagactctgtctctacaaaaaaattggtcaggtgttgcggtgtgggcctgtggttccagctactcaggaggctgaggtgggagaattcgcttgagcctgggaggtcaaggctgcagtgagccgtgaacatgccactgtagtctagcctgggcagcagagcgaggttgtctcaaaaaaaaaaaaatccatatgaaggcaactcttttaaagtaaatgttaaatttttaaggaggacaatggtttggcttcttggaataagggcttattttcaggtgggaagacacatctcagtttagaggctgcagcaacccagaagaaaagtcccctaggaagcagaaagaggaaagaaccagactcagatataggaaggggcaagatgagagaaactggttggagaaattgacatactaatggttacaaagactttctgagaggaggtctcctattgtggaagactaagccaaagtaactgtttccagttatgtggcagtgttttttaaaaacactttcctagacccatgggcatgttatttatgtggaccaggaaatgcaaatgatgattgaaaatatgggccaggcacrgtagctcacgcctgtaatcgcagcactttaggaagccgaggcgggtggatcacgaggtcaggagatctcatggtgaaaccccgtctctactaaaaatacaaaaattaaccaggcatggtggcatgggcctgtagttccagctgctcaggaggctgaggcaggagaatggcgtgaacccaggaggtggaggttgcagtgagctgagattgcaccactgcactccagcctaggcgacagagtgagactgcgtcttgaaaaaaaaaaaaaaagaaaatattatatagcctcatgaatctagcactttgtgtaatagtcatttacaactaaatgaatattgaatatttcctcgacctcaatttctgtccagtgacttcaacatcaatcaatacagtattgaaagggaatctagtcagagcacatgtcctgatgctattttcccaaaggcaaggactaggtcttttcatctcctaggacacagtggctcactaagtagagcatagggaattaggggatgggtgtggaatgtgatagctgcaagagatgtttccaagcactacacatatagggcagagttcttctaggccaagaagtcggaagctccttttgcagygcagatccgacttacttgamgactgcctaacttctggctctcacagttttattggagaatatggaatgatttcctttcatggcctgacaccttcagaactcccgatggtaattacaggcaattagtgtggtggctgagagtggagtcttggtgtcttggtttctttatgtataaaatgccaccatccttcttcacttcgattgctacaatagtatttttccagctggtcttccagttcctgttcttgctcccttatagtctacttcctatatggcagctagaataatctttgtaaaaccatcagtgtggttgmtcaagcctgtaatcccagcactttgggaggtcgaggtgggtggatcacctgaggtcaggagttcgagagttggagaccagccttgtcaacacggtgaaaygctgtctctactaaaaatacaaaaattaaccgggcatagtggcacatgtctgtaatcccagctaatcaggaggctgaggcacgagaattgcttgaacctgggaggcggaggttgcagtgagccgagattgcactactgcattccagcctgggcgacagagttgagactctgtcataaacaaacaaacaaaatctatcatgtcactcctgtgctcaagagctttcaaagacttcctatcactcagtaaaggttgaagtscttacaatggcccatatagaccctacataatctgtcccctgctacctgtctgacctcatcacccacaaccttatccctaactctagtccagaatcacytggaggtcttgttaaaacaaagttgttggaaacaactttaccacagttggtagttggaaaacacagccatggaagtaggaatctrctaaggagmgtacaactyaccttctgaaaacaaaaacaaaaacaaaaacaaaaacagaaagctgagtcccacccttaagttttctggttcagtaggtctggggtgggtttaagagttttcatatctagtaagtttccaggtgaagctgatgctgctggtcttggtaaaaaccactttgaaaactactgatccagccagctcaactgctttggtatttttcaaacacaccaggcacattcctgcttagggastttgtacttggtcttccctctctctgaaacactcttatgtcaaatagcagcatgacttggacccttacctctgtccagcgtcatattctcaaagagatcctccttgacacccctattggaaatcacactcgacaactggcattcctatttcttcctctctttgtattttctccatagcacttagcactatttgacatactgtatgttttacttatttgtttgcctccctaccaatcacccccccacataccccccaacagtttgtcagctccatgaggcagggctgttagatctgtccattgctgcctatctaccagctagaataatgcctgacacatagaggacaatgaatgcttgttggatgaataaatctgtaaaatgggataatgatagttcctacttcacagggttgtgatgaagattaatgagttaaaagatctcttagaaaagcacctgtcacagagttaagtatcaataaatgatagctagtattattattattagaggggaaccaaaaacatttggtgtactactgtggagattctgagcctttatcagggtgtttttccttctagttgtgttggacatgggatttgctctctatagaaggttctttgttcctgaagatgggtctccggtgagttcagtttctttcttttataaaatagaaattagtttactgtcaaaaagggttatcaaataggggttacaacgctgtgatttagggcagcsaaatttccatttggaagttaagaaaatttttaaggaaatcagacttttgaattgtccttcccacttaactctctcacagccctgatcactggctctacttcactgcacctgccatattggtagctattccaaaacaggagagaatggccaggcatggtggctcatgcctgtaatcccagcactttgggaagccaagatcggcggatcacagggtcaggagtttgagaccagcctggccaatatgatgaaaccccgtctctactaaaaatacaaaaattagctgggcgtggtggcagtcacctgtaatcccagctactcgggaagctgaggcaggagaatcgcttgaatctgggaggcrgaggttgcagtgagccgagatcgyrccactgcactccagcctgggtgacagagygactctgtctcaaaaaaacaaaaaacaggagagaatggattttcctgtccacatagaataaaaagcagttggtttagccaggcatggtggcatgtgcctgtagtcccagctacttggggagctgagatgggaggattgcttgagtcctagaggttgagtctacagtgagctgtgatcatgcgactgcactccagcctgggcgacagagttgagaccccatttcaaaaaacaaaacaaaacaaaaaaacagattggaaaacagcaatgaaagattgagttctataagttgacaataaagaaaattgacaaaattttccagttttgctgtgatttgtctttgaatttggtagtttctgtttgggtatttcttgtgtatgttattacttgtgttttaaatctgaaaccccatgtatgtggaatcagattatgctgctatagagatccctcatggcaactcaaccattctcttagttggcattatatagaattattttaaatgcaatgatgattaagaatgagaaacaatttctctgtcttttgtactctaagaatgggtgaaaatgacatttttaagctttgtatctttcagagtatctccttctctctgtgcacatggagttttgtgtctcttttgcyttacccctagttctctagacctttaagactcttgtttaactgtgacggtatttgtgtttgaataagagagatgcaactgaaatacacaattagcattgtcttcacttatttccattttccctccttttctcccaaggtgtcttttgcagctcacattgcaggtggatttgctggaatgtccattggctacacggtgtttagctgctttgataaagcactgmtgaaagatccaaggttttggatagcaattgctgcatatttagcttgtgtcttatttgctgtgtttttcaacattttcctatctccagcaaactgacctgcccctattgtaagtcaattaataaaaagagccatctggaggaaataaaaaaaaaaggaagactctatgaagaaacagagaagtctcagmaaaggctaacaattttatatagaggacaaaacagcattaaactcatcagttgcaaagattgcctataaaaggaccttaggatttaaggaaggggcttcttaatgtagaaagggaagaagaagagagaaaagaagggtagtaaaaactagagattggggccaggcgcagtggctcacgcctgtaatcccagcactttgggaggctgaggcgggtgaaatcacctgaggtcatgagttcaagaccagcctgaccaatatggtgaaaccctgtctctactaaagaaaatacaaaaattagccgggcgtggtggcgtgtgcctgtagtcccagctacttgcgaggctgaggcaggagaattgcttgaacctgggaggcgaaggttgcagtgagccgagattgcgccactgcactccagcctgggtgacagagcgacactcggtctcaaaaaacaaaacaaaacaaaacaaaattagagattgggtctttcccaggcatatggtattctataaaacagacttactctccttggaggatatattttggagaatgcttcataaaatctatgaatactgtacaatgctgataataaaaactttttatacctgtgtcagactcctgataatcactttaaaatagatcactgtttgaggagatagatcactactgtttgaggtgttttacacactttattgataatattatcaacaacccggaaaggtagttattactctgcatcttagagtaatcttaaagaatcccttaaaggaacccttaaagaattaagtacttgtctgaggggagcagaatttaaacatagataatgacttggaaacctgtagtctcccctataggtccaacaatgctgtgttccccaaacactgaagggtatcataggagtacaggaacaaacatctatgcggggtacaccatgaatggtggaaatatctcatagaagaagactgaggattttctggactgctagtttaagattctgataccgtgtctaagatcccaaggaaccgggcactggctttctggtgcacactatatacctagacttcagattctcatctgtgatcagactgtcatccttcatgtgggtcatggctctcctaggagtgggtaggatttatttacagaaggtaaaatgtcatacctgaaagctgagaagcatgtgtcattttcctgtatagaattcagactgtggtttattatgtttttggaaatggtagttttgggtcatctgaatataggaaatataattttttcttttatcatcaatgtatttattaaacacccatctaaacatgtcactgtatctggaaggggcatatacacttagttagatatagtgagaaaagttaatactttagtattttgagaaaaactgatcagaaatttgtttaaaaagttaaatttaagtataaacatgggaatatgagtgtttttttttttgttttgtttttttttgagatggagtctcgctctgtttcccaggctggagtgcagtgggctgatcttggctcactgcaacctctgcctcctgggttcaagcaattctcctacctcagcctccagagtagctgggattacaggcatgcgccaccacatctggctaattattattattttttttttgagaccgagtcttgctctgtcgcccaggctggagtgcagtggccggatcttggttcactgaaacctccgcctcctgggttcaagtgattctcctatctcagcttcctgagtagctgggattacaggtggccgccaccaaacctgactaatttatttatttatttatttatttatttatttatttatttatttttagtagagacggggtttcaccatgctggccaggctggtctcgaactcccgacctcaggccctcaggcgatctgcccgccttggcctcccaaagtgctgggattacaggtgtgagccactgtgcccggtccctaatttttttttttttttgagatggagtttcgctcttgtcatctaggctagagtgcgatggtacgatctcggctcactgccacctccacccactgggttcaagtgattctcctgcctcagcctcctgagtagctgggattacaggcacctgccaccacgcctggctaatttttgtatttttagtagagacggggtttcaccatgttggccaggctggtcttgaactcctgaccttaggtgatccgcccacctcggcctcccaaagtgctgggattacaggtgtgaaccactgcactcggctaatttttgtattttttagtagagacggtgtttcaccatgttggccaggctggtctcaaacccctgacctcaagtgatccacccacctcagcctcccaaagtgctgggattacaggtgtgagccaccatgcctggccttatgagtgtgttcttggttaaacaaagattcaaacaagaagttaaaagataaaatctcagccaggtgcagtggctcatgcctataatctcagcactttgggaggccaatgtgggaggactgcttgagcccaggagtttgagaacagcctgggtaacattcaagaactctacaaaaacataaaaaataaccaggtgtggtggtgcttgcctgtagttctagctactccagaggctgaggtgggaggatcactggaacccaggagttcgaggttacagtgagctatgatcatgccactgccctccagcctgggtgacagagtgagaccctgtcttaaaaaaaaaaaaaatctccttttgccttctcacttcaaacctgctgtttttccctagtgctgaccatcatcagtggtcacaacagtatggtctgtatccttgcagacatttttctatgtaggatgagcagaaaggaaaatggatttaagttaatgtccaactcatccactgtattgaacttcactgaatctgctctacaccctcaaagggacaaatctgaagaacaaattagaggtgtccatggtataactcctcctaagcatcatttgcttctcagattgatctcaactaggaaaagtttttgttaatcgattttagctaaatatatatgtgtgtgtgtgtgtgtgtgtgtgtgtgtgtgtgtgtgtgtatatatatttttttttttttcttgagacagggtcttgctgtgtcgcccaggctggagtgcagtggcgccatctcggctcactgcaacctctgcctcctgggttcaagcaattctcctgcctcagcctcccgggtagctgggattataggcatgtgccaccatgcctggctaatttttggtatttttaatagagactgggtttcaccacattggccaggctggtcttgaactcctgacttcaggtgatccgcctgtctcagcctcctcccaaagtgctaggattatagacatgagcccagcctctaattagatatttttatgaaatgtaggttttaacaggataaatgtgatacatgtattgttctataacttgctttacaacatgacctagggacctttctctattagttcatagaaatctttattctctgaattgctgaatgatatagatgtaccatagataaccattcctctgtcagacatttaaattattgctgcttttgtataattaccaacagtgctatgtgaacatcctagcatgtgcagtgtgtctctgaatgtctatgctgaatgaatatttcaagtatccaaaagcagaaatgctatactaatattgataggtttaaactgccttttaaatagctgtatccatttatattcttacctacaggatatgagagtaacagtgtctccctactttgccaaaagaaggtattataaatctttaaaattttgcattttgatagttaaaaaataatatttcacttaaatatgtattctctgactaccgaggttgaggaagtttcgagtttattaataatttatgagttacacatatgtaattcagataacacataatatagaaacatgaatatattgtgtatgtatgtgtgcctatacaaatatatatatatataatatatatatatatatatatataaatatatatatatatatatatatatatatatatatatatatatatatatattttgtccctggtgaaatgtttgtatttaatctgagaagtagctattgttggcaaaaaagcccagggaagaagtatttatctgttatgctcaacctgccagatcactagctctgaagggacctttaatgacctaaaatacaatgtaattgttaataacagaacatgggagacagaatcaggatctatctatgaaatcggacatgacccatttattaaggcagatgaccaagaagttattatctagtaagaaagacttttttggttctagaaacatggtttattgcacaaaaaacaatgacattttattaggttcccccagtggcaaaagttgcatacaaacagcacacaaatacctcctgtcattttaaatttgacatctctgaattatggaggaatcattcactcagcttaatttggggctcatgactttagtcttctagattgcagtgtgttatcaggactattataagcattctttatctgtgctgtccaaaaaagcagccattaggtagatgcagctctttacatttttattaaaattatttaaaattaaaaattcaattgctctgacacacaaaccataatgcaagtgttcaatagctacatttggctactggctgccttattggctagcacagatagaatatttccattgttgcagaaagttctattggatggtgctgttttaaaagcaaggataagcagaaagggacatggattttagttgatggatgactcactcactacattcaactgaactgaatctgctctataccagcaaagggacaaattcagaaaataaattgaagatggccatgctgtaacttctaaacatggtttgcttctcagatttacctaaactaagaaaggtttgtgttaatctctctgttttagcttattaagaaagagttgtttgaaatgtttttatctttttcttttgaattctatggtactgtatatatgtataccagtttttatgtcatttgctatgaaagctttaatttgtagctaaatactactgctccttctttcaggaaatactatgtgttgtcctttatgaaaaaaatattttctttctttttatgattataaaagtaaaatgcttatagtaaaaaattaaaatacatgtaattacaatatattaagtatataatttgtaatcccaacatccagagctaatcaccgttaatattttcatgaatatccttctagacttttttgtatacatctgtaaatgtaactaaacttataataatggggccatattattctattttataacatcaatttcactgaaatgaaatatcaaatgccattttatgtatgtttatcatttctactggttgcatagtatcacaccgtggatgtagtcgattatttaaccagtttttcttgtattattattttatgtttttagcttatgactattataaacaacatgaattacatctttgcttacattattattatttatgaaccataaatgagacttaacttgcttactttttttttattttttgagacagagtctcactctattgcccaggctggaatgcagtggccagatctcggctcactgcaaccttcacctcccaggttcaagcgattctcctgcctcagtctcctgagtagctgggattacaggcatgtgccaccatgcccggctaatttttgtatttttagtagagatggggttcaaccatgttgctcaggctggtctcgaactcctgacctcgtaatccgcccgcctgtgcctcccaaagtgctgggattacaggcgtgagccaccgcgcctggccaacttgcttacattttaaagtgctttgggttgttgggtcagagtatgctattattattattattattattattattattattattatttatttttttttgagacagagtcttgctctgtcgcccaggctggagtgcaatggtgtgatctcggctcactgcaacctctgcctctgggttcaagtgattcttctgcctcagcctcccgagtagctgggactacaggcgcccgccaccacgcccgactaatttttgtatttttagtagagcaagggtttcaaccatgttggccaggctggtctcaaactcctgacctcaagtgatccgctggcctcggcctcctaaagtattgggattacaggcgtgagccacgtgcccggccagagtatgctattattaacataataaagtcaatggaaagtttctctatttcaggaatacaactatattttagaaggttgatgcttttgcaaatcgtattaacagagccgggcgcggtggctcacgcttgtaatcccagcactttgggaggccgaggcgggaggatcacgaggtcaggagatcgagatcacggtgaaaccccgtctctactaaaaataacaaaaaaattagccgggcgtggtggcaggcgcctgtagtcccagctacccggagaggctgaggcaggagaatggcgtgaacccgggaggcggagcttgcagtgagccgagatcgcg

SEQ ID NO: 12349 - DNA, 23346 bp, Homo sapiens
ggaggaggtgctggcatctttgagtctaatttggcccctctgcagatggtgctgcagcatctcaggcaccttccagtctgttatgggctgcttttcccccataaaattcgtatgttgggctgggcgcggtggctcacgcctgtaatcccagcactttgggaggcctaggcagtccaatcacctgaggtcaggagttcaagaccagcctggccaacatggtgaaaccccgactctactaaaaatacaaaaattagccgggtgtggtggtgcgtgcctgtaatcacagctactcaggaggctgaggcaggagaatcacttgaatccaggagaatcacttgaatccaggaggcagaggttgcagtgagctgagatcgcgccactgtacttcagcctgggtgacagagagagactccgtctccaaaaaaaaaaaaaattcgtatgttgaagtcccaatcttagaatgtgaccttatttggaaaattccttataaaaacacgtgacctttaaagaggtaataagttaaaattaagtcattcgggtggaccccaacccatatgaagaggaaatatggacacagacacgaagtgggaaggccctgtgttgacccaggaagaagggggggcgctacccacagacccagaaaacagccccaggagaaaccagccccacacatgccttgactgtgggcctctggcttccagaactgggagagaataaacgtctgttgttgaggctcagtccctggtcctgtcgtggcagccctaggacactggatgcatggggccgtccctgccctcagccctaggatgctggtgcactggcctgtctctgccctcagccctaggacagtgggtgcatggggccgtccctgccctcagtcctaggatgctggtgcaccggcctgtctctgccctcagccctaggacactgggtgcatggggccttccctgccctcagtcctaggatgctgctgcacggggccacctctgccctcagccagaggatgctggtgcaggaggctatttctgcccacctcagcaccctgcagcagccccatcacacaccctggtggccccagcccaggttgggacaggcctggatccgttctccttggattttccctgagttgtttcctaagacgctcgctgcggaatccccctatgcaggggtgaggctgcctcttctgggaagtgtcagtggccctccctgcggcacgttgcccgcctgaccccctggtgtggggagtggggccccgcctccacatctttgcccctgcccaggatgccgtcccttctcacttctgagtgtgtcctgtctgtccctagggccccatccctttctctagctcctgaagcccccaggaatggcatgtggctctcaactgctgcctttgctgtcaccgtgagcttccctgacaggcagggtgcaggggtctcgggatgaactcgatggactggcccagtgctagagcctctgtcctggagggaggggtccttctgggctccggcactgtgggctgagtgtcccccgaggccagcgcctgcttccgctggcctctgagcaaaggagaggttggtggtgttttgggtggcaggcagcgtccaccccctgctgcctcgagaccctgagtgccgagctccgcagccttcccctcccttgttctctgacccttggactgagccctgagctgtctggaatggaaagctggagtgactgcctccggaacgaaaaggaagtgggaacttctctgaaagtgaaagtatggggtcctggtggagggtagggctgtgggtggggccgggtgggcctggcaggcgctgaccatggctgggaagtcccagctgttggtcactcgctcaggctgctctagaggccccatagccagggcccggctctgagggccccacgggccagcttctcagggggctgtgttcttcctgggccaaggctgcgtgctcagcaggtatgttctgggcaggtggagcaggagggcatggggtgctgtgggcgggcttgaggaccattccggctctgcgtgtggccttccaggccaagggcctcactcagagcccaggccgaccaggccagagggccagcgcaaatcacagtggacacacacacacccgatacacaggcagacacactcaggtagaaagcacagatagacagacacagaagacaccaaggtgggcatgcaggcacagacacagactcagaagcactggcagaccctctggggacactccagggcagagtcatgcacatacagggagacactctcaggccaacacacagatgtgcaaaaccgacgcccagaaaagtgtgtatatgcccgcgcgctcaagctcaggcatcagattcactttcctggtttccccgggaaagtgccgagtactagccatggctgggggctgagtcaggctcactccctgccttgcgggtctccyggtctccaggctctgtaactgtccctccgtcatggcaggtgtgcccagggctgggatcaggcccacagcaggaggtgccgaacatggtatgggctcagctggtccgggaaggcttcttgggggaggagccatttctgctgagccttcaatgagttgacaactgaagaaggaggggctgaggtcattgtaggcagagaggatggcctgtgcaaaggtgtggaggagaggtgggtacttctgagtgatcagagtgagggaatgagttgggactgaagccagaggggtcattaggagaggccttgaatgccaagctaaggatggagctgtgcttcttccgagggcagcagcggctcagggggcttatgctttgttgctactgtgaagggaagtcttttaagtgtctctttctaataggctttgctagggtataggaaaggtgttgcttgtatttacataatcaatgcacaaaatttactaaacccttttattagctccaataattttcagcctcagattttctaagccaacaatcatatcacctatgaataatgacagtttaatctgctccttcccagtgtttacatctcttatttatttttctttccttattgccttaactagttcttccagccaaatgttgaggagtaagaatggtgagaacaaacatccttgtcattttccttatttgcaggggctggaaggaaaaggaaagcttgcaaggaaagctttcaaaggaggtttatagggccgggcatggtggctcactcctgtaatcccagcactttgggaggctgaggcaggaggattatttgaggccagaagtttgagaccagcctgggcacacataatgagacccctgtctctacaaaaaatataaaaattagccaggcatggtgttgcgcacctgtagtcccagctacttgggacgcttaggtgggaggactgcttgagtccaggagtttgaggctgtggtgagctatgatcgcatccctgcactccagcagtgggtgaagtgacacagcgagacctcgtctctaaaaacaaaaaacaaaggaggttgacgttttggcaagattctttttttttttgcaattgtaagatttagtagagtgaaaacagagctcctatacaaaaggaggggacccaaagagggtagctgttgccagctcaaatgcctgggtttatatcccgatcattgtccctcccactgtgctctcaggcgatagatgattggctatttgtttacctcctgtttttgcctaattagcatttctgtgagctctctttaatacctgattggtcgggtgtgagctaagttgcaagccccatgtttaaagatggatgcagtcaccttcccagctaggcttaggcattcttagtcggactaggaaatccagctagttctgtctcagtcccccctctcaacaggaaaacccaagtgctgttggggaggttggccaacgaccgtctaagtgctaggcaagattcttatgactgatccgaggaggcagcattgagggggcctgggaaggagagcagctcggaggctgtgatcaggtgaaggtggatggcaggtggggaagtgagaggggacaagccccgcacagggcttcggcccagggcacagtacaggcagtcacctgcaagaggctcctttggagcgttgaggagtggagcgatggtccagtcccagcgtagttggggaggctggggagtgggtgagcactgcagagtgattgggaggatgaggagcagctacgggagggaaggtctaggggaaagcggggagtagaagctgaggctgggggtagggagggtggggaagttcggacttgacttctcggacacagctagggtggcccagggtgggagctctcagtgactgtgtctctgggtggtttcttgcccctgctgctggccccacaaagggtgtattagcctgacctggggagagtgggacccggggctcaggccgggcgtcagtctctggggccttgcaatcagggagcggcagcataggagccggggccccctggactctccgggcactggggacagagagacgcagagagaaaagagagccagagagagtccatgggggtgtggggaggcaggcacagggacaggccaggcgagagccttgggaggtggaggggggagttgagaggggccttcaggtctcagccccgcaggcgccagcatggcagcaggcaggccagccgggggtggcagggcgaccctgataccgatgttccgcctgcttccaggctgtgctcaggggtgaccggggtagatggacagaggctgccagcccagtgcaggagggccacatcatcacagggacagtgccgagtacccactgagcagatagatggtgacggccggtggtgcaaggcatctgaaccccgaggtcctgaaacccaagtcaggtttggagaacaaacaggggccaggaaagggaatggccggaggggaagctggaggctgggcgtgcagccgggaggacagagaagaagctgggtggggtgcaggttgtccgtgaaccccaggggaagctggtgaggtgtcatcagcgggaggtggggggtggaggaaggaggttccaggatggatgcccggctgtggggctcgggcaggagggaaccatggaagggcttaaagcaggggagtgacctggctggacttttgctttgggaaggtcgagaatagcttgggaagctgttgggagctgcagggtcgaaggtggcatggctggaggctgaggggccatctggggacctcactggcccttcagcgaagttctggtttgggacaaaagcaggctgagtgacccccaagcctctgcctatgtaacctcctaagagattcaccgcacagctgcccctccttacccggcgctcgtctgggcttcctgggagagaacctccacatctgaccccactctgggacctgctgacaccttgggtctctccgccgggaggggagcttctgggcggcagttctgagtccctgggggtggagacgtggcaggtcccgcctctgctcccagctccaagcaggctccccagcctgagtgcgcggccaggggcagactctgtccctctgtgagcctcaggttcctcatctgtgaaatgggcaaatgacaacccctaactttgatgtcacagtagctgatctgtgtcaggcatcgagctgggcacacagtaggtgcttactaagtgtgagttctcccaaacaagaaggcggggcctggcttgtccttccccacatccccgcctccgtcctcttgacagcggtggatgcagcatgtgctgaaccgttctcttcacaacacccctgccctgctgggcgccggcccccatgccaagcatgaaggggcaccggggagagagaagcgagtggaggctgggacagatggtgccctgaagtgtgggtcaagtccgaatcaggcagggtccctgaaccctggcgctgggggaagtcgccgacctgtggccagggcggggctgataaagctccatcaatcacttgactgtctctccttcctcgggcctccatccagctgcttagccgcctctgggaacctcaaggaaggtaggtaggctgcagctgggcccagcaggcaccttgctggagggcgagggtgggtgggggtctgggccctgcccactttggtgtcattccaccgcagcaaactggggcctggggaggcacacttcctgcccgatgtcacccaagggttgggtggtgggtcaggcgggtgctttggtcctggcacctgggtggggggccctggggctgggctaggggcaggtccagcccttctttggccccagtttctcccagaggaaagtgaggttttgctggcctaatgccctcccccacccatggcccagcttgtgcaatggggtgggtgggaggcccctcccctctcccaacctaaagccaggaaagcaaacacagctcctaacgctggaagggggtgtgggtggagcctggcaggccacggtgccgagggccctgggggagcaggagcagccgcagctcagccacccccatgtccctgggacaccccctccattccctgtgttggggaggggccagagcatgctatggtggagagggagaggagtggggggaggaggagaggcaatgggtgggaaacagcattgagaacccccccagtccctggttaaatatagacccgaggctcctccttctgccgcccctgtggctgcatggccatgataagccgcagggtggccttggccactgccctcaggccccacacctcctcggcgggctctgtgacacccagggaagggggtgggctcccatgggggtccctgccctccccgttgagccaaagtagtcaggccttttgggctgaaggcgggtgagctgagggacctggagggcagtgaaggagctggtgggggctggggggagggttttaggcctcaggacctaacatctgggaaggcctagatgtggctgctgrtcctgccctcgggtgttgtgagctgtggtctggactgggccccagaactgcatgtcagtgccctcctccaattctaatgggagggtctrgcctggcagaggccgagtgacggtgggcacctgcggagaccctttttgggggatggtctcaggaaaggctcctgatggaagcagctgtctatatctccgtgcccagctgcggcctggcacactgagggctctcgccaagagagtggcctggtgatgcttccttttgacagcctgagggctgcctcctctggagagccttccttgaccaagcccctgggtgtggccaggccccacagggccacaacaggtttctgcatctgctcctatggccactccttcttgcccccagctctcctgctgccaagatgccatcaccacagacagacactccygggccggagctgcagagtcccaaggaggctgaggagccacagactccagctcagggctcccggcgaacaagcagcaggaaagagcccaatgcccaccgcaaggatggcacaaggctgggcctgggctccctgaggcaggccttctcccgggccagccagcgggctttgacccaggtctccaaggaagataygggcctgttcyrgcgaagctcctgctccctgttccggtccttccggcaagccctgaatgasggcccagctaccggccattcccaggcsactcctgaggtgccctcgggggtcatgaatggtgtcagccarcaggcatccactggggcagcgtctgaggaactgaaacccgaggcaggtaagggcctcagaaacaacacgaagcatgaaaggaaacgggccagaggtcagggcagctcagctgaggtttccggaaaggctgtcctccctagctccccaaaccctgcccccgaacatgtgcaattctttatttatttgagacagggtctccactctgtcacccaggctggcatgcagtggtgcaatcacagctcactgcgaccttggcctcctgggctcaagcgatcctcccacctcaactttctgagtagctgggactacaggtgtaagccactgcacccggctaattttttttttttttttttgacactgactctcactctatcacccaggctggagtgcagtgacgcaatcttggctcactgcaacctccacctcccaggttcaagtgattcttctgcctcaggcccccaagtcactaggactacaggtgcgtgccaacacacctggttaatttttttttttgcatttttagtaagacggggtttcaccatattggccagcctggtcttgagctcctgacctcgcgatccgccccctcagcctcccaaagtgctgggattacaggcgtgaaccactgtgcctggcctaattttttaaatttgtttttatttttttgtagagatatggtcttgctatgttgcccaggctggtctcaaactcctgagctcacccaatcctcctgccttggcttcctgaagtgctgggattacaggcgtgagccaccatgcccagctggacaattgcactttaaattcttgcagcatctctgcaatgggagcccccccattgggcagataagaaaagtgaggctcagagaggtggagtgacttgcctcaagtctcacagcgtggagaatgggacctgaacccagatatgcatggccctagatccccacctctccatggcctttcacagcctggctcctggtcaaactagggccatgcacacagctgatcacagggttgcagagggtgcaaggctcgcagaggtaccaggaggggaggtcagggggattgcccagaggaggatacactggggtgggaagagggggacatggaggtggagagctcttgtcgggtggaggctggcggagagtggggagcagcaggaatgtaaagctggacacgggcaggacacgccctgcctgagctccgaccctattagacctgcaatcagggctgagcatgaggctatcaggtccggctcagccgggagtggaaggtgggtgtgggatccaggcggaaggtaggggttgacccaaattgctctgttcagccaggcttggggccccaggttctgcctcttcaaaggtgactctaagggagggctcctggcagctggggcctgttgttcctggagcaggccttcagctgtgctggggcatctggcagaggacagacaatccagccccgatggattgagccgtggcctgcaggtcttcgtccaggttcgggtcttggggcggtccctctcaccgcccttctcgcccgcctgtgcagaaggcaaatccgtggccgacctcattactgaacggcaactgctggcggccttcgaacagcttctgcgcctggagacgctgctggtggccgagaaggcctcgcgcacctttgagcaggaccctacggccttcgcgcggcgcgctatggacgtgtgcctgctttacgacgggctggcagccgagatcggcgccatcgtgcgcgagacgctggacagcgacggtgtggacgcggccgcgctggccgagctggcccgcgtggtgagcgcggaggaggargcccacccttctccccccgacgacggcgacttcctgcgcacgccgcgccgctggcgccagcactgggaggaggcggtgcggcgaagcgctcaggagcgcgtgcggcggccgggcgcggggtgggccttcggggaggcggagggcgcgtcgggtttggcccagcttctggccgagctgggtggcttggttcgccgcgacctgcagaaggtgcggcaggaggtgcagcccgcgtatgcggcggccggcttcccagcgtgggaggtctatctgcgtgccttccacagcgccgtggcccagcgcctccaggagctcgcgcgcgacgcccgcggctgcgagcagctctatatcctgctggactgggccgccaacgtctacggcaggtgagtctcggccagggcgcccagtggcgaggacagctgccgcttcctccgcaggccttggggagccggctttgaggagcaccggacctttcttctctgttccctccctgggagagggctgagagccgagggcttcgacatgctttcctcggcgggttaggccgtggggcgctcccgccccaggttttctaggggtcacccatacacagttccagaatttgaaaagtttccgcggggaggttcccatgggagcagggcctgtgctggttccaccaggtgcctttgggcgcatcagaaaagggcacatcttggccaggcgccatggctcacgcctgtaatcccagcattttgggaggctgaggcggccgatcacctgaggtcaggagttcgaaatcagcctggccaacacggtgaaaccccgtctctacaaaaattagccgggcatggtggcacgcacctgtaatctcagctattccggaggctgaggtaggagaatcgcttgaacccgggaggcggaggttgcagtgagccgaggtcgcgctattgcactccagcatgggcgacagagcaagactctgtctcaaaaaaaaaaaaaaaaagaaagaaagaaagaaaagaaaaaagaaaagggcaccccgttaggccagacgggcatctgggttcagggtacagcctgcggggagcggccacctcccgctctctgcctgggatgaggatggattgccttccccgcggagcggttcccagccccaccggcaggagcgcccacggaggtgggggaggttgcctgaagtcccgcactccttaaattgctccttaaattgtgtggggtcagacccgtgtccgccctgctgtgggcctccgtgctgcgggttggagggtggccgattcctgagctgtgtttgaggagagggcggagtgccatctgggtagccgtccttcagcgttctgcaggaaggcaggaacccagctgtcagaggcttcccgggagggggtgtggcatggcagcctagaggcgcgcgcgcgtgtgtgtgtgtgtgtgtgtgtgtgtgtgtgtacagatgcccaggttcgggattggcgttagactttgagcctggccagaagaggggcagcggctgccgcatcagagccgctcccgcccccagccccctgccctgtcttccagtcctgacttcctgggcgccccggggctggcgctgcccgccgagccgctgcctccgctcctggcgccggacgtgtgggcccgactggagagcgactacaccagcttcctggaggtcaggccgggcgggtcaggctgggcgggccaggctggagggggcgggccctggggggatgtgcggcgcccaggctatcggcggccagagctggctctggttcaccctgtggcccccggcgcgggcttgtgacccgacagggcggccctcatcccggacggcgcgggacggggtctgggagggtctcaccacggcccatcccttctccccccaggccaagatcgcaagctgcttcgacagcatcttgcagctggagcagagtcactgggcggccgccgaggtccccgaggtgctgcagggcctctaccaggcgccgctgtccatggacgtccatatggtgcggcccgggagcaggggctgagaaggggcgtctgttcaagcctcacgcacacggtggcgatttccagaacgaattcctatccagtcccaaccaacccttccgttagatgggagcctgaggccccacgcggggggaaatcggggacccccggcgcgccgacgggcagggaggctgctggatgggagtttgcgggagttgactctccagttgggcggctgaaagctggaggggccaagactgacaggcacagcggggcgggctggaggcgcagcgggggctaccaggggacccgcggcctcaggtcgggggctgggaggcacgctcagtgcggggcttcgctcgcagctcgtggccgagcacgtgaaggcggccggcgccatctccgcggagctggaggccaccaccctgcgaatctgcacgcgggcgctcggcctcttcgtgcccaggtgcggacgcatcctcagtaggggagcgacctggccgggtgcgctctgcaggtgggagggaggagtctgcgtagggacctgattgggagggtggacccagggtcatcgcgcagctagggagggtccccaaaggctctgtgtatcccgccccaggtttgaaaaggcttttctggcgtcggaggcggtgagcgagccgcacctgggcgcctacatcaacgcctgcgaggagctcaggtagggctcgcccgctcctgtgcgggcgcagcgtggccagcagggggcgcgcgagcgccgggaacctggatggaggggagtgcgcgcgcgtggagggggcagaggtgaggagtgtgtgtgtgtgtttgtgtctgtgtgttggtggatctgaggggtgtgtgtgcgtgtgtgtgtagcagagttggggggtgtgtgtgcgtgtgtgatggagctgagggtgtgtgcctgtgtgtgcatgcgtggagagctgaggctgtgtgtgtgcgtgtttggcagagctgagggctgtgtgtgtgtgtgtgtgtgtgtgttggagctaagaggtgtttatgcatgtgcgtgtaggggtggagctgagtggtgtgtgtgtgtcagagcctagatgcgtgtgtcttgtgtgtgtgtgtccatccgagcaggggccctgggggagtgtggatggctcttcaaggctgagcagaggccgaggggttccagctccctgcctgctgccctgggctccatttttccctcccttcatcccaggcagcatttcttccatcttgggacacctccttctctgggaagcctccctcagcctgcaccctgggctttgctggggtgaggtctgggtctctgtgtccccagaaggcagacgccctccctgtgggctggcagtagctgttggccttccgtgccctcagctccaggccaggcctcagcagatgcggcagcgccagaggcacagactgagcctccccatctgggtttatccttttttaaaagtgtgtaaattttagtgtcccgaagtacttctcatttgtctgacttcaaagaacagctgtgccacctgctggctgtgtgctccgggacaagccacctcccctctgtggctcttttgccacctgtcaaataggatcagagcacctgctccctggggtggtgtgggacctctgtgcctcaggggactcagttcccattggctctttgtgagcacttctcagtgccaggcactttgtgggtgccttccctgcctgacacgtctcatcccaagcgcagtatacccacgcacaggtgcagagcacaggcctggaaaggaggtgccacttgcccgtggccacgtagccaggaagtggtggagctgggacttgaactaggcctgcctaaatccaaagcatgaccatcaggcactgcttctccaacactctcgtccttaatctgtgccaggcttgtccttggtgctgggaccctggggtttcagctccagggagcgttctctgccccttggtaggcagcctctggccaaacccttgatggaactccagcctgctctactgtgtccctggctgcggggactgcgtatagcctggccctcagtttcctcaacagtgaaatagggacatggtcaccttcagggggcagttatraggctcagggtagggtatgttccaggcatggctatgccgcactgtttatcaccaagagggatggaaggtctgtcccagagctgccagaggggaacgggtcagccacccctgacccacccctttgtgactggctccctgggcttctgtgctgtcccccacttgactctgctcgcagacagctacaatggggagccccacgggctgcccttcacattgtagtctaagtgagtggagctgtgtgcccggctctattcyccagcctggtctcccttgcccacctcatcgctggtcctggcccctccccaggaccagtcttctctccaggttcccaggaacccaagaggagctggagaagcccctggtgacggccacctgcagcttccagaagcacttgcttcagggcttgcagcgtgagttgcaggtgactgtgataggccctctctccctacttcccatgcccagcaggcaccccctatttcctagagcctgggggcccaggtcacagcattcatttattccagggtgagctcatgggtgtgtgtgtagggtagtgggcaggggacccaggtgaggtcccagctgagcaggggcggctgggagacgcctgccttctcacttcagtctccagctcttagtggtcacccccgaagcctgggatggtgggtccacggatccaggcccagggtcctcacccagtccctcaaggcttctccagggcatgccctgagcagatctgactgcacagactcaaaccctgcccctagagcttggggcctgggagaggcattctgggaaagggctcgtgacataacctgtggctaggagagggaatggcaccccaaacccaggagggaaggggtcaggagtggcacactgggcttcgagggaggggttacgttgcgggcgtagtgcacatttgcagactcccagcccctctgtccccagccgctcttcagggttgtgtgcaccagggactggctgacgcaggactggctgcatcccctcatggacaaggtggtgaccttcgccggtcatctccagcgtgtggcccggccgcgggcacaggtaccacaagggggagggccctggcagggctgtgcccaggattggggctgttgaccctgaccctgaccctgaccctgggccgcccaggagactctgcaggaggtgcaccggttcgtggtccgcgagtacctggcgcgggcgctgaggccacgggagcggttccggggcatggagcgcatgcatggctcccagaagatgagcctggatgcccaggccatcagcgacaccttccagggcctggtaggggcggcatgactgcccttcggtgctcgcctctgtgtggggagtggtggcagtgactagggccttagcgccgggagggcttttggcagsagtggttctccccactctggatcaggtggaacagggactggggcgcctgtggggctggggggtggagggaaccaggtgggagggcggcactttgcatacatttgcatacagtttgcaggggtgcggggaaggggcgagggtcacagccccatctcacggtcagggcctttgggaggtgtcccccacctcaggccagagccctcagagtggaggcaccagcgcccctgcacacccctcgtctgccccctagcagtgctttcaggctggcctcggttttcctgtccaagcaggatgggatcggaggggagatgaaggctgtgtagccagcccatgagccctcggtgcccaggcacgctcccgttctgttttgggggaggcagtcccggcaccgagccagagtgactacaggagggctgacgctgcgggagggctgacctcgcactgacctcgcgctcttgcaggagttggagcagcggtggggagagggctgttggggcaggyggtggctctgtctcgcagggttccgaggccacatggttggaccaagccatccagtgcgtggctgagatcctgggcgagacctacaaagatgacatccagcggcacctggagactcttatccggagctaccccgacatcaggtgtgtaccccayctgcttccactagcttcctaccagagcttcagggccaagggggctggtattggagcaaccccagcccagacctgactgcccaggggcctgaagaccagaggcaggaggtaggccttggaccctcagaccctcaaggctggagggggaatggagagagccccttctcctaatctgctcttggccatcctccatcagccccaccrggggtgggcacgcctccagtcctggaatctgagggggaggcggaccccccacccctggggagaaagccctctctgaaagccaggggattctgagacctggtcaggaggaaggaggttttgatcccgggttgtgctggggggtcggtgagtcatccaagcctttggaaatcccagctcgaatctctccaagtccattcttttggagattctgggatgtggagctcacagaaagcccctggttcatccccttccccaggccaccctgccatggggtggggaaggattccccatccccagcaggcctgtcttccaggctgtggctcagagagagtggcccttacatcaccctgggagttcccctccaactactccccaaccccgttggccccgtcacccgcagctgcatcaccccctccctccctctccaccacctgtcccccggtctccctctctccctcgccaccctgtccccatgtctccctccctccctccctctccaccctgtccccgtgtctccctccctccctccctctccaccctgtccccatgtctccctccctccctccctctccaccctgcccccatgtctccctcctccctccctctccaccctgcccccatgtctccctcctccctccctctccaccctgcccccatgtctccctcctccctccctctccaccctgcccccatgtctccctcctccctccctctccaccctgcccccatgtctccctcctccctccctctccaccctgcccccatgtctccctcctccctccctctccaccctgtccccatgtctccctccctccctccctctccaccctgcccccatgtctccctcctccctccctctccaccctgcccccatgtctccctcctccctccctctccaccctgcccccatgtctccctcctccctccctctccaccctgcccccatgtctccctcctccctccctctccaccctgtccctgggtctccctctctctccagcctgggtctctccacccggtccccaggtctccctccacgcctttgcgtgggctctttcccactctgcacacccctctcctgtgccccttcaagcccagctatggtgtcccccaggcccacgccctgccccctcccccagcacagctcttcctggcctcagtcaatctgacctccctgaccatcctggaatgcagagtgactcatactaactcccaagcccrtgggttcgcctcatgctggggctgggggtgttgcggaggtgtaggtctgcagtgagtgcccgcatgtctctgcaggcgggaccacatactggccattctggcrctgcgccgactgggccgccrgcggaaccagcatctcttgcagcacacysaagacctgctgagagctgcggccgggrcggcgggtgcggaggcccctcggggccgcgtgctcttcgaggagatcaaggtgcccagtgccatggctgtgctgatcacctgcgtctagttctctctggctcgagggggggccggccgctggcagggagctgtggtcagtgggggtcagccaggagcccagggagtcactctgggccctgcccccaactctgacactgcagttagggaatttttgtcgtcagcagccaagcgcagctgtcaggccagaaggagcagccgtgcaggaggcatttcaggcatcgttgaggggagtgttttggggcygcagagctctcaatgctgcctatcgggcgggggggggcctcccgcccgactgtccagcttcaccctccagtctgaaagtgaagagcagagtatttatttaaaaaataaatgtgaattaaaatggtgcctccctaaggagtgggcaggggatgggagacctgggtcccggtgtgctgaagggccaggccggaggctgtctggtgacactatttggtgggtggccctctcatgcctgtggaagccacgggaagactgaggcaggtccagagcagggaaggcccatgcctgtggctgcccccaccacggcccggatccactggccttgtgcctggtcagccttgtcccagccaaagcagactcggggcttcctgggaacaaaaagaggataaggctggttctgcagcttgaagaatttgggttagatgtaggagggacttctcagcagtggaagttgtcaagttactgcagggggtgtgtcacccatggagtgtgtgtccgggggtgaccctgaggtgtcagcaatggaggcaagcgtaaggagactgctccagcgtgcacctgcgtccccgcttctctctgcaaagctgccgctgaaatttggcggcagcctgcgggctggggtgctgggaaacctatttgcattggcagccgggctggctggggaggctgaaagttgagatggggagatttccagagagcagctgagacaggtggtgacaggtgcccctcccagccctccacagtgggcccccatagtgtctctgggcctgaccctgaccctggcgggagtggggggcaggtgactgcaggtgggccaaggttccaagagctccacaaacttgggtcgcctgaggacagggtaaggagtctgaaaggctgtggtgccaggcaagcagggggcgtgtctatccccactccctccaggccccctccctgcactgtggacagtcagggggcagttccccgggcagacctgccccggttcctatgccagggctggggcctggagcctgagtcttgctggggcctagagcctgggggttgagtgcctggggcttgtctgtctcttctgggagcaagtgctggggcagtgccctcctccatgggggcaccagggctggaggtcaggagcagggcaggccagggcaagggaatatccagacctcccctggcagggtggggcaggtggggcaggaatgaggaagtgggagggttggggttccccatctccagggctggggtgggggcaggtatgtgatgctggtgccaataagcggtcccgtccctgatgggaaaacaggctggcagatgctcaggatcctcccagccaggggccagaggggcatgtcttttcccaggggaggggtccaagagggggcaggtgattgacaggtcagcctgtcccctgcttgaccccacccctgacctggtggccatgagtgtcccaggcagggtgcatgggaggggagaagggagggcttggcctggtctggtcctggtcaggttctccccaaggagcccctgccacccccttccccacccttctgtctcaagctcctcactgagccacttggctggagccagagggtcctggggcagggctgtggggttaaggagggggttccgtcctggctctgccacttcccacctgtgagaatgcaggcaggttcttttatctcactgcttcattttttttccagctgtgaaatgggggtgctgttagtgcctcctcggctggggagggtgaagtcagagccagccataaggccgggggcctggcctccctgtgaccccatgttcccagaggcccacctacgggaaggccttgggcaccctggggttggggtggtggggtgctgaggctggagcaaaacctgagttgagtggaggtcactgggagtgggaggccccaagagaggctgggaagaggtgctgaaggctgagcggcttgtggcagagggagggggcccggcttagaccctgagggttcctaggcccggagacaggaagtcagggttttcctggcaggaactgtgtgcacatgtgcacctgtatctccatgccaggagggtgtgtatgccatgtgtgcagatcctcctgaacccagcggtggctggggctgggacttcccaggccaagccaggccgagctgggggtgggatggcagctcctagaggatgcagtcagggaggctgggggcagaggcggggcygagaccggggcaccctgggtgcctcagtcctggggtctggccactggcctttctgctctaaggggtggaggctgagcccatgagaccttgcaatgagcctgcagtgcttccttggccatctgttgtccaggccaagcctgcagggtgccggtgggggtggggctggctctcagagaggtacttgggttctcattggccaggtcacctggctgataagtgtgtgtgtgtgtgtgtgtgtgtctgtgcacgtgtacctatgtgcaccagcccctgtcagcacccccaggatggaggcccttgcctagtctcctcactcctctcagaaagcaggacagcctggaaccatcctacttgcccccaagctcagcccccaggccctgcctgccggcccctggcccgcagccttggccagtgcctgttccctgctgcatggcccaggtctcctccctcttcagggccagctgggcttcccccagtgccaccgtggcctggggctcctgcatgtcctggggttccctctggtctctgtccctgagcttgaggtccttgagactgggtctgctctgtgaatcttctggggccccaccccaggcccaactgggagggcagagagaaaccacagagaacccacatgccccagacccgcacactctggtctgcagagatgatccactgtgtgtgtgtgtgtatatatgtatgtatgtgtgtgtgtgtgtgtgtgtgtgtatgtgtgtgtgtatatgtgtgtgtgtatgtgtgtgtgtgtgcacacacacacacctgctggcccagcgacagcgtgtgtggggtgagaggagactggggagctgcctcccccagctcaggctggggcccagcagccctccgaggccatctctccctcctggtgtctgggcctggcccctgcttgagtgtgtcatgtgggagacacacgaggctgagccatgcaggcatgtgttccagtctcagctctgccccttctagcgggggacccagttttcttgttggtaacatgggagggagtgcccagtagggagccagtgaacctgttcacagcgttcctgacaagagggtgtgctgtgagtgacggtccgtgtgtcccctccaggcctgcacagcgtgccctcttccttcctcgcctggtgaccccagcccctcccttcctggcttcagtacccagtgggcccctatgcgtgggggcagcatccccagcggctggaaggttactgcaggacccctcactgctgcccacattgggagaggaggctgcagggtccccaaggctacccccgtccccaaacttccttcctttgccaccgcaaagaagccccagggccgccgtcggcgcatgcaactcacaggccatcatgaggcccaggggggtggccaggagtgggctgccccacaacactgcccgtccccccccttccctgtggaaggctggtcagtgggcacctgccggccactgtgctgcaacaagactgccgctgcagagggcggggtccacagtgccccaggtcacaggatcagatcctgctgggagccacccaaatctcagcctggcctcctgggaccctggtcttgggaaacacttggaggggagtgaaacttggacaagtcacacccacccctcggtccatcctctcctgggccctgggggcctgggcctctccagggacaccctcacttctgtctgcacatatgcccacccatctattagcagccttaaaaatgtgttaaatgcttaataatgtgttgggtagcaatacgttcacataggtcaaaatttaaaagatacgcaaagggtatagggtaaaaagtccccttcttatctctagtcttcctgctcccattcccagaagtgaccgaggttccttgtgggacacttgagttgttaaaaagggattcttgcccaagggatttatatgaatggtgacattctgggcattggtgaggaacctgtttttgctggaggtggttgacaggatagggcagtcgtttctttttttcttttctttttttttttttttttttgagatgaagtcttactgtgtcacccaggctgcagtgcagtggagtgatctcagctcatcacaacctccacctcccaggttcgagcgattctgctgcctcagcctcccaagtagctgggattataggcacccaccaccttgcccagctaattttttgtatttttagtagagacagggtttcaccatgttggtcaggctggtctcaaactcctgacttcaaatgatcctcctgcctcaacctcccaaagtgctggggttacaggtgtgagccactgtgcctggcctgggcagtcgttcttgatccctataaacatcaaatgaggaactcaaggctcttagacggatagaatcctcaaataatgggctcttagaatcttggggaaaacaaaagtcaccagtagagggtcgtgactgcaagttgtccatgttcttggcgttttgaacaaagaattggacaaaatgcccagcaaagcaaagaaagaatgaagcaacgaaagaacgaaagcagggatttactgaaaatgaaagtacactccacagtgtgggagtggcccgagcagcagctcaacagcccagatacagaatcttcttgggtccaaatatcccctagaagtttcccgttggccacttcatgctcacctcatgtaaatgaagtggtggcctgcaatcaacctgattggttgcggaaagcagccaaccagaggctgaagtgaagttacaaaggtcacactcctgtgcaaacatctgattggttgcaaaaagcaaccagtcagaggctagggtgaggccgggcgcggtggctcacacctgtgatcccagcagtttgggaggccaaggcaggcagatcacttgaggtcaggagttcaagaccagcctggccaacatggtgaaaccgtctctactaaaaatacaaaaaaattaactgggcatggtggtggacacctgtaatctcagctattcaggaaactgaggcaggagaattgcttgaacccgggaggcggaggttgcagtgaaccgagacagcaccattgcactccagcctccctagcagctgggattacaggtgcccgccaccacgcccagttaatttttttgtgtgggttttcctttcaatatagttctaggaagtaggaacgaaacagccttaggttccctgcctcctattctcctgcctcatcatgagaagctctgctgtttgtggggcgcccaccatgtgctttactctggtggtgtatgatgttcctgctttccctggactcagggctggcatttcgaatcagcttctggactcagacacctctgggctggaatcctagctctgcgccttcctagctgtgtgacctgtgtgagtcactccacctctctgggttccatctccctgtgtaaactggggaggattacacaagaaaatgcaagagttggctggaggagggcctggctctccaagagcatcctcctacctgtggcattcgttgttatttatctgcactacctcctttaagccatccctgccaaccctctgagtgtgccagtgccatctc

SEQ ID NO: 12350 - DNA, 26952 bp, Homo sapiens
atgctgttcacactctcagtgtgcacactctggggtttctgataggtaggaactgatgtatactccagtatgagaaccttcagtggatccccagctgctgagtccagtctgcccagaggcaaggggaataggagagaggggtggggctaggaaagggaggcagaaggaatccaggcctgactgtggtgactgagcacaggaagggttcactacttggttcctgggaactggtgtggggactgggagcacagatctgaacccctggggccttgggtctgatttgccctrtgagccctggtagtccgacagtcccggggaatgtcccaggaaataccaactgtgctattgtgaaatatatatttggtctttgtcccagcttcctggcatgcagctcctaaaatctttggtttacttgactgatggctggcaacccttgggtagcttcaggatggaggctagtcatcagaaagaccaagcaggattagaaggcgggaacttatagccccaccccatcagcctctgaggaaggaaacagggctgaaggctaagttaccaatgaccagtaatgtaatcaatcatgcctatgtaatgagcttctatacaaacacaacaaagcagggttcagagggcttcacgacagtggaggttcctggaggatggtgcctggagagggcatggaggcttcatgtccccttcccccatacctcgccctatgcatctcttcccctgtagccttcataatacccttttttttttttttttgagacagagttttgctcttgtcacctagactgaagtgcagtggtgtgatcttggctcactgcaacctccgcctcccgggttcaagagattctcctgcctcagcctcccaagtagctaggattacaggtgcccgccaccaagcccagttgatttttgtatatttagtagagatggggtttcaccatgttggccaggctggtcttgaactcctgacctcaggtgatccacccacatcagcctcccaaagtgctgggattacagccgtgagccaccacgcccagcccataataccctttttaataaaccagtaaacataagtgcttccctgagttccatgagctgtggtagcaaattaatgaaacccaaggatggggtcatagaaaccctaatttatggtcatttggtcagaagcactgggaaaacaacccagggcttgcaactggtatctgaagtaggggcagccttgtgggactggggcctcaacatgtggggcctgagcctacctccaggtagatcgtctcagagttgaattgaattagaagacagccagctggtgtctgcagctgaaggactactggctttgtatgtggggaatccccgcccccccccccacacacacacacacatctgaagtcacaaaagtattttgtgttgtgagagtaaggagaaactgagtttgttattcttacattctcagatccccctgcctcagcactgtccagcaaggaagtctttgggcagagcctgctcagacagaagtcctggcctgctagacgtgcacataccctgacggtaagccttgcttgcccacacatgtgcccagaaccagtggggatcagctctgcctcccaggggtccttccctctagggcagcctggggctgtttgcaactggctcttgaggccagtggggatctagacaggaaaaacatggccagctggtcaaatgccaagtcctggccctgggtacgggattccaaaaggctccctggatgactgccatgggagtgacttatgtccccaagagtgctttcaggacctggctgatgttccaggatccagagacgttggccccagagagatgtacccttgctcctgcctggctctgtcatgttggccgaggccctcaactctgagccttgggctcagagcccatggagacttgggttccatgtcttcaaagctgagacagtggggcttatactgcaagctcggtctttgaaagtaccaaattgacaaattcaaagaaggcaaactaaagtcctatgtaagtccactgttcagtatcttcctaagggccttctctgggccaagtggtttcacactgaccaaatccaccatgtcagctaatgtacctgctgcacagatgacatcagcaaggcggtgaggatttgtcttcctcaccgggcttcctggttcctggaataggccatctgctcctgaaccccagggccaggtgccaaaggagtgagggcagatgtgggtggttgggaggggtccctccaggactgcacgggagctgggagaggagcactcctggaggggtggcagggccaagggtatccagggatcccatagggccccacagtcttcctatgacctgagcgctcctggaccagcgttctccagcctcacctggcaggcaagtgaggaagacatcgtgcctcccttgtgtgattttatgtttcagcactttggagccaaatacttatttcaagagggggattgcggtgggagggtgtcaagtaatacaaaaaatattcttcatgtagaaaaggttttcaaatttcagatctatttgtattgctgtcaaaatttttgctatgtctccagccacctagactagcacttgctatgttagcttcaattgacttactttttaaaacttgaaccatatattaaaaaaaaawcctgagcaatatctgaaatatctgcctttactgtgctagttatattttttcttattactttaaaaaaataaatacataaatctatattttatagatttcagagtaccacctgaagtcaccttgtcaattacacactgtacaacatggatttagtgtaaaccttcaatccctactgggaaccctcttgcaggcccagccgttgggccctggaggagtgaacggcccaggccaggcagaggggggtaggcagatgctgcctaggggtctagagaccatagcacacatgccagctcaggagatgccctgcctttaactcagcagccagacccctgcctcccaccttgaactgtgcttaacaaggcatccctgaggagccgctgtgccctgcattacctggtagagcggcacagagtctgaagacttcaggagaaggtggggctctatggggagtaagagtccccaggcagagaaagaaaggtggagccttttgagcataagcataagcaaaggacacagggaaaggggtggggaacttcgctgacccgaatttgagaggtacccctgtggccgagtgagctggagacatgtcaaaatggcctggtctgatggccgcctgcctgtgcaggcggtgcggaggcccccagagtgtacagggttttattttattttatttacatatttacatatttatttatttatttacatatttgtttatttatttatttttgagacggagtctcgctttgtcacccaggctggagtgcagtggcgccatctcggctcactgcaagctccgcctcccgggttcacgccattttcctgcctcagcctcccgagtagctgggactacaggcgcccgccaccacggccggctaatttttttgtatttttagtagagacggggtttcaccgtgttagccaggatggtctcgaactcctgacctcgtgatccgcccgcctcggccttccaaagtgctgggattacaggcatgagccaccgtgcccggccagggttttaaatttcaatcgccaattgtaaaattgtgaggcttgtacctaaaatatggatccttggccaccctatttaaaatcctaactcccaccccactttcctctgctccatcttcccctagcatttaatggccttctaagtattttatgcgtaattacttatgcttagcgccatgtgcttctaaacgtttagtgccttttctaaactacttcaaacatgtagcccaggtctagcacatagtgggtgctcagtaagtatttaacgaacgactagcggaagggatggccccatgggtgccacactagcttctgttctggggcctcagggcgcctgcgggaggggcagcggccaggcctgaatccctggttcgccctcgactcagcccacgcgggcctttcaggcttctgggacagatcctaggtccagctgcccacctgattttgtggcaaagaaaaaaagaagaagaagaagcgagaggcgatggcgtttgctttggccagatttaagggcaagcgaggctgcgcgcggctcccgcagggtcggatctccgagctccagggcgcccctccacccgggtgtagatttcccgcggaccccttcgccctcccgggtttcatcagctgcgcaggaatggagctggccagagctctgggagcggggagggaggcgccgccaccagagggcgccggagccccagcgctgcggccggtgagcggccaggctccccggcccagcccagcaaaggcctggggacgcccgacggctgccttcttcactggacctcactgccttcagttctttaagagcagggccaagtcagtggggttcccggctccaagcccagtgcccagggtgggtgggtgggtgggtggatgggtggatggatggatggatggatggatggatggagtgccggcccacagccatctaacggccaaagtggttttggaaaaaaaatgcacagaagacacctactcccaccagcggagttccggagccctcgcagcctcctgttgaccgctcccgcctaatgcagccgctgaccgcccactccccgacggccaggactccccagggacagggacgtgtccccagggcaggcccctggatggacgcggcgactgaccccacttcgctggacgctgtgctgggaaggacacagagaggtggctggggcagcctgcggtcacaaagcgaggcccaaaggggcgctctcctcacccccacgcctcctgggtgccgacctgcaccctcccttcgccaccggactggggccatctgggatgtctcgggggtatccggagggctaagcaccgccgagggacggctccgtgggaagagttttctggacccagaaggcagacgccagtagtactgtcctaggagtcggaggtcggggtgggggagttctcagctctttgggtcgcacggagcttttcttgggtaaggcagtaagtacttaggtttaaaggacttacttacagctaccatttattgagtactgtctgcttgtcagacacgatgcagagaatttcgcggcgtggggcgggtctcattgaatctcccgtcccactccgcggggtgggcctgtgattagctcatttcaccattgagaggtcggaagtacaaaggctacattcgcttttactgagagccgccggcgccttctgctttgtttgtacaggcgaggaaactgaggctcggctggtggcgccgtgggcttggagtccgagccacgctgactgcaaagacgggtctcattcccgcagatcgagctctgccggcggctgcgccgcaagccgggcaggtggcgagcttgagcccccacgcacagaaagcaggaccccctcggctgccttgggccgccaccgccagcaggccctccgcccgggactaacttgtttgcttttcattggttctcattcagttcccgccatcgaaaggccccgtcccgcagctttccacgcgcgccccactttacgcctaaggtcctcagtctctccagtggggccctgtcacagggacaataagcggccctccagccggcgtcgctcaggctgcggacctcactgcagaccgggccagcggtgcggggcccagcggagcctgagaaggtcaaaggccggagcgcactgcgcctcgggagcacagagggagcggaggaggggcgaaggggatgggtggggggtgccgccgagggagtcgcgcgtcagagaccccggccacggccagcactcggctccgggcccgcccctcaccgcgcgccccgccccgccccgcctggctctcccctctaaagcgcccggcgcgcgcctcccaccgccgcactttcactctccgtcagccgcattgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacggtaagtgcgctcggcggggaggccctggcgaggctctgggcttcggctcccgcccggcgcagagccgcggctcctctgcctgcgcccgcagtttgcgccgcccgacacagtgggggtggaggcagctcgcttagctgggcgctctggtgcggtgtcgcgttcaaagccctacttttgcgccgagggtttgtgacctgcagagagcgaccgcctgacctcaagctggctgcagagcgaggtcagccgggacaactgggcaggaacgccccaagagagcgttcgggactggcgcgggaaggcgcgagggtggggagccgcggaccccagacccctgcctgcccaccctccacccactgccttcccgctgcgggctcggtttccacaggcgaatgggctccgaggtcctgctgcgcacagtgctggaggtcgggcggtgcatggcgagagcgcgctttgcaaagttcgcctcatgccgcgacttgaggctgtgaggtccgatgcagccgcgcagcctccgctccctgcgaagccgatcctctccccacaccctcgcggggctcttggccaggcgcgggcgggctgcgcggcgcagctgtcgggcttgtgccacccgccaggccgcgcttctgcacagctccgcggtccgcagcgacgcggacctgggcgcgcgtccagccgctgycttcctgtctcttctcgggttcacctgagagaggcccagggaccctccgagcctcacacgccccctccccagctccccaaacacacctgcagacaggctcttttgtcaccagctggccaagcgctttgccccagaatgagagctgcagcaaagttcaatctccaaggccctgggccactgggaaccgtggtgtcccgtttcactgggagagggcttttttcttttctttcgctgaagagaaactcgctgcgctgtcacaggacaccgatgcaaaccaaaataaactgttgcctctgaacacacaaaacaaaaccctgtggctcargccgctgagcttccttggctgtgaagtttcctgcaaagagttgaaggacactctgagtgctcttgcagccgcgggctgtgcaggcccagcgcgcctcgagcccttggctgggttggtgcagacgtggccccggcgtcctagctggcttggactgtgcgctggtgtgagcaggaccagcgcagctgagtcgggctggagaagctgggcagcctggggtcgtggcggactgcctaagtgttaaggacacagactgaaggcaattgggaatgttcgtcgttgatgaaaagtccctgaggctgtgtctgcacactgaccccccccccccccccgcaagtcatggggcatgtttctagtttttattgctggatattcttctgttcctgtaargtctctggtttgggcagttattgactgattggtgggatgakcgcggaggtgtcacagtgcgccgctctgggaaatggtgctgccccctccccggagggctggagagaggattggaatgaggaacctcggtctttgagttatgggtgcaactgacctgggggaagcacagagacgtggggttcatcccagactcctcctggcctgggaagggtgacatggccctcagagttgccccattggcagccaagtaaccagggcaggagcctgggctccaggcagatctgctccttacacacatcgccagaatgttttgttttgttttgttttcccctcacctcacagtgcctatgtgccccctatccccacacttagtcctcaagctgcactacagagagagcttggccaggggtcctgcccctcccccattggctgacttccgtcaggcagctgggcccttgggtttcccgggcttaaactcagggtgggcccccttcccaagcctgcttggaggggccagctgggctcctgtctctgcattagactggagggctttctgaaaactcctggagccaagctcacccggtcccaaatccggggtaccatcagagccagtcaggactcttgccggtacacggatttacatccagaacggttgggaaagttagtcttactgacaaaaagctggaggaaggagcacatgaggtacacacgagaccatgttcttttggtaagcacacctgggggctctgtcactttaaaaagacctgttgaaattcgctgcttgacaggcgggccttaggtcctgggagtagaagcaagaattgcttttgaaggaaatggataatcccagggggtggagggggagaggagagagagcctgtgtgttgagctctgaataggctctgatttctggcctcatcaccactgcttggttggggggccagaggagcttctctcctctgggcgctggagagtcacagccccacccatcccagcgggggcggctgcagcacttgcccttggctgcatatcttcaagctcactgttgccgggagggggcttgtgcctcactaccggcctcctattctcctgctccacccccaacccaccccctgcctcagcttggaagggcccaaaagaaatccagggaaacctggaggcacaacactcaggagcgtttagctcctcagttacccaggctgcaggccccggccctgggggtggctttcccaggtgatctggttacagtgcagtgctgacttcccctgcagggtcccagtgcagctgctggaagctggccccagaggtgcctttctggagttagatcaggtgtaactgtgaaggctgcyttaggtctctccagtgccatgagtcaccagcaccctgatgcttggctttttcctggttttcagggagttgcatttggtcctggggacaaggaagtggggggacaagtggtccacttttcctgcaacttggtggctgaatacacaatgcarttcctagtccacatcatccctcaattgattgcagtctgtagaaaaaataaaataaaatgagccccttactcaagatttcctcctacttccccagcattctttcccaaaggtgcagaatttcagaaccacagaggtctctcagaactttgtaaacaggcaaacttaaaaaaaaagaaaaaagaaaaaaaatctctggaccaaatattcttagacatatatttaatctctgatgaaaggatccacaagttcaaataatttggggtattaagtggggcttggataaaatcttcaaggaaaaaagaaaaacaaaaagcacacacaaatcccagccctccagggcttgcaatcctatatttaaagggtgagcagtgggttctgcaggagccccttgctaatttacactaatgagtgtcaattatggcattttgtaaattggtgattttgcaaagatcttaatacaattcctgaggctacagcatccctgcctaggcaatgaaaaccacatttaactccagctccactaatctctaagccttggggaaagtgctgggcagaaggtgggtccttggcctgctctcaggggactcacaggtaggaagccagccaggattcttttgtgccttccagagctttaggtgaatgtgaggaggggtctctggggtgggggagggcagcattcctgagtactactgtgcttcctggctagaggcctgtgccagaggagagaggccagggagcctggagcctcttgtccccctttcttttccctgagtagggagatctttctcagttgtcccttgaggaattttttttacaaagagtaactggaaatttcagtaccttggactgaaaccgttatctactataattactacctttatcttgagacactgagcaggtggcttctaatttaatctcccccctcatctaggctccggctctccccaggcctgttgggctccttgccctgtagaagctgagcctgagctcagccagcactcactgtgttgcctgaggagatggcctttcccaacatacaccagtaacctggaacttaccccagtgatgccgtctcttgatccttaatcgctgcaccaaytgctgcagcccagacacacattaccaaaatctggcagggtagtaaagtgccttgttgtccttacctcttctagggaagcccgtcagcctgagctacagatgcccatgccgattcttcgaaagccatgttgccagagccaacgtcaagcatctcaaaattctcaacactccaaactgtgcccttcagattgtgtaagtcttgaaattgaacatcatctaacgaacatagttgcatctaacgaacatagtaacatctaacccgagtcttattaaaggtgtagaggtgacaagccaagtgtccaaccttgaacttggcataattagtggcagctattcttatcatgaggacctttagtatgccaccaggcattaattttaaaagccgctcttggcctgggcaccctgctgtgctcgtagtagttctctcttctttccaaacctgtgttcttcagcacagcacagctggatgctggagaaactatgggcttcaccaaggttttggctgaagcctagtaaattasccagcccttagctaataacagtgataactggcctgccagtttyggggatctgatgccctacattaactcacaagacccaaatgcagtttaagtcctctttaaccattgggtgaaacttcaacattttcagctcacttgcctgtattttctcaagtacaacatatgaggttttggtgttatttggtgtggatggcagccactaacatttgattttattcatttgggaaacaaagaccaaaatcacacatccacaagacaggaagatctcagctgggtacagaagaccgggagaaatgcgggaagaaagccatgtgcttgaaagccctctcatgctcaagaggtcctgtgtctgaacacggggaagcgagggctcagggagtctcctggagaggatttgattgctcagaagttctagtgctaaawatggggtggggagacagcagttggaaccaaagctacaactttcccaagacttttccacccaacaccaaatgtttttacttttgattttagaaaactgtttttagttttgagttaaccctttactgccttgaatgtgtttgttatttacagtatgttttagggccctagaaaatgaatgttttttcagtactttgcctacaacatgatactttatctcttgtgaagagtattttaaagatgctcaatttagctascttggacctgctttacagcactgatcatgctggtttacyggcctggaaatgcaccttgaagttgaagatgccaaatacaattctcaggtctgagcagacactaaattaacaaagaataggccccagatttggaccccaatgtgggttgctccgagccacacccayctctgcacccctcttcacctaatggacaggctgcttgaagactccctgggtgcccctgaaccactgttctggggcttagctgtcctcaagacccttaagtacttgggctgcatgagattacctggcaccaaagggctttctggcaagagatycagagagatgaaatcaggccytccccaggagtttgcatgtagggaagcttttaagagtgtgaacttytaaaaaacaaatgagaccaagaaacattcagtgaacttgtaaaatctttctagaaactattttctggtaagccacctgcactgcccctcccctccctggctggtcaccctcccggtcagaccgcggtgacttctggcaggcctccttcctccaggcttcctcatgcccatccttaagtcggccctatatctatcaagatgacccatccaaataaacctctgctctgttgctctccattctcccctccccaggtgcctagagcatcctgtcgtccccttcctcagtttcctctgtatgctttgatgacccccctggcgtatttgctcctgattttcccttcccgtttatttactctccaagctcctacttatccttcaaaggcagctcaaatgctcccttacatgaattcccctgcactgccccggaaagacttctgttcacatttccatgtctctgcaatggaacttcctgcactgccagcgctgagctttccccagcacaccgcgagcacmtctggagcctgagcgtaccaagtggagcacggggtgccagcgagggccctagatgrgtgttgggggagcggatgcacacgttgcagccgcgcyttcctcctgtgcagccgcacactgttgccattctgttttcacagagcccggctgaagaacaacaacagacaagtgtgcattgacccgaagctaaagtggattcaggagtacctggagaaagctttaaacaagtaagcacaacagccaaaaaggactttccgctagacccactcgaggaaaactaaaaccttgtgagagatgaaagggcaaagacgtgggggagggggccttaaccatgaggaccaggtgtgtgtgtggggtgggcacattgatctgggatcgggcctgaggtttgccagcatttagaccctgcatttatagcatacggtatgatattgcagcttatattcatccatgccctgtaccygtgcacgttggaacttttattactggggtttttctaagaaagaaattgtattatcaacagcattttcaagcagttagttccttcatgatcatcacaatcatcatcattctcattctcattttttaaatcaacgagtacttcaagatctgaatttggcttgtttggagcatctcctctgctcccctggggagtctgggcacagtcaggtggtggcttaacagggagctggaaaaagtgtcctttcttcagacactgaggctcccgcagcagcgcccctcccaagaggaaggcctctgtggcactcagataccgactggggctgggcgccgccactgccttcacctcctctttcaacctcagtgattggctctgtgggctccatgtagaagccactattactgggactgtgctcagagacccctctcccagctattcctactctctccccgactccgagagcatgcttaatcttgcttctgcttctcatttctgtagcctgatcagcgccgcaccagccgggaagagggtgattgctggggctcgtgccctgcatccctctcctcccagggcctgccccacagctcgggccctctgtgagatccgtctwtggcctcctccagaatggagctggccctctcctggggatgtgtaatggtccccctgcttacccgcaaaagacaagtctttacagaatcaaatgcaattttaaatctgagagctcgctttgagtgactgggttttgtgattgcctctgaagcctatgtatgccatggaggcactaacaaactctgaggtttccgaaatcagaagcgaaaaaatcagtgaataaaccatcatcttgccactaccccctcctgaagccacagcagggtttcaggttccaatcagaactgttggcaaggtgacatttccatgcataaatgcgatccacagarggtcctggtggtatttgtaactttttgcaaggcatttttttatatatatttttgtgcacatttttttttacgtttctttagaaaacaaatgtatttcaaaatatatttatagtcgaacaattcatatatttgaagtggagccatatgaatgtcagtagtttatacttctctattatctcaaactactggcaatttgtaaagaaatatatatgatatataaatgtgattgcagcttttcaatgttagccacagtgtattttttcacttgtactaaaattgtatcaaatgtgacattatatgcactagcaataaaatgctaattgtttcatggtataaacgtcctactgtatgtgggaatttatttacctgaaataaaattcattagttgttagtgatggagcttatagacgtttctggtttatatagttaagcctgcctgcagtcaggtgtctgagaccccttctcacagcccatgtgtgacagtgtatgggcttttctcacgagcagattagatctgcagctcaagtttttggatcttttttttttttttttaacccgattgaaatagcagtgctggttttctgaagaataatatttgactcactaattcgtcttccctccctcctcctccttggttctcctaacttccccatgtaatccccagagactcaaccctagtaatatcaaccttttacattttcccatgtaaaaatcccatgactccaggccatggttaatatgaagctttcacagggacaggtggcctcaccccataaatcattaaataccattcagcttgaatcattttaatgtgacagtcacgagccagttgctctaataaaattctgctaaccagctctctcccttgctctccagaacaatcgcattcattcccaggagtgttcacaggcgtctagaaaggggaaggtgggaccactgccttttttctcctcttctgaatggcagtctgaacctggggcctgcagcctccaaaacgttattcaatttgaaatgcagacatttcttagagaaagctaagagttcagccctgcattgagaagaagaaaaagtcccatgagarcagggcagggtggggtgacaaggaccacgatggccagcctggccctgggtgtaccctgagatgtggattccttgtccccagtgggaatcrggttcaggttggcagattggcagtcgctgtaacccattcacaaaggtgttctaggagcccattgaacatttgtttgaatggaaggaaatgtccaatttattttaatgaattactgataaacagtgctttgaccaggggcctccaggcctgagactgaaggcacagtttaaccagtacacgggccagtgttaaatyttatgcagactgagacgaacttttgtttatttccacattattaatggtwctactaattttatctaagggggcgcagagaagaaaaagtggggaaaaaagaaaagataggaaaaaagaagcgacagaagaagagaaaggctgcccagaaaaggaaaaactagttatctgccacctcgagatggaccacagttcacttgctctcggcgctttgtaaatttgctcgatcctcctccaggacagacccccatgcagactgggcaggggctcagacttccgtgggggagcagtgctttgctgccctgccagccacaccggcttctgtatttatgtgctttttaaggcccttgttggtctgctaagttatgaagaaagtagttgtgcagagactggggcgggggtctgtgacgcggagsctgtgtgctcaggactctgtccagaatagcctgggagctccaggaatgcccaggttgctgagccccccagccygccctccacttcctctcttagaaggcctgcgctcactggggagctcaccagctccacayacttgcagtctgcattcctgtggagaccaggctgtggccacctggccagtgtgcagggcaacctgctagcccagcagaggtggcctcgccaggaagggggtgtgccacccctctgtggccctcaggaaaggtgaaaactgactgacccttaggaatgggccctggctttttccaaatacccattgcctttccctccagcactctgccacctgggaaggggcttcttcagcccctccttcctgggttgtgggagtggctttatccccaagcccgggtgggtttctgcaaactgtgtggggtgagcccgagggaatgctgcattctcagagagcagatgtggaaacacttctcagggagctcctctttgggcaattctctttagagtctttaaacgggtcccccacgtggaggacagatgtgctatggaactttgcaagggtcctgaatccctggggatcccagcctgtcccctcccgcctcctgcgtgatggcgtgtgctccagctgcagggcacagctgcctctgtcctcattcatgggaaataccttatctgcctaaagcaaataccacttaagctctaggaactttcctgcaccctccttccctgcccatgtagatgtatgtgtgagattttttggcaagtttctctaatctggaccgggaggatggaagagcaaggacsccatttcagtagtgctcggaaaaaggatgcgttgaatttctcagcccttctccacctcacataaacacccgcccaccctgcacccrgatcctgggtcataattttaataaatgcagaaagagaaagtggttggaggatggagcacatggaattcaggagaaaacccacaaagacccctgcatgtcagacacaccctgtcccggagcgtggtgtccccttgagctttaatgagctccctgtgatcacagccatgccttctcctcsttggggaggtgtcctaggatgcttcagccaaagacctttgtttcccrctgctatctcttttacctggacaactctcctggcccacgttcctcttgccagcactgggggtcacaggcctgagccctgggtacaggggtgccctagtcttctgccctccccacctcttaaggcacagagctgttgggtgggctgcctggggctgccatccttcccgtggaagccagtagccactctagtccatgggactcttgacaaaagcgccccgagagggcaaacctgtgcccccatactcgcctgcattcttcggactccacatgcagcagggctttgtgcctggggaggggtggccagtctgtcctggtcagtatgaaaagctgttggccccctagggacagagggcccagctaaggctgcctgaggatacaaactgcttgctwtcccactcctggggagcagggtctgcagggactgagagtgggtcccaccttgagaacgcatgcaaggtccgtcctgtcttgatgtcttgatgtgactgtatgtgccctgggggctcactgtggtttacaagtggcttgtgaagctcctgggagcaggtggtacacccagtgctgaagacagggtcgccgtggaagagygaagagcctgaccgggattcctggtgggttgaaactaggaagtgctcacaccagtcagagccaaatgaggggtgcgctatggtcactgctctgtccagcatgcgttcctcctgggaggtcctggccacctgtgcacccacccctgtgccacctccagcagtcccacctggggccacctacggtggcatggcccctggctgagaggccccgagggcgaagggttactggaagccacgaaagtgcctcttgggacagccgaggccaggatgcagggcagcagcatcctgagcctcagccccacgccggtgccgggtaagcagtgtgccctgtccccgtcgtatgaccactctgatgggcctctctgtgccttygtgcgtctgccacgcccagtgcttgccacrtgtctgtcctctgctttctgccatccatgggtccctccgcttcagcctggctgcgtctcgcactcccctcccgtctgttgtcgcagggcctctgaagggagatgcatggccaaggtggcaacttggaagtagggattggccccagggcctccgcgcaggccrctgtcctkctggagctggctgggtgtggggggaacctgccttaatggtgtttccctctgttcttgtcaacaggaggttcaagatgtgagagggtcagacgcctgaggaacccttacagtaggagcccagctctgaaaccagtgttagggaagggcctgccacagcctcccctgccagggcagggccccaggcattgccaagggctttgttttgcacactttgccatattttcaccatttgattatgtagcaaaatacatgacatttatttttcatttagtttgattattcagtgtcactggcgacacgtagcagcttagactaaggccattattgtacttgccttattagagtgtctttccacggagccactcctctgactcagggctcctgggttttgtattctctgagctgtgcaggtggggagactgggctgagggagcctggccccatggtcagccctagggtggagagccaccaagagggacgcctgggggtgccaggaccagtcaacctgggcaaagcctagtgaaggcttctctctgtgggatgggatggtggagggccacatgggaggctcacccccttctccatccacatgggagccrggtctgcctcttctgggagggcagcagggctaccctgagctgaggcagcagtgtgaggccagggcagagtgagacccagccctcatcccgagcacctccacatcctccacgttctgctcatcattctctgtctcatccatcatcatgtgtgtccacgactgtctccatggcccygcaaaaggactctcaggaccaaagctttcatgtaaactgtgcaccaagcaggaaatgaaaatgtcttgtgttacctgaaaacactgtgcacatctgtgtcttgtttggaatattgtccattgtccaatcctatgtttttgttcaaagccagcgtcctcctctgtgaccaatgtcttgatgcatgcactgttccccctgtgcagccgctgagcgaggagatgctccttgggccctttgagtgcagtcctgatcagagccgtggtcctttggggtgaactaccttggttcccccactgatcacaaaaacatggtgsgtccatgggcagagcccaagggaattcggtgtgcaccagggttgaccccagaggattgctgccccatcagtgctccctcacatgtcagtaccttcaaactagggccaagcccagcactgcttgaggaaaacaagcattcacaacttgtttttggtttttaaaacccagtccacaaaataaccaatcctggacatgaagattctttcccaattcacatctaacctcatcttcttcaccatttggcaatgccatcatctcctgccttcctcctgggccctctctgctctgcgtgtcacctgtgcttcgggcccttcccacaggacatttctctaagagaacaatgtgctatgtgaagagtaagtcaacctgcctgacatttggagtgttccccttccactgagggcagtcgatagagctgtattaagccacttaaaatgttcacttttgacaaaggcaagcacttgygggtttttgttttgtttttcattcagtcttacgaatacttttgccctttgattaaagactccagttaaaaaaaattttaatgaagaaagtggaaaacaaggaagtcaaagcaaggaaactatgtaacatgtaggaagtaggaagtaaattatagtgaygtaatcttgaattgtaactgttcttgaatttaataatctgtagggtaattagtaacatgtgttaagtattttcataagtatttcaaattggagcttcatggcagaaggcaaacccatcaacaaaaattgtcccttaaacaaaaattaaaatcctcaatccagctatgttatattgaaaaaatagagcctgagggatctttactagttataaagatacagaactctttcaaaaccttttgaaattaacctctcactataccagtataattgagttttcagtggggcagtcattatccaggtaatccaagatattttaaaatctgtcacgtagaacttggatgtacctgcccccaatccatgaaccaagaccattgaattcttggttgaggaaacaaacatgaccctaaatcttgactacagtcaggaaaggaatcatttctatttctcctccatgggagaaaatagataagagtagaaactgcagggaaaattatttgcataacaattcctctactaayaatcagctccttcctggagactgcccagctaaagcaatatgcatttaaatacagtcttccatttgcaagggaaaagtctcttgtaatccgaatctctttttgctttcgaactgctagtcaagtgcgtccacgagctgtttactagggatccctcatctgtccctccgggacctggtgctgcctctacctgacactcccttgggctccctgtaacctcttcagaggccctcgctgccagctctgtatcaggacccagaggaaggggccagaggctcgttgactggctgtgtgttgggattgagtctgtgccacgtgtttgtgctgtggtgtgtccccctctgtccaggcactgwgataccagcgaggaggctccagagggcactctgcttgttattagagattacctcctgagaaaaaagsttccgcttggagcagaggggctgaatagcagaaggttgcacctcccccaaccttagatgttctaagtctttccattggatctcattggacccttccatggtgtgatcgtctgactggtgttatcaccgtgggctccctgactgggagttgatcgcctttcccaggtgctacacccttttccagctggatgagaatttgagtgctctgatccctctacagagcttccctgacycattctgaaggagccccattcctgggaaatattccctagaaacttccaaatcccctaagcagaccactgataaaaccatgtagaaaatttgttattttgcaacctcgctggactctcagtctctgagcagtgaakgattcagtgttaaatgtgatgaatactgtattttgtattgtttcaattgcatctcccagataatgtgaaaatggtccaggagaaggccrattcctatacgcrgygtgctttaaaaaataaataagaaacaactctttgagaaacaacaatttctactttgaagtcataccaatgaaaaaatgtatatgcacttataattttcctaataaagttctgtactcaaatgtagccaccaacagtttgaaattagtgttactacttggaattttctggacgtgctttttttccccacaaacccaaaactgagggttgtgtaatcctggctacagtggttcatggaaaacagggcattgtaatcatgctaatcacagctgagaattctggaggcatacttgcctcttctggacagctgatccttagcagggaaaggtgctcccttttctctgagtgtctttgattttgctagaattgcttctgaaaggccagcctgtcctccactccacaagggatggttttgtgcaagggtctcaggtatttcttgacagctgtgaggagggaagcttccactctgcccttctcagtcctgggagaatgcaacagaggtctggccctgatggtaattgctgaggaccagcactctgtgtgtttcctgcactgcacagagaccttgctggaagccagacacgattctctcacctagcaatggctagccagcactgtcctggacatggggcataggagatgagcccagcagacaggttctggtcctcacagaggtcagcccttaacactctctagcacattctctgtcatccacagtcaactttgttagaaaggagagtcagcacaaaagttccgaatgtctgagtcagattgtccggtcctccaagccctcttccccattggtccagatgtgatcacatcatcccatgccaaatcttcccatgacttaatgggatggccgtcatgtgggtgctaagctgcagatggactggggaaggaagaagggttagagcaggccgggaagggcagcgtggtgtcaggggacctgtgcaggtgtgaagatcagtagactggggcttgcgtcccattcactctctgctccctctgtgatttgagatgcatcccttgatctctctgagttccagtctcccagctgcaacactgaagcttattactgccaacggtcaagaggattagactgggagagtgtgtggaagaagctagcttttgagggacaggacaaagcccgcccctccaccctgaaagttccccattttgctccctctctccacctcctgtttcctgaggtccacagagctagaataagacccacatctgcctctgctgagccccttaacaaagctcagagaccaagggagcaggaagtgacctggaagctgagcctgcccctcagctaaaggatggggagaagtcactgggtcgcatcccctgtatctccggcacaccacactgctatcctagcactgggaatcgacaatgggccaacccttcaaaatgacctggcatcagaaagaaarcctgagccctggcatgcttgcattctcccctcatttacttggccaacaacagctgtgatgcctctcctgcaccgcaggagtgtggggagcaagacacactcactctaattccatgaagcctgcagtctggcggctgccgtgtgagaagtgggtattttcatagattgtggtgcattcaggcatcagggaagcgtaaaacagaaaagacccctaacttaggcatcagtaaggatttgcttaaaaagcgctggtgaaggtgagacctgagaaaagtggattctttggggaggtggtctactgagcccatgagggctggcatggagagcccaggtggtatcctcctgtgaattggaaagggggcttattctagaagccggaggtgtagctcacacagggagtctggcatggggggcacagggcactgggtttcagcttccttattcccatcacttgtgggaggcacaaacacagctgagaaagctggacccccacggtgatggggtcccctcagcacggctgattgcatggagtggacactggatgcatattgcaggccgatctgattttctgtcacaggagtacaaggctgtgattcaacagcatcgggctttgctccctttctctgtgcctgcagctgaggactcggcactctggagtgtgggctgccgggagacagaagcagagggagcccccactgcttgaaacagattcagagagagaagtggggatgcaagaccagggaagcaacctgtggctgcccatggagggcctggagaacctcagagggcattggtcactggtgaagtctggccacactccccgccttgggttctgtgtgttccaagtaaatcctcttggaggtaaaatgaggatttctgctatttacactcaaacaatcatcaccagggtcaacttgcaagctccaaagaaagaccatttagatcagcgttccccaacctttttgacaccagggatcggtttcttggaagacaatttttccacgggcagtgcagggtggggtgggtgtggtttcaggatgaaacttccacctcagaggatcaggcgtgagttagattctcataagcagcacgcaacctaggtccctcgcacgcgcagttcacaatagggttctcctaggagaatcgaatgctgttgctgattatcatgacaggaggtgagctcaggtggtaatgctccctcacccaccattcatgtcctgctgtgcagtccagttcctaacaggccatggacccctactggtctgcagcctgggggttggggacccctgatttagaccacacagattccttagctgtgcctgctacccattaggattgatcaaagaccctgaggcattccccgagcctctctccacataaggcacacaggacccgtgtagcacccaccctgcctgcccagcatcagctgtgaagagacgggtgaacatccgtcagcctgggagagctctggcccagccaccaggtgtgtgcagagaaggcttgggcctactgcacagcctgtgtatccgctgagcagagcaaactggagatagctaagtcctcagctgtcctcaggtagagtctgctcctagacatcccccactaggaggaagctccacaatgccttttcagggtttcctgccagtgcctcatcatggatgtttcacagacttaatgagtaagctgactcttcaggctgcaaggcagcaccaggccctgggcagcagcctctggtcaagtcacagcccaaccctggggttcccgtcttagctgctgtcagatttcaaggccattgccctgctacaagtaagagcataaggaattgtgtccaccccttggcccatgaaactaaaaagaaacaaagctgaatgaagccatagatgaaggctctgaactccccaatcctcctattcttgctgtgaatggaggggcctggggtggcaagtggggcttgtggacttggcagctgagtggaaagagccccaggcttagaataaaggacccagctgtcaatggctgtttaaccttctccagctaagtctaacttagtccaccctgcacctgcacctccaaagctgatcggagcttagaaaaaattcttccctgctgtccactctcaaaattcatactcagccacctgatcctactcagcccttctgtttgcccttcctactcctgggggcttgttccatgctttcttctctttcgttaagctttcttcctcctctcctttgtcaacttgcagctcatgatctggcttcctctgtcacagaatcaaagggagcattatggaggggggtttcccaaacaccacatgttctcacttataagtgggacctagatgataagaagacatggacacatagaggggaacaacacacactggggcctgttggaaggtggagagtaggaggagggagaggatcagaaaaaatgactaatgggtactgggcttcatatctgtggatgaaataatctgcacagcaaacccccatgacatgagttcacctatacaacaaatctgcacatgtactcctgaacttaaaagttaaaaaaaaaaagaagaagggggttttcacaagcttcacctctcgtccacccactcatccaatatgtatgcactgtagctgctktcacccacctccctgccacccagcacctgggacatggagatcagcattcctcacctgcacaaggatgcctcttctgacttcccctttctgctacaccataattttttcactgcttacattaacctgccaacatgttataatatctcctatcaaaaacaaagcaaagcaacattgaaaacgatctctaacctatatcccactgcatcttctggagtatctctgcttcttatcacacacaagccctcaaaagggttgtctgtgttccccatgcccactgtctctccgcctctcccttcgttgagcccacttccatgagcattcctttggctcatgtgctggagctgctcgggcgctaggctgccagtcagccccatgctgggaaatccaaaggccagttatcaatgctaagcttccttggtcccttggcatcacctgacattgttgatcgccctccttgaagcacattttctggttggcctttaggaggccaatctggcctgtttctttgcttcacaccctctcattccacttcactgcttcctctttctcctctagacagcttaccatgagagcgtccagggttcagtgctcctagcttgtcttattttcttatttttttgttgtttttgtttttcttttcttttttctttcttttttttttttttttttttttttttttgagacagagtctcattctgtcaccctggctggagtgcagtggcatgatcttggctcactgcaacctctgcctcccgggttcaagcgattctcctgcctcagtctcctgagtagctgggattacaggcatgcaccaccacgcctggctaatttttgtatttttagtagagatggggtttcaccatgttggccagcctggtctcgagctcctgacctcaggtaatccgcccgcctcagcctcccaaagtgctgggattacaggcgggagccactgcacccggcccctagctcttcttgagcaccagttgtactcacttgttcttttggccttgaacaccatggaaacatgaaggaattccagagtgctgtctccagcccaaacctgtacacccagctcctcctctgaaatgcaccatatgcagaatgaaactctgaatttccacctgcttatccccatttctgcaaatggcaactccatcctttcagtggctcaggccaaagcccttatatttatctttgattgattttattctcacacaaccccaagctaaaccattaacaaacccaattagttatcatgaaaatatttccagaatccaatcacttctcactgttactgtcttggtccaagtcacaggggtctcctgcctaaatcactgtgctagcccctgactgtccaccctcaggctctttcagaagcagctgaagtggcctgtgatgatggctggctgcagcccacctcctcaagccttcctgtggcttcccatcccatgtggtgtaacagcctacaaaggtttgccccaccagcctggcatgtctctgaactcagccctctctgctccagccacactggcctcctcttacttcaacaggtcaggcccacccctggcagaggacttttgcagtagttggtctcttggcccgcatatcatcccatggttcacccctcccttcctgcagcctctgctcaccatggccttgtcagaaaagcctttgcagaggccccctcctcccacgctgctgcgccccggcctcctcttgctgctgctcctctccattgcattgcctgaccacatctgtttgtttcttgcctgctttcctgcgctgcacagcaaggggggacttggtctgttgtgtttgcctatcagttgctgtggctggcacatagaaggtacgacagtaattttggaatgatggcacaatagctaaatgggatgttaacatgttggacgctttctccactcatctctgcaatgaaggcagcaactcacctccagggttgtgcattcatttgcacacccaaggtcacactggtacccaaatccatctcactccaatgtttgtacatcagtggttacccgcactgctccttctgcagactcccct

SEQ ID NO: 12351 - DNA, 32546 bp, Homo sapiens
tacacattgagtcttcaggtttcaaaacgagaactcttcctgagtgctgtaatctggtcaaaatcacagggtgggtcgacaggcctgagttggaattccagcttgtctctttaattgtgtgatctcagggaaaccatctgatctcttgctttagtttattatttatgaaatgaagttaataataactacctcctgtggctcatgcctgtaatcccagcacttcgggaagccaagacgggtggatcgcttgagcccaggagttcaagaccaccctgggcaacatggcaaaatcctgtctctacaaaaaaattgaaaaattatccaggtgtgggccgggcacggtggctcacgcctgtgatcccagcactttgggaggccgaggcgggcggatcacgaagtcaggagatcgagaccatcctggctaacacggtgaaaccccatctctactaaaaatacaaaaaaaaattagctgggcgtggtggcgggcacctgtagtcccaactacttgggaggctgaggcaggagaatggcgtgaacctgggaggcggagcttgcagtgagccgaggtcgtgccactgcactccagccttgacaacagagtgagactccgtctcaaaaaaaaaaaaaaaaattagccaggtgtggcagtgcgcagctgtggttccaggtacttggaaggctgaggtgggagcatcgtttgacctcaggagttggaggctgcagtgaaccaatattgcaccacccactgcactccagcctgggcaacaaaggaagacctgtctcaaaagaaacaaacaggccaggcacggtggctcacgcctgtaatctcagcactttgggaggccgaggcaggtggatcactcaaggtcagaagttcaagaccagcctggccaacatagtgaaaacccatctctactaaaaatacaaaaattagctaggcatggaggtggacacctgtaatccctgctactcgggagtctgaggcaggagaatcacttgaacccgggaagcagaggttgcagtgagccgagatgacgccactacactccagcctgggtgacagagtgaaattctgtctcaaaaaaacagaaaccaaaaactacctcctagacttgtagaaaatattaagtaattttatttatttatttatttatttattttgagacagcgtctccctctgtcgcctggactggaatgcagtggcacaaccttggctcactgcaacctctgcctcccaagttcaagcgattcttgtgcctcagcctctctagtagctgggattacagatgtgtaccatcacacctggctagtttttatatttttagtagagacagggtttccccatgttggtcaggctggtcttgaactcctgacctcaagtgatcctcctgcctcagcctcccaaattgcttggattacaggtgctccaggccaagattaagtaattttttgtgaagcaccaagagccacagctggatatcatattacttaatctctcctggagttatggtgagattaaacagttataaggatgcctggcacagagtccgagctaaatgagtgatggatgtggttactggtggtaacatgctttagatatggaagatattataggacttcctgcatgccaactgcccttcaatttgtgtgggggggaagggtgggcagaaggcagaggctctcactcattctctaacattattgccccctctcccacagatgagtcctgccggcrgtgaccatcttccaacatagggatatacctccctccttcttataactgaagatcctggagcccggaagattcagggcagacagaccctgataatgagcctggcagggaagggcaaccaacatcttgtaacttgctttccccaccctgtttctgggggcagagccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaagcactcgtctctctgggaggcccagaccccactccatttataggcacatctccttcatttcctaggtcactgcccctttgtttacagctcctgcctcctcccttgaccacagcctggtttacaaattccatcagctcccagccccaccygccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaamtcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttcaactcgtctgcttctccttctttgggaaaaaaaaagggtatgtgaggggaggctctggtggctgggggagaggaaaatgatgggggatgaaccaggaactcggcactgacatgtcaaaaggggtctgggaagctgcacgtgggtttcacgcaggacaagcaggtgacatgagaaagggcagttgaagtgtccactagactggaagtgccatgagggctgactacatcagctggattcactgcaatatcctgtacctgtcaactagtagacacggaattatttctagaatgaatgacaacaaatgaatgaatagaagaaaagggttaaaatattacagaggacactttgagttgaagggttctagtattcagaagcctgctgccatgaaggcagctaggtagtgtatgacacaacccatgtggctaatccagggatacttacttaaagagctggggctacgaatactaaatctgaaattgctgcaaaatgaagtaagtatgtacaagagtcagtttcctggaaaaggttcccctctgatagacaatggattttatatcgttaaaggcctaaaggccgggcacggtggctcacgcctgtgatcccagcactttgggaggccgaggcaggcggatcataaggtcaggagattgagaccatcctggctaacacggtgaaaccccgtctctactaaaaatacaaaaaattagcggggcatagtggtgggcacctgtagtcccagctactcgggaggctgaggcaggagaatggcatgaacccgggaggtggagcttgcagtgagctgagattgcgccattacactccagcctgggcagcagagtgagactccatctcaaaaaaaaaaaaaaaggtttaaaaaccatcttgatagtgcatggctttggtgcccatgtagttgatatttggaattttcccatttcaaagaatatcttatacaaatgtggaacatcaatattttactcatcaggaaaatttgtttgtttgttgttagctctccaggctaacaaagatatggttgaatagttatagtccttctaccactacaagttgctcctctcagactggtcagaggaggccccacacctttactataaaacaaaatatatgagacaaattgaacttaagcatacgccaaaggttttcaatttactagcaagagaacaagccaggtgtcaaaagactcagccagttcagagaaggtctgggtagggaaggaaacagaatgattatattagtagcctgttaggtaaaggtcttaaaaagtttccagttgtgacccaggaaaacagagttaggaagctccgaggtgccaggggtgctcacagtccatctcagaaacagaaaacaatgcattcaagaggtcaggccaggtgtggtggctcatgcctgtaatcctaacactttgggatgccaaggcgggtggactgcctcatctgaggagtttgagaccagcctgggcaacatgatgaaaccccgtctctactaaaatacaaaaaattagctggacgtggtggcacgcacctgtagtcccrcctactcaggaggctgaggcaggagaattgcttgaacccaggaggtggaggctgcagtgagccaagatcacgccactgcattccagcctgggcgacagagtgagactccgagactccctttccaaaaaaaaaaaaaaaaaagtcagtgatgtagatccacttgtggctattaataagaacaatgtttcatttcctaacagtagtgcctggtaactgcaattaatcacaaaagtatgatgcaggatcaaacaaatcagacagcagagcatcgagtaacaaattcagctttttgttttgtttgtttttttttttttgagcatagtcttggtctgttgcctaggttggagtgcctgacctcggctcactgcaacctctggctcctgggctcaagagattctcctgtctcaggcccagtgcggtggctcacgcctgtaatcccagcactttgggaggccgagacgggcggatcatgaggtcaggagtttgagaccagcctgaccaacatggtaaaaccccatctgtattaaaaatacaaaaactagctgggcgtgatggcatgtgcttgtcacacttgtaattccagctactcaggaggctgaggcaggagaatcacttgaacctgggaggcggaagttgcagtgagccgagatcgtgccattgcactccagtctgggcaacagagcgagactctgtctccaaaaaaaaaaaaaaaattctcctgtctcagtctccagagtagctgggactacaggtgcacacctccacacctggctaattttttgtagagatggtggggtctcaccctgttgcccaggctggtctcaaacccctggtctcaagatatcctcctgcctcagcctcccaaagtgctgggattacagcaagagccactgcacctggccttgcttacttttaaataagcagccaccagtgattttctcaagctgttaagcaaaaatgcagaacacagtttgcctgttccttagtttggagattttgtctttaacaactttccccagttccccagtttcttcctgcctagaggtcttcccttatacctgacctgtcttcactcctgctgcaggcaaaccagtcctagcaacggtcacttttttgtttgtttgagacagagacttcctctgttgctcaggctggagtgccgtggtgggatctcggctcactgcaaactctgcttcccatgttcaaatgattctcctgcctcagcctcccgagtggctgggactacaggcgcacaccaccacgccaggctaatttttatatttttagtagagacagggtttcgccatcttggccaggctggtctcgaactcctgacctcagataatccgcccgccttggcctcccaaagtgctgggattacaggcatgagccaccgcgcccggccaacaatgctaatatgttttatgagcatggacccgatcttccaatctgaaatagaatttcattcctcccttactttgtatagtttttggctctataaaatttccatactttctttattatgtatcctgtccctcccccaccgcaaaatgtaaatttggtaaggaacttttgatttgtcctctgctatatcccagggacggaaagcaatgagcacacattaggcatccattaaattaatttcacttgttgaatgaatgcgtgagcgaagcactcacagactgaccatcagggggcgtcagagaaactggacagaggcgaaatgaagaaaaaagaattaccccgagttttcaggtatggttccgcgaggtttgaactcgctcggccaccgtagtgcttagaggccgaaaaagtacagccccttccgggctccgcggtacgggaagacagctttgggatgtcggaagatcctagaggtcccaaggtagctgacytgcgaagctgaggctccagccgagggctccaggcctstgaccggcccagcagtgagcgcggctgcccgacgcttcagggccgggagcagggagcgtgagtcgccatggcgacgccggcgggtctggagcgctgggttcaggacgagctgcactcggtgttggggctgagcgagcggcacgtcgcccagtttctgatcggtaccgcacagcgctgcacctctgccgaggagttcgtgcagcgcctycgagacactgataccttggatctcagtgggccggcccgggacttcgccctgagactctggaacaaggtgtcggcaggggtggggaggggccctgtgatttgtcccggtgaggctggcctmacggtccatcgagaagttaagaaagctcagttcrcaagcacttattctttgtccgttgtcgcgtaggtactgtgctagctgctggacgcccagctcagtggagaagattgaggagggcttaggtgtgtcgggttaagcgcaatagaacggtgtttctcgaactcttaacatgcatccaaggttcttgttaaaatgcagattgcgattcagtagggatcttagtttctgcatttctttctttcttttttttttttttgagagacacagtctcgctcgccccgtcgcccaggctggagtgcggtcgtaagatcacggctcactacagcgtcgacctccctggttgaagcgaccctcccacctcatcttccccggtagctgggactacgggcgcgcgccaccacccccggctaatatcttttatttttatttttatttttagagatgaggccttggtgtgttgcgcaggctggtctctaactcctcagctcaagcaatcctctctcagccccctcagagtgctgagattacaggcgtgagccaccatgcccggcccccctcatcttctgaacttcctttcagtcgtttaattaacagagggggccgggtgcagtggctcacacctgtaatcccagcaccccgggaggctgaggcaggaggattacttgagcccaggagttcgagaccagcctgggcaacatggcgaaaccttcgtcctacaaaaaaattaaaaattagttgagcgtggtagtgtgcacctgtgtttctagctacttaggagcctgaggtgggaggatcccttgagcccaagagggacagagtgaaaccctgtctgtaaaaaaaaataaaaaaccccattcaggatgatgaagatggggtgaagccatgaggaagaaagagaatgaatgctggttagctggtttaaaactaagtaattgtgcccgggtgcggtggctcatgcctgtaatcccagcactttgggaggctgaggtgagtggatcatgaggtcaggagtttgagaccagcctggccaacatggtgaaacctcatctctactaaaaatacaaaaatagtcgggcgtggtggcatgtgcctgtaatctcagctacttgggaggctgaggcaggagaattgcttgaacctgggaggcggaggttgaagtgagccgagatcacgccattgcctgacagtggggccgggccgcgggggcaggaaagactaagtaattgcttaaattaggaacagagctaagtgggagggcagagatcaggagttgctcagacctccttatcttcccctctactgacaggtaccacgaaaggcagtggtagaaaagccagctcgggcagcagagcgagaggcccgggccctgctggagaagaaccgatcttataggttactggaagacagtgaagagagcagtgaggagactgtgagtagggctggaagcagcctccagaagaaacgtaaaaagcggaaacacctcaggaagaagcgtgaggaagaagaggaggaagaggcttctgagaaagggaagaagaaaacagggtaagtcagaagcagggtgagagaggatggggcaggctgaagtgttctctatgcccttatttaatcccctggatgggctgcagggggagtaaacagcagacagagaagccagagtcggaagatgagtgggaacggacagagcgtgaacgccttcaggacctggaggagcgtgatgcctttgctgagcgggttcgacagcgggacaaggatcggactcgaaatgtcctggaacggtcagacaagaaggtgaataggagcagcatgttctgtaaatccccaagatcccagggtgaaatctgaggttggctgtgagtgcagagatagtgatctctgggaagacaaggggctgtctctagtgagatgttcacctctgtggtgagagaagccctgtgcatcctgtggctaagacaactgtctgctgtacctgcaatcagagagattcctcactgagaggggacattttttgtgttagggcgcatctgaatgatccttgtgattctagaggggagcagctgtcagtgtgggggctctttggcctcacacccctccattcttgttttttcttctaggcttatgaagaggctcagaagcgcctcaagatggccgaggaagaccggaaggccatggtgagtcccagggcctagggagccaagatcagaagacaaaaggaaagactttctgatagagtgtatagggagagaggatacagaggaagcacagtgtggatgctgatggggkggtcaggtttctagaagaggggcttggttgttaggagccagctgaggatagacttatgttgttgagggaaggatccytcttaagttgtagggggaaggaggctacccataagtcctccttgactcttaactttaggatcaaatatactctattagtgaatgaaattgtgagctttccctattcctgagtcctaatgagatatgaggcagctggaatgttgtcaagaaggttgctggagggcaagggcagggcagcagtcccactgtacagggatgtgctgaccattcagcttaggcacaccatctccaaataccttcccaccacctaattcctgcaccccttatgtggctttgtgatctccctgtgtcttctcactggacagggacagagcccttgtaattcataaactggactttttatggtgtgaaactaggtagggtaagctgttttccaaaggcctggtcttgtcaagtaaagtcacacttagattccccaataccccaatagaattttgagactcttgaagttccttttttttttttttttttttaaaccttttttcttttttttgaaacggggtcttgccctgtcaccgaggctggagtgcaatgatgcgatctcggctcactgcaacctccgcctcctgagtagctgggattacaggcgcacaccaccacgcctggctaattttttgtacctttagtagagacggggtttcaccatgttggccagggtggtctcgaacccctgaccttgtgatccacctgctttggcctcccagagagctggaattacaggcgtgagccaccatgcccagccttctttttatttgttttgttttattttttatttttatttatttatttttgagatggagtctcactctgttgccaggctggagtgtggtggtgcgatctcagctcactacaacctgtgcctccctggtggaggaatcaagcgattctcctgcctcagcctcctgagtagctgggactacaggcctgcagtaccacactcggctaattttttgtatttttagtagaggagatttcatcatgttggccaggatggtcttgatctcttgaccttgtgatctgcccgccttggcctcccaaagtgttgggattataggcatgagccactacgcctggccgtttttactttttaaaattcatttatttatttttttgaaacagagttttgcacttgttgctcaggctgaagtgcagtggcgtgatcttggctcactgcaacttccacctcccgagttcaagcgattctcctgtctcagcctccagagtagctgggattacaggcatgagccacctcgcctggctaattttgtatttttagtagagatggggtttctccatgttggtcaggctggtcttgaactcctgacctcaggtgatccacctgcctcggcctcccaaagtgctgggattataggcgtgagtcaccacgtgcccggccaacttttggagttctaagaatggcctactggttcccaggtctctcctgaccaatttatctcatatctcttcctgaaattgactgtggttaggcttctgggacatctcagtgcagttgtggtggtagtggtgttactgttttggcctgaatttaatttttcgggttttttttgagacagaatctcattctgtcgcccaggctggagtgcagtggcatgatctcggctcactgcaacctccgcctcccgggttcaagtgattctcctgcctcaacctcccgagcagctgggactacagacatgcactagcatgcctggctgatttttgtatgtttagtagagatagggtttcaccatgttggccagtctgatctcaaactcctgacctttggcgatccacccccctcggtctcccaaaatgttaagattacaggcgtgagccactgtgcccagctgtaatttttctttttcgattacaaaaatatttaagcacatagggaagttgaaagaatagaacaaagaacactcatagacactattcagattgaaaaatggttaatactatgggtagtatttgcattgtaattgtaaatgtggtatgttttttcttttcagaccatttaaaagagtcttagacatcatggcgttttatctctaagtacatcagtgtgtacctgctaaggataaagatattgtcctctaaaatcagaatgctcttgtcacagtcaggaagttgaacagtaattcttatgtatcgactaagatctctctacaataaaagataccctcattaccctcaaaataactttaatgactgctttttcctaacaagaatgcagtcaaggttcatgcattgcatttgggtcttagatgttaagtttgtttctctctctgtctgtctcaccttgcagtgtcctacattctggatttgcctgattcttatcttgtggtgttaagtacttctctgccctgtgctttctttgaagcaggaattgggtctaaagcttattgacactcagattaaacagttgtggcaggaacacttcttgggcggtgatgtgcacttcatattatgtcatatcacggggacatactatccagttgtgtatctatatattagtattaatatcctttctaccaatagcctttcatcaaatgcttttagaagccactggtaatcctttcctgaacatgttatttttattggggattgcaaaatggtgattttttttttttttttttgagacagagtctcgctctgtcgcccaggctggagtgcaacggtgcgatctcggctcactgcaagctctgccttccgggttcatgccattctcctgcctcagcctcctgagcagctagaactacaggcgcctgctgccacgcccggctaattttttgtatttttagtagagatggggtctcaccatgttagccaggatggtctcgatctcctgacttcgtgatcctcttgcctcagcctcccaaagtgctgggattacaggcgtgagccaccgcgcccggccgaaatggtgattttttgattctgtcattcctgttacgtgtattggctagaatttgtctataaagaagagcttttcctcaacaactaggaacaagctacagttccttcttaaaaagggtaaatgtttgtttccttttaaatacgaatttttagagtaaggcgtttgctgtaacagtcatttcactggtgacagatttttttcccttgttttttgtttgtgtgtgtcaaattggactcatgaatttttatttttcagtattttataatctcacatcattattctttttaatgctcaaatggctctgattttttgcccatattaaaaaaaaaatctatctggctcttccatggaaggaatatttgactgtggtacccagattaggtcatgatcataaactgcattttaagtctttacagaacaaacaagaaaagccaaacaactaaatagaaccaggccccttaagggtagaacagcagaggggctttttttttaaagatgcagttttgttcttgttgctcaggctggagtgcaatggcgtgagctaagctcactgcaacctccgtctcccgggttcaaatgattctcctgcctcagcctcccgagtagctgggattacaggtgcccactaccatgcccagctaatttttgtattttcagtagagacgggatttcaccatgttggccaggctggtctctaactcctgaccttaggtgatccacccacctcagcctttcaaagtgctgggattacaggtgtgagtcaccacgcccacccagccaccagaggggctttgaccttgcagtagaggaagttgtgatcacagagaggatgatgtcatagtgggaggactcctggcaggaaagggccttatagatattgccagttttctgctgtcatccataatgtgtcctgaaaagtttgtatcaaaggtaaatgtgtagaaactaagtgagacacagcatggtgaagagaggttagtaccagaaagccaaacatccctgattacatttgccttacagaaacactctgatgctgtagtcctaactttttataatcagtttttctcccttcctcaaactacagtcattccgtttaagaccaaagaacatctaactggggctgaagattgcctcctgttggccccctcactggtttctatctttgtctgaattgttttcggtttgagtcctgtgcttctaaaygctggattagccttttattttccccctttccactaatttgaataaaatggcaagagtaaaatataagctacgcagacatctccctagtgcatctatattaacaaagatgataatgctgcctaagaggactttccagctggattctgctgcaggaagatacgatgtggggtcagcatgtagcatccaaagaggcccagatttgagtatgtcattgttttggttgtgcattgcagagggaaggtagagggtgcatcctgaggttctcatgcctgcctgtcaggggatttttcccttgtagggattggtagagaaaggggttgctcctccagcaagatgaggattcgactgtcctttcccaactcaggtccctgagctgcggaagaaatctcgccgagagtacctggctaagcgggagcgagagaagcttgaggacctggaggcggagctggctgatgaggagttcctttttggggacgtggagctgagccggcacgagcggcaggagctcaaatataagcggcgagtgcgggatctcgcccgggagtaccgggcagctggggagcaggagaagctggaggccaccaatcgctaccacatgcccaaggaaacccgargacaggtgaggtgaagyggcgtctgcttcagccttggtccccaagacaagttgtggggaaggcttcaggggattgggcaacacgtgggtcatcccctttcttgccttgccgttcccaatgggcagtgggcgggggtagtaatgggaagaggggagagggcagagaggacatcctgtttttgagtcttcacatatcccctctctctgtagccagcccgagctgtggatctagtggaggaggaatcaggagcccctggggaggagcagcggcgctgggaggaggcgcggcttggggcagcgtccctgaagtttggggcccgagatgctgcctctcaggagcccyagtatcaactggtgctggaggaggaggagaccattgagtttgtccgggccactcagctccagggtgatgaggtaagaggggagctgggagactttctgaggaagacccgtagcgagctatttagctcacacctccttctctttccttaggagccytcagctccacccacttcaactcaggcccagcagaaagagtccatccaggccgtccgccgcagcctcccggtgttcccatttcgagaggagctcctggctgctattgcayatcaccaagtcctcatcattgaaggcgagacaggctcagggaagaccacccagatcccgcagtatctctttgaggaggtacagtcatctcacccttcagcttgccagggcacctggcatcaatgtcctcattcctgtcagagctccttttacattatatttttagtagtcacttacctatcttttccactaaattgtgaaattcttgagagtaaagaccatacccttttcacatttctgttctcacttcctgcattcatttcatttggaaggacgggtagatggataggtggagtggggcgtgtataaatgtggacctccctatgctccaacgtggccaaaaaacaaggagttaaaggactattttcctgcctttttgttagttttttttttttttttttggagacggagtcttgctctgtcacccaggctgkagtgcagtggtgcgatcttggcttactgcaacctctgactcctgggttcaaggaattctcctgcgtcagccttcagagtagctggaattacaggcatgcgccaccacacctggctaattttttagtagagatggggtttcaccatgttggccaggctgctctcgaactcctgacctcaagtgatccagccacctcagcctcccaaagtgctgggattacaggtgtgagccactgtgcctagcccctgccttattttggagacaggctcttgctctgatgcccaagctggagtgatgtggcaccatcatgactcactgcaacctgggactcctgggctcaagagatcatcccacctcagcctcctgagtatctgggaggtgcacaccaccatgcccatattaaacattttttgtttttttttgaggtggagtcttgctctgtcaccaggctggagtgcagtggcgcgatcttgactcactgcaacctccacctcctgggttcaagtgattctcctgcctcagcctcctaagtagctgggactacaggtgcgtaccaccacacccagctaatttttgtatttttagtagagatggggtttcaccatgttggccaggatggtctcaatctcctgacctcgtgatctgcccacctcagcctcccaaagtgctggagttacaggtgttagccactgtgcctggcctgaaatttttttttttttttttttgagacagagtcttgctctgttgcccaggctggagtgcggtggcatgatcttggcttactgcaacctctgtctcccaggttcaagcgactctcctgcctcagcctcccaagtagctggaaatacaggcatgcaccaccatgctcggctaattttttgtatttttagtagacggggtttcaccattttggccaggctggtctcgaactcccaacctcaggagatccgtctgcctcggcctcccaaagtgctggaattgcaggtgtgagccactgtgcctggtcaaaattttgaatttttaatttttttgtcacactatgttgcccaggctggtctcgaactcctgagctcaagccatcctcccacctcagcctcccaaagtactaggattacaggcatgagccactgtgcccagccttcctgcttttttaccttagctggctctgtctcagctaatctgttcttttccagctcaagtctagcagagtcatgaacttaattacccagagctgggtgaggaccccctttgagggccctaggtctgtcatcctatctatttgcccttcttttctggttttcagcatctgtcttttcctccttttctcctgcctggtttttacaacttctttctctgaaatgtacctggtcccagggtgcatatttagtaaagggcaaacttcttcttttttctttgtcattcagggttatacaaacaagggtatgaagattgcctgcacccaaccccggagagtggctgccatgagtgtggccgcccgagtggcccgggagatgggtgtgaagcttgggaatgaggtgagatttctagggaaccggggggtagagtctggggtctgtgactcagtctacagttccctcaggtccctacagcagaagtcttggtgctgccccacttcacctttccccaagttcctttcagggcacaccagsccacacttggttgctaatggttcccttgaccaggttggctacagcatccgctttgaggactgcacatcagagcgaactgtcctccgctacatgacagatgggatgcttctccgggagttcctctctgagcctgacctggcgagttacaggtatctctaatctctggcctttctctcccttcttcccacccagccaattcagccattgtcttctgattaatccacccgttcttgaatctttgtggttcaaatggtccttgaactgacctccaggtaccacggagatggggctggaggacagaagagattgtagagaaagcctcttctttccccattcatctccagggtttagaaaacaaccaggatagcagagcattgctgccgagacttgaaataccgtgtgaagaccatttgaaaacacttggaatgctcagctcagagggagaaacaggaagcatcctggttccctctaaatatgtgaaggctgttacatggaaagaaggatcagattgttttatgtgaccctacacgacatagctaggagccatggggaggttacagggagacagattccaactcaataccaatggctgagtaaccctcagagtggtggagattgcarggcctgtcagagtggttggactctgggtcttggccctccacacaagtcttgggtagcttggtctgtgaataatgagctcttagtgctggaaatggccaagcaggggttggttgaacatgtgttgagggggaaaagggattcatgaatgtaatgggggtggggtcaggccagctgaacaatatgtgcctttttgactcttcagaggctgtgaatttctggtcttggaagatcacagtggagcaattggacagataggattttatccttcatatcccttgcaaaaratctctaagaacccatggagagccagccagcgcaagagtgtctgatgcagatgtttttgcccatcgagccagcctgctttgtggaatggctggggacttcaccatcacagttagggttaggcacaaagagttgaggtcagggaggtgggtaggggaagatggggatgagttcctgggacttggctgccacccagaaaagccaaagaacaaagagaaagaaggtgtcatgcacataactgagttaggaggaaaccaaggagcatgcagagtcctgtgagagttgaggtagaaaggcttaacttgctcctgtctccaaaagaagaaacagtcaagaatgatgccagcagcagttgtcccacaggacaccaggagcttctaggctatttgaatcacagcagctcaggtctattacccccagtcagccttgctggcccacccttattgaaagggaccctgccttccactttttttttcctttaaaacgtatcagccgggagcggtggctcacgcctgtaatcccagcactttgggaggcagaggcaggcggatcacgaggtaaggagatcaagaccatcctggctaacacggtgaaaccccgtctctactaaaaaatataaaaaattagctgggcgtggkggcgggcacctgtagtcccagctactcaggaggctgaggcaggagaatggcgtgaacgcaacccaggaggcggagcttgcggtgagccgagatcgtgccactgtactccagcctgggcgacagagtgagactctgtttcaaaactccgtctctactaaaaatacaaaaaattagccaggcacagtggcaggcacctgtagtcccagctacttgggaggctgaggcaggagaatggtgtgaacccaggaggcggagcttgcagtgagctgagatcatgccactacactccagcctgcaacagagcaagactgtctcaaaaaaaaaatccttccactttttcttttttctttttttagatggagtctcgctctgtcacccaggctggagtgcagtggcacgatcttggctcactgcaacctctgcctcccaggttcaagcgattctcctgcctcagcctcccaagtagctgggactacaggcgtctaccaccacatctggctaattttttttgtatttttagaagagacggggtttcactgtattggccagactggtctcgaactcctgaccttgtgatccacctgcctcggcctcccaaggtgctgggattacaggcgtgagctaccaccatgcccagcctaaaacatatccttcaactttttctagtaagagcagctgctgagtctaagcagactcttgactgaactagagggtatggctaacttgtcctggcctcagtgtgcagcctctacatcttgtytcctattrtctgctgaggctgggataggttgcagatcatggggccctggccttctctgactttctgttgctctacataagtgggatggctgacttctccttagagycccctccgtcaacagtcattcttgaactctttgtgtccattactcccctctcatccagttaacyctggtgtctgatactgcattgcctagcgctcttccctcattgctctcctattccctccccagcgtggtgatggtggatgaggcacacgaaaggaccctacacacagacattctctttggattgatcaaggatgttgctcgcttccgacctgagctcaaggtcctggtggcttcagccacaatggacactgcccgtttttccaccttctttgatgrcgcccctgtgtttcgaatccccggacgcaggtttcctgtggacatcttctacaccaaggtgccccctcagggaggatgggcttaagtctgtggcagaaaagctgaggcctttggagaaggttatcctgtggagggaaagatggaatggaaggttcaaaggggaactaggataaagtgtatgttgaattgggaggagaggaaaggtttgcctaagcaggtggccctcctgtgaccccatctctttctgctctccaggctccagaggctgactacttggaagcttgtgtagtatctgtgttgcagatccatgtgacccagccccctggggatatcctggtgttcctgacaggacaggtgcctgacatggtggggagaggggatgatgtatcccaggggaagacagggccggcatgttggccttctgtgactctgggacccctgctgctctccctaccctctatccaggaggagattgaggctgcctgtgagatgctccaggatcgctgccgccgcctgggctccaaaatccgggagctcctggtgctgcccatttatgccaatctgccctctgacatgcaggcccgtatcttccagcccacaccacctggggcacgaaagmtcagttggagaaacccacactcttcacccctrtgcttcccacaactagtagtgaaaaagctgtgtgcctgccccatgcaaggtgagtcctgcgcactgctgcacacagctgaggagcagccagtcccttgttcctgggactgaagagaggagaaatatggtgtgaaccaagagagagccaaatatgtgatctggaaagtatgcacagtagattcagtggagaagggaagtccttgatgtgctaagaggtgggatttgatatggacctttaagagaaatgtctgaggtcaggtgcggtggctcacgcctgtaatcccaggactttcggaggctgaggtgggcggatcacttgaggtcagtagttcgaaaccaggctgcctaacgtggtgaaaccctgcctccactgaaaatacaaaaatcagcagggcatggtggcgtgcgcctataatcccacctgtttaggaggctgagtcatgagaatcgcttgaacccaggaggaggaggttgcagtgagctgagattgtgccactgcactccagcctgggtgacagtgcgagactccatctcaaaaaagaaaaatggctgagaagtcatcagaggaaggcccaaggtatgtttgaggtcagagtgtgagmtagtaggcttagtgggaggttcatgtggtgaaggagtaggagacaaggctaaaaacaatttggggctaagattagggagggcctttgatgacaggaaagtttggactttatttatttttcttttttgagacagagtctcgctctgttgcccaggctggagtgcagtggcaagatctcggctcactgcagcctccacctcccaggctcaagtgattcttgtgcctcagcttcccaagtagctgggattacaggtgtgtaccaccaccccaagctaatttttttttttttttttttgagatggagtctcactctgtcgcccaggctggagtgcagtggcaccaactctgctcactgcaacctctgcctcacaggttcaagcgattctcctgtctcagccccccagtagctgggattacaggtgccctccaccacgcctggccaattttttgtatttttagtagagatgaggtttcgctattttggccaggttggtctcaaactcctgacctcaggtgatctgcccaccttggcctcccaaagtgctgggattataggcgtgagccaccatgcctggccaacacccagctaatttttagtagagatggggtttcgccatgttggccaggctggtcttgaactcctggactcaagtgatccgcctgccttggcctctcaaagtgctgggttacaggcatgagccactgtgcttggcgaagtttggactttagacagctgagtagcagtcaaaggattttgagcagagatataactttcattcaacaaatatttaatgagttccttctgtgtgtcaggtacacaggggttgatgatacagtgatgaacaaaacaaagtccttagcctaacaaacttgcacttgtggtctatcggggaagcagtggatgcataaatacatattgtcaatttgtggccagtgctatgaagagatacaaggcagcatagtaggatggaacttgactctgtggggtgggagtgaggactggcatgaaggtattttccttggggtgtagggagggcctcttcagtaaggggaaagtggaatagagacccaaaccaggtgagggagggagccaggctgatatctgggagaagagtatgccagacagagggaatagctgatgcaaatgatccagtgaggagtgcacttacttgggcagagcaaagcagtgtgtgggaggagtgagggaggtggtggagtgctagcagatgaggtcagaaaggcagctggggtaggtgatccaggcttttaaggggcttggattgaattctagagtaggataggaagccactgaaggatggggagtgatgtgacaggtttgtattttaaaaggaccatcctggatgccatgtgacagaggctaggagcagaagcagggatacacgttaggaggctcttacaggaagtgttgtgtgaagacgaaagcggtgatggggaggatcgggcaggaacttgaacacccccatttcccatctctgaaaaaaaaaaaaaaccctaaatcctcttctccatttcctttcctcctatggccctgctgactcccagcccccacttccctgtcccctgtcttctggccttgtcccctgctcctgaccttggatactactaattccctcagctcctgccccttactgcaactgcttcactactcctaactttccaagattactttttctgggtaactaggtaggtggggtcactgggtgaccccatatcctatcactcaggtggttgtggcaacgaacattgctgagacatcactcaccattgagggcatcatttatgtgctggatccagggttctgtaagcagaagagctacaacccccgcacaggcatggaatcgctcactgtcacaccctgcagcaaggtcagcctggggatgcatgggagtgggggaggtggagttggcccacagagaaggtccaactcagaagcagggtgggggcttcctagggaaccgggatgagcagtttgcatccttccagatttcttgcataaatactgcctttttcttttccctgaccaaattgtcagccagcctgttcccctttctttmcaggcctcagccaatcagcgagctggcagggcaggtcgggtggctgcagggaagtgcttccgcctgtataccgcctgggcctatcagcacgagcttgaggaaaccacagtgcctgagatccagaggaccagcttgggcaatgtcgtgttgctgctcaagagcttaggtgattgggctacctgagagaggagggaggggctggagtcactgtcctttgaagggactctgttccatccatcacacctctttctagggatccatgacctaatgcactttgatttcctggaccctccaccatatgagacactgctgctgyctttggagcagctgtatgctctgggagccctcaaccaccttggggagctcaccacggtgagtcgggggrcagcatgggtggaggcaggatgataggggtcaggatggctccagggacccctgtagtagtagcgggaaacctgagggaggactgggctcaactctctctctcttctccttagtctggtcgaaagatggcagagctgccggtggaccccatgctgtccaaaatgatcttagcctctgagaagtaagccctcgcctccacctgggcccccagcacacaaacaggccaggcctcctctgtctccagggtcccctttgtctgtctttttctgttcatcatactatcccttaacacataataaagtattagataactctgattgcccccttttgaggcccacaagggtaagacacttgatcctatccttgattccactgcgcccggccccttgaggaacttacttgttcctaaggtttccaactagaacatttagatgtagctgtggagggatgacctttaaatgccattcctctgctgtcagagatcttttccaaatgcacatagtgaatgcacactttctgcagaagcctcagaattccccggtgtttcctgctcctgcctccatggatgtccctcctttgtgactgtgtttcatctatggcccctacttccttgacccccaagctgctgccagaatctatctgctggctgctttgtagccattatgccaaccagccttccccacatgaggaaacatccatcacacagtgatcactccccactccaccatatctgttcctatgtgtcttgctttgaactcatgctttccccttcctgtcccaggtacagctgttcagaggagatcctgacagtggctgccatgctctctgtcaacaactccatcttctaccgaccaaaggacaaggtcgtccatgctgacaatgcccgtgtcaacttctttctccctggcggtgaccacctggttctgctaaatgtttacacacaggtcactgggcttgggtgagtgggaatgagagacactgggggactttagtcctgctgtatacttaattatctctcctttctttttaactgtcttcccagtgggctgagagtggttactcttcccagtggtgctatgagaacttygtacagttcagatcgatgcgccgagcccgggatgtgcgggaacagctggaagggctcttggaacgtgtggaagttggtctcagttcctgccagggggactatatccgtgtacgcaaggtcagcatttcttcagcctcctgctttccacccccagtaccttcccaggagcaagcttctctgggggcatgcagcatttcctccagcgtgagagcatgccctcttccccttgtgtatgacgtgtcctcccagggccctttcttccccagaccactgaaggttcattcctgggaagttcttcatgcattccttacctctctagttttcctgaagcctgaactaaaaaggtagtgcattcttagggtccccagatgtctgccttttccattgattttctttcctgcccgctccttaggccatcactgctggttacttttaccacacggcacggttgactcggagtggctaccgcacagtgaaacagcagcagacagtcttcattcatcccaactcctccctctttgagcaacagccacgctggctgctctaccacgaacttgtcttgaccaccaaagagttcatgagacaggtgaggagaacatcctgtgcccaygcaggtggagactatgtagagagatggtgtcctggcaagctaagaacccaggttcaagttgctgggactggtacagaaagaggaaggtagggtaaaatagaaagacatcctttgtttttttttgttttttttgagacggagtctcactctgttgtccaggctggagtgcagtggcgcaatctagcctcactgcaacctctgcctctggggttcaagagattctcatgcctcagcctcccaagtagctgagattacaggcgcaagcctccaggcctggctaatttttgttatttttagtagagatgaggtttcaccatgttggccaggctggtctcaaatgcctgcctcggcctcccaaagtgcagggattacaggtgtgagccaccatgcccagcccaaagacatcctttctaacaggtgtgtcagcatcttccaagatctgagaactagacacttattcaataaatatttgaatggctactgtataggtgctggggctataatgaacaaagcagtctctggtctcacagagtatagtctttatgttctaggcttttcttttttttgagagagttccgtgctgttgtagcccaggctggagtgcagtggcaccatctcagctcatgcaacctccgccttcggtttcaagtgattcccctgcctcagcctccagtgtagctgggattacaggtgcccaccaccacgcccagctaattttatatttttagtagagactgggtttcaccatgttggccaggctgatctcgaactcctgacctcatgatccgcctgccacggcctcccaaagtgttgggattacaggtgtgagccactgtgcctggcatgttgttctagacttttcttgggaatagcttatttggtatcttgaataacatacagaggtgtatctgccctttgggtatataataatagagccaggcacctttacacctagccctgcagtcaaagaggaaagataacttttgaccatacacataaggatctaggttggggctgggcatagtggctcatttttgtaaaccatcccagcactttgggaggccaaggcaggatcckagcacttygggaggccaagatcagcccaggcaacatagtgagaccccaactatacaaaaaattaatggtgcactgtgatgtgtgcctgtagtctcagctacttgggaggctgaggcagtaggactgctttgagccatgatacgccactgcagtccagcctgggcaatagagcaagactctgtttcaatttaagaaaaaaaaataacaacaacaaaagatctatgttggaaagaagggaactccattgatcttttctctctcctaggtactggagattgagagcagttggcttctggaggtggctccccattattataaggccaaggagctagaagatccccatgctaagaaaatgcccaaaaaaataggcaaaacacgagaagagctagggtaagagaaggacgtaaacagaacctgacaccagctccttttccttrtatacattatttaatacctattaaataaaattatttttggaataaagcttgtgggaacatttgggatctagagaaagtgatatgtgaaattctatctcatatagtcagttaaactttattatttacaagttaaattacacagcagctttacacagcatgagatggaaaggaaggaaggagagaaacgaggagaggaagctggctcctgagattcttggctgcctccacctccttctcttgggcgtagcagtcttcagtgctgcctccactccaaggtcaaggatcagggcttggaacacaggtttaagtcaggttctggctctgacagccccagggccaccagggctcccactagcagcttcttcacaggcgttggaggtgagtgtgaaggcatcagctgcagggagaaaggttaatgccagttgggggaggcacacaaatgttctaccctttaccccacccagccctacctaggactcaktttatctagacgatggcgacaaatgaggccactggaattcaggtagaaagtggagtaggcatcataggtcctggggaatagagggaggcttactgagggagaaggtgactggtcccaaagctgaattcaagcatttgtttaaacgagtagtccctaaattctgctacatattagatcacctgggcaacttacaaacatctcagtgcttargttgtgccctgtctcarttaaatcagagtgtttggcgtcaatattttttaacratccttgggcatttctactgtgcagcagtttgggaactgctggtttaaaaacttatatccaatgtttgtggctgagtctaacaatttattgggattctactcccaggcggaaatttaccaggttgtaaggctcaacatatgagacaggacttttcatttgttcagtacttttgtgtgtgtgtgtgtgtgtgtgtgtgtgtgtgtgtgacagggtttcactctgtcacccaggctggagtccagtaatgtgatcacggctcactgcaacctcaacctcccaggttgaagtgattctctcatctcagcctcccaagtagctggaactacaggtgtgtaccaccacactgggctaatttttgtatttttttgggttttaccatgttggccaggcaggtctccaactccttacctcaagtgatccgcccacctcggcctcccaaagtgctggcattacaggcatgagccaccacacccagtctgttcagtaagtatttgagtacctaccatgtgctaggcactgtataggaagaaactgaagctcagaggtttttctaatatacccagtctctattttttttttaacattaacataaactaaacaggatccctgtccttaaacagtcaagtgaggataggtcaagggttgtctgggagactagatcatctgtaatctcagcactttgggaagctaaggcaggtggatcacctaaggtgaggagttcgagaccagcctggccaacatggtgaaaccctctgtctactaaaaatacaaaaattagccgggtgtgatggtgtgcctgtaattccagctacccaggaggctgaggctggagaattgctggaagccgggaggcagaggctgcagtgagctgagatcacgccactgcactccatcctgggtgacagagtgagactccgtctcaaaaaaaaaaaaaaaaggaactgattatagtttgggtcctttctcatttctctcttaccggtaatgctcgtctttgtcacgcttgtagaaccgcaaaaagagcaagtggacgggcagccccacaagccgccaccgggcttgcagggtccagttctckgggtggcgggtcagctgtaaaacctccaaacgaaggtgtgcaaaataattccaggccaggaaacggcagagggtcagtgaaagaatgtaccatgtccggcccctgtgaagaagggatgggaaagaaatctcatgatggcagaattagaaaaccaaactggcttctaaggaatggggaacagctgtgagaagcagtctaggaacttctctgggaagtgaaaagggtcatgtatatacctytgggtgcttttcctccccagtgccctacctgtgccccayttctcacttggtacgtatgttgaggatctcattgatgaattccacatccaaggaatacagactgtagtcgtgggactgaaggaagagcttgggaagctaggtggaagaagatggcatcaacccagtgggaaagaaaagataatcctatttttcagttttctaatttttttttttttttgagacggagtctagctctgtcgcccaggctggagtacagaggtacaatctcagctcactgcaacctccgcctcctaggttcaagcgattctcctgcctcagcctcccgagtagctgggattacaggcttgagatggagtctagctctgtcgcccaggctggagtgcagaggtacaatctcggctcactgcaacctccgcctcccaggttcaagcgattctcctgcctcagcctcccgagtagctgggattacaggcacccaccaccatgcccagctaatttttgtatttttagtagagacggggtttcactgtgttggccaggctggtcttgaactcctgaccttgtgatccgcctgcctcggcctcccaaagtgctaggattataagcgtgagccatgtgccaggcccagttttctatttttaaggcctccttactcccatcttggagtgaaagatctcatcccatgattaacctcccttaacccaaaatgaggaacatcattttctttcttttttttttttttgagacggagtctcgctctgttgcctaggctggagtacaatggagatatctcctttcactgcgcctcctgggttcaagcgattctcctgcctcagcctcctgagtagctgggattataggcgtctgccaccatgcctggctgatttttgtgtttttagtagagatggggtttcaccatgttggccaggctggtcttgaactcctgacctcaggtgatccacctgcctaagcctcccaaagtgctgggattacagcactttgagccaccgtgcctggctggaacatcattttctcaggaaaatgtttataatatatttctatgcctgcctcatggttccaaaaaagaatccagttgactatccctgtacgtccaaggattacscacatccttcccactgtagacgaaggccacttttgcactgacttacctcttgtctcagtctctcatacatgacagacagatgttcctccatactaggatctcctgacggggtggcaggggaagggtgggcagttccagggacttggaaaggtatccaagccccaggataggggcagggaggtccctcaaaaaggcttctaagcccatccaggcagccgctatgcaactcaggtcctggtccctcctccccctttcctggagggagaaccacccatgctgagctgagggcctggatctgagggagaggtagtgggggaacctggggaagacgctgggtgggaaggcgtgggggcaggggagaccagaatagaggagaagatggggaagtggttgtcgtggagtggggccaaaggggtgggaatggtagagtccctggataaagctggtcctaaggagaaagaacagaagggagaaagataagaatccacttgtctaacaccccttgatcccctggatgctcaacaggcttccaatacctattcctcctgacagaatggatggaattactataggaaaaaagggatggattcatctccatctctactgaaaacaggaggaaaccattttattttattatttattttgagatggagtctcgctctgttgccaggctggagtgcagtagcacgatctcagctcactgcaacctccgcctcccgggttcaagtgattttcctgcctcagcctcctgagtagctgggactacaggcgcgcgccaccatgcccagctagtttttgtatttttagtagagacaggatttcaccatgttagccaggatggttttcatctcttgacctcgtgatccacccgcctctgcctcctaaagtgctgggattacaggcgtgggccaccgcgcccagccgagcaaactgttttatgtgacataaataccggcacctcccaaaacctagcagacattttacttttttttctttttttgagacgaagtctcaccgtcgcccaggctggagtgcattggcgcgaactcgggtcactgcaaccgccgcctcctgggttcaagccattctcctgcctcagcctcccgagtagctgggattacaggcacccttcaccacgcccggctaatttttgtatttttagttacagatggggtttcaccatgttggccaggctgttctcgaactcctgacctcaggtaatccgcccacctcggcctcccaaagtgctgggattacaggcgtgagccaccgtgcccggcccagtgttggaatcttaaagaaatgtggccgggcgcggtggctcacgcctgtaatcccagcactttgggaagccgaggcgggcggatcacgaggtctaggagttcgagaccagcctggccaatatggtgacaccccatctctactaaagatacaaaacaattagccgggtgtggtggcgggagcctgtagtcccagctactcgggaggctgaggaaggagaattgcttgaacccaggagacggagattgcagtgagccgagatggtgccaatgcacttcagcctgggtgacggagcaagactccatttcaaaaaaaaaaaaaaaaagattccaacactgggggcagtttcacctctcttatcgcaagaatcatgtaatacatacttgatgagttaacgaataacaggttttattgtactgtggattaaatgctgtggcctgtacatctccatgattaagtgtgcgaggcaaatgtacagagaaaaaagaatatccagctgaagctaggaatctgaattctatcatgtaactttaggcattctcattccctatgcctccgcttcctacaaatgtcctataaatgagaacaataaagcctcactgggttatgaggcctatatgaaataatgaatgtaaacaaaacgtagcgacctagaaagcagtacataaatggaagctattatcatttcgggcccctctaatgacagacacaacctcaggagacagttaaaggctggccttcactctcctgggtttaccgacgttgaaactgcaaggggaggtcacccaaagttaggcctcacccgagtccctccgctcccaaggaaccccccaggggatcgtctcactgcagggaaggcgggcggaccgctcgggtacctcggtccccgatggtgtcctagaggcgccgtctctgctgggggcgtggccatcttgccagcccgggcgcaggggcccgaaccgggtgcacactggccggccttcctgccaggaccgctctccgagtgcaagacgggcgggctgctgagggcgccccgcgggtctggtctgggccggggaactccgggacggcgccgcagcagggctacgaatctctcggcccctgcccttcaaatcacctctaggcacaggtaaccgcggagagtcgggcgcaacgcagacgcgccccgctgcctggccttgaccccgcctgaccgccctcaaacctgggaggaccgacgtccttgcgcgacaggcccggcagcgcctccctcccgctcccgcgacccctagcctgtccacgcgctgcagggcacaggtgggaaggggcggcgggtgtctctgcgcctgcgcggaacccagcgcgcgctccgccccacgcaccggctttgaggagggtctctccccgccccctctcctccctccctcttctcctccgctcacctggggtcgagcctggtaggcgcgcaggcaagggccgagacgccgggccgcaccccggctgggctggtacatgatcttccgggagtggagaaggagcctcctgagtccgacctccggcctcctcacaggggtgagcgcgccccagagccggcttcgtgaaggggaaaggaggccggggcgrgggggtagggggggaaggggctgagggagggaaacggagatgtcccgcgcttgcgcactgcaggctcgagggaagcggctgaagcgctctgtcggctgtaagcgcgcctgcgcccgcgggctcggagactgcctgagtgcgcttgcgcaagttacagcctccccygcccccccaagcgctgtattcacagctgaggcctttgagcaaaaagctgagcaaaaacagggctgaaggctgaatgggtgcaacgacagtgaggggtgaggcggctgaaataatgagtcaaatttttcaacagctcttgtgataaaaataaatacttttattggtctggttaaaagatacaaatgacttgaatctgataagcctgctgaatgaatgaatgaatgaatgtatccatctattatgagggttgggctttggctctttcctgtagtgagggagaaataatactttgaagatgtttgacggggctgcggtcaccaaggcctggtgctgcgacgttcctgcaggtttcgaatgaacctggcgttgagtatgtccccacccactgtccaggactgggctggcggggccggggcctgtggaggagctgtgtgcatgggcttctccccagacccatcctgtgacaaggcctgctc

SEQ ID NO: 12352 - DNA, 18041 bp, Homo sapiens
caacctggtaggcggaagttgtagtgagccgagatcgtgccactgcactccaccctggtgacagagtgagactgtctcaaagaaaaaaaaaagaattgtgtgtatatgtgtgtgtgtgtgtgtaacaataaaaacaggtagcaatcaatgagttattgttctaggactgtttctacccactttacaaatataaatcattgattgcaatagctctgtgatagagtattcccattttacagataaggaaactgagacatggggagatgaaatggtttccctgagtcatagggccagaaagtaggtaagccaggattagaatccaggttgggctgattccacaagtcctagtcttgactagcaagataaagtgtaacaaattatgtagaagctatcatggtataccaggttgaattcattcagggccactcatcaggttggcagcagtgtgtatgtactaaggagctttgaagggactgagatgcaagtttggattccagcataaattacctgacattagagctcaggcttccccaccttaaagttgtgataatggtatacctgttttgcaaggttatcacaatggttagatttaacccgtacaatggttggtgtagaataagttgtagccactatgttgttatttcatgatatgtccagatataacttttataatgaacccaccaacagccttaagcagtgttgtttagactggagtttggggctcccwagggttctattaatatattcttgggggatctgcaagttcttaaagtttgaaaaactgagctaaagcattcctgtattgtggacacacacagttacttccactgatttctgaagcaaaaatagggtggcaggaaatagtacccacttaggaaaataatgagttctcttacacaacagctatatgtactactcacacctgcgtaaataaagcaacacaagatggagagaaaagtcaccagaggaaacagcccacacagggaggctcacggcaaatattccacatgaagatgcaacatggataatgcccgacaccacacatgtggtgcttcatgacacgacatgagaaggttttggagagctgaatacatatagtctctcacttacctggctggcaatgtaagctatactttcccactaaggatcatcgctggggctttcaaaatagtacaacgggaaacaaggtaccgtcaactcctttccaaaagaaggtaaatgcgcttactcagaaatgtactgcagaaatgccaacgtcatgagtttcttatatatacatttatatatgctttttacatttcctgctttgtaaaaataaaggataaggaagaagaatcaatgaatattttcccagtggaaggcatggaattaaaacatctgaaataaaaaattaacattgctatcttttaatgaatttctttgctagagaccgtctagcttttaaaaaaattctagataaagtctctacaggagcctgaatgtaaattaatttgtctttcatcagatgacgggaaacagaaatgcaagaaagctgacgaagaccgtaatttttaaaagcttagccaaattggctaaggtctgaatttcacaatagttcatgtttttcttcaggtggtatcatcctggcaatgcgtgaatgtgccatctcgttcatggggaagctccaatctccccctagatatgcttgtgggtgtgattctggtgttgctgtccagctacctctgccttgaggtctaacctagcctgcctttccccttcccccgcattgtttggagaaatcattaacccgtgctcaataagcccttgcagctcctcatcatggggcaagctgcacggagcttccacgtgagaagcagtttgattgcaaacctggatctgcaattcccaggggctgccctcatggaattttaattgggggctatttgaaattccctttggctttctcacagcctatcactgcctataagtcatgttacctactgtcagttccttaggcttcttgtgtttctcggttgctactgttgtggtacaacttcttggtatcttttaaaagcactcatcagaagaccttagggacagttttgtgcaacccatatacattttacattaagccatactatttcaggtgtatccttcaaatacagttaaattcagttttgaagttttagctgcactgaaagccactgtcactttgagggcctacctgggacccctaaatgcatttacattttaagtcagaacttccaaaactctccttatttgctgaaaatctgtttaactgttttcacatgatgtgttaataaatgtcattgtattcacagagattattccaagaagattaaaggtcatgctagcccatttgcatcttataaatctcaagtgccctcaaactcaggaaaattcctgcaaaagtggaatgtttctcaaatggcctagagaaaattttataaccaaaatacactgctttaaaaattttttttttttaactaacaatttttaaggaactttccagggggaaacaccaggaggaattcaagcacaagcacaggtgctcggtgcacacatacatacacacacacacacacacacacacacagaggaagaaacaagaatctatgaaagtgcttctctgcactcatgagaatggatcacagatgatctgctatctccaatttttaaatacagacctcttcatatgaatgatatcctctgaagggcactgaggcctctggaattaaggaagcctgtaattcttccaactactacagcccttatctcctaagagagcttttcctcagtgcctcacaggaatggcaatatcaccaccaacagcattccttatgcaggaatgaagtggtgatattttaaaaatcatcttctgaataccgactttgtgccctacacttctcgtgtgtcatctcagttgtgtctaatcctcacagtcctttgagggaggaatatatattcccaatgttacacacttccgaattccttttcttgctttttctctatagcgctttcactttctaatatataattatttgttttgttaattggactgtcctcattagaatgtaaacttcagtgaggcaggttattgttgtctgtttattctctactgctttcctggaatctagaataaatgcatcaatgaatgaatgaagtgaggcccagactactactgagtgacagaggtttgaacctaggcttatgtgctgtgctgacgcactagataaccaatgacacttgtgaagattaggatctagggcatattctaagagagataaaatatgcaacatttagtgaatgtttgactgatgaagggttgcgtgcaaagaaaaccactggtgtgtaaaaggagcagggaaagcagcctcgcttttgatctttgacatggaggatgcaacagaaaacgtgaggctggagaaagcctggaggtcaaaattcaaaatgctgaccttgaaattcttcacatgtgggcagggaataccacgtggaggtgaatatagtgtccataacactctatgtaatccgtgcatgtgggcatccttaagagtctgtaaagggtttggcctcacgtcttgacactctgttgctactgtgtgcccttgggcaaattctttaatctttgtaaatgggataatttacatgttttttctgaagactgtccgaaattatgcaagtaaacacagaaacaagacggtacccatcatgcagttaagtgcccaatatgcattgttgtatcagtttgctgtggctggagaacagcgtgttccaaaggtgaccagtagggagaaatcagaaatgtagctgggtccattctgataactgtgctaaaggatttttgatcctggtctacgataacaccccctttacttgacagctgaattggaacggattaaatcggttagggtagtatctcagagggctttgctgcagatgagcgagtccaggcgggctgtcaagcgagcctcaaggggcatctgtgggatgcccaaaccgtgtccccaagccgaggcctttttacaggtcctcaattcagaatgaaaaattaattccaacggctaatagcaccccaccaccactttaggacgtttcaccgtacccattttgtcgtcacagggaccctatgaagcagatagttttatcttcgttatgccgacgtggaagactgcaacttagaacggctaaatgatttaactaagggcgcttacctaggaagaagcgggggacataatgcaaacgagggccgtcycactccagaagcccttttcgcagcatttctagtactgagcagtcagaacgccactttaatcaatgcgccaggaaacactggcattcccttggcgataaagttcagaagcatgggtaaaactacagtttcgatgtatcctcccgaatctatagtcatactcaagtagctgcgtattaaaacaggcaaagtagaaacccaacttccctccctttctcttctgttggaggtcctgtgctgaacctccaacaggtttgctcttctcagttccgctgaagggcatcctgcctcttccctccctgtccccaggtcccaatgactgaaacgtctcggggtgggaacttctgtgacagatcgtggaggacagggggagtcaactccagcgcaggcctcccccggctgaaactagaagatacccartgaaatatacgagttttgttccaaggactgcccaaaaatggtgcggagaggagctcggcaatccccacctttgtcgaacacgctcctccaggggcggcctgcctgaagcagagctccaaaattggcaacctaggcstcgcagccgcctttttttagcctacatttcccaaaccagggaagaggcgggtgactaaaaatgcaaattgcagcgggggtgttagcaggcatgcccgtgggtgcggggcgtcgggcgaagggagaccccgcgaccttaggcgccctcgcggtgttcacggtaggcgcaaagcgcagcaagggacactccccaaagccgcaccccgccggacggctgcccccgcttccgcctctcaggcagcggtgggacaaagcgcggcctcttttccgccggggtttagggagggaaggccggattagggcccgcgccttccggctgcatccctctcgcgccgcgccggccgcacacaggtggttttccgctcrggaggggcaggcttcggcacttttatataacaatagagctctgcgcgccgggaacgcgcctccccgccgccgcggcccccacccggccacgcctccatccggcttccaatccgtccgccccgcggcgcctgggccgagtgctgctcgctggcctggcccgcacctccccaaagttacctgctggctttgcagcgcggtagagacgttcccctcgactccttgggagcgaggagccaggggggtcccggcaggcactcgtccttgctccccccaccctccccagatctctatggacccgggagtccctcgctgagccccgcacccgtccactgcgtcgcgcacagccccgtgcccaagcggggagacggggacggcggggcggtggcagggagcgcagcgcgcaggcgcggctggtgctccccggagtgcccggcgctggacaaagggaggaggcggcggcaggagagggctggggaggccccctctgacatgcctccctgccaactgtaaccaatcgtcgagcccccctgccgagcccccgcagcctgcaggtcttgcgggaggacttcctcacgcctcgcccatggcggggactgctggcccggcccggcgcgtcccagcacacctcgctcaggcagccccgccagaccggctcccccgtcagaagccgagctccttgcccagaaatcattaaccagcgcgacctcccagcaggcgatggtggtggtggggcggggggagagatatagattcccccgaacaatggcttgtaactccccacgccgccggagcggaatacagtaaaagcactggactgacctaagagtttgtttctgcactctacattgttttaatgaaaataaaatgttattttaagaaaaaaggttttcttctgattttctgcacaaccagacgtttgtttgtttgctttaaaatgtttcaacaaaatcctggtttgtttcgaaataygttggattagcatttaacacctcatcggtcactaaagcccagtcagttcaccagccccaacacagcctcggctaaaagaacatcagagcaaacagagctgggcctttaaaagtggcaaacaaatgccacacaccgcctaaagaaggggggttgggggaggggagggttaaggcgaacttgggtccaaatgagtttgaagggaatacaaagaacgaaaagtcagcacaagttttcctaaagctagctcgcgaacgcaagcgtcgcgaacaagggcttttgtgcatgctaattgcgccattggtgcgcaaaagttccgacgcgaagkgtgaactctcaacagaaggaaacatgagacaactgaagtgccctggtttatgtgccctgctcctcctccgctgccgcctccccttctttctccttcctcccgccgagcccgctgttgcagcttgtttgcactggggcttatccggagcggaaattcctttccgtttttgtgaatgacaaactcattaacaattcatcaacacaacctgttccagccggcccgtccccacggcaacagccccttccgcagcacgctcattggctggcccggagaatgtatccattgagacgctcgctgtttgtatccattgaggagctgcctcgcgcagggggtgtgcgaggctgagtccaagagatagcaaatcgagtcttaaataatccggggagaaagacgcccgggtagatttgaggtgcagccttggagggagggattagaagccgctagacttyttttcctcccctctcagtagcacggagtccgaattaattggatttcattcactggggaggaacaaaaactatctgggcagcttcattgagagagattcattgacactaagagccagcggctgcagctgggtgcagagagaacctccggctttacttctgtctcgtctgccccaaccgctagcctcggcttgggtaaggcgaggcggaattaaaccccgctccgagagcrgcagcttcgcgcgcggtgcgctcggcctatgcctgccccgaggggcgtctggtaggcaccccgccctctcccgcagctcgacccccatgatagatacgctcagacccgtgcccttcgcgtcggaaatggcgatcagcaagacggtggcgtggctcaacgagcagctggagctgggcaacgagcggctgctgctgatggactgccggccgcaggagctatacgagtcgtcgcacatcgagtcggccatcaacgtggccatcccgggcatcatgctgcggcgcctgcagaagggtaacctgccggtgcgcgcgctcttcacgcgcggcgaggaccgggaccgcttcayccggcgctgtggcaccgacacagtggtgctctacgacgagagcagcagcgactggaacgagaatacgggcggcgagtcgktgctcgggctgctgctcaagaagctcaaggacgagggctgccgggcgttctacctggaaggtacgcgcccagggaactccgcgcgcggggcagggctaggggcgcagggctgcgggcggggcgcgtggattgaaaatacctctgctccgctcagctggagcttcggagccgcgctgcccgcctagggaccggcagccggcgaggtaggggccgcgaaccgcgcgttccgcaccagagaaccgggccggctcagaatccactcgcttccggctgcgggtaccggcggtttcyttctaacgggttctgcgccttcttagccagaacatcctccaccatcaccctgttttctatcgttcgattttgaattaagatttgcaggacgggagagattgttggggatgcaaattggcacatcttagctctcaaaatattccaaaaagttgccattttgtctatttccggattcaagcgaataagggttccctggcgaggcgggcccgttcgttccattcccgatggtgcacatttaaagtgtgtttctcttatagatggttctgtatgwagggggttcgtaggatgcttgtggtgtttcttgcgccgggctgcggttcttacragctgtgaaaactactacggcttctcaggttagaygattgcttttctcgttctggcaggtggcttcagtaagttccaagccgagttckccctgcattgcgagaccaatctagacggctcgtgtagcagcagctcgccgccgttgccagtgctggggctcgggggcctgcggatcagctctgactcttcctcggacatcgagtctgaccttgaccgagaccccaatagtgcaacagactcggatggtagtccgctgtccaacagccagccttccttcccagtggagatcttgcccttcctctacttgggctgtgccaaagactccaccaacttggacgtgttggaggaattcggcatcaagtacatcttgaacgtcacccccaatttgccgaatctctttgagaacgcaggagagtttaaatacaagcaaatccccatctcggatcactggagccaaaacctgtcccagtttttccctgaggccatttctttcataggtgagactaattaatagtcgtcgctctgacatttaaatgcaaaattcctagccattcatagagtttaagctgttaatcgttcttgctgcttgctaatttgtctgactgcaggtctctamtgttcctagagcgtccttaattctggtttatcttcttgctaaaggaagaaaacctgccttttgacatggctgcagatcacaggtgtatttgaaacgctgtttcttgaatctttgaattcagtcattgacagtcgttcataatcggacaacagatttttccccccagtctttggactcaggggaagggtcagatagaaktactcactatagacaggaattccagcattgctttataatttaaaaacatctaggagttattttaggacatcaagttagttgttggaaagcagtatgaatgctgaatgttatscagttgaatgatgckgtgatactggtaacagtgagacagtgggtaacctgagcccagcaggaagaactgtgggctggaagcctgggagaagtgaatctccaggcattgtaatgcatttcctattacaaaggaactcattttcaggccgtgtcgacatcctgttcctcctaatgggccgtcccctgtgacttccctctctcttttaaaatgcctgaatacctccattgttagctgcacaacatttggagcataatttaatagacccttgcagtctggttgtctgtgtaaaaggcattcacgaacatattgcagggtttctggyattcacatgccgaggcaaagaatgyacccattaaggagttttttgttggcagaaacttaatacaaaagctctcttttcagaaaatatctgaaatatgtaattgtgtccagtgtacatgtttcatttcagtgatacattttctgctgcttgtagggctcaactgccacacacaactattattattattatgttttcaagttcagtttttagactgatcattcacaaagggtggttttcagtctgctgagatcttgcttttctttttgtgttcacagatgaagcccggggcaagaactgtggtgtcttggtacattgcttggctggcattagccgckcagtcactgtgactgtggcttaccttatgcagaagctcaatctgtcgatgaacgaygcctatgacattgtcaaaatgaaaaaatccaacatatcccctaacttcaacttcatgggtcagctgctggacttcgagaggacgctgggactcagcagcccatgtgacaacagggttccagcacagcagctgtattttaccaccccttccaaccagaatgtataccaggtggactctctgcaatctacgtgaaagaccccacacccctccttgctggaatgtgtctggcccttcagcagtttctcttggcagcatcagctgggctgctttctttgtgtgtggccccaggtgtcaaaatgacaccagctgtctgtactagacaaggttaccaagtgcggaattggttaatactaacagagagatttgctccattctctttggaataacaggacatgctgtatagatacaggcagtaggtttgctctgtacccatgtgtacagcctacccatgcagggactgggattcgaggacttccaggcgcatagggtagraccaaatgatagggtaggagcatgtgttctttagggccttgtaaggctgtttccttttgcatctggaactgactatataattgtcttcaatgaagactaattcaattttgcatatagaggagccaaagagagatttcagctctgtatttgtggtatcagtttggaaaaraaaatctgatactccatttgattattgtaaatatttgatcttgaatcacttgacagtgtttgtttgaattgtgtttgttttttcctttgatgggcttaaaagaaattatccaaagggagaaagagcagtatgccacttcttaaaacagaacaaaacaaaaaaagaaaattgtgctctkttstaatccaaagggkakatttgcagcatgcttgactttaccaattctgatgacatctttacggacactattatcactaagaccttgttatggcgaastctttagtctttttcatgtattttcctcatgattttttctctttatgtagtttgastatgccttacctttgtaaatatttttgcttgtgttgtcgcaaaggggataatctgggaaagacaccaaatcatgggctcactttaaaaaaaraaagaataaaaaaaccttcagctgtgctaaacagtatattacctctgtataaaattcttcagggagtgtcacctcaaatgcaatactttgggttggtttctttcctttaaaaaaatttgtataaaactggaagtgtgtgtgtgtgagcatgggtacccatttgataagagaaatgcatttgattgtgaagaagggagagttaaattctccattatgttcgtggtgtaaagtttwgagctggaatttattataagaatgtaaaaccttaaattattaataaataactattttggctattgaatgtgtgtttttaaaaactcagttatacctatgtgtgaagtgacacattttagaactttttcattcagggattgattttgacttgtaggcatagtagggcaaggttcttttaagcttttcctagaaygtttttcagcagcagtttatgaaattcatcgtttgccacgaataaagatgacatcctagaatggaccgactgtaccgtgtatatgaacaatacctcttatgagtatagttccggcttaagattttaaagcccctgaagaaaaatgaacctatagagcatagcttgctgaggaatacaatttggatattaaccacagagaggtgtagcagaataccaagatgacagccacatgttaacctcctccctatccttcactgtcaggatcttctgctytataatgctgagataatgccaaagaggaagtagggataattctttttccagtctgttgtcatgggcaattctacctgcagatatcctagtgtgagaatgctgaatccagaatgatgtctccactttttcccctagcatgcgcatggcaaggcatatctaagcttcctcacygtgtcaggatayggctttagaattttacattggcacttaggaggcaactttgtcatccctgttgtaatgtgcttttttgtttaactggcttgggatgtgggtcagaaacccttattgaaacttgtggggattattttagtttcttttcaagctaaagactttatatcttgccatttttcttgggacctaccctctccttacctcaaatgtaaaaatacacaaaccaaaataaaaggcaggtgtatggaatcaaaagaactagaacgtacttatatttggggctctttttgcatgagctcagtcccttcatgtgaagtggggagaagaatgagcttttcacctacatggcacatgagttgactgcttggtcgtctacactaacttaggaggcaagtggccttcattcgatggcaatcatataaaactgtccatggtgatttttaagcaactaagtataaaaagcaaacagaaatagtgcaaatatatatatataccaagtcagtctgtcctatttgggtgtcccaagtcagcaagagcacagaaaggagaagtggattgcagttcaacttggctcgtgttaatccagttctgaacggtttccgctcctggcattccctaaactgcctgttcaaagtaaggatttgcaagcagcgttagcaatttcctgtccagctgcagctcaagtagctgggtgcttttcccccctttcttttctctgatttcttttctctttctttttctttctttcgttttttaaaaaaatatgggctgtggataattttagtgcatttcctctttgtggattattatctctttcctcctagaacctgcatacattgagttcctactgcttggctcaagccgacagctggcctccccagcacttcctctcgttttactgtgggtttgttgtttgtcagtccacttctgaaattaataatgttttctggctaagtgccacaagccattaccacaaaggggaagtaacacatatgaatagcaggaagccatgcagggtcacagtgtgagctgaacctgtggagggagcataattgagcctggcccattcagcaagtgtctgactgcaatttggggagagggagctcgctgcatctaagcagctcaagctgtgaaaaaaaaaaaagtttccaataaattgggagcaaatggtctttgtcaccagtctgaataaaggagagagagagtatgaagagcttagagcctccataaagttgcaatgtttgaggtttctcccccttctcctgacatattgtttcagaaggctggtgaacagaggggtgcctgtttccctctattctcaccaaaggactcatgttaaatgggtggtttttacggttcacataggccagaagattcaaagagctattctctttccttctttttcttctgtggaaggtggaaggttgtaactgacagcatgggcccccacctctctctgtgcctccctttcttccagctatatcagggctcctctggttcctttgtgcttgcagtagccgcgtgaaggcgatcattttgcatcttggagttgggctggcttcctgaatggagcccgcacggttactagggcaacctttgccagcagctgcagttccaccgcctccttcctcacctgctgtccccattagtagcttcctcaggtctctgagaaagcgctacctttcctggccttttgcaggggcaggggggtagggtggggtatggcttttgggaaggggaggttatcagcaggtttcctgggagctgcaggagacagagattgcagtggttaatagtatgaactggtcttagcgttaaaataggaatgaaaaagggttatctggggataaaaataccaacacagtcttcaaaggaatgaaaactgagacttgcaccaaccttgacaattaggagacctgaactgtagctgctgctttcttgctaatgaatcaggtagccctgggcagggcacccaatcttaccgcatttcttttttcttgtctgtaaaaatgagggagtttttacctcccattctaggattctctcataattccagcttctgttcatggattggtgacacttattacatgataaaatgaggtgcggagcaggtgaaacaaataactaacatttatcatgagtaccagatactatactttgtatctcatttaatcttcaaaacagctctgtgagataggtcctattattatctttattttgcaaagaggaaactgaggcagagaaaggccaataaagcctaaagccacctttatgggacacctgacacataatgttagagaaggtttgcatatccagtgcttgttactgcagaactgaaccttgagcctttggctcttcctgttggaaactgcttgtcatcagtatttgctcccctttataaagtctcatgatgtcggctaggaaatgctgtccccattatacagctgaggaagtggaggaagcagaggttaaatgactagccaaattccatgtgaattccacagccacatgggaggccccagctggtgtgctgtcagagaggtgtccaccgggggtaaacttccatcctccttctccgcagagaagttgctcttccttggtcccattggcacttaaattataaaactacttttcctaagtatctctaaaatggctaccagctagcatagggcctgaccctgacccttgcccatactcccctttcaggatgacacaactaaactggccccaaagaagttcacttcctcactcttatccctcctagaggcaaactgggagagggaggtgggtcaggggaaaggggaagggtgtgaagaagcaaggaggagaggcagaagacatatatatggtgcaggtctacagaagaagagaggtaaactgaccagcaaattagcaaataatggagatgggggtttttaggatacagccagggcagatcatgtggtagctggctgtaagaaaatatccttgaaatgtcctcttaaaaaaagtcagtcttcagactttcagctgcttcagaaggattactttgggtgtaaatttatatgcagttcctcacacagccataatcgttttcggaaagatcctgcaagactttcaaatacccttgttcctcccgtgttctcactgctcacttagcaattggccctgaatcagtccagttatggtgaacgaattttcaaacttctttaaagtccaaaatcgatttcctgagaatattgaagggcacagaacaaagttcaaacaactcacaaatatttatccaggccttggtgtgcattgcactggttcgatgaaacaagttaaaaataaaaggcaacgaaagacctcccaggagccctcagaggctgaaggcaatgacccgtttctagatggaaccgctaaagtgcccaaatcaaagaggagccctgaagaaactaccgggcaaggtcttgtatttccctatctgcttccaactaacattttagatcccacattttatttttttatataggaaaggattaatggcccacatgtatgcaatttgacccactcactttcttactttgtcatggaaaacaccactagagaaggcgtgcatatctattagccatcactgatgtaataaaaacatgttaaaccaccataccgtcaaacatgaactctcagacactcaaaggaaaagtgaggaaatatcattcactttttgataatgacatccgagaaagcacgaagcaagtctggaaaaggttgctaattctaaagaattctgtttcctacttttggggaaaatctaagtatttatcacgttaagtatttttcattgggtccagtttaattcctactgcaaacacgaacagaaggaggaaagaaagagcggaaggagcagcaggggatcttcgggtgtacctggctctctgaaaaattgtagcaggaatacccttttatcttatgttccatttatttattgctacattacaaagcgccccaaaacttagtggcttcaaataacagtcatttattttgttcctaagtctgcatttggtcagggctcagcaggggaggctggcctctgatcagcgcagttttgtcaggggcagctcaactgctggccagaggattcatttctaagatagttcactcactttgctggtgagttggttttggctttggctgcccactgggacctctgccaggggccggggctggggactttggttctccatgtggcctaaatttccacatagtatggtggctgggttccatgggtgaaatccccagagagagagagagagagaggctggtggaaactatgttgatttttatgacctgctcagaggtcacttctgctgcatacaaagtttaaggagaaagaacgtaaaaatccatcttttaatggaggagaggaaaaattctgaaaaagcacaagagatggaaaatattgttgcagttgttcttggaaagtacaatgtgccacatcttggttgcgtgaatgttgtttcaatgtgggactgtgagagtaatagtgagtacccacggagatagatatgaaagtgtttagccatactaatttcttggttcaatcttgaaaacattcaacaactgctataattgttcctttattcctatttttttcatctgtttctaacgttaacagtagagtaatgccgtcaaaacactctttaaaggccgggtgcggtggcttacgcctgtatttccagcattttgggaggctgaggcgggtggatcacgaggtcaagagatcgagaccatcctggcccacatggtgaaaccctgtctctactaaaaatacaaaaattagctgggcgtggtggcgcacgcctgtagtcccagctactccggaggctaaggcaggagaatcgcttgaacccgggaggcagaggttgcagtgagccgagatcatgccactgcactccagcctggtgacagagcgagactccagctcaaacaaagaaacaaaaaaatttttagattgacccataaaataaaacagtttttataaaagaatattaatttttttattttgtcagagaaaacattatatttgagattgagtcgcccaagttattgagtgtagctatggtatacattattttcatgcaaaatatagtgtttcatgtattacattatagtaggtaatcttacattggtagaatttgggtttttccccctaattttgactattttgaacaatactgctaagaatacttttgtgcatgtattctaatgctcatgtgtacacgtttcccggtggtttgcagaggagtggaataagcatagtttgtgtagaacctcaatttcagacaattaaaatcgtttttgaagtggatattccaacttatattcccactaatgatatttaacttttcatactctcccaaattttttataaacacttgttttgtttacactttttagttttcacctatctagtagatgtgaaatggtagtttattttgattctaatttccattattctgattcctaatgaggttggatccttttcttgtgttcattggccataagatattttattttgtgaagagcctgttcaaatctgttgtcaagtttcagttgtgttacttctatttttttgtattgatatcagaggtgcttggacactctaaatactagtcctctattgagtatatgcattaaaaatatcagtacaatgcttttcaaactttgttcctcagggaaggaccaggctacatttggaggcaggatgtacactgcacagctctacagggtatcagtcagaaagataatgatacaaatggccatgcccaacctgtataaccctacatggagttctaggagactcatgtgggacttgtgcctaaacatatttgaaatccactcattgaatccatttaacaaatgtggaaacagagtcagagagattaagttgaaagaatagatacttttgattatctcgattgaagtggggctggcctagaagtgtttttggttatactaaatcttgaactcagttttgaagaggggctagtttttcacatagatgtggaaaagatgtgacagttgtgagtaatgaattacacccagctttggaagtagtaaaagacaaacttcctcgcaagagatggcaacaatatttttcaagatgtaaaacagagataaaaaatcaagatgcttagggatatgagagataaaatttaaagagaagttgcaaagtgcagaaataactgtattttttttgtctgcctatcctcccttcccagttacttgtagttgtggaa

SEQ ID NO: 12353 - DNA, 14120 bp, Homo sapiens
cagaagcaaggagtcccctgaccacttcttccaaacatattcttttgtctttaattcccgcgttccttctcctttgttcagtccaacagggtccacggcaacrtggcacccatacacagggataggaggacatgaaggaagaaggtctgctggagcagaagaagtgaaattgatcagatgaatggggacaccaggaggagtctgccgcagccgatataaggtcagtgccctaaagaggtactgagagtaatataaggttcaaggtataaccccaggctaacccacctgccctgggctgagttgctggacatgcctgtgagtgctcagagtcacacacatgaatgagggggtcaggcaccacggtgcctttattcattcatttctcaaactcaattccctgcaaatcctgactctatttcataggccaaaggatgctactcatatttatttggtgccaaattattattattattattattattattattattattattattattattatcttttgagatggagtctcactctgtcacccagactggggtgcggtggcgtgatcacggctcattgcaacctctgcctcccaggttcaagcaactctctgcctcagccacccgagtagctgggattataggcaagtgccaccatgcccggctaatttttgttatttttggtagagacggggtttcaccatcttggccacgctcgtcttgaactcctgaccttgtgatccacctgcctcggcctcttaaagtgctgggattataggcatgagccactgtgcccggccaaaaatttttttttttttttaaatccttacatctgcaccttgaaaagtaaactgcaatatccagcacaacattgtcagacagagctgctgtatggttatttagcttcatctgcctgggtaatgtttaatatgcttcatcctttacagctggaagaaggatgttctctgtatttaaccagccatagtgcattcagagataaacagcttttatggactatttgcccaggaattttcagtaaacaactaagttcaggccctgattttatttcggtcagtatgtgcacatattcacttgcaattacccagaaagaagagaaactggttaacaagaaacctaccattatgtcagatgctggaaatcaatctttagctacataatatttacaggaagcattttaagattcataatcgactgggcacggtggctcacgcctgtaatcccagcactttggtaggccgaagcaggtggatcacgaggtcagatcaagaccatcctggctaacacggtgaaaccccgtctctactaaaaatacaaaaaatttgccgggcatggtggcaggcacctgtagtcccagctactcgggaggctgaggcaggagaatggcatgaacccgggaggcggagcttgcagtgagccaagattgtgccactgcaatccagcctgggagacagagcgagactgcgtcaataaataaataaatgaatacagataaaaaaatcataatccactttttcagtctgtctattatatttcattagtcaattggaagtggcatatgagctttatctggaaaaaatattttcacattttctaattcctttgacaaagaagtttttgtctggtaaggaatgagaatgctatttggccattacctacttttagaattccaactaacccttcaaatatctttatttagatcatatgctctcaaactatcttactgttttactgacacaatggtaaaactggtttcccaaaatgtcaaaaccataatggaatctctatggtcagtgcttcaaaaaagtactgggaacgagaagtttcttttttccttttttttttttttttttttgagatggagtctcgctctgtctcccagtctcccaggctggagtgcaatggcacaatctccgctcactgcaagctctgactctcaggttctcaccattctcctgcctcagcctcccaagtaggtgggacttcgggcgcccgccaccacacccgtctaatttttgctatttttagtagagatggggtttcaccgcattagccaggatggtcttgatctcctgacctcatgatctgcccgcctcggcctcccaaagtgctgggattacaggcgtgagccactgcgcccggccttgggaaagagaaatttctgaatcaggttaacatggggcacaatttgtttattgaagaaaaactttatgtgaagttgcttgaagttttacttaaacaatctgtggctcaggttagttgtcagacattaactaagcttctgcatgagattaccatgcataacccatggtttccacagacaggcactcttgatttgaaaaattgggacagagcaggagaaggattaaaatgggctcatcaatagccgggcgcggtggctcatgcctgtaatcccagcactttgggaggctgaggcgggcagatcacctgaggtcgggagttcgagaccagcctgaaaaatatggtgaagccctgtctctactaaaaatacaaaaattagccttgactggtggccggcacctgtagtcccagctacatgggaggctgaagcaggagaattgcttgaacccgggaggcagaggttgcagtgagctgagatcatgccactgcactccagcctgggagacagagcaagactccgtctcaaaaaataaataaaaaataaaataaaataaaatgggctcatcaagcaggccttaaagttgatcatctgttttctccacttggagttttgttcatactgtccttctgccattatctccttcttattctgctggacagaaggagtcatgttctgagtctaaaaatctgaaagaatctgttgtcccacccacagcaccagttgaaaataaaaaacaggagagggagtataaaaattggcctgtaccgccccctccaattgcagaaacatctgtaccgcctccttcggtagcagaaatagaaaccccaatagagagaattttatgctctgctgccatagctggagagctcttaggaccctgtgcttttcctatctccataaggcccgatacaaatagcccacagcagcttattcatcaacacaccccactagagtttaagttgttgaaggaattaagagctagtgtacttaataatggaatacagagcccattcactttaggattgctagaatctgtatttggtgctatgcaccttctaccctttgatgtaaagcatttggcttgcacttgtttgtctgctagtgtatacctgacatggaatttaaattggcaagaaatgtgtgcagaccaagctagacagaaccgtgctgctggacacagagacactacagaggatatgctgttaggtcatggcccttattcagacctggaacatcaaatggcactcccagacgctgcttatcagcagtgtgcactggccactaaacatgcctgggccacaattacagaagagggagtcccagtacaatcctttttaaatattgtgcaagggtctcaggaaccttatgcacaatttcttgcaggatctcaagaggcagtcaagtgtcagattcctcacaccactgctgcagaaatgttaaccttaaccctagcttttcagaatgcaaatgcagattgtaaacatgcactggcacctgtgaaatgtacaaaaacttgggaaattttctcagagcttgtcaagatgtgggaattgagctgcattgctccacaatgttagcacaagaaatggctaatttggcagttgataagtctaaaaagagccaatggtcaaaccctaaaatggaaaaaaaaaaaaaaccctaaaatgggaaaatgttataactgtggaaataactggacattttaaaaaggaatgcagtgagatctcaagagagaaaggaccttacaatgcggttccccactactaccaggaaaaaatgccaggactctgtcctcactgtaacaaagaaaatcactgggctaatcagtgccactcaaaatttcatcagaatcgtacccccatcaggaaatgagaagggggcctggacccaggcccctcaaacaataagggcattcatatttcagaccacaaccacacttcaggggtgggtcccagaagaaacattgattccctcaccccaggaacaccaggaagtccaggataagatctccctgccagagaaagaattatattagttggaggagacaaacctaccaaagctccccctggcatttagagacctttaccagcaggatacatgggactaattttgggcaagagccatcttaacttgtgaggcatcactgtagtccctggagtagttgactccaattatgaaggagaaattcaagtagttttaatgtcacaagatcttcaggtttttgaaccaggagaatatattgctcaattgttgcttattctctgcaaattacacccttctccatgaaaagagaaatgaggraacaaagggtttgggagcacaactacatgggaaatctatcccaacccataaactctaatagacctacctgtgtaatacaaattaaagaaaagaaattttatgggctaatggacacaggagctgatgtgtcagtaataaccagtaaggaccggcccctaccatggcctctcagactaacctccacatccctagtgggagtaggagcagttcaaagtgtttgacagagtgctgagattttactttgtcttggtctgggtggacagtcatatacttttcagctctatgttgcaaatatagctatcaatttatggggctgagacttacggcatgggatagcagacttacaagtgaaaatttgataacccaggatttaaaatgttgaagaatatgggatatcagagtgggaaaagtttagggaaattcctacaaggaactcctaacccgatatgagaaactggaaaaacagatagaaaagggctaggacatcaggatttctgatgggggtcattgatatttctcctctgccaactgccttaccattagaatggctcagcaaaacacctgtatgggtcgatcaatggcccctaacacaggagaaacaaactcaacttcagcagctagtaaaagagcaattggatgcaggacatatagtgatgtcagctggaattcaccagtgtttgttatctcaaaaaagcccggaagatggtgactgtggcatgatttgagagctgttaatgcacaaattaaaccaatgggtgcattacagcaaggtctgccagccccagcagccattccaagatactggcctcttgtagtaatagatcttaaggattgttttttttttttactatacccttacataagaaggataagcctcaatttgctttctctgtgccttctattaatcaaagagaacctgtttctcgctatcaatggaaagttttacctcaaggcatacttaacagtcctacactatgtcagcattttgtaggaagggcatgaaaggagccttggaatatgtttcctactgcttacatcattcattatatggatgacattcttttggtcgctcctacagatcaaatctcacatgagttattccgaggaacaaagcaggctttaactaaatggaatctcaaaatagctccagaaaaggtacaatttccccataccattacgcaggcactattgttactgaaagaagtgtacagcctcagaaagtagttctctgtaaagacaggttacagacttcaaattattttcaacagctattaggggatattaattggctgcactcagccaggcgcggtggctcacgcctataatcccagcactttgagatgccgaggcgggtggatcatgagatcagaggttcgagaccagcctgaccaacatggtgaaaccccgtctctactaaaaatacaaaaaaattagctgggcgtggtggctggcgcctgtaatctcagctactcaggaggctgaggcaggagaactgcttgaacccaggaggtggaggttgcagtgagcagagatcactgcactccactgcactccagcctgggcgacagagaaagactctgtctcaaaaaaaaaaaaaaaagaaagaaagaaaagaaagaaaaaatttcttctggtgtgaaaactcacgttaataaatgtaagtggtgatttttttgattctccattgctcccacaagaacagaaaacacacattagggaaaaatcttatgaatgtaatgagcatggcaaagtctttagagtgtcttcaagccttggtaaccatgacataatcctggatccagataaactttacaaatgtaatgagtgtggtaaagtctttaggaaaaattcatacattgtacaacatcacagaattcatayaggagagaaatcttacaaacgtaatgaatgtgcaaggtctttaatcgcaattcacatcttgcagaacatctgagaattcatactggagagaaaccttacaaatgtatggaatgtggcaaagtctttagtcgcaattcacaccttacagagtattagtgagtgaatacaggacagaaaccttacaaatgtaatgaatgcggcaagttctttagttgcaattcaaaccttgcacaamatcgaagaattcatactggagaaagtctcagaaacakaatgaatgtggcaaaatatttaacgagtggttagacctcactgcccatcttgtaattcatactggagagaaccttacaaatgtaaaaaaatttggcaaagtcttcaggtatgagttatcccttatcaatcatcagagaattcatactggagagaaaccttacaaatgtaatgagtgtggtaaagtcttcaggaataattcataccttgcatgacatcagagaattcatacyggagagaaaccttacaaatgtaatgaatgttacaaggtctttactcagagttcacaccttgcagaacattggataattcatactggagagaagccttacaaatgtaatgaatgtggcaaagtttttagcccgagactgagttatttcttactggagagaaaccttacaaatgtaatgaatgttacaaggtctttactcacagttcacactttatagaacattggataattcataccagagaaaagccttacaaatgtaatgaatgtggcaaagtttttagtcaactttcataccttgtatgacatcgaagaattcatactggagagaagtgttacaaatatattgaatgtggcaaagcatttagtgactattcaggccttattgcccatcttctaattcatagtggaaagaaaccttacaaatgtcatgaacgtggcaaggtcttcaggcatagtttatccctaagcaatcatcagagaattcatactggagagaggccttacaaatgtwatgaatgtggcaaggtcttcaatcaaattgcacaccttgcacgacattggagaactcatactggagagaaaccttacaaaagtaatgaatgtggtaagatctttagtcacaattcacactttacagaacactggataattcatatggaagagaaaccttatagatgtaatgaatgtggcaaggtctatagtagctattcatacctagcacaatgttggagaattcatacaggagagaaactttacaaatgcaataaatgtgccaaagaatttggtgggcattcaagcctcactrcccatctgttaatccacaytggaargaaaccttatacatgtaaggaatgtgataaggacttcaggaacaagttctccttaacaattcatcagagaattcatactggagagagacataaatgtaacgaatgtggcagagcctttaatcaaatttcacaccttgcaaaacatcagatagttcatactggagagaaatcttacaaatgtaattaatatagctaagcatttagtgtgcattcaagcctcgcctttcataaaataatccataatgcacagaaaccttaaaaatgtagtgagtgagactaggtttttagacaaaagttccaccttacaagttatcacagagtccattctggagagaaaccttacaaatataatgagtgtggtaaggtcttcactcagatttcacatcttgcaaatcatcacagaatccatactgaagagaaacattacaaatgccatgtatgtggtaaggtctttagtcacaaatcacaacttacaccgcatcagataattaattcatgagacagtcattacaaaccgagtatggcaaacttttcatcatgagcgttaatcaacatcagagtccatagtaaagagaaaccatgtaaatgtagtgtacaagacacaggctttgttgaggcctgccacatcactagacatcaaaagatatatctttgaaaatacctcacagatagattttgtatgctgaggctataactcaaggaatattactagagtacatcagaagacttatgcaagaaataactcagtctctggttctcttatattaatgtatgatattgcatgctgaagaaacattatacaacaaaatatgtttatcctcatgacatgatgtgtaccaaaggttcaacggcatgtggaaatgatcagttatattcagcttataattttttaaaaaattatttgggaggttttttgaaaaggcttctttactctttatgactttagcctgaactttgaaatcttttcatggcatggaggtgagcagagaataatgtaaaactatgatgccagtcattatacttattgtgttcaatgtatccttttccttacagaatggcttagtgcttctatgctctaccaaataacctcaaaatagagcatgtcatggccttaggaaaataggatttttatggaaaagagtaatgggttcttagggactgattatgccatagaaatcatccaggggaaatgatggccacctcctcaactgaatagcaatagctgttgtttagcaaaaattgatgaactatagtcttatttttgaaatggaagagagaacagttatatcagagtagagagtttaatgaaaactgccaatatagcatgttcttgaatagaattcacatttaactgttggtaatataatgtgcaactttgatttagaatgtgcatagttctcatgttttatgtaataaagtttaaattttcttaagtatgaatgaatcatgttatgtctaccaacactgttttatcccaccacaggaagatactttatagcagacaataataatgcaccattagggttttcaccatgttgggcaggctggtctcgaactcatggcctcaggtgatctacccgccttagcctcccaaagtgctgggaatacaggcatgagtcactgtgcctggccaccatattattatatttctatgtgcctttttgtgtgtatgccaaataagacccatggcatgcaccttcatttatatgaagtataccaatatagtaatatgaaaaataagatgtaaaaatgtatgaggttaagggtaaaaatactgtaataatgtctttttcgtccttgtgattagtgacattaatctgaaaatactaatcttcatacattttctcaagaatgaacacacaaaatgagtattgttttcttttggcagactgactagaaatttcatatattcaccttcataccttttttttggtaattttaacttttgcccactgtactggaacttgtctaaagtctacctgaggtttggtttggatattgataatgatgatgccatacactcaaatggcctgaaaatgtttattacataatgaggctttatggagaaagcagggtagacttctctagctggttcaaatgcagcttcagagaactggaatagatgacaggcttggggtaccatgattgttaaaggatagggctggggttggagtacccacttgtggtttgaacttccagctggtgcaaaaggagggggcactcaggctttattatcagcttgacaagatgggcagaatacaaagagggagtgcagaggtgtaaaatgtgttagtaattgtattagggttctacagagaaacagaactaataggatctgtgtatatataaaagggagtttattagggagaaccggctcatacaattgtaaagttaagttccacaataggctctctgcaaaccagggaagagaaaagctggtagtcgctcagttaaaatccaaaagtctctgaaccagggaagccaacagtattacagccttgtattagtccattctcacattgctataaagaaatatctaacactgggtaatttataaagaaaagaggtttaattggctcacagttctgcagggtgtgccggaagcataatgccagcatctctctgacttctagggaggccttaggaaacttaaaatcatgaaggaaggtgaagtaagagcaggcacttcacatggccagaacaggaggaagtgggtgggggtaggtgccacacatgtttaaacaaccagatctcacaagaactcactattgcaatgggagcacaaagaggaagatggtgtcaaaccacgtgaaatgccctccatgatcaaatcacctcccaccaggccccactttcagcactggggattacagttcaacatgagttttggatagggacatagatccaatccatattaggctttcagtctatggctaaaagcctggaagcccttgggaagccactagtgcaagcctcagagtccgaaggccaaagaacctggagtctgatttccaagggcaggaggagtgtaagcaagcgtccagcatagaaagaagaaagagccagaagacccagcaagtcaatttattctaccttttgcctgttttgttctagccgtctggcagtcaactggatggtgcccacccacactgagggtgggccttcctctcccagtttactgactcccatgtcaatctcctttagcaatacactcactgacatatccagaaacaatactttatgaaccatctaggcatccctcaatccaatcaaactgacaaccaagattaaccacaagtctacccctcatcaacttggcacccatacacatctccttaaatcataatctccaaatatagacaataatgtcataattatgcctcagcagttcttttggagtgcagcgcacctcctcacgggtcacatcacctctagcagccactgggacttgagtctagttacaggtctagaggcaaagaagggtggtgggggaggaacctgagaagaatcagcattgccttgcctcgcatctgcctcagaggaggccattgttgtttcctcaggcaatgcatggtgaatgtcctcagaaaaaaggtacaaaggctgaaagcagccttggtggggaagaagatgttgccaccatgaggggtagggaggccattttctctcgcaaaaagggctcatcagggtttaagagctcagtgttcccagcttcatcaggatcctcccacacatccctatgtcaagttacatgctcccaatctttcccaatcaatgcccttactttatagatacctggtgaggctgagtgtgcaccaattattgtaggtcatccactcacataagagcttgtgtctgatttttggcaatttcagccttttgtctacaaaacagtcgcacccagggtacccttagaagctttgaggctaagtatgatatattctagatctgggaggtatcatctctgagcttatccatttctttcatcattttttaccagggaacttaggaaagcaacttcattatgttctttggttctccagaaatgttgaaaagtatcatgtataaagtcactaaactccttgcctctcaggagcactgaatcatgagtatcaaatacatttattttgcacgagtctctgaacaatgcataccaaggactatcagtgttctctgtactattagaagtagagaccttagcatttttagttgtaataagattagagagccaactccagaagcccctaaaccaactaaggaaattcatccttaaaattttgttcctctaggctggacacagtggctcacacctgtattcccagtactttgggaggccaaggcaggtggattacttgagctcgggagttcgagatcagcctgggaagcatggcaaaaccgcatcatacaaaaaatgcaaaaattagccaggtatggtggtgcacacctgtagtcccagctgcctggggagctgaggcaggaggatggcttgaacctcagaggtggaggttgcagtgagccaagattgcaccactgcactccagcctgggcaaaagagtgagaccctgtcaaaaaaaaaaaaaaaacaaaaaaaaaccactccaggtaccaaagtctgtattagtcagggttctctataggtacagaacaaatgggatacatgtatatataaaagggagtttattagggagaattggttcacacaattacaaggcaaaggtcccatgataggctgtatgcaagctggagaagagagaagctggtagtggctcagtccaagtctgaaaacctcaaaaccaaggaagccaatgatgcaaccttcagtctgtgaccaaaggctcgagatatcccaggaagctgctggttcaagtcccagagtccaaaggctgaagaacctataatctgatgtccaagggcaggagaagcataaacaagcatccagcatgggaagaagaaagagaaccagaagactcagcaagcaaggttatcccaccttcttccacctgctttgttctagccacactggcagccagtcggatggtgcccactcacattgagggtgggtcttcctctcctagtccactgactcaaatgtcaatctcctcggcaacaccctcacagacacacccagaaacaatactttatcagccatctagatatccttcaactcactcaagttgacacctaatattaaccatcacattactcagacatcacaaaatgaagtctaactctttaggataacactgaatgtttactcttgaaactccagacttggttaggagagacttcaattttcttcatggtaatagcttattacattcctcttgtggctggacacataggtcccattgcacaatatgactgttgaaaatgcttgtgaaatactgtttagtaaaattgcctaagatatttttcatatcagttcagtgaaaattattgtgaagtgtttatttacataatataatttatcattatctaattgttatatataataaataggactctactagaagagcatttttccaaaagctacggaaatgtcatttttgattatggtattaagcaaaatgttctctggttctttaattgtaataaaattattttttgtttttgtacacaattttaaaaagtttccttttccatatgttgcagtctacattctatgtttcatgcatttcttccctttgttactgtagtgaaaagtttagggggcacataaatgaagctgttatttggagaaaaaaaatatgcatgagtatgcacataagatcacggcaggtataaactaggtttattgtaaatatgaaaaaaagaaggaaatacttatactatattagaagacttgaaatcacatgaaatgattccaacctttttattttttttcccagatgttttaggcattctatctttttttgcctttctacataattttttggataatcttgttagtatccacaaaacaccttgataggaaatgtattaatgttgtatatcaatttggttaatttcacattgtttctatgctgagtcttccaataaattgacattgtatatgtctccatttgagtgcctttgatttctttcgtcagcattttgtagtttgttttctttctttctttttttttcttttttaagagttggggtctcactctgtttcccacaggctggaatgcagtggtttgatcatgctcactgccatctcaactgactgccctcaagtgatcctcccacctccgcctcccaagcaggtgggactacaggtttgtgccaccacgctcagctaaattttttatttattttattttattttattttttttgagatagtgctttgctcttgttgcccaggctggagtgcagtggtgcgatctcagctcaccacaacctccacctcccgggcaaaacaagttactaacagatatgatctacaaaagtaaattgaggtgtggtggt

SEQ ID NO: 12354 - DNA, 18071 bp, Homo sapiens
gagctgagtccatgcctttttctctctgcgttgggaaagccatgctagctacatgcatttttggtcatgaaccagtcttagatttaagtcaatgtaaatttggcctttgccgtgttcttaatgtcttctttacatacctaggaaaagtgaaggagaggtgagaaagacagagtggggaggaacccgtgtctgtgggtttgtrctagatgccaacctggctcttcacatcctctgtctcatccagtcaagcagccacactgagtcccccagcatgagaacagcttccacagagcaggagattctgggtctgaaatgaggagagagctccagtcccaccagtgccctagagcatacctcagaatgctcctttctcctggtgggatccgtggagtctgcctgctcttccaaggatgcctcagccttttaagtaaggcctagggaggggccctgaaactaccaggacctgaggagaagcaggattctcagcgtgatttcacaccaccctaagccgccgggaatacttgctgctcattatctctctattggagtctcatggaacacattgtgggaagtgctatagaattctagggacatagtgggcaccaagtgaatatcagttactttaattattactaaatttatctccctaacaggaatttactatcttaccataataaactctgcttacatactcatataggtgaatacacctgccctaagtcatctctacagcaagagcagaggccacatctacctccagggttattgccattctcacaaaggtgaggataagtcaccacggggaacattgcttctctgcaggctgtgacactttccagggcatataaagcccatgaagaactgagatgtttgctgagaagagagcatacccaccgaagacagtggaaaatgaaaaaacaacaggagtagaaacttcccaatagtgatgtcaaactgtattagttactaattgctgtgtaacagcaaacctagcgacctaaaacaaacaaaaaaattatttaacaaagacagagtcgggaataagaaaactggcttggctggagggttcggctcagggtgtctgattaggttgtaggaaagatgtcagccaaggtttcagtcatctgaaggcttgactgggactgaaggatctgtttgtaagattgctcactcagaccattggcaggaaaccacagtttctcaccatgtgggcttctatataggggtgcttgaatatccttattagatggcagctggcttcatccaggtgagtgttctaagagcaaggaggaaactgcaatgccttttatgacctggtctcagaagtgacatgctgccatgttcaccatgtaacatactcattagaaaaaagtcactaagtccagtccatactcaagagaagggcagttaaacttcctctctgtatcagtctgttctcacactgctaataaagacatacctgagactgagtaatgtgtaaaggaaagagattgaattgactcacagttccacatggctgaggtggcatcacaatcatgatggaagatgaaggaagagcaaagtcacatcttacatggcaggagggaagagagcttgtgtaggggaatgcccctttataaaaccatcaggtctcatgagacttattcactagaatgagaatagcacaggaaagacctgccctgatgattcagttacctcccactgggtcccttccatgacatatgggaattatgggagcaacagctcaagatgagctttgggtggggacacagccaaactatatcattccacccctggctcctcgcaaatcacatgtcctcacatttcaaaaccaatcatgccttcccaacagtcccccagggtcttaacgcatttcagcattaactcaaaattccacagtccaaagtctcatctgagacaaggcaagtctcttctgcctatgagctgtaaaatcaaaagcaagttagttacttcctaaatacaataggagtacaggcatttggtaagtacagctattccaaatgggagaaattggccaaaacaaaggggctacaggccccatgcaagttcaaaatccagcggggcagtcaaatcttaacgcttcaaaattacctcctttgagtctctgtctcacatccaggtcatgcttatgcaagaggtgggttcccatagtctttggcagctccactcctgtgactttgcagggtacaaccctcctcctggctgctttcatgggctgacactgtctgtggcttttccaggcacacagcataagctgttggtggatctaccattctgggatctggaggacagtggccctcttctcacagttccactagacaatgccccagtggggacattgtgtgggggctcccaccccacatttcccttctgcactgccctagcagaggttctccatgagggctatgcccatgcagcacacctctgcttggacatttagacatttccaaacatcctatgaaatctaggcggaggctcccaaacctcagttcttcacttttgtgcacccacaggctcaacaccacatggaagctgccaagggttgggatttacaccctctaaagccatgacccaagctgtacctttgccctctttagccaaagctggagtggctgggatgcaagtcatcccaagtcctgagactacacaaagctgccaggccctgggtctggcccatgaaaccattttttcctcctggacctccaggtctgtgatgggaggggcttctgtgaagacctctgatatgccctggagacactttccccattttcttggtgaaaaacatttggctcctctttccttatgcaaatttctgcagccagctcgaatttctcttcagaaaataggtttttcttatctcatcttcatgctgcatgttttccaaacttttatgctctgcttcccttttaaatgtaggttccaattccaaaccatatatttgtgaatacataaaactgaatgttatcagcacccaaatcacctcttgaatactttgctgcttagaaatttcttttgccagatgccctaaatcatctctttcaagttcaaagttccacagatttctaggtcaggggcaaaatgctgccagtctctttgctaaagcataacaagagtcacctttgcttcagttcccaacaagttcctcatctccatctgagaccacctcagcctggaccttattgtccatatcactatcagcattttggtcaaagctattcagtgagtctccaggaagttccaaactttcccacatcctcctatcttcttctgagccctccaaactgttccaacctctgccttttacccagttccaaattgctgggtaacaggcaaagtgttaaagtgctgaaatgccaatagtgatgtcaaggtgtgttagttaccaattgttgtgtaacaaagtatcagcaaagttagcagcttaaaacaagaaaaaattattatttaacaaaggctgagagtcaggaatgagaaaactggcttggctggagggtttggctcagggtgtctcattaggttacaggaaagatgtcagccagggttgcagtcatctgaaggcttgactggggctagaggatctgcttctaagattgtgcattcacagactgttggcaggaaaaaatagtttctcaccacgtgggcctctccatagggctgcttgagtgtccttatcacatagtggctggctttgtccaggtgagtgatctaagagctaggaggaaattgcaatgccttttatgatgctgccatgttcatcatgtaacatagcgccccactcccagtatcaatttactatatcagtctgttctcatgctgctaataacaacataaccaagactgtgtaatttataaaggaaagaggttgaattgacttagagttccacatggctggggaggcctcacaatcatggtggaagatgatgaaagaagagcaaagtcatgtcttacatagtggcaggcaggagagcttgtgtggggaaattcccctgtataaaaccatcagatcttgtgagacttattcactatcatgagaccagcacaagaaagacctgcccccatgattcaattacctcccactgggttccttccatgacacgtgggaattatagaagctacaattcaagatgaaatttgggtgggaacagagccaaaccatatcaccttcttaaagatgaagtttccaagaatttatggacatattttaaaacagccacacatggtttgcgaattggcagcattgtctttaggtagtgccaaagtttatttttcagaagttcaaaacttgactctcatacacacatatagtgagcatgtgtcaaagatttactatttttcataagtgagggaatcagcaagattataaagctgattatcaaaagataattcagggaatggaggcttataccgtcagtcaagaaataaaggctgaaataggttggctaagttacgtttttaaagacagctttatgacttgtgaggcaataaaactgcaccctttggagttatcttttctatcagacaggaataatgtgtaatttatcaatgttctcttagttcatggctaatttcacagagtctgagacctaattagtaagtcaagcaaagggataggtccagagagaacttattgttggtgaggcctgtttgataatgttttcatataatattgacagtatacacagtcatagtttcattttacttattatttatttatttattgaggcagagtctagctctctctgtcatccaggctggagtacagtggctcaatcttggctcactgcaacctccacctcccaggttcaagcaattctcacacctcagcctcctgagtagcttggattacaaatgtgcaccaccaacccggctaatttttgtgttttcagtagagatggggttttgccacgttggccaggcttgtctcatttcatcttatttctactgtcattccatttggtcaatttgtaatttaataattttgtacaaggcagtttctacattaattttatttttctgaaaagtgtctatcatattagtggcattatgaaaatcgtagattattttctgtgttttgaacaacttgatattttatttattcttgaacacttgtaggacctcttggctcatatgtctgaataccatttctttaaaatgtacgctttaacatgtatacatatgtaacaaacctgcacattgtacacatgtatcctaaaacttaaagtataataataataataaaagaaaaaagaaaaataaaacttaaaaaaaaaagtgtatgctttaacaataaattattaataaatagttatctgtgttattcaagatataattaaattgttttttgtgcactgacccttacctttatttcagatccatcacagagagtgcatggaggtatttaaactgcattaactgtttcacaattaagtattatcttatcaattaggtattcaagaaagatcacttacagaattatagatggcatgagctagattttactttctaaagaaataaccagatacatgagcaaagatgttaatacaaagatgtttgtcacaacatggttttcaatagcaaaaaaagagagaaaaatatataaaagacaaataacagtggataggtttcaataaataatgttacagtgatacagttaaatactatacagctattgaagcatgtcattattcatatttagtatggaaagatattttgctattttgctacatgaaaaaatgaggttggaaaaagtataggttttgtgaatctgttgtatgaaagctgtctatagttacatgtgtatgtgtgtggaggaaaaagtgttgtcattggttttctgatgatgcactcagaaaagacaagtattcacattttttcttgtggctgatctggattttcaggtttttctacaatgaacatgtaggctgaacattccctaagcaggagagtcccacctctaacatctcctgtaggcctggcaatggcaggcaggaaagacagaggaaggaaggagggagaagggaaggagtgaaggaaggagtgaaaaaggtaaggaagaaagggaataggggaggaagggaggaaatgggaagggaaagaaggaaaggaaggaaagagggagggaagaaaggaagggaaaagggagggagtgagtgaatgaaagatggaaagaaggaagaaagggagggaggcagggaggaaagaaagtygcgcttcccttgagctgccatgggcactgactcttagggtctgaaagcccctgagatgcaaaagcctagtgctcacaaagagctggaaagcctcaaggaagttcttcaatatttytggaaggaaactgtctccagaagcttccctccccacgacagayaatgagcagcaagtgcttctggcgacttagggtgatgtgaaatcacgctgggaatcctgctcctcctcaggtcctggcagtttcagggcccctccctaggccttacttaaaaggctgaggcatccttggaggaacaggcagactccacagctcccgccaggagaaaggaacattctgaggtatgctctggggcgctggtggtaccggagctctctcctgaccccagacccagaatctgctccgtggaggctgttcacatgctggggagctcggtgcagctgcttgctccccagaccccagscmactcagcctctctctccatgattttctgttgtttattccaaaataggggagtctacaccctgtggagctcaagatggtcctgagtggggcgctgtgcttccggtgagtgtatgaggccctggtttggtggtgtcctccggaggaagtgagttctggatagacccgttgtccagctctgagcaggagggaggaagggaggggctgccattgcagctgggaaattgtgaccagcacctcaytgctcttagagttttcccagcctttttcaaataggggcaggactggggcaggccatctcacaaggggtccctgatgctgagggggayaagtgaacctcccagtctagagctccagccaagtctatccaaggtgggaacgggggccaggatccytgctcagagctccgccattgtcccccatcacagtgaatggatgtaagctcacccactctgtgcccctrcctccctgctactctttggggataataataaaacaaaaaccattaccatcagycagtctgtccacccactggcatgtaccaagccagacactctgccgtgttctgggcttwacaacagaggatgagagtggtcctttctctcagtctaataaagcacttcccaygatgtgttctatgggactcgattagaggagtcccacagaggcatccaggagatgctttacacagtggagctctctgatcaagtaaatgcagggaattctgctttctacatcctctcataagagaaccacagcccagctcagcatatgagtgaytgaggttttctgaagtaaggcaacttgttgaatygtatttagcyatgcatcgacccaatttttacactgcatccttttcccccatataacttttggagaaacccactttaggatacatcttccacctcataggatgccaggaaatcaactgagttcaaagatgagaaacaactttgaaaagttaaataaaagaaatttaaatttaaagaaactcctcacttagtaaggaatatatgaccaaatagaaatacatgtatcttgaagaattgaagaatcaggctttaacgtggaagaggcctggatgttatccaacccatcatcttagtgtagcaatggggaggctcaggcccagagtgggcgagagagttgtctcctgcgactcagcagcattggaggcakagatggggcaagawcctagggctctgactcaccgwgcagcttctcttccarcaggagatgggttggggcagaaaaggttgaatagggtgaaggagcaaaccacagactccagtgggagactgtggggtcatcctccttgtagggcatgagcccagcagggctgggagacaaggctgtgctgttacttctggcacagtaggaagaaagagagacaaaatgcctgagatcagggggttctctggatccagggcatgctggagtgtccaccctcctcctaatgtagtcctcaccccttcctgatgtttcagaatgaaggactcggcattgaaggtgctttatctgcataataaccagcttctagctggagggctgcatgcagggaaggtcattaaaggttggtgatgaaacatgacccactttccttggtctctatacactctcaggggagggggcctgaagagggcttagaatagtcatacagattagcataggcctacagagcccaggcattrgggcagcacaaaccaggctctaagcaaaggcaaataaaatactacacctctcagcaaagtgaagacacasgctctggggccacctgaagcttctrtgcagaagtgrgaatgttttccaagaggcttgtcttgtcattcccttacaggtagatttaggtcaagcattgcattccctgggagccagtaagtaccaaggagagaactaacgtagattctctataccttttttcccatatgggagtgggtttctgcctctccaccctgggtcccctctgctctctgaagatcctcagtcacttagagtggagggacccagagaacaggtggcattgttggacctcctgcttgctcactctgccccatgcactgcaacasgtccctctctaaaatagtttgcacctgcccacctggggcacccttgctgagcacagatgccaggtagatccttcagctaggccatatgtgtatgtgtgtgcttactggtgtatgtatgtgtgcatgcaggcatatatgtgtgagcatatgtgtgcatgcatgtatctgtrtgtaaccatgtatgtgtgagtgcaggtatgtaggtatgagcatgtgtgtgwatatgtatatgtgtgcatgcatgtatctgtgyatgtatgtatctgatgtatgtgggtggtgaggggatgtacagagaggaatgagaccctcttttgctctcagcaacmtcacagggtgtagaaagttgtccaaacaattccaaaggggggcttattaagacagggttcagaaaaaggcctgagacccaaggggcattaaaggagggggttgartctattttgggktgtagaggcttgaagatttgaccctgaactagagggtggagtggaggtggtacaatgtgcttccatgccttgatgtccactctgrgccagtggacaggagaagccatgtcatgacagctgctgagaagcctcccttctgcccagcctgggggcaggccgtctyacagcagtcctgtgccctagagcccaggacaggggaagaaggagggaaaggcatccagggccctgcatctggcctctttcccacaggtgaagagatcagcgtggtccccaatcggtggctggatgccagcctgtcccccgtcatcctgggtgtccagggtggaagccagtgcctgtcatgtggggtggggcaggagccgactctaacactagaggtgagacttggggcatcctcactggggactcagccacagatgctgagcctactgaagccgggcagcccacagccctggtgctgtgggacaccctagcaggattctgttgatggcagctttgcctcctccctaaggatcctgcccagccctccctctgcccctgcttctgccctcacctgacctcccctcctctgccggcagccagtgaacatcatggagctctatcttggtgccaaggaatccaagagcttcaccttctaccggcgggacatggggctcacctccagcttcgagtcggctgcctacccgggctggttcctgtgcacsgtgcctgaagccgatcagcctgtcagactcacccagcttcccgagaatggtggctggaatgcccccatcacagacttctacttccagcagtgtgactagggcaaygtgccccccagaactccctgggcagagccagctcgggtgaggggtgagtggaggagacccatggcggacaatcactctctctgctctcaggacccccasgtctgacttagtgggcacctgaccactttgtcttctggttcccagtttggataaattctgagatttggagctcagtccacggtcctcccccactggatggtgctactgctgtggaaycttgtaaaaaccatgtggggtaaactgggaataacatgaaaagatttctgtggrggtggggtgggggagtggtgggaatcattcctgcttaatggtaactgacmagtgttaccctgagccccgcaggccaacccatccccagttgagccttatagggtcagtagctctccacatgaagwcctstcactcaccactrtgcaggagagggaggtggtcatagagtcagggatctatggcccttggcccagccccaccyccttccctttaatcctgccactgtcatatgctacctttcctatctcttccctcatcatcttgttgtgggcatgaggaggtgstgatgtcagaagaaatggytcgagctcagaagataaaagataagtagggtatgctgatcctcttttaaaaacccaagatacaatcaaaatcccagatgctggtctctattcccatgaaaaagtgctcatgacatattgagaagacctacttacaaagtggcatatattgcaatttattttaattaaaagatacctatttatatatttctttatagaaaaaagtctggaagagtttacttcaattgtagcaatgtcagggtggtggcagtataggtgatttttcttttaattctgttaatttayctgtatttcctaatttttctacaatgaagatgaattccttgtataaaaataagaaaagaaattaatcttgaggtaagcagagyagacatcatctctgattgtcctcagcctccamttccccagagtaaattcaaattgaatcgagctctgctgctctggttggttgtagtagtgatcaggaawcagatctcagcaaagccactgaggaggaggctgtgmtgagtttgtgtggctggaatctctgggtaaggaacttaaagaacaaaaatcatctggtaattctttcctagaaggatcacagcccctgggattccaaggcattggatccagtctctaagaaggctgctgtactggttgaattgtgtccccctcaaattcacatccttcttggaatctcagtctgtgagtttatttggagataaggtctctgcagatgtagttagttaagacaaggtcatgctggatgaaggtagacctaaattcaatatgactggtttccttgtatgaaaaggagaggacacagagacagaggagaygcggggaagactatgtaaagatgaaggcagagatcggagttttgcagccacaagctaagaaacaccaaggattgtggcaaccatcagaagcttggaagaggcaaagaagaattcttccctagaggctttagagggataacggctctgctgamaccttaatctcagacttccagcctcctgaacgaagaaagaataaatttcggctgttttaagccaccaaggataattggttayrgcagctctaggaaactaatacagctgctaaaatgatccctgtctcctcgtgtttacattctgtgtgtgtcccctcccacaatgtaccaaagttgtctttgtgaccaatagaatatggcagaagtgatggcatgccacttccaagattaggttataaaagacactgcagcttctacttgagccctctctctctgccacccaccgcccccaatctatcttggctcactcgctctgggggaagctagctkccatgctatgagcaggcctataaagagacttaygtggtaaaaaatgaagtctcctgcccacagccacattagtgaacctagaagcagagactctgtgagataatcratgtttgttgttttaagttgctcagttttggtctaacttgttatgcagcaatagataaataatatgcagagaaagagaaacaaatgcatttgttttattattgcaattttctccaatattttttattttctttctcacaatgaacaactatccttcatttacccaaatattctatttaaaagctaataatacagcatttgttgagtcatctggttctgcaagattgagatcctcttgtcctatgtgccaggaatgaactccagtgtccccacccaaaccctggggaatgggagcagaagccagaggaggagcccatatctgagccccaggtattccacctgcacttcacctgttggaccagcttggtggttgagagtccactgaggcactggcaaggaggtggccaggacagacaaggctgcctctatggacctcacagctccagcccagattcagctgaagtcctcaggcaacaggcagcacagctcctaccccaggcctctcagggctgccaagaacatgagctccggatgctaggctgtgtttcagaccctgttcacactctctttgtccatgggcccagacacagtcttgtgctgctccctctgcttttgggtcctccatccatcctctctgcctagataaatctctcatctttcaataccctgctaagatgtcacctcctccaagaagcttttactgagttgagacacccccagctatctgatctggcaatgtttgtatgcacctccctgcactgtagtaccttaacttggagtctgtggcccctgggatgaccttaaggttagggacatataagtttgtctcttagcaccttgcataatgcttggcacataatggaaacccaatgagtatataatgtagaaactatttctccaccctggaatattctctccttctcctccacccatctaaacaggcccacctctaagggagcagcttaaattccacctcattcttgaaggtttctccagcctgaatttgttgcttcctcatttgtaggatgacagaactcagaagagctttagccatgatgagccgacacaagtcagtagtaaaagaaggaatataaaatgcctccttcaggaatgtacaggctggacatcatgactctacaagtgaaaaagagttagtggctttagatttctgcaattttggtataaatcactggcctggacctgtatttacagagatgcaatactcacatcatgtggggtttgtacaaattgcagacatcgaggaacagagaatgttccaagggcaggctgtagggaagaggctacgatgtgggaggtattatcctgaaaaaagcaatgcacagggagccctcttcaagcacttaaaggcttgccaagtagaagaatgtgcttgttctgtgtaattccagaacacacaagcagaaccaatgggtgcaaattatgtggaggctgtttttcctatatgacccccatattttaaccacaaggaccacaaacattgatagggtttcttcaagaggttgtgtggtccctgaccctggagatgttaaggcagagcctaattaaccaatttctcagggatgccatagcacagatttctccaattggagggaaactatgattccatgtctatgagatggagtttcactctgtcgcccaggctggagtacagtggtgccatcttggcccactgcaacctctgcctcccaggttccagtgattcccctgcctcagcctcctaagtagctgggcctacaggtgcatgccaccatgcctggctaatttttctatttttagtagacacgaggtttcaccatgttggccaggctggtttgaactcctgacctcaagggatctgcctgccttagcctcccaaagtgttgggatacaggcatgagccaccatgcctggcctaaagtcctttcaattctaagattttttttttgcccaaggagcttatctgccactattgtttccaacatgtccttggcccacagcttagagagtctggtcttcttaattatcttttcaagtgtttatgacttagttcctcagctagactgtgaaactacttaacaacaaggactgtgtattgaatgtctgtgtcacacagcagtgtaaatgctgggtaaacactcattggttgcctgacatagtaactcatgctttaagccttcccatagaagggtgagagattgggagagtggaagaagaatgatcactggccttagaaagcagaaatctggtcccatttctgcccatcttttctcatttctcatcctgcaggcatctgagtcttagacccacctatcccacttcctcaagaagcccttggtggaactttgcaaatgaccaaagagggagaattataataaggttgttagtttccagagaacattacacctaagcttctccacgcttgtaatggagggatggatggatggatggatggatggatggatgaatggatggatgaaagggtggacagaagggtggatggatgggcacatgggtggatggatggttggatggatgatggatggatggaagaatggacagatgggtagatagatggacagatgggtggccgggtggatggatggatggatggactgagtcaagtaatgtcaattagagacctgagtgttctttcctctgtgctctactcacactatcatatttcctagcagtccatggcacatgatgtctgctcagtctcagggtgaatctgaggtcaatatctttgcagttgggtttccctagatgttctgtcccatcaagctggtaccaactaattaaacccactgaaaagcagagactcccttctcgtctttccaaacagagtcacactcacagtgctatcagccccttctcttattctggctgtctggccacagcctggattccggcatcagaatttgttctgtccttgggcttgccagacatactttctcttgtattcaccacctcttcaagcctaggatggagccccacggggcaccaaagatgtctgaccccagcactgtttatctggctgcaaacccactaataacatagtcaacracagtcagtacagagcaggggccccataccttatttctgccaaggctttatggatgactctctcccccttcaacaaatgctcmttaatgttcccaccatcttattattcatgctgtaccaaagacattgtgaaatgcccaggctcttcttccttcatgtcctgcagccaattatagagattggtgcaggcctgacccacctgtaccagacggtataaacacagcgcaatgccctggagaaatcagttggagtctccagggatcagggttccaggaactcaggatctgcaggtcagtgatggacaggcaatattctctctctcttttctttcttttctactctctcctgtcaatatctctggtatgccctctatcccttcactcctcctggcaagctgtctaggtaacaaggtagtcccctcatatgacatgatgggacatcaaaaacatttaggagcacataaagagatttgaggagaaggaataggttaagccaaatcaagatttctgaactacttagaacaactgactttagaaagtaatctcaaaagaaaccatctgggccaatggtattcaaaccgtgtttggtggaagcttaagagattttttgttttcgtttttttttttttgtgctccttggtagctcctcagtgtcttctttgcaggcaagagaaatactagcagggttccaaagtctccattgcttcctgtgtcagcaaagcagctgccctttatcctttttacaatcattagaattctgcataaaattttattgtgaaacttaaaacagttttgaaagataccttactcaatctttccatccaatgttgataagttgaaggcccagggataaaaggtggcaaaataaattggtagcagagctaggtctaggactcagcctttctattcaaagtctgctctgtgtgtttctatgtcctggccacaaggaccagggtagttcaattagggtggttggagagagcttcaagtgagctgtaagccatgcttcatgacttcaagatcttataaacttttataagggaaacaaatatctttatgtacaacaataaataatacagtaaaatttaataggagttcagagtrgagttacaatagtaagggaaagattcattaaactctgagtcatggaattataaatagtttggcctagaaagaaccttcataaccacataatctaatcccatgaatgtatagtgctgaaactgagggttggaggttaaaagacataaccctgtatgtctaagctgtaactctacactggtaattaatttgatagaactagatactgaacccatctatactgatactatctccagtgatcttaatatcaaaagatctgaatggatgacaatgagaagggatgacttttgaggcagggagaacaatgggacacctgtgagtacgtccactgagaagataagaaaggaattatgtcgccaggaggtgtggtttagtgtccatggagaagtgagatgctatcacacaagaaaatcagtgccagacggtgacaaaacagtcagtcactgtagattctagagctgggcagggatgtggtgaaaaaatctttagaacgtgggtccacattcctcacataggttggaatgaatgaaaggcagaaaaaccgggaatacaagtacagtagtaatggcaattaaaaacacaaagttatattttaaagaaataacctgtagggacttgataagttagacactgagtcaggagaagtaggagatattgtcaatgagtctcaggttttgaatatcactggtgagaggaatattatgacagtgagagaaatgaaattgggaggaatgtgtgggctgggaggagaagataattaacttaaccttaaatatatttggttggatatcagcaggatgtccaaagtgggctgtcctgtaggctgcaggaggtaaagtgggatgtgcagtctacatttgggagccattagcccaagataatcattgcagctgtagaagtcaatgaattgcagcttaatatgatgtgaaatagaagtgcttaggaccttgttagccttaggggtggccccagaaggaggtgaaatctacaatgggagaaagaggtgtgaagggagtcattcaatgtcaagggttccaaggaggcaatgactaaatatcaaaggaatcaaaagaatctctggatcttgctccacagaagttaatattggtcttggacagaacatcccacatagatactgtgcaggagaatgatgaaggataggacagggtgctgtgcaaaagaacatggggaaagcccaagtttagctgatggcagtgtttgagccaggacaggtgaattgcggaggtctgagagccagatgccatgtccagggagaaatgagaggaagaaaagagggatatagactgaagttcagtgaaaagtcatttgaggaaaatagggaggggaagctttgggggtgaggcatgtggcacactgggaggggcttggcacacagcagaggttcagcaccaagacccaggctctctgatggaccagacgctagcttcctacccttactcacttcatcacaatctatcagaacccaggcggagggagccgaataggggagcctttgggaaagacactgtacattttggctgtgccagaatgggaggtttctagggcccatgggatccagctggactggaccagcattgaatttcttccagctctttgagctgacactgacccagagtgggagtcatcagcttgctatccaccttcacccagggccctccactttgttgccccayctagatctgggcacagctaccacactgcccactgtcctgctgctacaaccaaagaagccccagtggtttggccaaggggagcccatcatcaagtgggcttgcattgaggccatgatgctgttgagttatctgtactgggggattgtctagtcctttaggactcaaagtgctggccaggaggaaccagcagcattgacatcacctggttgcatatttgaaatgtacagt

SEQ ID NO: 12355 - DNA, 18320 bp, Homo sapiens
ttttggtaagcctcgaaaggtgagcacctctctgcggtatcctccctatgttcccagtttcaggcctggggagctgccatctctgtctcttccactcctccttgctggtatctgtgggactggttggtttagatgcaggagtaccatctctccaactccgttttgtgtgtcagaaagctttgcttgtttgtctttaatacgccaaatctcctgtttctaaccccctgacttccatctctccagtttcccagtcctgcaagagtcctttgctctgctcttgcagtttctccgtgtgttcttcagcaatatgcaccctgatggtttgcactttctatcgtgtttattattctaatggctaatgtccatgttaatatttctacttcattgcttttctactgcctcttgcttgtgtcatgtgggcagtatcttcactgatttctctatggatattgattatacttattttaaattactggtattcctttccaataattttgcagccagtagtgtgtgcttctggtccttatctttccattgtgctgatcgtgcccctctcagcctgctctttatcttagcagtgagcaacctccttttgggggtgtagcctgtctggtcacctctgccacatgctgctctaggtcaccaggtgagccaaagcagaggcagagaatgggcctggacaagaagtgtccctggccccagaaacctatcaatgatggtcacccactaggaaattcttgttttttttttttagagagggaagctgccccagagggaggacgctggtggaaggaatataccaggcctgggagtgaaggggcagaaggaagaatggcagtaaggaatgtctgaggagagtctgaaagccacatgtgttctgatttctgtggcaaaagagcaggtctttgctrtcctaactactgagctgcctttcactgcagccaccctgtgttcaaggccatgtcacagataagcatgtctctatcacatgggcagatatgacaccctctgaccacccaccccatggctataggggcctaaggtagtccttgccagatgcagtgggcctgtgtatttgtgttggttaaaaagaaggcctgtgacatttacacattctcagagagttcatgagcaaaaacaagcaaagaaaaaatagcaggactggaacacaggacagtacaggatgaaaagtatgggaaggtcaggccttagggttacaaaggacactgctgacaacaagaaagcagcctaccgctgtcagctgtctctcacagcctgtctctcatggccagaccatggtattccctgctgaccctaaacacttccacagaataccggtgtacaacaatattactctgttgtgagatcccaaatcattscaaaatcatgtcttcatatagacagaaaaggttgctctgtgaaccacaaaaacgaaaaacatgcccctctcctgcttaatataaacatctgccactcttttacaaaatacagcttcgccttgctctgttctacttatctcctaaataaaagttaagatgcacaatcacagaattgcccagcttacggacagcaccctatccagaacagactcctgcttctcaaaccccttcccccaaaaccacctaaaacaaaacaagtcttatagaaatcccctcccgacaccctgttactgagaaatcctagggtacaccattgtgctcaatatccctgttggaacaaacagttaaaagaaactaaaaataataaatccattttatctgactataagcatattcctgatggtcctcacttggagagcaataacattctcattgctattgtcctactcacagcagctctgtggaaaagggaatgaggttcaaaatctgatttgaaagatgtaaaactgaggttcggccagaatatggggtctatctaagctcatattcatgagacaaaaccaagccttctggtttccaatctcaaaccatgcctctcacatggagccacccaagaacactgcttcccaagctgagaagactcttgaacagtcaccctggagggaatgaaggcctttcttaagcaggctgtcatggtgagccacgtgccatgcactctgaatgtggaccagttaaggacacaccactccacagccaaggcagcggtgccctctttcccagacgaggaaactgaggacatgaaggcagtggaacttgaataaggtcacactgttgggaagtgggagagctgggatttcaccctagtctacaaaaaaggggatgtagggcaccaggcagtcctcctgcaggtcagagaggcagttttctctgcagcctcttggggtgaggtggatttgttgtggcgctgccagaatggaagcagtgttaggaaagtggaaagttttttttttttttagacggagaggctctgtcgcccaggctggagcgcagtggtgcaatctcggctcactgcaagctccgcctcccgggctcactccattctcctgcctcagcctcctgggtagctgggattacaggcacccgccaccacgcccggctagtttgttgttttttttttttttgtattttttagtagagatggggtttcactgtgttagccaggatggtctcaatctcctgacctcatgatccgcccgcctcggcctcccaaggtgctgggattacaggagtgagccaccacgcctggctgggaagggttttaaagtccagaacaaatgcacacagtggccttatctatggggtggagtgcagagtgggcattcgtgtggagagagacattcaggctgcggcatgtggagagtggcctctccttttgggaaaggccttctggagagcaggatgtaactgggcgacactccaatctccggatcaattgctagattgactttcccccagatacccacaccctctgaacccagttctaggaaatttcagggtctggagagcagtttcctgacctctggactaggtaaacaatgaaagcaagcactgtgattaaagccagcaccgccagtgacctggagtcaactacctcacctcaccttctgccactggagcaggagcagggggaagctctggctgctaaagaataagaagggaaacaagtcttctcaggccctgtcttctttaggccctggatctcctgatatccactgatggctttaggcatgtggctctgtaccatcctggacatttttccaggcacagcagacaggtcagcaggaagtaaggaagccagtccctccacaagccaagaagacttcaattggaagggacctggaaatgcatcttactcacatttcttttggtgtttggaggcctccatagtacccccaccacatggccccgcagcctctgaacttctcaggatgggctccccaacaccccaagctacatggcatttttctgaaagccatatcagtaatgtagttgagaatcaaatgaactatgttcgtaaaagtattcttccatcccttctagattgtccccattaaccacagcaagatggttcaagccattaacacacacgatacccatgatcttatagtgccaagtgctgttcttttgcttcttatctcagttgagtggcccctagatagtcaagtcataaatgtgtgtgcccatgaaaacttcttattatcactcactattctagctaattctcaagtgcaatcaatacctcctgtttctcaagtgtgcctaccttcttaatctagctgccattaccctgacccaggccactgtcttctgctgcttagatcatggcaagcacttccttttagatctgcttttctccagtcctgttcccctcaacatcatagccagaacaagccttgcaaaattcaaatgtgatcacctctccactactgcagtccctctagtgccccctggaaggaaacccaaagtctttaacacagtttacaattcttgttatgaggatgaaatttgaagacattgtgctaagtgaaataagccagatacaagggggctattgtatgatttcacatatatgaggtacctaggatagatgaattcagagagacagaaagtaaaacagaagttaccagtggctgtgggtaggggtaaatggagaattctagtttaatgagttgagagtttcagtttgggatgatgaaaatcatcccatgatgtggtgatgatagcacaaccgtgtgaatgtacttaatgctactgagttgtgtgcttaataataatggtcaaaatggtaaattttatgtctattttaccacaatgaaaaactggaaaagtaaagtcaatgactataatatcataaagtgtaagtaacatgagagaaaataattcaggctaagaggatagagactgctaggtaggactattttagaataagtgatcaaggtactgatttctctgaaattggaatatttgaatagaagagaaagagctagctggcgatgcccgtaaggggtccaggcatggagacatcaaatgaagagtctgaggcaggaatggccttaatgcattaatggcagcaagaggtctatgtggtttcatggatgggtgtgtgcgtgcatgcacgtgtctgtgtgtatagttggtgtgcatgagcatgtgtatgcatttgtgagtatctttgtttttctgttggaaacaaggatgtcaacaggactaactaggtgaacctagctgtggtagttcagcaatgagatttgccaaaatggatggcaattgaaagaggaattgtgctgtattaaagcagacagctgccgagcactgtattggaggctcctaaatttctcatagttctgagaagagctgtttattaatctggagttgaaggccaggcccaggatatccttgttcacaaggttgattgggccctacattgctgagcccagcctcctccctcactctgaggcatctgccagagccccaggctagagggccagcgtccttgtcactgagtccctgctctgcagaaacaccagtaagtcatttctggtgaataaatctgggtttccggatcaagggtttggggagctgacatgaccctggaggcatggaggaggctttctaggggtggggggagtgggatggaaagcagaaatcaggttgaggatgtctctttttctgcttgtgctggagcatctgtgactttcctccattatctgttcatctgcagtggagactgtctttgttttcaaagggaaacttggaggcttagacctatggggctaggctgctgaggtttcttagggggcaatagctggaagaaagctctgaagaacaaatgaaaggttaatactgagaaatgggaggaggattcaaggcaagttttctaattgccagtggtttttgactcacagaacatggggaattcctgccagaaagtagagaggtatttagcactctgccagggccaacgtagtaagaaatttccagagaaaatgcttacccaggcaagcctgtctaaaacaccaaggggaagcaaactccagttaattctgggctgggttggtgactaaggttgaggttgatctgaggttgagaccttcctctttggatcaccagctttcagctcagggcctgccamtgagtaaatgatagttaacaggtcctggaggggaatcagctgcccagatacaaagatgggattcaggtggcagatggacccgaagaggacatggagagaaagaggaagctcctacagacacctgggtttccactcattctcattccctaagctaacaggcataagccagctggcaatgcacggtcccatttgttctcactgccacggaaagcatgtttatagtcttccagcagcaacgccaggtgtctaggcacagatgaacccctccttaggatccccactgctcatcatagtgcctacctttgttaaagtactagtcacgcagtgtcacaaggaatgtttacttttccaaatccycagctagaggccagggatgggtcatctatttctatatagcctgcacccagattgtaggacagagggcatgctcggtaaatatgtgttcattaactgagattaaccttccctgagttttctcacaccaaggtgaggaccatgtccctgtttccatcactccctctccttctcctgagtatggtggcagcgtcttactcagaaactgtgacctgtgaggatgcccaaaagacctgccctgcagtgattgcctgtagctctccaggcatcaayggcttcccaggcaaagatgggygtgatgrcaccaaggragaaaagggggaaccaggtacgtgttgggctgttctgtctctgcaattctttaccttccagaggaaactgcctggggatatgaggagactgatgtcctatttgagtatatttttctcaactatactrtaactcaaaacagagattcagctctcattctctggcatctcagaattccacacagcagtttgtgactaatagttgtcttgccagcccaggaaagtggcccacaggtcaggccatcccrtgggacacaggatgaatttttcttctctgggtcattgtcatgtcagacccctattcacttcagtagggatggcaccaggttcaagaggccaaagaagagatggagtcagcaaacaaacataggttttactgggggaayctgtttacagggagatccagcagcagtgggctggacaggagaacaacaactactggtaaaaacaaatgcagttaattttcactttgcaccctccctgcagcaacctccacgtggcaactttatttcttaagttattgctctcaggtgcmcaccatacagttattgagagcagtgctcagaaaggtcagtcctgggtcaaggtctccyttctcctgagaagggattgggcatcaaactcttgaagagagagagcaagaacatagatattaagtcacatttcctttgtcttccaacaggccaagggctcagaggcttacagggcccccctggaaagttggggcctccaggaaatccagggccttctgggtcaccaggaccaaagggccaaaaaggagaccctggaaaaagtccgggtaaggaccccagcaaggtctgagctgacttcacccagggttctgagaccttgagtatctggtaagaggtgccccttctcctgttccttcaaaggaagatacccaaatttgctttctgacccagtgccctcagccctctcttcattcttagagccttagggaattcctataagtgcctgagtacagacttacaaacttttcaagacaactccctcatcaggcactccctgtaagagctgagcctggattctccatcagctgaaacagtctaatgtgaggccctggtcctagagggagaaaacaggccatctaagtgtgggcttattatacctatttttacaaaagcatgtaaccatggtatgycatattttacttcataagaaaccaagccaaagcttaatagcttaaaaacatagccgtcaatttaaatcacaagtctgtgggtcggccatgtgatttctctgctggtttaagctgggcttacccacatgtctgtggtcaactgatggccaatagtctcactcatgtgtctggctgttgtctgaatgttagctggagtgatgagggtaattgaaccacatctctcatcatccaacagggcttgttcacatagcagtgattacaggattcccaagagtagaaataagataggctttaggcttcttgaagactcagagcacattatcatttctgtcagactgtattggtcaaaacaagtcacaaggccagcccagattcaaggagtggggtaatagactcatgtcttaatgcgaggagctgtaccctattgaggccatttttgccatctactacaacaagtgatttgctcatgccctccccacttggataatgggcaactcacaaaaatcttggtttcctgactaacagaacaaacctggaaaaaacaaaaacaaaacaaaagacatcaaaagcaaaacctctccaaagayaaaaactctgcaatctttttcgtcactcttcaccaggtcataatagagtaacgcctcaagagatttctttttagttttgatagaacaatttatttgaaaaaaaaatctgtgaagaacctggcatatggattgctaggtaatcagggagtatatgygtgcatgtgatatgtatgcgtactttgggatacagtaaacagacaaagagggacatttggggttggayggaaatagcgatttttcattctttgggcttttcagtattttttattttccttcaaagtgtaaacatcaatgtaaaataagctttttttttcagtttgaaaaagatactccactcccttgtatatgcacagttctgaggctccttctcaacaatgcttctttactttgttctaattttctagatggtgatagtagcctggctgcctcagaaagaaaagctctgcaaacagaaatggcacgtatcaaaaagtgtaagctttttctcttactctccaggcagcttgaagtttgggaaaaatagaatgcaacaaatatttgttgaatgcatataattttctgtaccctgctaggcatttctcatattcttacctcatgaaattctcacaacattttggtagaaatggaggcaaagggaagttaaattacttgttcaaatgcacagagctaataaatggcaggggtggtttatagatggaagtcagtctgactcgagagaccctaatcctttaccgtctgatattgctcactgaaaatgggacttatatccctttgttgcactggtattgagacctggccgtggggtctaacctgcctggggcaaatattttcagacattttttgtttggtctcaagttaacaatttagaattcagaagtccaaattatatgtcttttagaattctgatctgaaagcacagagaggcctttgtaccagtctgtctgttcacatttgggttgccatatttaacaaataaaaagacaaagcaccagttaaattggatttcagctgaaaaacatttttagtataagtgtgtctgaaaaattatatgggagatatactaaaatattcattgtttgtctgaaattcaaatttaactggacatactatattttatccggcaactstactctagaagactttttcttgagaaataccttgagttgggcttaaggatgagtsagtttcacccactttttcacattttagggctsaccttctctctgggcaaacaagttgggaacaagttcttcctgaccaatggtgaaataatgacctttgaaaaagtgaaggccttgtgtgtcaagttccaggcctctgtggccacccccaggaatgctgcagagaatggagccattcagaatctcatcaaggaggaagccttcctgggcatcactgatgagaagacagaagggcagtttgtggatctgacaggaaatagactgacctacacaaactggaacgagggtgaacccaacaatgctggttctgatgaagattgtgtattgctactgaaaaatggccagtggaatgacgtcccctgctccacctcccatctggccgtctgtgagttccctatctgaagggtcatatcactcaggccctccttgtctttttactgcaacccacaggcccacagtatgcttgaaaagataaattatatcaatttcctcatatccagtattgttccttttgtgggcaatcactaaaaatgatcactaacagcaccaacaaagcaataatagtagtagtagtagttagcagcagcagtagtagtcatgctaattatataatatttttaatatatactatgaggccctatcttttgcatcctacattaattatctagtttaattaatctgtaatgctttcgatagtgttaacttgctgcagtatgaaaataagacggatttatttttccatttacaacaaacacctgtgctctgttgagccttcctttctgtttgggtagagggctcccctaatgacatcaccacagtttaataccacagctttttaccaagtttcaggtattaagaaaatctattttgtaactttctctatgaactctgttttctttctaatgagatattaaaccatgtaaagaacataaataacaaatctcaagcaaacagcttcacaaattctcacacacatacatacctatatactcactttctagattaagatatgggacatttttgactccctagaagccccgttataactcctcctagtactaactcctaggaaaatactattctgacctccatgactgcacagtaatttcgtctgtttataaacattgtatagttggaatcatattgtgtgtaatgttgtatgtcttgyttactcagaattaagtctgtgagattcattcatgtcatgtgtacaaaagtttcatccttttcattgccatgtagggttcccttatattaatattcctcagttcatccattctattgttaataggcacttaagtggcttccaatttttggccatgaggaagagaacccacgaacattcctggacttgtcttttggtggacatggtgcactaatttcactacctatccaggagtggaactggtagaggatgaggaaagcatgtattcagctttagtagatattaccagttttcctaagtgattgtatgaatttatgctcctaccggcaatgtgtggcagtcctagatgctctatgtgcttgtaaaaagtcratgttttcagttctcttgattttcattattcctgtggatgtaaagtgatatttccccatggttttaatctgtatttccccaacatgtaataaggttgaacacttttttatatgcttattgggcacttgggtatcttcttytgtgaagtacccgttcacatttttgtattttgtttaaattagttagccaatatttttcttactgatttttaagttatttttacattctgaatatgtcctttttaatgtgtattacaaatattttgctagtttttgacttgctcctaatgttgaattttgatgaacaaaatttcctaattttgagaaagtcttatttattcatattttctttcaaaattagtgctttttgtgtcatgtttaagaaatttttgcccatcccaaaatcataagatatttttcatgattttgaaaccatgaagagatttttcatgattttgaaatcatgaagatatttttccatttttttctaatagttttattaataaacattctatctattcctggtagaatagatatccacttgagacagcactatrtaggaaagaccatttttcctccactgaactagggtggtgcatttttgtaagttaggtaactgtatgtgtgtgtgtctgtttctgggctgtctattctagtctatttgttgatgcttgtgtcaaacagtacactatcttaattattgtacatttatagttgtaactrtagtccagctttgttcttcttmaagtcaagatttccatataaatattagaaacagyttctcaatttctacaaaatcctgatgaggtttctactgggaccacattgagtctatcaatcaacttatgcagaactggcaacttactactgaatctctaatcaatgttcatcatgtatcgcttcatktaactagratttctttaacttaattgctatgttttgacatttttagtttaaaaaccttgtatatcttgttttggtggttttagtgattttaataatatattttaaatattttttcttttctattgttgtacacagaaatacagttaagttttgtgtgtagtcttacgatgtttagtaamctcaataagtttatttcttaaatctagtaatttgtagattcctctggattttgtatatgcatagtcatgtaagctgaaaatatggcaatacttgcttcttcccaattgctttaccttttttcttaccttattgcactggttagcaaccccaatacagagaccaccagakcaggtatagactcctgaaagacaatataatgaagtgctccagtcaggcctatctaaactggattcacagctctgtcacttaattgctacatgatctagagccagttactttktgtttcagccatgtatttgcagctgagagaaaataatcattcttatttcatgaaaattgtggggatgatgaaataagttaacacctttaaagtgtgtagtaaagtatcaggatactatattttaggtcttaatacacacagttatgccgctagatacatgctttttaatgagataatgtgatattatacataacacatatcgatttttaaaaattaaatcaaccttgctttgatggaataaactccatttagtcacattttatcttgtgtatgtattattggagtggacttgttaatagtttgtttagaacgtttgcacctatgttcatgagagatactagctttttttcccctccttaatgcacttgctatggtttggggtcaatgttatgtaagcctcattaaaatgagctgtgatgtgctctcatgctccttattatctaaaataatttgtgtaaaattatactttaatgttagataaattcaccagtgaagccatcttggaatggtgttttctgttgggaaatgattttaatttcagatttaatttcctcatgatctaaacctattcatgttttctgtcttttgttcggtttcagtgagttatatttttcaatgaatgtgtcaatttcctctgaatatatatgtattggcataaaattgttacaatatctttgtatttcttttcaatataagtaggatctatagcaatgtctatgtatctgttatgattatttgcattttatctttattttattgtatttttttttgagatggagtctcactctgtcacccaggctggagtggctggagtacagtggcacgatcttggctcactgcaatctctgcctcccaggttcaagagattctcctgcctcagcctcccaggtagctgggattacagatgcccaccaccattcctggctaatttttttaattttttgtggagacgaggtttcgccatgctggctaggctggtctcaaacccctgacctgaggtgatctacctgcctcagcctcccaaagtgctgggattacaggcatgagccactgtgcttggcccatctctttttttcttaatcaatcttgcaaaggatttgtccattttattaaatttttccaaaaacttctttttggtgtttactaacctctatgattacatttatttatatctgttcctgtctttatcatttcttgtatcgatcttctgtgggtttaattggccattctttttctagcttcttttaattgacatttagagaactgattttcttccttccttctttgctaatataatcatttaaagttataatttttatttaagaactatttcagctgcataccacaggtttggatatgtatcttttcccaccaattcaaaataggtttttcatatccaattcaaaatattttataattttcattgtgacttcttcgactcatggtttatttataagtgtgtggtttaattcctaaatatttgagtattttaaaaagctatactcctgtaagtgatttatagtttaattccactgtatccagaaatatacttttatatgagttcaatcttttgaaatttgttaagattttattttatgatccaggttatgatttagaatggtaaatgtattatgtgcactagaaataatgtggtttttacagttgattagtgtatcattaggtcaggatatgaatcttctttgtattttctgtattctcactaatattttgcccttttagaaggaaataacaaagatcagaatagaaataaatgacatagagagtagaaaagcaaatagatcaatgaaactcaaaagttaatttttgtgaaatgatacaatttccaaactttagctaaaataactaagaaaaatacagagaagactcaaaatcagaaatgagaggagacacgacaactgataacatacaagtacaaaggatcataagagctacattcctttgtgttacattgttttctctttacattctgattgtctctcgcttgctcgctgtcttcttttaaagttttgtttcagaagaactaaaaaaatctaggtttaaaatgtacagatatcctttgtaacttagcattaggcaaaattgtcttagagaactcaattacttttcaagtaaaaaatgataaattgaatttcatcaaaattaaagattaactcagtttgttaaacattaggaaaacaggcaaaccatgactaggagaaaaatatttgcaaatattggcctgcatctgtcaaaggatacataggatacagaaacaactgctataagccagcaataaaaagacagaactgggaagggatggccagggaccaaaggagaagaaatgaaacacaggatagaccaccttcagtgtccttggtcaggaattcccattccttaatgttgtgggctaaatagtgtcgcaaaaaaaaaaaaaaaaaaaaaaaaatctatgcaagtcctaaccaccaggacttatgaatgcacccttatgtggaattagggtctttacagttataataaagacaaggcgaggccacactggattagagcaggccctaatccactgactggtgtccttctaagaagagggaaatttggacacgcagtcacacaaggagaatgctgtgtgatgaagaaggcagagagtggagtgacacatctttaagacaaagactgccaaagattgtggacaatactggtatcagaaacttctgccaacttcttctgaaacgtctgcctacaaacttgttttctactaaaatcgtccattctatgagaaaacacagaatatgatgaaccattcagccaggaaactgctgctaattcctcagggctgtttacctatgatggcctatatcagaagctaggagtgaggcatagaataatattcctcagagcctccagtaggaaccaaccctagtgacaccttgctctcagacttctagcctccagcactgtgtaagaataaatttatgttgttttaagccacccagtttgtggtagtttattatggaagccctagaaaacaaatacacttggcagtggagactcctgttgtgtatactacagtagactgaattgttccctggaaaacatccttctgagcttcagtcttatgattgggaagacagaaagagagagagagagagagagagaatgaatgaatgaatgaattgagatattttcatgtgctttccaggacctccataaaaagtcactctgcggtctgggctcacatccccactgggggattcatgaggagggagtgggctactgtagtgtgtgtgattcaaaggctgggtcctgctacatttatgagaataatgatggcttcgacgttgacctcacaggaaggtgtctccacagtactgaaggccaatctgggcaaggagctgcaggccaccctcaggcagacaccaggcttttagctaagggtgagggggaacttcggagcccaatgagcccatgtaacccacagcaggactttgtcactgcaaccaaagtgagtagcggggagctggctgggagaggaccaggagtgagctaggtgtgtgtacaggttgggtgccatgtgatttaaatctttacaggagaatcagagtggaacaagaggtgaagaaaaacttgtagaaggggtttctgagtaccttttatgtgccatattttgtacttagaaactttgcaccatgacctcataaaacatcattttacaaaagaggaaaagagaatctaagaggttgggacactcgcagcgagctcacagttcacgtgaggtagctttagaaagttgaaaattcacaactgtctcactcaaaactcatgtcatcaagcatattctccatgtgttaatccatactctaggtcataaattggttcaagcaattcctcttgttcttctctcccagtttctggccagtgttacataacctagctcttcctttcagacttgcctccccttatcatcccacctcaagaggcatcacttagagatgccaaaagaagaaactgctgaggacaggcaaccactttcacatggaaggacagaatgatacataaaacaaagatgatgaggcagtaccatacccttccttacacacacacaagcacacatacaagaaacacccaagagacacacaaaataaacatgtatacagcaaacatacaaacactcatagatgcatagaagccagactctaatcaaaggcctgactgtgatccctctcttctccagctctgatcttgcaggaatccatgatcatggagggaaataggacctttgccagcaacaggcagtcatttggccgcccactgtgaactctgtgtccatgagtccatcaccaccctcatggacctgaagaacacaggcctagtatgtctcatgaggaaagtaacacacctacctgggcctaagggaggccccagtcccaggaaattgcgctacctgaatgagacccctgtaactgtacatttgctacccagaggagcctgatggacaagacagaggaaagtgcgtggagatgaacgggataggaaatggaataacataaactttgtgcagtcctatctcactatgtgagttccacatgcatcaccaggaaagtcaggaagattaatgcttgttccagaaacgggattgctccctcacagcacccttctgggcaccaatatctgaatagtaatggttagtttgggcctaccagtttgccaaattttgtatgaaaactactgttgttagctgaaaggtaacctccaatgatatattcatattctaatctctgggatccgtgaatattactttacagggcaaaatagtgcatactatcttatatgtgatatgattaaattaaggatcttgcaaggaggaattaccctggattatttggttgggctcttttttagccatttcagattgctgtaacaaagtattgtagactgggtgacttataaataacaaatttatttctcacagtcctggaagatggaagtccaagatcagcatgctaccatggccgggttccgatgaggttgtggacctcttccaggttctagacagctgactgctccttgtgctctcacatggtagaaagagactggtagagctctctagagtcacagactccataatggcacaaactcatttagcagagctccaccctcatgacctaatcacctccaaaggccacaacttctaataccatcatattgacagttaggatttcaagataggaatttcgagaggaaacaaacattcagtccattgcaggccctaaataaaatcacatgtatcaagatgggcagggggagtttggagacagatgtccagaagaagaagaggaaggaatgaggaagcagagattggagcaatgcagccacaagcaaagaaacatctgcaaacactgaaggaaggaagaagaaagctgaggctgaaagaggcaagaaagagatcctcccctacagtgtctaaagggagtgtagccctgccaacactttgatttcagacttctggactccagaaattggagcaaatgaatttttgttgttttaatccacctagcttgtgttaatttactacagtcatcctaggaaactaaaacaagtatgcacaggagtttttgctcaggactcatgaaaaactacaggctcctgaaggaggcatgagcctgtcctttggacaatctctatgcagtggccaccacaaatagtagcacccctctcctataaagtgtgtctgcgggttatgaggcaaactccagttgctcctctttcaggatccatgggatcaccttttcctggagaatgaagaatgtcttgaaatcatgagcaccagaattctctcattcctggaggcccttgaaaggctgatccttctctgtgtcctttagtatctttgtcccactcctgtctgctctaagatgtggtcattttgatgctggccccttaaactctgcagctgtggatgtctatgcccaattctgggtctttcataacagcatctttatcaattacatgcactaagggtctgtttcccacccatgtctgcaatcagttgatttcaacctccctcctaccaagagtggcttctcttcctacatttgttaacccaggatctcagtgggtctctctgttcctatccatgatgtggtctgtgtcagaggtctcagctggagagtgccaacgggaagaatgacaggaagtactcatgaatgatgagataacttgtggagtggggctggaaatggatacacacacccgcac

SEQ ID NO: 12356 - DNA, 25751 bp, Homo sapiens
agacagagagaaagagagagacagagacagagagaaagagagagacagagacagagagaaagagagagacagagacagagagaaagagagagacagagacaaagagaaagagagagacagagaaagagaaacagaggggagggagtaagtccaggtaaaaaacaaacaaaaaaattgagaatagaacaagagagaaacagagacatggagacacagagaaagacacagtgagacacaggagacagagacagagagagatgctgagagacagacagggagagggagagagagaggagacaccaagacacaaagagggcggagagacagacacagaaagagggagacagcggggctggatggacgtgtggccgggccagtggggaggagagacgagtccgcagacagcgttcagaggccgcgctgcctgggtgctgagccgtcccggggttcacggtcgcagtttgtccttacaaaacgcccagccgccccgacctgtggtgcttagggaggacctacctggctgtgccggtctgagaaggggccagtgaggcccggtgcgggtacgggcgggtgcagatgcagccaggaggacgggcgggagcgggggcctgtcccacacgggggcctcggcagcaccggcatggctggaggccagtacggccaggtgtggcgggagggagcgccgtctggcttgggtcgtccatcctgacaggacgctgcaagggcaggagccccgcgccccgtgtcctgcgcccccgctcgaggacaagccccagccgccggtctccgctgggttccgacaggccttgctgggaggccttgctgggagctgggggtcgaggctcacagactgcgctgaccccagcaggcacagctgggtccagggactcgggaactcgcagcctgacgcgggccggacccccggggtgggtgctgagggcctcggatgccctccctggctggacgttgtggctgtgctgatactgagcggtaaccctaggaaggagagtcccctgggctcagctacccgggacaaggtcaacagggacaccggccccagttccaggagaaaaacaagcacggccagcggcgagtgtgggcgacagcagctcagggagaagcagattatcaacagcgaattcactcagggtcagccaactgtacgcttaaaaaaagattcctgcggtaaactgtatgtctattttaccacaataaaaaacttattgtttttaattaccaatgacttctaaaaaatgtttttaaaacccagatcacaaatcctgaacatagggcctgaaaggcgaattcagccaccacggaggactcccgcacggtggagccgggacgcagggactccatgctgcgcggagggcaggggcacgtgacgcagggcgtgggggaggcggggcgtggaggaggcggggcgcggggggcggggcgtgggggaggcggggcgtgggggcggggcgtggggggcggggcgtgggggagggcaggggcacgtgacgcagggcgtgggggaggcggggcgcgggggaggcggggcgcgggggaggaggggcgtgggggggcgggccgtgggggaggaggggcgtgggggggcgggccgtgggggaggaggggcgtggggggcggggcgtcggggagggcaggggcacgtgacgcagggcgcgggggaggcggggcgcgggggaggcggggcgcgggggaggcggggcgcgggggaggcggggcgcgggggaggcggggcgcgggggaggcggggcgcgggggaggaggaggaagggttctgagtggacgcggggactccatgccacgcggagggcagccgctcatgaggcggggtgtgggggaggaggaggaagggttctggagtggcttttctactccagaagtctccccgatcctgaaagaaaatctagacaggtggaaaaaagagaaacatgtccagatagtgtcttccacattaatggtctcccaagctctgaggaagcccaatgagttgaacagtttctcataagcttgcgggtccctgtcagtgcttctgagatgctaaaaacgccaggctgtgggctgcgtcaccatgtgtctcctctttaatttcttcaggagctccaggtgataagctgccacctccatccacaatgtggacatcagaggatgcagcatgctgtggtttgaatgtgtccctatagtgcacgtgttggaaacttaatcccaaggcaacagtgttgagaggtgggacctttaagacgcattcattgtcagagcccacgtgaatgaattgataccactattgtaggagtgggttcgttattttggaataaaaggatgagtttggcccccttcctctctcccctttctctctctctctctctctctctctctctcacgcgcatccaccttccaccatgggatgacgcagcaagaaggccctcgccagatgggggcccctggacctttgatgtcccagcctccagaactgtaagaaataaatttctgttctttataaattacccagtctcagatatcctgttacagcaccacaaagtggactagaccacactctactctgtgaatctaagacgcaccattattgatgaacctgaaagaaagagcatatacccaaattagctgtgggtcagctcagcctggaggcaagagggggaagctcagataatctaaaccacaggccagccaggaaccagctttgcaatacatttacactattcacatgggctcccaaaactcacacaaaaaaatgtatttaaagggattgcaaagtggcagtgcccccagggggcaacataaagcacaacccctttcaggaagaactcggccttgtccaggctgacattagaacattggctgtagggaacaggccaattcagagatgttgaaatctaaaacataggtcccagagttgattgaacaggtatttaaatagggactgcggcaagatctaagtattcaatgaccaggttctccataggctgctcatttcaggttccacacaaagttgtggggtcagttgatttaagctggggacccccacagaggacaccccaacatctgaaggacacgacaaagaccccaaaggaaggaagattctcctcaggtatacagaaggaaagtaaaccagtcaatggaaaaagtgtcccaatgttggttggtttgtttttcagaacagaagagggtgacagaagaacgattattcatatgagagatgaggaagatgagcagaacgaggtgaatcttaatgtttggacaatttattattgtagaatttttggtccaaaggtggtatctttgagaaggcagatgagaaaattaaatcaccacatacaacacggtcagtccacgtacaacacagtcaatcacagctgtggcctcgatgttgatgccttcctgtattagtctgttctcatgtcactgtgaagaaatacttgagactaggtaatttataaagaaaagcggtttaatgaactcacagttccacatggctggggaggcctcaggaaacataatcatggcaagcaggcacctcttcacagggtggcaggagagagaaaatgtgtgtcaatcacagggggaagycccttataaaatcattagctcttgtgagaatgcactcactatcacaagaaccacctccatgattcaatcacctccacctggtcctgcccttgacctgtggggattattacaattcaaggtgagatttggttggggacacagagccaaaccatcccccaaaactcacgttgaaacctaaccccctgtgcaatagtactaggaggtggggcctctgggaggcactctgccttcatggatggatgactgccctcccaaaagaggctccagggagcacccacattcctcccttccaccatccaaggacacgtctatgaatcatgggccgtcaccagacactgagtctactggagccttgatcttggacttcccatcctccagaactgtgagcactacgtttctgtttatcgtaaattacccactctaaggtgttttgttacagcagccccaacagactaaaatggtccatgagggaagaggttgtagctcagatacccatgtcaggcatataggatgtgcttaattaacacttattgatcgaatgtgtatgtccctgtctgcctttccatttttaggcagctattgatggtttttaaactatccagcagaagtatttttaatgtaaatttccatgtgggaatacattttcacacaaaaaaaggcaccttttcttaagtgaaggccacgtagattgccaggctggtgcaattcacccaagagctatcctatacaatcaacttctggctttcaaattattttaactcactcactaaagataaactttattttcttttcccagctttttaaagcaaacttcacaacttcagtgtatttgcgggcatgccctcttaatcaagggtgtcagcttcttagttttcttctgttcccactttaacaaaattgtatttagaatcctttcattgagttttgccacctttgagtgtcattcaatcgaacaatatctatatgctgacaatgctgtcatttcatctgttaccacctgaatctccactgtgagtcccagcttctcggatgcccactcctgtctccacctggacatcccacagacacctcaaatttgccaaacctcgcttccctctgccctcctggagcttggccgtctcagcacacgcactgccatcctcccaatcgctcagcccaaaccttggagccgtgctgcccgacacaattcatcatgaatcccatcagctttcccttcctgaagcatccagactgcaaacgtgcttcctgctgcatggctgcaccctcaccccctcctggactagccggcagcctcccttttgacttctctggaatgttctgttctccacacagcagcccagtgatcccttcagagcacaaatctttccatgtcaattcctgttccctccaatatcttcccaacacagtgaaaatgaaacaccaggttcttacctcaggcttcaagggctgatatggtttggctgtgtccccaccgaaatcttatcttgaattgtaatccccatagtccccacgtgtcctgggagggacccggtgggaggtaattgaatcatgggggtggtttccaccatgctgttcttgggatagtgagtgagtctcaagagatttgatggttttataaggatctggcatttcccctgcttcagtcattctctctgctgccaccctgtgaagaggtgccttctgccataattataagtttcctgaggcctccccagccatgtggaactgggagtcaactaaacctcttttcttaaattacccagtcttggctatttcttcataacagtgtaagaagggactaatacacagggcctacatctgaaagcagcaaacgacaaccctggggccaaatctggccccttaatagctcttataaataaagctttattggcacacagccaagtgttcattcatgattgtctatgctgcctctgctacaatggtgctgagctgtagtgacagacactatttggcccttccccgctttctccctcctccctccctcccttccttttctccccttccttctttccatcctcctgctttccctccctcactccctcctgtctctttccctcgttcttttctgtgtattccacacacacctagaacgtaagctgcatgtgactttgtctgtcccgcccagtgctgtgtccccagggcctatctcacctccattgaccacacacgggcatgggtgccaccttccaccttgcacctgctgcctttaccttctgttctctgtctccctaaatatctcccagggtcctctgagccttcaccgttcatttctctgcctggcctcaaacagaaaacgtcaggagggaagcacacagctgcacaggtcgtgccccgaggctcctgctgccggcacctcccccagcctggactttggctgtgtttgtagccctgtcccagcrctccgggtgggaatggcaggctgcgtcccactgctccagggcctggtcctggtcctcgccctccatcgtgtggagccctcargtaggcatctggcttayctrtctgttgtgcctgtgctgtgtctttcttgactcggtccatggtggatttgtagatgaggctttttccaggagccagaggagccctgagtgcccagactagtcttaattcccctgaaaaagctgtttggatctttatcatttggtgacaagtatttgggacatgatagtgtcacttggggtcctcccaagagatgcccaaatggraagaagcctgtgtgcaggggattcagccgggwaaggccggggagaggggaggrggaaagggggaggagtgggggkaggcctgggttgggcattggacgaggggagggggtggggcaggctgagcccagactgcaatgtgggcagagagagccttggccaggccagccaggaatgcccagtcttgagtcaggagacatagccagggagcagccaccctgcctgcctgccacccttctaccaccagccacttcactgaaggaacgacatggactccattctgactctgcctgcacaggcgtccaggaaagctgcaagtcaaaacacccagcatccccgctggccccatggtctcccgctggccccatggtctcccaccctgagagggtgatccccccgccctgycctgcccagcacttaccgtagccggacttagctgagcccccyctgctgtaaccctcagcaccgagagaaarggagggaggatgggaagggcctgggctttgaccctcccggagagggagagaacatgctttgggaccctcaggtgggaagaggctccagagaccactgccgcgggtcaactcrtttgccttctcctcctggaaatcgcagagcctgctgcaatgtataagtttcttctttatgtgttttatcaagatgttaaatgctgcgcacagaggcrgcacaggagctgatggctcttggtccccagttctcagtacggggacctttgaccccagctcagccttccttcgcactcagacccaaaacccagttggagccctccctcctccactttcctgactgaggcccgtggcctctctgcagaaccttagtgtatccgcactgatcctggggctgatccattcgcccagaggatgaagtgcttgcctacctcgggggagggagtagcggggtggccctgaggccctcgcaggctgagagcctgtggagacrgacggggctggggctggcggccrgccggggaggaagccaggcagctctggaaagcagggccctcggtgctcccagtcacctgccttcttgtctcgtctgtagtatttctcccggcctccaaagcaaacgacgttctggtgaggtggaagcgtgcgggctcctatcttctggaagaactcttcgagggaaacttggaaaaagaatgttatgaagaaatctgtgtctatgaagaagcaagaraagtgtttgaaaatgaagtagtcactgtatgtacccscaccacaaaccacaggcctcctcattatttagacttctgctggcccagggagcatcatttctcagagattaagcttaattaattagcctatttacttaccgatgaggttgacacaatcccagttttacagatgaggaaacaatttagagaatcgacttaatccacctttccctacagcagtgagtggggctggaagtcagctcagagcccactggactcatttcttcaggtcaggcaaggcccacacactgatcagacacccagcatacattttctttctaggcttcaagtctgaataattctcctaattttagatactcctaccccaaactaagygtccccactccctacagaggtatatatctttaaaattcaactcggtttataaaaagygaaaaggtgatgtgacttctatatcatgtgcttttgtggagggtggcgtggagattggccctagaagggaagggccacgttaggggctgtgggtggtgggtttgtgccatgtcatagactctggccttcctcaaataggtggtggtaagcacatgttgagtaatatatcttacagatacatttagttactatacatttaacataaacaaataggctgtaaaacaggaaaattgtgcattgtttcaaccactattgtcctattaagtgaataaaatcaacattttcttaccttcaagttcatctayaggaaagaatatagaaaaacaaatatcccatttgtaayatttttatgttttaactctaaaggatgaattctggagacgatayaagggtaagtggtttccttcgtctcctcagaagtattaattcctygggatgargtgcgtgggtgggcttaggacgcttcacgaccccagctcagcggatgccaagcctctggctccaggacccacggtgtctctccagggaagggcagctccgactctccccaaggaccaggtcaggaagcccccgggctctgccaccagggccacaggcagtgcctggtttgtcttgcccagtgtctgggtagtttcttggcactctgggacatgggccacaggccaggagggcccccccagagcagctcctccagccgcctggctcctgggctcctgggaagcctcatgctgcagcagggtcagaactcgtctcaaattttggaaagtcatggccccgatggagactttggttaggagactcctcccaagggaggagctctaggtgggcaactgcagaagagcatgggacagragtaacacagatggagacccacggggctgggggaggccagggtaaggacccacctgggaatgagtaagcaaagagctgcagccaccaccagacaagcacggggacaactgggcacagaaggaagcgggagaggcagggaaggccggagaagggctgatggggcgggacagaggggaccgcgtgcggacgaagaaagggcacccagcagagtgggaggcactggcagccaggccttacatccggagcggggagcgtcctgggggccaggcgatggcatggggagcagcatgagcaggctcagtccccattcctgccaccccctgcccccccgtcctcctcctgctcaggtccccgtccctgccacctcctcacatcctcctcctgctcaggtccccgtccctgccacgtccccccatcctcctcctgctcaggtccccgtccctgccacgtccccacatcctcctcctgctcaggtccccgtccctgccacctccccccatcctcctcctgctcaggtccccgtccctgccacctccccacatcctcctcctgctcaggtcctcgtccctgccacctcctcacatcctcctcctgctcaggtccccgtccctgccacgtccccacatcctcctcctgctcaggtcctcgtccctgccacctccccccatcctcctcctgctcaggtccccgtccctgccacgtccccacatcctcctcctgctcaggtccccgtccctgccacgtccccacatcctcctcctgctcaggtccccgtccctgccacgtccccccatcctcctcctgctcaggtccccgtccctgccacctccccacatcctcctcctgctcaggtccccgtccctgccacctccccacatcctcctcctgctcaggtccccgtccctgccacctccccacatcctcctcctgctcaggtccccgtccctgccacgtcccctcatcctcctcctgctcaggtccccgtccctgccacctccccacatcctcctcctgctcaggtccccgtccctgccacctccccacatcctcctcctgctcaggtccccgtccctgccacctccccacatcctcctcctgctcaggtccccgtccctgccacctccccacatcctcctcctgctcaggtccccgtccctgccacgtcccctcatcctcctcctgctcaggtccccgtccctgccacctcctcacatcctcctcctgctcaggtccccgtccctgccacctccccacatcctcctcctgctcaggtccccgtccctgccacctccccacatcctcctcctgctcaggtccccgtccctgccacgtccccccatcctcctcctgctcaggtccccgtccctgctccactctgtcctcctcctgctctggtccctgttcctgtcaccccaccctcctcctgctcaggtgctcaggtccccgtccctgctgccaccccccactccatcctcctcctgctcaggtccccattcctgtcaccacccccaccctcctcctgctcaggtccccgttcctgtcaccaccaccccaacccccatcctcctcctgcaggcggctccccgtgcatctcccagccctgcctccacaacggctcttgccaggacagcatctggggctacacctgcacctgctcccccggctatgagggcagcaactgcgagctgggtgaggccccggccgtccccttcccccaagggcctccctgggcaggtgggcctcacatcctcggccagagtcccaatgggcccctcctgaggtgtagccaygaaggtgcctgtgtgaaccgcgatttggctcaccccaggggattcctctcatcccaaccagattctcctccagaaaccacgccgggggctggctgcattctgagctgccccttccagacaggcccccatacttttcatagcaggggcccctctcctccccccmccacctcaaccattcacaatctgctcacaggctgggggggtcacacacagkcgtcctcastgccagactcccagtgggagactgcagacagggaagacgcaaagcacgtaarcaaatatccttaaatacccgccaaatgtcagtgtccatcatcgccaactacagcaacaagcgtgctccgctctcagcaccactggtcaacttggagcccgtttctctggggaaaaccttcctcccagccgagccctctcctccgaagtccagatttctgctccatctgcctccttgatgccccagctaatgccttcacagacaccccaaatttaccacgtaccaaagggggctttgaccttcacccaccatgtgcccctttcttaatcttctccctcttggtggaaagcccccatcccagctgctcagccaccaccgatgtcacactaaccccctcccatcccacgtcccctccttgaagaagcagcaatttaaagggaatagccaatgcaagccggcagacaaaacaggcgcgtggattagtccatgtggaaaaaggacaaatagaagtgtcatcactcatggagtctttttttttttttaatttttattttatttttgagatggagtctcgctctgtcgccaggctggagtgcagtgacgcgatgtcagctcactgcaaccttttgcctcctgggttcaagtgattctcctgcctcagcctcccgagtaactgggactacaggcacgcgccaccacgcctggctaatttttgtatttttagtagagatggggtttcaccatgttggccaggctggtcttgatctcctgacctcgtgatccgcccacctcggcctccyaaagtgctgggattacaggcatgagccaccgcgcccggcctcactcacggagtctttgttctacatgcacattcctgaaatacggacatgtgggaaacactgacacagaggacaacgatctgaagagaatgagaacacatggaccaacacaccagawctcttgtgtgcaaggctgtgataaaatgaacatggaccaacacacagaactgtgtgcaaggctgtgataaaatgactatttccaagctagcatttccttttttttttttyccttttcagctaaaaatgaatgtcacccagagcggactgatgggtgtcaacacttctgcctcccaggacaggaatcctacacrtgcagctgtgctcagggctacaggcttggtgaggaccacaaacagtgtgtgccccacggtgagtgctcagaccacagcggcctccagcttccaatgccagcraccccgwccacatcctccttccttctgtagtactgggtgaagcccgcggatttgtgataagcagttgccacgactcagaaggtggtccgcgtctccacgctggagcaatggccatgctagaaagtgcagtttctgtcactagtgcttgctcggacyactctgagctaaaccatgagtgctgtgaggggtggtttaactccagtctgtgtgtctgtgaattactgcacattcatcagcattaaggataagattataatggttagtaccatagacggaattatgcaacggttaacaccatagacagagtccgatattcgctgagaaggcgytgatttttattctcatgttgctgccgcaaatgcagaccagtgtgcctgcggggtgctgacctctgagaagcgtgcaccggatctacaggacctcccgtggcaggtaacagagcgctctccgcgtgcttcaatttattgttatgactttcacctcacttgtcatttcctaaatagaaatgttracaactaagtgaatcaggcatcctgactttgatgggctactgactgcactgaccaacctctattcacacttccaaccatgttctaatgccgagttcataactaatacaaaaggasagcattatttacagcccccaagacctttcctctgcagttccaaactgttaccaatgtcattttctcagaacataagcatctcaaaatctctgctctcrgctgctggcctggcattctagctttgttactttgttcactaaatttctctagtttggcrttcatttttgttctccttttcccctccttggctggtttagaagttaaccattcatttgtttttggtttgttttttttgagatggagtctcaatctgtcacccagcctggagtgcagtggtccagtcccrgctcacwgcaacctctgcctcctgggcacaagcrctttccctgcctccacctcctgagtagctgggattacaggaatgtgccaccacgcccggctgatttttatatttttagtagagacggggtttcaccatgttggacaggatggtctcgaatgcctgacctcaagtgacccacctgccttggcctcccaaagtgctgggattacaggcgtgagccaccaygcctggcctcatcattcactttctgtttacttaatggtcactcttgacacataaacatccatatttagcacaagtagtcagctatttctccctcctcaggctaattcccagcacctcattctgggtccatttgctgtctggccagtattttattcttttcttgctttctgtatatcttcacaaaatagatattacgatttttgttattatggttttataccacccacactggctttgatttacttacctcattttccactttccttgcctttcaggcctctaacacaattatctcctgcctgagtatatccttcagaacagccttgtccaatagaaatgcagtgtaaaccacataatttaaaattttctagtagccacaataatgtaagtaaaagcatgtgaaatttggatatttaacccaatatgtgtcattatttccccatgtaatgaatataaacattattgaggttatttgcctttttcctttacactgaatctttggaatctggtgtgaatttacactgaggtgcagccctcgtgtccmcaatgctccgtacccgagtgtggctgccgtgtggatggcacagcctcaggggccccccttgtgagtaataagcccctgaggtttctgtgtgtgacacccgtcagtttcacccgactcttacaagacagctgtgcccagcccactcattctggcagttgtgtggactggcagagaacaggatggagctcaaggacttgaagccacccagctccaaggtggaraggaagaaaccgaagggaggcaaagcagacggagtgatggaaggcggggatggaagcgggaatggtctatcaccagctttgcaaacttcctctcaatcttttatcacttttcctgcccaagctttctaagacagttcttcctatcgctgtctgmcccatgagtgcgctgagggtcggtacttgggaggcccagagtgcagtggtcctccataggtagtgacagggtctggctctaccacctgcaggctgtctccagcttcccagcttacccaagggaagagagggygcggttctagtctgcaaccgtagcactcataccagcaaggctaagagccatataaccagggaggaggcattctctaaacacagctggtgtgtttaagacagaggacactgacttaggcaggctacatactattagattttttacttcagtattataaattgttctgaagttatttaactgaatatatggaattttcctaaaacaaactttgaaaaggagaataattaagtgacctagcaggayatagggttgaagattatctttagaacttccttgtttcttacatcctmgggaagaagtatcactaaaagtctggcagactgatggcgcaagtgccgtcttctctcgaacttggttttatcccctttaaagtgaggatctcacccctagaggtgcagtgaggattacagrtaacgttcttgacttatggtaggtattcaacaagtggcagctattattcataaacacatgaagagttccaggaacgacgccacggtaaagttggaaaaacactttctcacttggctcagcattttgcattagacggttgaaaactgcaacacttaacacttccagagccagtacccgtrctatgtgggsacatgctttatttcatttaatctttcaaacaacttctcgttttctccttttgtatccctggtaatattatttgctctaaaatcccctttgtctgatattgatatasacwctttactttctaattattagtgttagcatgacttatctttttccaatcttctacttttagcctatttgtatttttataaagtgcatgtttaaaaaataaataaggtacatgttttataggtagtatataattggctttcatttttatccagtgtgaaaaacctctgccttttaattggggtatttaggccattttacatttattgtaattgtcgatatgtttacggttaaagctatcatcttgctatctttyatttttcttatctgttcttttcccctttttctgccttctgttagattaactatatattgttatgattctgttttctctcctttgttggtttatcatctctggttctttgttggcggttgcttcacagtttggagaatgcatctttaccctatcacagtccactccactttcgccgacgccacatccgctcgctgtagcatgagtccttacagcaatcatgccccattcctcccctcctgacctgggtgctggttttggcataggtcttacatctacagatgttataaatgccactctatacttccattatttttgtttaaacagtatcckgtraaraagtttaaagaataaggaaaaaaaccttacatatatagtggaatgyggataaatatttaatgggatgtcataaccttttccagtgttccttgctgctttgtgtaratccaggcctccctctggtatcgttttcctcctgcctaaagggcccctttgatatctgctgtgctgtgaggcgtctggggaagaagccttcttgcgtttgtctggaggagtctttgttcatcttcatctatgaaaggcattgcgtctggcgcagagccccaggctggcagcagtcctctcctctctgcacttgggcctgccccactgccttcctgtctgccttgtgccacaagacggctcccatcaccctgctgctgttcctcacatgtccttacctgtggcacttttaagattttaaatgctttttaattttaactttctaagatttcctctatcatggattttgaatttaattatactstgtattgttttcatgtttcttgcacatagggtttgttgagattcttgtatttgtgggctaatatcgcttgtcaaatttgaaaaatatttggtcataattttcttttttttgagaccgggtctcgccctattgcctgggctggagtgtagtggtgtgatcatggctcactgcagcctcaacctcctgggttcaggtgatcctcccacctcagcgtcttgagtagctgggaccatagktgtgcacgaccacacasagctaatttttaaatttcatgtagagatggggtcttgctatgttgctcaggctggtctcaaactcctgggctcaagcaatccttccacctcagmctcccaaagtgctgggattataggcgtgagccaccatgcctggcccattattttcagattttttttctctcctccttctccctgctctgttttgggactctaattacatgtatcttaagctgtttgaaatcccatagctcagagatggtctgttcatttttcaaaaatctccgttctctccgtgttttacttttgatagtttctgttgtgatgccttcaaggtcatcaatctgttcttctgcaatgtctaatctgccattcatcctggccagtggatgtttaacctcatatattgtagctgtcatccaaaaatttaatttaggtttttaaaaatacgtatttttgtctctacttaactttttgaacatttggactacagttacaatcactgtttaattgtccttgtctactaatatctgtcagtgctgactcagttttgggatatttttcttctcattatgggtcacattttcctgtttgtatgccgtaatggatttccagacatgtgaattttatcctgttagrtgctgaatattttgtgctctatacatacacttggatattgtcctaggacacagttaggttggaaatactttcatcctttggcacattgctcttaagatttgtcagtaggaccagggcagcgctcaagtctagagctagttattctgactactgaagtgaaacccttctatgcatyctgccccgtgccccactgagtcagggatgttttaaytcagctggtggaagcaattgctattcccagcttgtgtgagtgtctagcacaggtccstctcacactcttgggtggttcttaccyggccataattagtctccaygtacacgtgatcaccactgctctgctgaaaactgctaggcatgtggccatcctccagcattctctaccaagctctctcctctgccggactctgttctgcaggactctgttctgcaaactccagccactgyggcctccctgggctctcagctttctctcttcaatttagggagtcagcrgggctccaactgagatgccccgtcctgctctgcaccatggaaattctggacagtagctgagaccgttgtttcttggggattacgattcctgaaaaccatcattccatagattttgtcaattttttgcttcaggtgggagggtaaatctgatcactgttacttcacctgggccgaaaggggaagtgccggccccatttaatccctaagcaaacaaaagcttagactgtcawcaatycgttaacaatcctgtaccatttgagtgctggggcaagaatcaaatacggctgtctgcctttggcggggggtgggggtgggggtgggggggtggtccatatccctatccagtagactttactgcccctaatcctgcaaattgtcaccagctatttattgtctgttttgatttttaaaggtaaagttaacaaattccgaaggaaaagacttctgtggtggtgttataatacgggaaaattttgtactgacaacagcaaaatgttcactgttacacaggaatattactgtaaaaacatgtaagtattttatcatgagtttttataaaaccacattggaaatacactatcctaygtaagaatgaaatgayaaatttaaaactggactgtttctaatgcaacatagaactgaatttactgtcaataaaactgagatacttatcaactcaggaagcatatgtaaaataccagcagaagcctgggcccagcgacaggcaagtgctaactcacactcggcaagggaggaaatcacagcctacataaggatgacttcatttcccactgaaattgagcagttgtggcataagagatggataattggctaaaaatcggaagaatggggctcgaatsccccagcagttgagacctcaggctgaggcagtggccttctcatcggcttatctgtgcctatttctttcttttttttttttgagacagagtctcactcaatccctcaggctggagtgcagtggcatgatccaggctcactgcaacctctgcctcctgggttcaagcgattctcatgcctcagcctcccgagtagctgggactacaggcatgcaccaccatatcccactaattttttgtatttttagtagaaatggggttttgctatgttggaaaagctggtctttactcctggccttaagtgatcgacctgcctcggcctcccgaagcgctggkattacagatgtgagccactgtgcctggcccttaaatatttttcaatcaacaaaataacgtgaaaaccacttctcaacagccaatgtttgactgkcctggagacgttccacatcactgcttcctgctttttaatcatttcaccacaccccactgcactccaaaacagaagaactaaccttgactgtttttaaaggctgtggcacttggttgcaatcgtgcaatctgtgagtggcctttctgtccgcagaaaggcmcagtgtccacaccacggggcggtgagcctgcgggtcctccagggcyggtctctccctcctcacgtggctccctgagmagctygtttgagcattatgtccccttgaaaatcagactgtaaagaactgacgattgttcatgatttcagattttaacagaacgagccaagacccgctgatgatcaagataacgcacgtccatgtgcacatgcggtatgacgcggacgcgggggagaatgacctgtcactgctggagctggagtggcccatccagtgcccaggtgcggggctccccgtgtgcacccctgagaaagacttcgctgagcacctcctcatcccacrcaccaggggcctcctcagyggctgggcacgcaatggcactgacctgggcaactcgctgaccacrcggcctgtcacacttgtggagggggaggagtgcgggcaggtcctgaatgtgactgtcaccaccaggacctactgtgagagaagcagcgtggcggccatgcactggatggatggaagtgtggtcaccagagaacacagaggctcctggtttctcacgggggtcctgggctcgcagccagtaggagggcaggctcacatggtccttgtcaccaaggtctccaggtactcactctggtttaaacagatcatgaactaactgaaactcagctagccagaatgaacaacacaacyggaagcgggattccaagctggcactgccactgtggagggcgctgaaacttcatcacacactgagaggccgtcacagccccagaccacccgcttggcccacgcagcagcagagccgccgtttgctgggttgtttaccgagcactgtgacctttctttccctggaactctttatctcaatagagaccttaaaagaaaacatgagatacgttaaataataaaataagataatctgtcagtcataaagcagcctggtttccagaaattctttccttctccaagtccagtgttccctgtgctcagggaatagccaccccagcctgcacactggtgagtgtgttctggtgcagaagcgacaacaatctccggttacagcagaaagtgacctcctctgttggtttaccaattgccactgtgactgaggaccatggctcagtgcagaagcagccactagaagcaggttggcaatggaggagaatgaccctgtgggtatcccagagaggcagcattagaggaaagggccagagagcacaagagaggctgaggaggcacgccggcgtctcacggggttgtgcacccgcccttctctgggagggttcccacggaaggttccggggcccgaartcagggctgagcactgagacccagctctctgctcgtcccaccaggtggctcttggacaactgttccacctcttcatgcctcagggtcgcccagggtagaatcccagcacctcaccaatgggctgatgggcagctagggcaacgcccagcactgttgtggctggagtgtgtgtcccttcaaaactccaaaattggaacttaccccaagatgatgatatggggaggtggggcccttgggaggtgactaggccatgagggctctgccagccccttccatctcttctcccatacgaggacactgcagtgaggtgctaccctggagacagagagccctcagcagacaccaaatctgccggcacccagatcttgaacttcccagcccccagatctgtgagaaatgagtttctgttatcacccagtccatggtattttgtagaacagaccaggacagcacgtgctgaatcacagtaaacacctgctgtcatgaaggctgcagctgcaatgcaagtaccaaagacagagctgcagtccagcccccagtgaaacgtccttggagactggagctcctagcagggtctgaatttgcactgaaatggacagaaatggcataaatgttcacattttaactctgacttagttaaggaaggggcacagctgcttctccaccagtgtccttgagtgacacagagcagagcatcgttgaagagcagagaggacttttaaaaagaggaattaaaaatgtaggtggacaaatattctcttgagttgagaacaatttacacataacttgggtttttaagccttactgttcttcagcacactctctttcatttacgctttaaccccagaattaaacttttctccaacctgtagatgaaatggcccatttctctgaaaggtccttggcaaaaagcaacactgtaatttaaggcaaattaatggggagggcagtttaaaattcactagggtgaattttaaagtcttagtgaagtttggttgtattattctcaaactacaataaggtaagtaagtcactgctttaaatgcctactaatgattttaaaatcagctaatgaacatggcaggctttctgtacataatgctgcagaaatgtctgcaatcttgcttctggtacttctattacaaatttggatttactagagtggaagccctgcttgaaaactattccagtccaggcgcagtagctcacgcccgtaatcccagcactttgggaggctgaggcgggcggatcacgaggtcaggagttcgagaccagcctgaccaacatggtgaaactccatctctactaaaaatacaaaaaaaaaaaaaatctttgccaagtgtggtggctcacgcctgtaatcccagctactgaggaggctgaggcaggagaatcacttgaacccgggaggcagaggttgcagtaaaccgagatcatgccactgcactccagcctgggcaacagggcgagactccatctcaaaaaaaaaaaaaaacctacttcaaacacagctgggcagaggcaaagcatatgaagaccctccctccgtaatggtgaaatctgtgaaatcaggaacaatcagagaaagctacaggcccagactgtcagcagagacatgaggggccttcaaaatgaagtaactactctactggcatttaatgacatgcttagaaactacaccataaacaaatctaacaaaacagtaaaactcaagaaaagggaagctagctatgatgactgtttttcttgttttttgagacagggtctctgtctgccacccaaggctggagtgcagggcacgatcctagctcatagtgggctcaacttcctgggctcaattgaccctcccacctcagcctcctgactacaggtgtggaccaccatgcccagctaatttttgtattttctgcagagatggattttgccatattgcccaggctggtctcgaactccagggctcaagcaatctactggcctcagcctcccaaagtgctggtatcataaatgtgagccaccacatccagcctgtgatgatgttttaaaagggccaaactagttcacacttgggcagagattattaagtccaatatttgaatccatgcaaacacactgatacatgcccatgtgtacgcccgtggacttgaatgctgccatgctggacacaggccttgactttgcgtctccacccaaattccatcttgaattgtaatccccacgtgtggagaagtgattggatcacgggggcggctcccccacgctgttctcgtgacagtgagggcgtctaacgagagctgatggttttaaaagtggcagttttgctcatgctcacttccccttccgccatgattgtaagtttcctgaggtcccccgagtcatgtggaactgtgagtccattaaacctctttcctttacatattacccagtctcgggcagttctttatagcagcgtgagaacgaactgacagaggcctgaacaccaagaggtaaacgtaaggacacctacactgaggttgtttctttcatcgctaagaataaccatccaattaccttaaagtatcaatccttgactttaggtgtcactatggacggttcaatacgttacccagaaatgttgacaaacctgagctttccaccgctattacatccagaatgaaattcaggtatgctggcagaaattccaatattcaaattactgcaagaaaatcatttaartcaaaagttgaaggatgttcaaggcccatgcagagcagcagggaagatcagatttccgtacccaacactgcaagagaacggggccccactggacacatgggtagctagaaaacagatgcgcgcccaaagcctccgccggcatgagtttgctccgtgtctgccccacaggacataggaggcacttgtcacgactgccagcgctgaggaccttgctgctgctggggagcagctacgtaggtcaagaggatccttggcatgaactccacaggcacaggcgcttgccttcgtgcattcatctctcgcgtgtacgtgtggcagtccacggctggaatccgggtgtgacttaggagagcagggcataaaagagatctggcttccctggctctactgggatctgcgctcccagaatccagctccctacgtgtggagagaaacaggggagcccacccacagccctgctgagctccaggtgagagcccgggccaatacacgggaatgagtcaccttcaaagaggcccattcgggccccagaagagcccacaagcttccccgcccagcccggaagaaactgcagacctgcagatgtaggagcgagctaaggagtgctgctgaagccctggggcagctcctgcatccaggggaacctgaggaaggagccacacaaagtgagtcctgygccgcgcggcccggagagagagaaagagggattcacactttgtagaatagcctctccttgaacaagcagctttcaaatgcagtaactttgcaaagatgagctcttatggtttgtgttcttctttagtaaattttttataaacggggaaatgtgcatactctgaaaaatggcagtgctggggactaaactgtgtcccccaaatttcttacattgaagtcctagccccagtgtgactgtatctggaggtaaggtcttcagggggtaactaaggctaaatgtggtcataagggtggggtcctaacccgacagaactgtggccttgtaagaggaagagagccgggtgtggtggcacatgcctgtcactcagcactttgggaggccgaggcgggggaattgccccgacagaactgtggccttgtaagaggaagagagccgggtgtggtggcacatgcctgtcaccccagcactttgggaggccgaggcgggggaattgccccgacagaactgtggccttgtaagaggaagagagccgggtgtggtggcacatgcctgtcacccagcactttgggaggctgaggcgggggaattgccccgacagaactgtggccttgtaagaggaagagagccgggtgtggtggcacatgcctgtcacccagcactttgggaggccgaggcgggggaattgccccgacagaactgtggccttgtaagaggaagagagccgggtgtggtggcacatgcctgtcaccccagcactttgggaggccgaggcgggggaattgccccgacagaactgtggccttgtaagaggaagagagccgggtgtggtggcacatgcctgtcacccagcactttgggaggccgaggcgggggaattgccccgacagaactgtggccttgtaagaggaagagagccgggtgtggtggcacatgcctgtcacccagcactttgggaggccgaggcgggggaattgctttagcccaggcgttccagaccagcctgtgcaatattagcaagaccctgtctctacaaaaaataaaaaaattagttgggtgtggtggcatgcacctgtgctcccagctacttgggaggctgaggagggaagatcacttgagtctcggaggtcgaggctgcagtaagcactgactgcactgccgcactccagcctgggtgacagagtgaggtcctgtctcaaaaaaggagggagagagtcatctctatctgtaccatctctagcacagcaaggaataccaccttattcttaagtgtgcaactcagaagagagccctccccagaagccgaccgtgctggcaaccccatctcagtcagacctccagcctctagaactgtgaggaaatacattcctgttgcttaagctgcctgtggtattctgtgatggcagccccaacagcccaatgtgagtggcccaacttagcgactgtcaacctcgccgtggtgccgaagggacgcgctcaggggcagccatgcctcagcgtccacgcagcccttcagtttccactctcagtgtagcactcggtaagctacacgaggtatttacacttttatttttatttatttatttttttgagacagagtttcgctcttgttgcccaggctggagtgcaatggcatgatctcggctcactgcaacctttgcctcccgggttcaagcgattctcctgcctcagcctcctgagtagctggaattacaggtatgcgccaccacgcccggctaattttgtatttttagtagagacggggtttctccatgttggtcaggctggtctccaactctcaatctcaggtgatctgcctgccttggcctctgaaagtgctgggattacaggcgtgagccwccacgcccggcatctacactttattataaaataaaatcggctttgtgtttgattttgcctaagagtggaggcttctgagtatgttaaggaaggctagagtgagccataatgtttagtagcaggtgtattaaatgtattttcaatttaagatggttttttaaaagaaatttttttttaaccaacaaagcaaaggcaaataaaataagtttattgggatgtaaccccatcataaattgaggagcatccatacaggcaagctataaaatctggaaaatttaaatcaaattaaattctgcttttaaaaaggtgccttaagttaaccaagcattttgataacacattcaaatttaatatataaaaatagatgtatcctgg

SEQ ID NO: 12357 - DNA, 71702 bp, Homo sapiens
  misc_feature (1)...(71702): n = A,T,C or G, or insertion/deletion polymorphism (see Tables 1-2)
cctgtatccatttgttatttcctcacagtgctccccagagtgctccacgcagagtagacactcggtagtgtttgttagtgaactcaggccagaaactctgcatttcgaaggaagggagggaggacatgagggagcctctgagccgtgtgctgtgatcaagcaagtacttcatgtgttcccagctcgtgccaaccccacacaaggtgtttttctgtgttcctttaattcttccaacaaccttataaggtatgaattccattatcactgtttacctttggtgataatataagtctgaaagaaatttagtaacttgcccaaagttatggctacacactcccagaaagcaggtggcccatctgactccagaactgattctcccagggtcctgtgctcttgggaaagtcatttatcctccctgaatttgcctccttatcccaaagaggaagacgtgaaaggggatgattttaaggtcccttttggatctgtggacttctagtggcctaagtgctttatccacgggttgacaaactgacacgtgggccaaatgcagccagctacttgtttttgtaaataagtttcattggaacacagccacacatattcatttatgtattgtcgataagagcagagttgagtagttgtaacagagaccatctggcccacaaaacctaaaatatttactattttgccctttatagaaaaagtttgctgactcctggaatatactaagctatagaccttaatgatgattaactacaatgatgaataggaaaaaatctggaggaccgaacatcaactgtaaactgttgacgggggtaagaatattatttacactgctttggttttttgtttgtttgtttgtttttcagatggagtcttgctctgtcgcccaggctggagtgcagtggcacaatctcggctcactgcaacctctgcctccggggttcacaccagtctcctgtctcagcctcccgagttgctgggactacaggcgcccgccaccacacctggctaattttgtatttttagtagagacggggtttcactgtgttagccaggatggtctcgatctcctgactttgtgatctacctgcctcggcctcccaaagtgctgggattacaggcatgagccaccacgcccggccccacactgtttacattttatacttggagtaatttatttaatttactttatactaatttataacttacatatggcaacatgcacagatcccacatgtatagcctggtgatggatccaccatcccaatcaaaatatagaaccatttctagcaccccagaaacctccagcaccacggatttgtttttccactttttaactttatataaatggaatcacacagtatatactctttcgtgtctggtgaaagtagttatttatttatttagagaatggggtctcattctgtcacccaggctgaagtgcagtgacacgatcatagttcaatggaacctcagactcctgggttcaagcgatcctcccacctcagcctcctgagtagccaggactataagcatgcactaccatgcctggctaatttttttattttttatttttgtagagacagggtctcactattttgcttgaactcctgggctcaagctatcctcccacctcggcctccaaaagaactatcacaggtgtgagccaccacacctggcaagtatttagttttaacagtattgtccagaggcaatcacatgttcgtttactcagtaagcattttcttgagcatctaccatgcaccagcacttctccaggcactgaggagtaagacatgagaagatgcctgcccctcatagggtttgctctctgtggtatattttttcgtggctagtcaaggcttcatgtccactactacacagaggtctggcctgagctcttggcccatctgcccgaaggcctgcaagtagacaccctaataatttaagaccttttaggaatttcaaattataaaaaaagttggaggacctaaatggttatccagaccaatagccatttttcaaaggtagaatcagagacccagagaaggtgctcaccaaaacttttggggagatgaatcacccagaaagaggttttgtagccagaagaagaacctcaggctctttccagaccctgatgtctagaatgttctccaggttgcaacactgctctctaacaagaaggcccctgacctcctgcagaacaggttaggatggtatttatgttttactctagagatgattttattttgaggccttctagatactctgtgaaccaatgagagaggctgggagagtggagtggcaggggtggaaatgaccagaatctcttctgtaaacaaagaagtgcaaccgtgaaaagtaggggaaagattgcatgcacaaatcagaaaagaaatatcgcttgtgctgctaagttccaggggagatgagttcacagaagccacatttgccaatctgtggaatgaccagcatggtgctcagaacaccttcatagaatgatgagtcaactggatttcaacttattttataccagggattgcacgtcctataaaaaacaagaacaacaaaccttgggatatgaactgcaaattcatctaatttgagcagatgaaactgatatggtctcttcaaattcagtagctcttaaaaacatgctgggactataagagcctaaagacatcagttgcctcagttctcagcatgttatcaagatgtgcctcttctttctaaatacgtgagagcccaccatattctaggaacctgtggttactaactcacctaatcttcacaccggcacagtagagtgtcattatcattttgcactgaggaaactaaggatcagaaagattatgtaacatgccaaaagtcacacagcaggtgaagcagatcttgggttcaagtttagttctgtttgactactccaaaccctgccctctattctctgctgggtatcctccacctctcccccacagaatccctctttcaacttctcatccctcaaaacaatgacagctagagaccctcctctttcatcctaaaaccctgctcaaaagttctgagccccaacctcaacccttccattaatttgctgaggtggctacaagcaacctgagactctcccatatcttatttttccatctttaaaatggagttattatatcagtccatcacgactttattctgtgtgaagcataaacagatgttatttcaatcctactccgtcttcctctatttgggggaagtttaactgaagagttttacaagatagctcacttaacattatgaactgcattctgaaagactatctgctggtctactttacacagctctttttaaacttccatatgaagggactggtgaatctgtttgaagatctatagtacagaacaattacttgataagcgcttatattgcacaaagtggcatattacaaggtaggactaggaaggagcattacaggaagttgctagatatgaatagccagattacctggaaaacatacctggacactcataggaagtttgtcctatcctctgtgtgaaattgcctgcacattcacatagttagctggggtgtggggaagaatgggtttgctgacacctgaattttgagagagaatgaggcttgggaatcagatggggcacacagcagctgcaactgccaatcaaagttttgttgttacaacagaagtgattgctgttttttaaatgggttttcccagcttaacacagaaactgatcttcattacacttgatgcttctatcctgatagcgagtgagagacagacgaagagattgttcttcagggacatttactctgaacacttcattatccttcttgaggcaagctgggtaggcagagaatgttcttccattgggcagaattatgagaagcaaagatttgcacctattacaacaaactagagggaaagaaggtgaaatgaaaagccaacattttcatgaagttatgactccctgtggcaccctgaggagtaatgggtgtctggaggctgaaggatggagaggttcctgaatttgggatttgcttgtctccgggaaagagggactgagatcagtgtaaactttcctcaggctacacgcacacaaccatcccgcttccttctggctctcagcacaagtggcccaggcacctgtagcagaccctgtatttaagaggcatcctagctccttaacagcctgacttgataaattacaccatcagcccttgcacacctaggagattagatcctgcccctaggcagatgagagctgctagactcttcctcctcctgctgaaattcctctctatccctaacctaaccttacttcctcctagatatctttcaagggtgggagaggaaggaaaatgtgcttagaaactcctttgcaatttttctgctgattctgaaaccctagtcccccaatccctccaaccccagcactgtatcaccaattctgaataccctaagtttccagagtaactcagttttactactgggaactggcttcccgtcttctcagaccagaaagtgttgaactttattattagaccaagcggttgcacaagtggcctcagtcaatatacacaacccccaaaaaaaggttatcagtggtatcctctttttgcagatgaggaaactgaggctcccagaagggaagcgttatgctcctccccagaagctttaggtctgtgtgtggtggaagcaaagaagcccctttccctgttcttctacaggtcaggtcctagcttgcaggtttgggcgcgcttccgccgccctcccctcctgcccgtcaccaggggggaagcaggtgaaactccaatagtgctgcaaggcctatggcttcctacctggcccaggccagagtgggaaaaaaaacatctttccctcagtagctctgtcgacaccttctgtactaggagtgcaagacttctgccactgctgcagtgacctcgtctacagagctcgtccccggcccagggaaccacagatgttctggaactacgaataaaccagaaatgagtgggccggggggaccctcggctgcaagtgtccacccagctgcaggtcaagctttgctttcactgcctcaccatcctagtgcctcaccatcctagtgcctcaccatcctagtgcctcaccattctgcctcaccatcctcccccaaggcggaggcgccttgacatccgggtttaaacaggagagtgaggagccccaggggtccagctccccagtggcgtggccaggctgggcgccggtgcagcccagctgctgggggagcttcactttggctactccctctacccataaagtagtctctttccaagagttctcccggactccttcaccctcgcctacgctctctggcgggcagttctgcaaacccaaaccgccagaccaggccagggaggttctggggcctggaggtagtaaccgaggtagaaataaatggagtccctccagggcatgctcaccacacctaacgctgcctcacctcccccgtggcctcggcgccccttcctaagtggtcagtttctcttccgccctgcgggctctcctggcccaccacctgcgtcggccgggacgcatccagggtctctactcttcgcttcctcctgcgtccccttcttccacgagcaccccagcttcctctggctctcacctgaaccccgaagcgtagtgtcttctctctggactaaagcggaactgagaaccggtggaaaagccccgcgcctaggctgcaaggcactggcttaacaagtccaaaggttaggtgaagtttggctgataagcagaaccagtaaaagaaggtctctagccccccagcgtgagtacaatggaccctggcaaagccccgctcccggcccaggtcttctgctctccaggtctgcccctccggctctccctctctccgggtttccccctccccaccatcatttgcatccagccgaaagctgggcccttcccactaatttgcatatcttatatggcctaatggtggcgatcatggcaagttagaagttttctgactcctttcggaggagcctccgggaccccggggagtaacaggtgtctggaggctgaagggtggaggggttcctggatttggggtttgcttgtgaaactcccctccaccctcctctctcgcacccacccaccccctcacccccttctttttccgtccttggaaaatggtgtccaagctcacgtcgctccagcaagaactcctgagcgccctgctgagctccggggtcaccaaggaggtgctggttcaggccttggaggagttgctgccatycccgaacttcggggtgaagctggagacgctgcccctgtcccctggcagcggggccgagcccgacaccaagccggtcttccatactctcaccaacggccacgccaagggccgcttgtccggcgacgagggctccgaggacggcgacgactatgacacacctcccatcctcaaggagctgcaggcgctcaacacckaggaggcggcggagcagcgggcggaggtggaccggatgctcaggtaggcgcagagcgaggtggaggggacccacccgaacccctggagccccggccccgggcctgagtgacactgcgcccgaccacactcgccaagcccgtttcccaccagagaagtcccccggggggcgctctgcttctctcccaacacccggacccttcccaatcccttagcgggacgaccctgcggcccaccgggcttcttctccccaggcccaggccagcgtccgagacccaagggcttttccccgcggggctggggctgggccggggagaactggagctgtggagccctttgccgggaggtttgcccacgcgactgaaggtgcgagtgggtgcagtgaaaccgctgcgacttcccgggagcagagcctcgcgccgctgcaagccccaggccgcgcatttttcctgcgcsctgcctcgggtctggaaagccgcatgtcggcctcggacacattgacctgcatgatgacctgcagttctttgccgaaggacaggcggcatccggagccgggatctgggaggcgagttccctggtgggcactcttgttagccgcgcccatgcaaggcccggaattatccgggatccccaacgcgggtttagatttgcaaagggcatgttccatgcagggtccgggtggacacgcgcggggccaaagaaacsaagcgcggtggtgtgggggcgaacgcgtctcagacctcagttcgcagaggatctggtctcagtctgagaaaggagggcgtttccagacctcgctgcccacccccggcctctccccgggagttcaggccggctggcagtgtatccccagggccgggatcgtttgtgggtcctccccgaccgccctagactttgacagctggttactaattatctaaggagccgagcggttccctgagacagcacgtcgctcccgggccactccgctttaggacagagcccatcgcgtggcttcggacactgaagcgcygsgatttcggggctgagccttggccgcacgtccgcagcggcggtttggggtgggatatgaccttgcatttgaatttgtgctccgagggcctggcggtttgccctctagccaaaacaatcaggggaacttgtagattttttttccccaaacacactttggtataattcataggtttgaggttcttccctcgtcgctctcccgcccggaggtgatttctcccctaccgggagagaactcctgcaagagagttccgcgaggcggaaggtgtgagtcgcggaggctaagaggggtcgagagagtggcccctaggagcggctggggcgccagggctgccggggaggtcgctcaggacctggcggatgaaccaggctcccaccgccggccaccgggggccacagggcctaggccctcccactcggccgcaggcgcccgctttctagcgcggcgctggaaggacctggggcgcccctccgcacccagccccgcgccgggctggccgcagctgagacgtaacataaactgcagcacgtggagttggggtgttattaatttatttctataaatcatcaacagaaagatacacaaagagccgtgattaggttgaaaagagaggcgggttattcattggtgaagttgtaaacgcggcttagaggggggaaggagatcaaaacgcgggcgcggggctgctcgccgctcccagcgcgcacccagccaggcgccccgtgcggcccygcggcctcaccgctctggcgcgggacgcgggctctgtgagcgcccgagccgcccgcggagcccccgggtcgccgacacccgcaggcccggccggcggagagccaggcccggcccagggtccttagaccccagccccgctcttccctccccaaagccccaggccccagcagggcagggagagggactggggagccggagaccctcgccgagttggagacgcgggacagacctggaggcttttttctcccgtcccgagcgggtgctgcctttcctcccccgctcccgggagcgccggacttgattaaagtaatttttcaagaaatcgctagcggttcctaggtcactgcacagggggctcccaagcctcgggcacacgcactcccttcttttgcccaccgtgttcccttaagacgaaaagcaaagagaaagaaaagtcgcgttttggagttcctggagttctagtaaacctcctggaagagaaaggcaggggagraaggtcgggactgcgcgcttcccggtccccggctcccggccggagctggcctttctcgcggcctcgaggcaggtgcgccgggggcgtctagaaagtgggctgcattctaagaagccgaagttgggctccttaacgaacgcgctgcggactgcgctggagtccaggcttctctgctcgtgggcagcaaagtcattgtttgagaaggagcgtgcgggacggaccctgcgggcgccgcggccggcgtttgacacctgcgcttgggacacaatggccgcaggccctcttcgggaccggtgcctttctcsgtgttagggaacctctgaacctgagctgtgttttcaaacaaacaaacaaaaataaccagctctcccggctcttcccggtgaacacacgtgaattttggggtcagagggytgtgaaggtataactgcgccatcttactcctcactcttttaagtcggacttaaaaggttttgccattatttataaggttcttgggggctttttttaaaccctccccaattgttgggctaattcactgtttccacagaatcattcccacttagaacagtaccctatttttctaggtttcttaggcatacaaaatgaacacaggtaaaggcatttaaacaaaagaaaaatagccgaagaatttgctaaagcaatattcacttttaaaatgcaatttttcccctaaggttcgaggcgtcttgttcgtagccgttgaaagtatttttccatcctaaaaatatckgtggaaatattgaccagaaataaacttttaaatgatctgtgatgtttacaaggatatgtctaaaacgtttattacattattttcctcttaatgtgaattctccacgtttgaaactgtaactcgttttctcattttttgttcttcttgttacttcctcatattgtgtacttggaaattacctttgtaaatacttgagaaattcgttcttatatataattaatataaaaagtttgcatttctcaaaaacatctctatcaaagcctgtgttctcacgagtttaatatcaaagtcttaataaaataatcacaactacccaaatgcttataaaatatgttcgattactggatttttattcattaaacagaattaattttatttgacatatttaaaggcgccatttagaaataaaattgcttattatgttgcaatrctgtatctatttcagcctctacaccgttttcttttttgtttcacctgaaactagttttcccttccgttttttttcttgttctatcaagctaatatatatatcaacatacagtaatggggtgctggtttttgtaagttaaatatgtacctgcattaaataaatagtaaacatgtatatattgcttctttagtacttttgttctgtgctgcacactattttaatttctagttttaaattatatctctcttttcaaagcatctgttcaataagcaagaaaagatattggcaaagttgaaaccattctagacaaataaaattcaaaggtgctaaaactagcagtttacacacctgtgtttatgagaaatgaaaagtataaccatgttcttatycagtatttaaaatttatgagaaacataatacaggaaaacaagcatctaaaattgttaatgtccgaaattgaagttatttgtccccattagcccagtagattttgtctggaaggtggagctgtggattttttttttttttaactacttgcctcacctcagtggtgtgatcctcccgtcccaaggagatacaacattgtattttggaaaacttttctaaaactctgaaaattatttactatttggctaagacatcctccttgcttcttagaaggtgaacacatacatttcacccctgttttataagaaatggagatacccattcaaaaggaaaataatgtaggagaggttgaagctaaaattgggcaaattcagaaactgatgctatccctacttcattgtaggatcagggagtccagccccaagctaaaggcatccccactttccagtgggcctcctgccttttaaatctcccacattgcaggaaaatggaggaaagcaaaataaaatggccaggcgcggtggctcacgtctgtaatcccagcactttgggaggccgaggcagatggatcacctaaggtcaggagtgtgagcccagcctggccaacatggtgaaaccccatctctactaaaaataaaaaatttagctgggtgtggtgctgggcatctataatcccagttactctggaggctgaggcaggagaatcgcttgaacccaggatcctggtggaggttgcagtgagccaagatgccgttgcactccagcctgggtgacaagagcaaaactccacatcaaaaaaaataataataaataaatwaattaattaattaaataaaacaagagcttttctttttgcttaataagagagagtggtggtggtgcttttttattcctgaagatgggaagtcctcttttgcccactaacctcrgaagaaagggatgaggtgtaccgtacaggggcagtcaccttctcctctgtttagcttccattttggcctcatgtctaccccaaagttgtagcttagatggggggaaaattcagaattttgcatagaccataggtagcaccccctagaaaaagartgtttctccccagatgtctcccactagtaccctaaccatctgcttgtctgtctagtgaggacccttggagggctgctaaaatgatcaagggttacatgcagcaacacaacatcccccagagggaggtggtcgatgtcaccggcctgaaccagtcgcacctcycccagcatctcaacaagggcacccctatgaagacccagaagcgtgccgctctgtacacctggtacgtcagaaagcaaygagagatcctccgacgtaagtgttttcatcctgcctctgcctcaacctgaagtgacctttgccctctcaccccattggctgcctcagtttccctttcatcgacaaggccttgtgagcacttggcagatatgaggaaggtggcaagtagatttggccttggtggttgctgtacaatggattggcttctgtcatgttcttcagtcacagcccccttgctacccagccagttgctctgaggagcctgtcagtgtatgcagcataccttaaactttttggcccctccttccacctccttctctttgaaaccaagtaggtgacagagtgaaatgtcttccctgagagaaaacccagcatctccccttgatacgtgaccatcagtcaatttccaaagaagacatttcgttgcagtcaataatattgattactattactgttaatttcctcctctctggaaaaagyatcaacaatagaatgcatttgtatagagagatatattcagaacttcaccctgttcttggaggatagtgggagggattgaatcctgaggcaatttaaggtgtttacccacatttaccaacactggtagagtgtggggacctcagctggtggccctgctcatgaagaagctatttctggctaaggcagggcacaggaaaagcatctgcatttggaactctgacccatcaattcttgtcatccccattcccatcccaaagttttttttctgtcccaagatttctcccacccaataattctaaaaggtttttgttttgaagtacgtctagagaagtttgaactgcctatgaataacaagagtaggaatgacatactgtctgtattttaggaaagtattctttgacattacactttcattactttgatccaatccttttcctggaaaatttgtatcggttttcactctccccacacactatcctctggctttatctaggcttctctgtctttatcaagatgttaatttccaccactatctgggtttctgggttgggttttttccctgttgctttttaaaatgactcttgtcttctgttacacactgctctgaagtgattgtttcagtatttattgtctcaatgtccctgggctggtgaaaggaatggttttaggtgttcatttcatattgtggtgtttgtgcttttgttgggagcattacatgaatagattggaagaagcaacatgagagctgtttgctgcttagagcgagagacctttccaagaatgggttggccccccatacttggtgactagctctttaagaatttgtgttcctgacatgaagcaactctctgtagttcctggaaagcctaaaaaaattctcaggagccattgtctccaaagacccaacaacgcttgggccctgcccaatttaagctttatgcagcatytccagtctgtgctgcctctctgtattcaatgagaatttcttcagaaaggagaaggaggcaggaaaggcagactggaaacttctcaaaagacagaggtccagaaagtttctcaagatgctgaggaagggacgttttacaaatacaacagcctcttcaagagattgttgttattgttatttttgttttatttatttatttatttatttaactttttgagacggggtctcgctctgccacccagactggagtgcagtggcgcgatctyggctcactgcaagctccgcctcccgggttcacgccattctcctgcttcagcctcccaagtagctgggactgcaggtgcccgccaccacacctggctaattttttttttttttggtatttttagtagagacggggtttcactatgttggccaggctggtcttgatctcctgacctcgtgatccgccgcctcagcctcccaaagtgctgggattacaggggtgagccaccgcacccagttgttatttttgttttaaagtcacacgagacataaaagcttaagaaacattccttccttctgtaactattatacaggcacctactatgtgccaaacactacgctaagctatggaatacataggttcttttctccagggacttacctgccatccagtgaagaagtggagatgtttgagtaaataatgacattcactttctaagagctgttataaagatatacacaaggggcagcagaggaattgctaaattgcctggagacatcatgggaggcttcctagaagaggtgacattcaaatcatgtcttgaaggatgaatgtaagacatgcaagcatgatataagaattaggaagtaagagaaataaaagagggacacaagtgaatggggtgaggagaaggaggaagaggggagagaataaaaaatgatacatgattacaaatttcctggaaaaactaaaaataacaaatggtaatattcatgggcccctctacacacacagaacctccttgtccaagcagcccccaagcctataaagaggctactgaagccaacttctccaagataattttcatgggcaatgaacattttcttccccaaccccaattaatctgaagggaagtagagaagagttgttggtggctagagggagcaaatgtgggagtctagttcttcaaaaattgggagaggctagagccaagcccctgatgtcagtggaacccgaatggttctgagcacctacaggcaaacccacctggctgatttgaggacacactgagttctgaacactgttcagcctgctacctcctcaaagggcaggtgagagactgaggcagccctcacactggggagcagctgcgagagtgtctcacacccaccagacacaaagcttcaggaatcggttttgtcacctccacacaagtcagatatgaagcgtttgcggggtacgtggcttgggttttgtttttagtgagaggtgatgcacaggctggtagttaggagcctgcaagcctgcaggctgggctcrtgtccaggctcctgccccaagtccacatgactttggrcaagtcacttcaccagtctgaacctcagtttcttcatctgtaaaatggaggtggctatacttctcacatggagcggtcgtaagaattagatgaaggaatatatttagaggatttggcacaatacctcaccacagaaaaggttcaataaatgtgaaccgttattgtgtctgttcacatyaaatgaaaaaatctcacattgctcccaggcccttgggatgatccacactggctttcgccattggtgactctactggtgccacacagggcccacggggaggagggaagacactgtgacagacctcactgagcaggggacatctccttctcccccttggatttcccctcaagtaactgcatttagagagctgctgtgaagtcaaataccatagaggggctaaagcactttgaaaagtataatcaggtggggcatggtggctcacgcctgtaaccccaatgctttgggaggctgaggtggcgggaagactgcttgaggccaggagtctgagaccagcttgggcaacatagcgagaccccgtctctacaaaaataattttttttaattagtcagatgtggtggcctgcacatccgtagtcccagctacttgggaggctaaggcgagaggatggcttgagcccaggaggtcaaggctgcagtgagctatgatcgtactactgcattccagcctgggtcacagagcaagaccttgtttgaaaaaaagaaaaagtataacccccaaaggaatttgggccaacatcactatcatcctgactaggggtagatattctaaaagactagttagtgtccctaagctttcagtcagtctcattccacagctggggagactaaatgatgagggaattaagctggggccccacatgatcccactagcagtgacttcctgctagtacatttgacagggactctctcaggtctatagtggcattgttgggcaccactgaaaacagagccctaaggtggcctaagaatcctccaaggtgaatgggccgaaatcaaaggccccagtgacaccatcagtccacagttaaacaaagcccaacaccacctgcagttgggattgcaagtcttggcgggctaggggccctaaccattcctcccgatggagcaaaatggaaatgagcctaagacaggtggtaagttccctgctgctggaggcatatagcctggagggccacttggtgtggggttgtagaggggattcaaacgttaagtagtagcctgacttgaaccttgaggattttggatccagttgtccaaaggaacaggaaggatggcatgtaaatgatggcacatcatttacatcacaaagggaggtggtagccttccactttctgtgacctgtgggagtaattacaggaactgagaaagaaagtcatcaaggtcgggcacggtggctcacacctgtaatccctgcactttgggaggctgaggcaggtggatcacctgaggtcgggagtttgagaccagcctgcccaacatgatgaaaccccatctctactaaaaatacaaaaaattagctgggcatggtgccgcacacctataatcccagctactcaggaggctgaggcaggagaattgtttgaacccgggaggcggagattgtagtgagccgagatcacaccactgtactccagcctgggcaacaagaggcaaactctgtctcaaaaaaaaaaaaaaaaagatattaagatccagaacatagggacccagagctaggagatgaatgtattacgtgtctttgctcagcagagtgcttagcctccatgtttattcatctttaaaatggaattaatcactcctgatgagccctgcttcatgcagatgtgaagacgaggacagcaaagctttcttcttcggtaatgtagatatcaaatctcattaaaccatgtgggctaaggcatcacctctgggccgagctgctggttctcattcattccacaaaaatctcctgatggtcacagtatgcctggactcaaggaattggacagacagggagcatcatttccagctaattaaacactactcccagacaggtcctgtgtttgtagtctttgaaattattttgagatctaaagcacattttctttttccaatacaaagctccagttatatttatttcaaagcatgttccaaaaggtttggggtttttctaaaaacctgactttataatgtagatacctaggatataggaagagrgaggagaggtggggagtgctatctacagcctctgaatattttgtgcaagtgtaaattgtacctttgagcagttctcccctggatgtgagacttgattgagctcacccacttgacatcaaatacaggagttcaggatgcagagtgttgcttcatctctgaaggccagtgagccaaaggggaaaaaataataattttcttaaaactatagctggctatgtttgagctccttcaaagaaaggaaaagggtggctttgctggagcaactgaggtgggcagtaagggcctgtgctgagggctccccatctccagctccacatgcagtgagagaaggttgcaaagcttagttagacgaggggaataaaggtgtcttcgtccgttgtctgtctgtctgtctgtctgctgagtgaaggctacagaccctatcaaatctactcctttctcttttcagaattcaaccagacagtccagagttctggaaatatgacagacaaaagcagtcaggatcagctgctgtttctctttccagagttcagtcaacagagccatgggcctgggcagtccgatgatgcctgctctgagcccaccaacaagaagatgcgccgcaaccggttcaaatgggggcccrcgtcccagcaaatcttgtaccaggcctacgatcggcaaaagaaccccagcaaggaagagagagaggccttagtggaggaatgcaacaggtaacaccaccagaagctcacctgggcaggtgggcaagtacacagacccaggaaccctcccctcggtcctgggatattgagacactagttatacagataagtgtggctaaatcagagcttctcaaagtatgttccacagaaccccaatatcaattcattaatcagtaagtctgagaatcagcatatggatacttccccttagagagtcacaacatatattaaaggttccgagaagccctgcagtcaagaaacccacttagctttgttgaattggttgttaactatggaatcttcggtagagtacaaacaaccccatgaattattcttccagggaagatactctggagaatgctaatttaaaatatgatacttgggaagcgaaattgtgtgtttgacctccctgcaggccagggtaaaactttcccttagccacagactctagatctggcctctaccaattgtcagacatgcagtggtccaaaaggaaacttggcaggagagtaagaattggtcagatctgttcagtctactctgcccccgctgactcaacagagttctttttacttgttaactaccagccaggcacggtggctcacacttataatcccagcactttgggaggccgaggcgggaggattgcttgagcccaggagtttgagaccagcctgggcaacatggtgaaaccctatctctatttaaaaaaaaaaacaaaaaaacaaaaaaacaactctgtgttattttaagtatttatttttaaaatgtggtcttgctatgttgcccagcagatcttgaactgggcttaagcgatcctcctgccttggcctcctaaatagctgggattacaggctctagccacagggcccagctattttttttttaaacgattggaaagccttgggaaatctttttacttcattcctgccctgttctccctgactccagtattgactttctaaaacttcagctctttggtctggccaaggcctgtgtgcgctttctctgtctctgggctgggctggccttggctgtgggaagaatgcagccagggaggtcaggctgggaagcagggaggcctgtattgccactgagtcctcaggctgtgctccataccccgactaatgagatgccttgcagcacccagtagtgtctaagaatctctcgcacctggttttgaggtttcaccagccctgataaagctagagactggccatctcaatgcaccctgctttgtaccccacccagcctgccttttggaggggataaagcatcttgcttcctggcactctttcagggagttcaagccccaaaagaccagaaatcctctcgaagtgctttgaagccactcaagacagagccagcgaagggctttgccttttatgtggtgggaagaatggctaaataaggaagccccatctggaccttcccctggactgcctgtccccggcttgctctcttctcctcgagagccacaccagagcctaagcccctgactcccagggcggcatagcctgctctgtccctgcgttcaggcccacttcagccatcttcatcagatcactccatggattggccttttctctgcataggcctctcctccccagccttccattctgcccacggccccttcatactcccaaccaagactgctgtgattgtgtgtttttggccaagcaccaacaagtccccccgccccccctcactcaccatctcccctccatccattcccagggcagaatgtttgcagygaggggtgtccccctccaaagcccacggcctgggctccaacttggtcactgaggtccgtgtctacaactggtttgcaaaccgcaggaaggaggaggcattccggcaraagctggccatggacgcctatagctccaaccagactcacagcctgaaccctctgctctcccacggctccccccaccaccagcccagctcctctcctccaaacaagctgtcaggtaagcaaaggttgggcctcactgcctcggcaacccaaccatcctggttcttgccacggatcttatctggtttaagggttttcagaggagcaaacgcttttgagatgatcctagggccgctctctcattgccagaatatactcccctggaaataatgtgtggctctgatcagtttcctccaactcctggttcagccattgccctgtgagggctcactcggcttccagggagccctttaccctatttgtctccttccctcttcttctccctgtgtggctgctgactcagcggtcattctacactgaggaggctgccttatgggtgggccasatccaaaccgcaggcaaacgggtcgtgatggcgtggcaaccctcactgtgttggaggatggcactccggccacctcctccatctctggccatatcctgcccctcgctcggtccggctgcctcaggagaagctcagtagcctttggggacggccactctgttggtggcctctgcttgttggcttccgtgtgtcatcagggttggtgggggtcagtcacttgaaatctttgcagcaatgagttgggaaaaactgaccgagtacctgctccatcatgcttgattgagtgctcctgtgtgctgggccctggcctggattagaatgcctctgctgtgggctttgggtttgtcaggatggaatcctacagcctcctygggggaaagcacacctcatgctgagcgctgtgttaggcacaggctgggatggagcacttcttctggtccttcattcttctggcaaagctggcttcctagaatggatgtgctcactggggtctgtgtggtgcccatgaggacaaagtgtagcagcctcctgcctgctccaagaaaagggcttgcgaaaggaaagccaaacactgtttctaactcaggggtgattctgaaacctgttggctcccctcacctgtcggttgcccttctgatgagaaaggcctgagggctgggggctgacccaagtgttgaggggaccaaagccaccaagacaggctcggagccatcagctgggtggtgtacaagcatttgttccatgcctgctgtgccctcccatagcactgcctcttccagggcctctgggagcctgacagtgcccagcatgaaggtggggccagtgctgggggtttctgtaggtcccactcccacagaggrgagaggctcagccacacaggaagaaagtcttggttacttaagaggcagagaagcccctaggcaaagactggcctgattgcagagtaacttcgcccctttagggaaattcaaagcagggttctgagggttgtggcaaatggcacatggctggcactgagcagtaccagtgtgcttgcccaccacagcgatccacggagctgaagctgggagctacagggggcgtggttggggcaaggggcattactgggaagacaatggccattgtgttgggacctgtgatctccacaccaaagtcagggagcctggaagccaaacaaaggcccagcagccttctgacaagcaagggctgtgctgaggtcaccacggggtcgttggtttaggcatcctgtgtgctgacaggagacccagagagctagggctggagggacagggagcagggcagaaaacacagcctgtgtactcctctgactggagtctaggaagggcgtgtcccatgggaagtggatactctggggtgcccctgaagtctggatctttctaaaaatcttgtaatgttagaatttggagggaatttgaagaaaggaactgaggcccagaaagaggcagtgatttgccaaagtgacacagagcaatggtagcaaaacaaggactagagctcaggcctgctggttcccactccatactttcccacagcactacgatgtgttgaatgcttaccaagtcctgggaatatgctagtgatgtacgagctgcgcgtcctgccctctgggaggttactgtctggtaggaaggatatcgggtcactgtcgagtccccagaaccagctgcagatggaggttttgtttgggggctttgtggatctttctgcggtgtaatagatcctattactgtttctggagcaacagttatgggacactgaatattatcagtggctgcctttcttctgtcttttttttttttttttttttttgagagacagggtctacctctgtcacccgagctrgagtgcagtggtgcagtcttggctcactrcagcctcgaactcctggtctcwwgcrgtcctcctgtcttagcctcccawagtkctgggattacagttgtgagattgtgcccrgcccttctgctttaattttcactctgggctcctcaacatggtccttgtcccaagcccagggactggcttctctttctctgagtgtagttatgtatctgggttctaaccagtaaggttataactgtggctaattcacataacttctctgagtctgaatttcctgcctacaaaatggagaaataggaccttccacacagggtgcatgtgaggatgaaaggagtgaatgtataaagacacctttcccgataacccatactaccctcattatgrctcttaacattagagagggctaaacaagggcagtgagaagactggcaggcagcagaaatcattttctttttgatctcacacaccagggcattccccstaagaggcagtgagatgtagcctggccctggaactagaaacagaggtggctgctgtgctagtgcctgagatgcacgatgctggggtcaaagacttgtgtccccacctcaggctgccaggatggcgtgtgtgccgtgacagggctcccgagtcatgcactcaggcagacagcaggctggagcccagcattcaggggtggcttctgtctgtagagccgcatggcactcttcccacctcagtgcccacagccaaggtagggtcactaaccaagccagaaacgtaactgtgtgcagaataccgaaaaaaaaaaaaaaaaaaaggccgggtgcggtggctcacgcctgtaatcccagcactttgggaggccgaggcgggcggatcacgargtcaggagatcgaggccatcctggctaacacagtgaaaccccgtctgtactaaaaatacaaaaaattagccgggtgtggtggcgggtgcctgtagtcccagctacttgggaggctgaggcaggagaatggcgtgaacccaggaggcggagcttgcagggagcagagatcacgccactgcactctagcctgggtgacagagcgagactccgtctcaaaaaaaaaaaaaacgctctgtgggctaggkgtggtggctcacacctgaaatcccagaactttggaaggccaaggcaggcagatcacttgaggtcaggagtttgagaccagcctgaccaacatggtgaaaccccatctctactaaaaacacaaaaatcagctgggcgtggtggcaggtgcctgtaatcccagcgactccggaggctgaggcaggagaatcgcttgaacccgggaggcgggaagtggaggttgcagtgagccgagatgggccactccactccactccaacctgagcaacagagcaagactctgtcttaaaaaaaaaacaacaaaaaaaactccatgttgctgaggagagcccaaaatccaccgtcagcactagcaaccccaaagactgagctggggggaacaaggcccgaatccctccacacccactctccasgctctcccctctccaaacatcagcacctgagccaggagggctggcagcaccttggagacgaagcttccccagaaccctcttcctagagaggaagagcagcctttctctaacagcacsttccctcccagccatgcttaccatgctgtggcccacttgcccacgatgaccacggtgtgaccctagtcctggaatgtccggcacaataggggtggcaggaggagcactctgcctctgtcagcggctgattggttacaagatgccctacaaacacactgtcagcagagtcagctgtttccagcgttgcccctccttggctttacaatcacacaccagcatgcagccaagggttgtcatggctttgtctcccttatgcatgcttaattgacaattaagttggggctttgaaccagcctggctgccgctgctgggccttcatctttccagggagtgtcacaggggcaccctttgtttgctcttcttgggggcctgaagttactgtagcaggctgcaggcagccatttatcttcagcctggaaggcctttatccgcccccaccccctattccagctcttggccagcaggagctgtccctggttataggctccatgacagcccattctgaagccattgagcaggtctggagtgatggcctctacctcccttctggagatgaatcaagagaaaggcccctaaaaggtcagagggcagggcggcagcaaggagaaggactggttggagcctggtgcttgtattgattggctcgaggaggaggaggaggaagttggcgcgggatggaaacttggctagccttggcccaagctgtggtatctgctgtgtgatctgtggcgaccttgctccctgtaccctttgctctagtcggcagcaagctcacctggccactaccttgaggaggagaggaggggtaaaaggtcttcatcagcctccgctctcccacgcatgatgtcctcactcttgtgtcacctttgagagggaaggggggacttattctcctggaaagaaagtgaggcacaaagaaaaagagaagaggccctgccaggaggactttcaggggtcccgaaccatagccccttcaccaaagaggagacatttatttctgtggctgctgctcctccctttcgctgaactctattcctccctctccaagcccagtggacttgacttccytgatgtggcttagagcttgaaaaacagagaatcctgcctcctgcctctcgctcatcccccttcacagcccctcccaggttacctgagggaatctaaccctgggtctcagaccagccaaactctgggccagggtacctatgtgaatgctgttgttttccctggcactgaattctgcaggacacgaggaaatctccaaagtgtccagtggcaaggtagtgactcaacgagaggaattctaatggccagtgttgatggagcacttccttggtcccaggccctgggccgagttcctccatgcatcatcttatgtgacccacacaacagccctgcagagtaggagccatctctagtgtcatcttcattttacaatcaagagaagtgaactatttagaatggaaggcatgtgcccaagttcatattcttagtaagtggtggggagaggttttgagctgttgcacactgtccatctctttttgctttatgcagatgctaagaacttttcaggcactaaacccaacacagagagagagagagagaaagacacacacacacacacacagcccccagcagttccttttcccacattcctactgttcccctctaaatgacactgaggctttgggagatcatggccaaagaggtggggtaagggtgagagtctcccattctgggtagtttactacttcctccccaaccactgcccctgaccaaggtggattctgtgccctgcccaggcaagaaatcaaagccccctctttcatgaccccatccccatttgtgtggggatttgaactgcccttgcagtcggcactgtctggactactaaatgccttaacaacttaatggggcttctgagacagtgcaagcacctcagctcacctctgggagctccgccccctccctgggcagcagacagcgggaggggtttatgagggtagttgtaaaaatattcatctcagcagcaaagttcctcacggtaaataaggcccattgtccttaagtagcagattatttcagttcagaagagagacaaatcctgccttgaaatgtctgctattctaggaaacacattcatactgacttgaggtttagtggcggacatgggtggctccagcattctccttcttagggactttatctgagtgccattttatctcttgaatttgaaggtcattttatcttgtgggtaccaccccatcagctgccactgggttggggaagacaatcaggatattaatgagattaagaggcctagccttcagggtgttctgctgtcagcctccctctgataggggaccagccctggtctgcatacaaagaaaccaggctgctgtgctcgtggggctccaagcctctgcacaaaggggccaggagatactggagtcctatcaccaaagggtcatgcctaatccgcctgaaggatccttagacgattcaaggactccttgccgcctccagtgagctctgaggaggaaggaagctgcctgcaagcacacagccctggcctgcagcttatgggagaagtgctcttggaaactgttgaaggtttgatgagaagcgacaggaacttggagagaattaggtattacaggtgcagagagaggcagagatctgtgcaagggcctttgaagctacctgcttaatggaatggaacaagatctggctttatgcctctacctattttttagggggaagtataaacacaaatgaagaggagagagagaaatatacatacatatatatgtattatatatatatacacacacacacacacacacacacacacacgcatacatatagaagttatatatataaaaggaatgcagcccacaaataaagtcagatcaattagtcagtcatggttattatcctagctattcataaattctctagaacagggattgacaaactttttctgtaaagagccagatagtaactattaagtactttaaactattcagttgtaattactcaactgtgcctttgtagcaccaaagcagccatagaccatagacatggaagtgaatgaacatcactgtcttccagtcaaactttattttatggggactgaaatttaaatttcatataattttcacatatcatcctatagtctttaattgattttttctcaactgtttaaaaatgtaaaacccattcttagcttgtgggtcatacaaaaacaggctgctttggccaacagaccagtttgctgaccccgctgtaggacaatagttctcaaatgtggccacactttagaatcacccgagggagtatttaaaaatcccagtatccaagctgcaccctggacctgtcagaacagctggggagtgggactacatatcagtagttaaaactttctaagtgataccaatgtgtagctaaatttgagaaccagttctaaggttctcaaatttagcttctcaaatgttaaagtgcatgccarttccctggggtgggggrtgttaggatacagattctcattctrtaggcctggggtgaggcctgggtttctgcattttcaacaagttcccaggtgctgttgaagaggatggtctgggacacacttttgagtactggagttggattagcaactaactcccctttgcctcccaacctgtgtaatttgcctcaccatcaccagccttgacatctaatatggggaaatgctcttttaaatccagccrgcacagtgacaaaattacaggctatggaggcagacccaaattccaaccttcactttggcacttactgctgtgtgaccttgggcaagtctctggaatctctgtgcttgcctcttgaggtgtggagacatccactcatgcagatgctggaagaattaaataagataatatatatgtaaaacactccagacataccagattctcataaatagtagctgttaccattccttgcagagacttgggggttgtttctttgtttttttgtttttttagttttttccctctttccttgtccttcttggaggtttcattcaaccttgatttttaaagaatttgagtatctccaactagatattcatcttggtgtttgcagcaaacttaggctggcttgttgcagcacattgggtatgaggcaatctcctgctcttcctaggacttctctgtgacatccacaaggcatattgagtgccgtaaggcatttagtacaaattcaggaaacagtgaggggaagctgggaagaccatggattggtgggggcagaggggagggtcatgaccatgtagcaggaggtcaggttcatgatgttcatgaagtcgagatgaccatgaatttcctgtaactaacagggcatttttcttttttctttttcttttaatttttttttttgagacagagtctcgctatctcccaggctggagtgcrgtggcgcgatctcggctcactgcaagctccgcctcccgggttcacgccattctccggcctcagcctcccgagtagctgggactacaggcgtccaccaccacgcccggctaattttttgtatttttttttttttagtagagacggggtttcaccgtgttagccaggatggtctccatctcctgacctcgtgatctgcccgcctcggcctcccaaagtgctgggattacagccgtgagccaccgcgcccggccatttttcttttttaattaaaggaggtgtgagtactcctctcatgtgtattgcttgttagtaattagccctgggaacctgccaggtasaggggtgtgggatgttcctggtggaggctgcatctgggaagcttaatggcccccaaacktcaggcgaaggagcatttaagaaggagaaggtgcacacagccccacggtgagcaaagggaaacctcagagctcctaagggctgattttctggaaaccacttccctcaacctgtgagcatgcgtctgcttcaggtaccttcctgttaccctatgctccaacttcagcagcctccgcaatagcacacttgcgtgagttcagccactgaggaatcaactggcaaggggggactcgatgcttccaatgcttttgggaagtcaagagtcagttttctcaggacttgtactctgcatgttcttcctaagttggagaaacaccttgcagatggtctttagcatgtagactttcccaagggaagcctacctgagccaaggtgagctggttatggccagtcccttctcaggaccggattcagatgcgtgtgtctgggtagccmagtatagcacccaaatcaggcttggcttgggttgtggttctgtcactatccrgcagtgtgaccttaagttattagcttctctgtcccaatacctatccccttaggggtgcaatgaggcttaaatatgatcagacacacccagtgccaagcacagtgcctggcaaggaaggttagctgccattacagtattattgaattgactcagaaacttcagggtgttgagagaacggaagagcttgggttctccctgggttcttgacaagggtcttaccttgtagtttcaatcgggaaggatttccctttccatgaaccctgcttgtcatttgaaacatcagaaacaatgaactaagtattggcaagatctgtggttctcaaatctctctccagaccacataaaaatcatccagggagctcattaaaaatagacatggctccctccacccacgcacacctttggagtcagaattgagagatgaggggttcacaggcataagaactttcgacaaaagccctaagagattcacgtagagtcccagctacttgtgaggctaaggtagcagggtcacttgaacccaggagtttgaggctgaagtgagctatggcagttgggttgtagacaacaaggaacacaggctgcttatttttgtctccttctataaaacaccttgagataaattaagcactttgtgcccattggcgccactgcagtacagcccgggtgacagagtgagaccctgtctctaaaaaaaaaaaaaaaaagagagagagatttggatgcatagtcagggttgacattactaggccagatggagcaggagagttctgaaggggttgaaggtaatcctcatggccccttgctgaaatgggaaaagagaagcagccggggtgaggggccttggactaggattcaggagatcagagccaccaatgagcaagggtgaccttgggtgaatcatttaacttcctgggaattctggcaaatgagggtgtgggatgagggcctttccactctgacaggctattatttgaagactgtgtgtggcatccagtcttggggcccaggactccgcagcttggagtgcagagggaggcttgccattgtggtattttattgtgaaactcatcattgtctctctctccttctctccctcactccctcgctccttccccgtttcaggaactgtgtgctgttagaagccttccacctttattagggatcattagagctttacgacaccagcagattgggtggggccagtcacaataaacagatttataatgggtataaacgagacacctataactgctagaggttaacactttgagggcttctgaatagcagctggcatgcccatgccttctggccctgtccactgcagggtgcctcttcctgcttggcacccattggactgggttggcagtgaagtctatgtgagttcttgttcagcaagagtggaaaacccttaaacaacatctcctatttgtgtaacatcagtttgcacgatgggcacaaaagtgcttaatttatctcaaggtgttttatggatggagacagaaatgagcggccgttcttcttcattgtctacaaccctacagccaggggaactagagggtttgcatccctacctgtaaacttcaatctcaccgtgaagaagaaggtcccygaagtctctgaacaccttgctctgtatgtatgtattctgagtggcagaattgtgggctgtaccaacatctgagcctgaggtagctttcttcatcattgtgtctccagcccatagccctgtgcctggcacatggtagacactccatatatttgtgaaataaagatatctattatagaaggcttcctgtcaaagcatatgcagaaaccccctgttttataaatttggtattcagtttaagaattaaactgagcctaggattagttttgttttatatagcatatatgtgctatataattatatatatatgtatatataaaggcatattttctcttctctagaaacagtgtcacccagcttcaaccctattaacactgcttaagtgtacagttcacaaattaatgtcgacatttaatgttaccagaaagttttcaaagaacgtatcatgagtttctccctaatgttctactagtaaactagtctactcatttaatttagttctactagttactttaatgttctactactttcattcattttaaaatctcttaccaggatccctagggcaagaaaagagcaagaacgtctcctcttttgtttcctttgagcaaaatgaggtctagaaaagggactggactactgcaaatcaattatctggacagacagaaacaaaactgccctgctctgggcagccattaggtctctggtggtgctccctgagcacttggctggtgctcctatctcagtgcccaacacctggtgttgcttgggacgagcctccttgggcctgccggtgatcggcagctatctgtcatgatgatggtgatgatgatggtgataatgatactgatggagatgccctctgtgacagtgatgaagaggctgggatctggccaggcaaatccctatcacaaggcagctctgacacttgccagacctcaaaggatcttctccctgggtatcatctcccagtacggtctttgttatgaataggctgtggtggaaaacctctcttttctaaggcaattttattagcccttcagtcacaatacagatgtctgtttataggaccttacttttgtgtggacacccagtggctcagtctgctgatggctttatagcctttctccctttgcccagacccactgggagcatcaccattctccttgtccactaggcctagaggcctttgttgcagccatattatctctgcctgcaaaggcagctgctcagaaaataccagaccccgggagccagactgcagaagggcactctgtgtccccacagcctttaggcctaacgatgtccaccattaacccttcttagttttactctagtttctttggagaaaggggcattkaaaagttattcatgttgccacagtaaattcccattaattgactcttctccttatccccaaatcaacccagtagcccccaaactcggttcttcaaatgtgaaactgcccaagtctatcaatactgtttcttcaattttgattgtattttaatctctctctcctcttctcttactcctctttcttcctccttaaaaagaatgcttgcctctccttgcccatggaaaaacagggaggggaggccaaagcagaaggactacttgagcccaggagtttgagactaccctgggcaacatagacccccccatctcttcaaaataataataacaataataataataatattaataaattagccaggcatggtggcatgtgcctgtagtctcaactatttttgggggctgaggtgggaggattccttgagcccaggagttcaaggctgcagtgagctgtgattgcaccaccacagtccagcctgggtgacagagctagagcttgcctcaaaaaagaaaagaaaaactgggagatttagaggataaatggacatactccagtcacttcaccaccactcaactcaacagtctaaaggtgaaagtgatgtggagtcatcagtcagagtttaagcataggttattcattcatcatttactccttcaataaatgtttactgaatgcttagcatgactctgccaagaagaaaatggagaatacagacaaggtcctgccctcatggggcttacattacagtgagggatgcagccaaggaacaagtaaacaaacctgcaagatcatttcaagctattagtgggtcgtgatggggaggctctacatatctggagcccatttggggcttaggaggaagagggagaagggtcagctttggaataccacggacttgctgggagaccccctagcaaggagcggtgcaaacaaccttgtcctctcygaacctcrgttttccactctgtcaaatgggtgcttgtgacacattgagaagcagatgggtgtaacatactctcagatgtgaggactgcccaagttatcaagtgccaggctggttccttttacctacagcagcaatcttcaggctgaagtattcattgcaaactgcctgatgtttgcctgcagaaactgccactctagtaaggatgaggcgtggtggcccaggtagaccttgtgggggaggacacacagagtttctgttggtcttctacctccccacatgtgcaattttttcaagtgcaccatgcatgttagcttctgttctcagccaaggtgcttttgatgaaagatttttttttcttttcttggttacatttgctttgattttttttttaaataagaaaaccagtttgtgggcttcccttaagtatcactcaacttttactccttgagtcaagaatgtttactgtccctgcaggcctgtctgtatttctcctcttatgaattgagctcctaactaagccatgttaggtagaaagggatccggaattgaaaccagcccagcatttaaattgctttcatcttgcatcagctttttcttccacatttgcagatttttaatcttctaaactctttgcaaacatgaatctktatcctctcagaggaggaaatattaataagaactagcaaaagtccagtgctacaaacaaggaaactgaggcagcaatgctaactcattcraaagctttcatttctggagttctcaatttcaagccagggaattgttcacattcttttcttccaaatgggcctctcagaagttcaccagacagaatcatttgtctctctgcctctgtccttaagaaaagtaaagtgtttagggagaaggtagagttatcaggacacagtactgggtccatcaagcctggcccagtctctccctgtcayctccccaacataatgatttggcttcatagaaaagatggctgtgtctactcataatttatgaacaatgaacatagttattaccttttggaagagctttctccttcgcatgctctctcctgcctgagtttaaattcccagtttctagacccaacagggctgggctgcactctgcatgaggttagaaacacaggggaagaatgtgtgtgacagagccccagccagttgagtaatgtttactctgttggtggctgggacgctcacttacgctggcagaggtccaccagccrgaggaacattcctgcattatcagggatgggaggttggctctgaaatgtcaagggtgaaaggcatcccaccagattctgggtgcagctcatagacttcagtgaaaggaacccccaggtttcagtgccaaaagccacatcgtgggcaagctgagccccacattgcccaggaatccccacttycctcatttcttcttactaaaagaacaattctggtcctgttttctttgttgacattgctcttctgtttacccagcagaaccagtgcatctctgacattattttattcattcattattctggcttgtgaagaaggaatatctgtgtgcccctttcacagacaaaaatgccaaggctcaaaagttaactgacccagaatcatcagagagttatggcagagagagagagagagagagagagagagagagagattgttaaagtgtctagaggctggtgcccagttgatctctggaatcatggaattccatgattttttgaagctcttagagctgaattaaatcgccaggggctctatgagctgtagctctaaggccctgaagcacaggtttctgcaaagtctctggtgaatggcaccctgagcagctcctctctggggtcctcctgcaaggcagtcatgtttgtctttgaacacacaggcgcagtagggtctatataacctgacatatgcagcctaaaaatcaccagagtttgctaagccatgtgataagaaccacagggcttacgggaaaaacaggattaaaaacacaacacttgaggccgggcgcagtggctcatgccttcaatcccagcactttgggaggctgaggcgggcggatcacttgaggtcaggagtttgagaccagcctggccaacacggtgaaactctgtctctaccaaaaatacaaaaatttagctgagcktggtggtgggcgcctgtagttccagctactcaggaggctgaggcaggagaatcacttgagcccgggaggcgaaggttgccgtgagccgagattacgccactgtactccagactaggtgacagaatgagactctgtctctgaaataaacttttttaaaaagcacaacacttgaaaacttcctcagcgacacattttgtttgttttgagatggagtcttgttctggtcacccaggctggagtgcagtggcacgatctcagctcactgcaacctctgcctcccaggttcaagcaattctcctgccttagcttcctgagtagtggggattacaccactatgcctagctaatgcgtgtaccaccatacccagctaatttttgtatgtttagtagagacagggtttcaccatgttggccaggctagtctcgaactcctgacctcaagtgatccacctgcctcrgcctcccaaagtgctgggattacaggcatgagccacsgtgcccggccaacacatttttaaaagataagaatccaataaaaagattaccasagttttatacccgttaaatagttaagaaatatatcaatgctatacaatagtaaatatggcaagtttgcctagggaagtgggcatcagaagtgctgygggttgtgagttactgtgaagcagtggagaaagggttatctgacatgggaaggaaaagatgtgactccatattgcatggatgtgtcttaccagtgcacacagtggaccgaggcggctggtggatgtttgaggtgcgcatatgtacacacaggagcattgttagtattctcctatgtggttccattcagctggatgcaggcttctgaattcactaagtgttttccaaatgtgaaattgacattacactcaaattatccccaatatgtctatataattggaacagatttacactttcactacaataaatacacaactgactgtattttctacttctgctagacgtgatgctccttgtctggggcatgggtgctcaaagctgctggggtttyattccttcagtcaataaatatgcacagtaccaggcagtctgctaggctataaggatgcaacaagtaaagactcatctctttctttaagaggcagagaaaagtaaacatatcatcagcgtgcatgcagggtgacygactcctgccgtaagtctctgtctagtgcatgtaaaatacaaaggaaggagcagccatctcccaggatgaatcaagaagagcttcacaggggggcgacatgtgacacgagatgctttccaggcagaggaaacagcaaaggtgcagaggcaggagatggtcaggccatttgagaagtgcattaagattgtggtgagagataatgcaaataaaacagaygaatcacaaaggcccagttctgccagtctcaggtgttggggcttttctggaaagcagtgaggagccatcagatrtttccaagcagagcagaggcatggtgtgactttgttttagaaagatatcccaggctgcagcagtgtgaaaggaccctagagacggtgctggcacaggaaggcagagcaaggatgctggcttyttggaaccatgcacctgtgccatgcctttggcacttctgaccagtcatattggatagaaaccgaatgatctgcgtctgtatccagraatagcccaacacccatgatgctgatgcctaggaatagaggaaagtagatgatctactcaccagggcctcagggatgtctcaactccaccttggatggcttttgctgctggacacaattgctgtggttcatagagccaacaatggggatggggccagtgagtggcttgagctaggaagtaagtrgaaggtgaatggctaccatctgccactgtcatttctcctatgggtcctctgtggctattaacctggcatctttggttaatcaatattaaaccagagcccttgtcatatgttcactttaagaacttgcattggtgaaggaagaagggaagatgctattccatttcttaatgcttcctaacacagtgcctggcacatggtaggtgctcaataaagtggcacgacctcagccttcctaaaaatgtcttttaaacaaggacagtgccaaagtaggaggaattgacgtgttttcagcaactgttatgtgcccagcatgatctgggtatttggacatccattaactcattccgttctcttcccaatgacctgacagatggatattgttaacagtaaggaactgaagctcagggaggttaagtaacttcccaagatcacacaggtcttacagggtagagccaagatttaaacccaggtcacctggctccagagcctacacactttgcacttatttttgttctcacttcaagtgctcttctgagtttttgaaatataggaggactggcctctccttcctctaacaagagcacctatttttggtgtacaccttgtgatgcgcccccaccccgccccctcataagatggctggctgattacagccaccctctcaggggccagtgattgccacatgcttggtgagaggagcatcgtgggaacacctgcaggtggatctggggctgatgagcagccttgtgcctggctcccatcacactgctgtgacaatggccccctccccacagtgggccgtcctctggcttatagatgaggaagctggtgctcacccaagaaattgatagcagagctgagattaaaacagggatcccccagtttccagccgrgcctctatcacttaaccaggggcttttaaaggaacgttcaaaggtctaggctcatctgtcttttgacagagcagctccaccgttatatttcttatataataaagttttgttggggagaaaacaaagtrtaaaaaccacagcagccttggaatatgctgcctggattctaacaaatggctcttgagtctctcctgacatgctcccttgtaaagaagccttttgtttcctgcggaaatccttggttaattatttttaaataaataattgcgtagcctttggtaggggagaagcctccttgtgacccatatttgatcatcagagggctggcccttttccatcagccaaattaaataggctaaatccagagactgtttgacttgagactgaatcgatgatggggacaggctgggaggtgaaaacacamctgactcccagcgttatcamcactctctcaggagcagagcctctcggggaggtaaatagctggttagggagtcagagaaagcaggagaaaaacagggtgaagtccagttcctccaaaagaacagagcaagagggcagcggctagacctctctcccaggttgcttccagggcaaagcatcagtggttctgccagggtaggattctttggaaactgttctctacggaaagataattccattcagtgtttagaatctgtcctaagccatctagaattctaggatcttagggcaaatatcttggggtccattcctgtaccagcttcctccccacagcatccccacccatagttgccatttatatggcattttgcaagaaactgtatagatgttacctctaatccaaaaagagtcctgttgaggaggcattctctccatttttctagaggaaacaaaggcacagagagggaaagtaattttcccatgatcacagatctattaagagcagcatcagaatttgaacctgagttggtttcgctgcagagtccatagtcttcccactgcccctccttgatagaaaattcttcctgttatttatttgaaatctgcctccctgttttccattgaacctagctctgccttcagagctcataaggttcaaatctctttcttctttcatgtaacaacactttgaactgttggaagcatcctactgggaactgggtggcagacgtgaagaaagaaggcctcatttaatccaatgggatggcatcgatggcaaacaggagacgtgggggctgcagataggtgcacaggaggacaggggcctgggcaccggctgttgacttggggagctgaacgctgttcctccttttaacttcatgatttctgtccttcccaaaaaatgtagtgccttaaaccaatacaccaatgccagcgccatcccactgtcaccaccacccccactagcagctccttgattcaaagaatggggaaaatggccaatagaaaagctcatagagcaagcgtcaagccactacatactcagacaagttgctcttgaaggttagaacccagctttagcatttgttttgttcttttccccagccctcttaagctctaggtcatatcggccttgggtaaagtccttaggaagatccaaggaaaactggcttggggctcatctagtctcatcttggtaagcttcatcttggtgaattagaggcagattatgacactgattatggcagtgcctggcccctgggggaactttgtggtctcctctggaaggtggggctctagctagggcagggggtgggtggatgaaagagcaacaacagaatcagtgtacagggatggttcatcttgggaaactgggcaaaggaagacgtgcagctaaagagttggtccacctatccagataattccatgcctagagcatttggtctctgcaggacagggtcctccaaacctttttgtcaaatccaaagcaaaaaacaagaacactgtctttctaagcactgagcttaggggtgagatgccccatgtacccccaaccttgtccttgactgtttcatgggcacatcaagcaggatttccatctgcaaactggacccaggcgttcttttagcttccttcagttgcctgatctctgtccagaacttttctttcctgagagcagacctccattttggttcccgagcaagagggagggtcagagcagcgaggttgtaaacatgtttggttctacccttcccctgcagagcaaactccagtggtttactaaacatccacatctgcctgtgtgtggtgctgcctgccccacctcccagcagacacacctttccctgtgccctggaaggcagccaaatgggacccccagcaaaggaatgtgagttctacagcctagctcctagacgcagcttcatccctgtcctgctctgcctgtgtccgtgcccctgacctcttgggcctggccacaaaggtggtacacagagactgatgcctaagctacggctctttcaagggtcactggacaagggcttcttcttcgtcacatgggtctacttatactttgcagcaccacgagggatgccagggaaacatttctaaaaggcattttaaagaataaaaaatactccagccagtaacagaaggctagtctcmacccccaaatcctcaaagaactgtgcggaagcaataacaaacagaatccatccagtcattcatttattcatcagaagtttaccragtggctattcagtgccaaggcactggggatacatcagtgaacaaaacaaacgagataaaaatttcctgccctcgtggcgcttacattctagaattaaatagagaacatgccatatttaccctggagaaaagcagccgatatttcttgtgggtggacaggggaggagaaagcaactttattttcttattacccacccttgaaaacaagaggtgccgagtcattgttccaggaccctggtggcactaatgttccctactgggtttgtgttgttttgcaggagtgcgctacagccagcagggaaacaatgagatcacttcctcctcaacaatcagtcaccatggcaacagcgccatggtgaccagccagtcggttttacagcaagtctccccagccagcctggacccaggccacaatctcctctcacctgatggtaaaatggtgagtacacctgggccattgtcgctctggagctgataagataagaggcaaaacaaacacaacttctcacaaggcctgcctcaaacaatgaaccattgtagccccataggggaaaatgagggctgtccagagtcggaaaggagaggtagtgctggtgacccagcctttggcgggtagaagaggtgttcggtttgaacccagccaataaatctgacagagttctgctctctttttattgattgaatgcctcataaaggagcaagcccggtgggacactgtttgttttggggcttgccaatgacatttgtgttgataaaatgttcattcatcyctccccccaaggcctccaaagccaattttttaacttagagagcacctcactttgacacaagccccctcttcctccttaccatccccttggtactgacaagaagagtcattagcaagtcaggatgtagtggataggaggcgatggggagaagcttcttgaactggaacagtgaaagacatgggacaccatgacagcgaagatcacagcacaaatggtagatggggtggggcgatgcttagggagggagaaacaccaactttgaagttacaattgcccaggttcaaatcccagctccagctcttaatagctgtgtagcctgagcaggttactcgactacttatgatctcttcctcatctataaaatgggggcggtaacaatagacttggtgggggcatgagcgtgataacatttgagaaatactctgcagtgtttgccatagaaaatagtcaataaattgcagtattgttgttgttgtcgtgtaaatgtcaatatcattctcattaaatgaagttttctatatccgtaaccacagccccacacccagatgcaagtttagcacacttggtgaagaatgcacaatttgaatttgaattttctacatcaaactagattctaggccaggtgcagtggctcatacctgtaattccagcacttggggagactgaggcaggtggatcacttgaggccagaaagtttgagaccagcctggacaacagggcgaaacaccatctctattaaaaaaaaaatacaaaaattagccaggaatggtggcatgcacctgtaatcccagctactcgggaggctgaggtggggagctcacttgagcctgggaggcagaggttgcagtgagctcacaccactgcactccagcctgggcaacagagtgagactcgggtgtctcaaaaaataataattaataataacaataaaataaataaaactaggttctaattaggattaggttctgatcctgtagcaacacaagtgcaggagagagtggcttatgggagaacaggagcattacgacactggcaagggtagagaatggaaagctctattctttgggtcatgctctgtttttcaggggagggaggagccgcagattcccgactttcatgctgaaggtggagctgcacacattcccagagtgggggccaggatgggtgagggcaacagggtgcagaggccattttagatcttgacgtgtgtgctgtgtaggcaacacagaaacggtgagtcacaggtgatcgagtccctggctccctggaggaaaaacaagtgtggtttctgaggggagcactgacccggccaattctggtttcagaggacctgagctgcttgccctggtcgtggtctctgcaaacaaaaatgaaagggcattcctgggggaggcattttgcagccctcttctcctactcccacctatcccttaagaaagatwmttctccatrtgaagaaccacttgtgtcagttacctgtgagaggcacagacaagtctttctgacttctcaagagtgtcccaaacaagttagggttaaggattacccaggcttccatggagaagggtgccttacggaagaggtcttgacttctcagtgtggaagaaccttccaggtctcagctcttactgcttgaaggtccttggggtttcctactgagctctgcctctcctccttctaagaggcaagctgcctcacccaggccagggccgctctaaatgcagcctgtggacacgctttttgcttcctgttctgctcagcagtgctttaactgggcagtgtgttactggattgatgattgaccaagactgcacacctcaacgttagcaaacacctggaagcttgtttgcagggcctggcttttctcttgtctccaacaccctagtgcatgtgctgtgtcactatcatcagaggtccaaattcaagagtctgttttcttgttaatataataacatgtccatcacggatcttggtcccccaaggcaagagtggagtatggttaaaaaggaatgcagggaagggaaccagtatgtgcaagtcttggctcggtcattcaccagcagtagtgtggacaaattgcttaacctcagtttcttcatctgtaaaatgggggataatgatgcctacgtcatagggttggtgtgaagattgcttgtagcactgttgttctttgggtcagccctgttctaggaatgacaatctctgcatgctgactttcagtaggacgtgccttgaaatctttccccaaggactggttttggaaataaagccaatccatttgaactctctgttgtactgtctgcccctacccacccccatgcccaaatgtcacgcattgacaaaaaactggccaggtttagggttgtagtctgtgcatgtcgaacctttaaaaaaaaaaaaaagagagagaacaaagcaaagcacatactggatactttcacagtatcaagcagtatgtcctaatggtgaaaagctcaggctgtggcggtagatagcctgctttcaaccccaattctaccacttgggcacacttcttaacttctctaaatttcagtatccttctctatgaaatagggataataataccaaccttatagattataggtatataaagaacctagcatagtgaagagaccataaatgacagcattaatgtaattcaggctctccaaattatcatgtaaggatcaccactgatacccttggcagtgccctagcttccatcagtccaggagccaaatagaaagtaatggttgtagccgggcacagtggctcacacgtgtaattccactattttgggaggtgaggaaagataattgcttgagcccaggagttcaagaccagcttgggtaacacagcaaggccctgtccctacaaaaaataaaaaaattagctgggcacggtggtgcatgcctgttgtcccagctactccagaggttgaggtgacaagatcgcttaattccaggagttcgaagctgcagtgagctgtgatcatgccactgcactccagccttggcgatagagtaagaccctgtctcaaaaaaaaaaaaaaaattaaaaataatagttgcattttagaatgggaagtaacttgatcaaggttgcccaaacttagtaagtgaataagatttaagctccagcaaaactggattttaactctggctttttcacttatgagtcaagtgacatagaaatagtctcaactcttctgaagatcagtttcttaatctgtaatacagggactgatagtaataatgcctgccctacttgtgtcattatctattaaggacaatcagtgaaagcactttacaaatcctaaagtcacacacatttaaattatttttatcattggcctccacacttctcttataccattaaccaaatgctgaaatgtcagagaaattactgtcacttggttgactttctccaaaggaactacattacccaagagattcagtctgagggcaggctacggatttttttttttttttttttttaatgactggtattttgaaaaacaagtccagcaaacaggctgcttctctcttgtttgatgtggtcagaattccttcttggtcatgtgaccccctaacatttcttgatgcttattttaaaaacacaaacaaacctgtttggtttttgctttctttctttttcaaattaaccttggacactatggagttgaccggaagggcagggtgggagatagcatcttacctgggtgctggtgggagagctatcgtctgaaaagctctgggaagtgaaagatggaagaaggaaagttgagttactcagacatctggtgcatcctaaccctaaagcacctctcggggttcctgatgctctcaagcacgcctgggttcagaataagaggggccagtcctttcttcataataactttaaaaattattttgaggctgggcacagtggctcacacctgtaatcccagcactttgggaggctgaggtgggcacataacctgaggtcaggagttcaagaccagcctggtcaacatagtgaaatcccgtctctactaaaaatacaaaaatcagccaggcgtggtggtaggtgcctgtggttccatccactcgggaggctgaggcaggagaattgcttgaacccacaaggcggaggttgcagtgagcagagatcatgccactgcactccagcctgggcaacagagctggactccacctcaaaaaaagaaaaaaattattttgaaactataagtagtaaactaatgtatcatggaaaaagtgtaggtgtgtttaaaactgatcgcgcccttataattacaattagagttaatgggaaaacattggaaacatttctgataacatcagaagcaaaataagcacatctattacagctgttattgtttaatactgtaagttctaagcaatataataggacatgtagacatatcagtactagcaaggaaaagaccctgttaccatcagatgcttgtattacaattacatacttggaaaaaaatcaatgaggaaaagacactagtaggattcagtgaagtggtcatgtacaaagtaaatacaccaaaatcagtagctttctcatactaatctgtcattaaaatataatggtgattacaatataggatccttgaccaaaaaagaaaaaaaattttgtaatgtgtactggagatgtggaaaaagtagagaaaccttrtaatggctaatctcccccaacccttagtaatttctgaagctggctagtaactcagacagtcaacaatagatgcaccatgagggcagggatcactgtctgttttacttactgctctatccccagcacctagaatagtgtctgtcccacagtagacacttaataattgtgtttttttctttttttgtagagatgatttcaccatgttgcccaggctggtcttgaactcctgagctcaggcagtcctcctgtcttggcttcccaaagtgctgggattacaggggtgaagcaccatgcccagccaataattgttattgagtgaatgaaggaatgaatttgagaactagtcatgccaaggaatcgctaagtcacatcrtgttggaaactgctctttgtggtccawgtccacccatgtttctcttgtttttttctctccatcagatctcagtctcaggaggaggtttgcccccagtcagcaccttgacgaatatccacagcctctcccaccataatccccagcaatctcaaaacctcatcatgacacccctctctggagtcatggcaattgcacaaagtaagttctattcttggttggaaaacytgggggcagggagaagaagaatgggaagcaaattaatgtggtgaaaaataactgtaggtctccttcaaactcacccacgactagtagatttggtttaacttctttagtttctcatctgtctccttaaatccaatatttggattgtttagcctaaaacaagagaaaattgtggaatggatttggatcctggtcacagtttagcagctgtgcatcctgggtcaaatcattgaaccttcaggagattcaatgtcctcatctataaaataggttgttaaagtgatcaactgacagtgaatatgaacatgcttataaatctctaaagcatgaatatgtataacatcgtagcttacactttgtcttgagttcattcctatcactaagtaggtggtagatttttcaggaggttctttctgtttggtgatgatgaagtaagaatgacaggtttccttctaaatggggagttttgtgtggtatatgaaatctccttggccagcagtgaaaatacaccaagggaggatccagagggaaactgccattgtatctgagagctttgaaaactttaaggagaaaaagcttgctttggcacatcacacgcctgaagacacggagatggatcaggtccctccagctccaggaggctcatattcaacagcaagcctgtgccctcccatacatgggccatcttgaggcatgagaagkctgaagggaactgtggttgtggatatctctttgagagttttaatgttgatgagtattcagcatatttccagcttcactatgacagctcaggtgtcgttgtttctcaaaascatccttgtgacccttggatgtattgctggatgtcttgggagagatctaagggtaacacattggtcatctttctttcaaccttgtattgctccattgtcctcttaccttccttgtatctagggctcatgttggccacctctttgttttgtttctgcctttttctttcttccctcttctctccctaaatcagctttagctagggtcggaacttggattctcacttctgaagagaatgacttacacatcctttgaggtcagaacagggctaagcccattggaggcacacaaatttattgaatatgtgtggctctcactctatccttagctgcttggaaattgacacacagtgcattgattttggcagaaggaaaatgggaatggggaagcatttagagaactcayaatataaatgatcattttaaatgtattgccttttgactgrgccctctggtatatggaatatggtaattatactaataccagagtttggaatgagataagatacctaaaaccagcttgtttgccatttagaagatttgattaaaaggcccgtggggaagatattccacttatttctgcaaccaaaataataaacaaactgtcccacttaacttctttctttccattctaagctttcactgccatacagttatatatatatatatatactatctgaattaaaattttccctggggctagtctgcatctttccattttgttctttctaatttcctctactcatatttctctatcatttcacgatgctccttaatctcctattcagatgggctgcaccagagtgcacactgacctcagaaggatggctgtgtgtgtacatatctgtgtacacttggggtagacagagcatgagaaatggtgagaatcaccagaagactgctgagacacagaggtcctacactatggagtgttaggatgagaaactggttgcaggcatcttcatttaactgactgatgtgttgagtaccatgggccctgcctcagaattgcggaagcctgtggagaaggtggtaacaaattatttggcagggccaattccttattctctactcattctcacctcttcatcctattctctttctcatctcttccctggactggatagcatacttcccaagcaagaaccagtgcccrgaaacagaaacagatgaaaaggtcaagacttacccactgagggagctggaatgacatcagaggctctcaatcctggaattgaggcacatcaggatcacagactgcattgaaaataagattcctgggccccacctctgaaggttctgactcattaggtcttgggtggggcccaggaatgtatatttgttaaagagctcccccagatgatttctgaagcacatgcaggtttcagaactatgccttcaaatgtcatccactctagacaggatcatttgcttttttgggcagcagtttctcaaaaagagcagcagcagtgctctcaaagatttctcaaaaacggcacattcatggagctttctgggagactgagaccataagcaggaggtaggaaagggaaacacggtcatcggtcatcagggtatctggtgagatgctggcttgaggagacgctgagccccctggggaactggagacagygctgttctgagggtgatcagagggtggcasccccagcccccacccaggagagccagaagcaggattcatcccctgtcctttctgctcaggggtctcgccttttaggtttctgataacagtatcagctaaagctctgagtaggcaattgttgaggactcygtgttatctccattgatgacttccctcaaacctgcctatgaaaccgtctccatttcaggaaagcctctctaggtgtcccttccacatccacctaaaacagacctttttctggattccttcttcatcccattcttcccccaacttcccagaaagcaagaacacaggaacacaatcgaccccaggaagcaggtccaggtgtcttctctcctgatcgtcctgtccccactccsatcctaccttagctgtcttcctccgtgtcgctctcagggaggagatagagcatgggtaccaggggatccaatcctcagagtgctggcccgggttctaaagaggcctcaggatacacagttccaagttacagaggccctgacatctccagaacagaaagatgggaagacccactataaatgccaagagtcaacctttaatgtactacttcctctttctaaaacctggtccttttagtgccacaagccctatgctgccacataagatatgcccgcctcgcagactggctgagttccagtgttttctcccctctctgttacagtcaagggagttggcacctgatttctctgggggtctttgtacagtctactaaataagggtctcccaacctcatactcccgggactatggamgttgtttttagtcaaaatttgggtccctgcacactcctgccctctactggacagaccgatctgggcaataacctgtgcctcagtgtggacatctttaactctgccctgcgggcaccagggcaagcctctctcacagcctggcatggatggagtgggcaggtagagccagcttttccaaagccctggtaacctcaagagagctaagtttgggaggtcacaggatgactctgggagactctcaggctttaatcagatctgtttaatgcccatctccaacccacaactcattgtggaacttgagcaagtaaattaatatctccaagtctccgtttctttacacttgcctcccatggaatctcctrtgtaacaggctcagyccrgtgactgggacattgagcgggggctcaaatgatggcatccatccacctctccttatcccaggagctgtctgtgatcttttcctcttgctcccacaggcctcaacacctcccaagcacagagtgtccctgtcatcaacagtgtggccggcagsctggcagccctgcagcccgtccagttctcccagcagctgcacagccctcaccagcagcccctcatgcagcagagcccargcagccacatggcccagcagcccttcatggcagctgtgactcagctgcagaactcacacagtaaggacacgggcatgtggagggagggagcactcaggaccctcagtggccaaccactttccctctctgggtctgaactttctcggaagtttattggcttggtcrcttttccctgcctatgatcaaccgactaagacaatttctcaagcataactcttgagtgttgctgtaccttttctagtcctcttctctacccctgagattcccagggaagggtttgaagaggacagtgtaggcctacagatgaaggggaattggagccagacagcatgtggaacacacaccgccaatttcccattccaacacctctggaaaagatcgcgtccataaaccaccagcaccttttcccagtgaacttcaacttagcctttgcaatctaaacttccaagcagccattatcaaatgatcacaattggcatctaatttgcatcctgtttgccttccctaaaagagaagaatcttctagagtcccrtgtcctccaatttatacaccccaaacatctctaatcaagaaccatgaacacaagtgaaaaataccagtggcatgccatcctgggcattagagtttcttcctccatgccacccctgcatctctgcacacagactgtttctcatatccaatttctatacctaccccaagcctacctttcgaccacttatttcccatccaatcccatcctctgtttctctgcctttcatcctgagtcccaggcttccaatcctctggccaggtctggctatagcccctgacacaggagtttgggaggaatcrtggcttctctgcttcagaaaccccaaggaagtgttcagtataaagcactagtcttagatcagacagacctggatttaaatcctggctgtgatacttaccagctgtgtagcytaatgcaagttacttagccactctaagtccaatctctacatccataaaatggaaatagtatgcatttagagtcattatgaatatgaaataaacataggggtaaactgcgtttggtaagcataaaaaattataaagattatttataaagggactcttagaaggcaatgatggtgaaagaggtttgtgtttcttccctagctgcatcggataagctgtgggtttgrgggagaacagccaagtccagccttctatcttcagggctcaatccccactcgggcctgtggagctggtttctgagcaccatctcacattccaatcacattttagtggcttctgaaaatctgccacagcctgtagsagagtctgagaccacatgtgccccacttcccttcctcccagagcctggtgatgtgctccccacttaccccatcccttcacctggccaggcttcctcagtggcgaggcctgggtgggatagtcagagagtggtcaccagcgacctgtggactgctgaggcccagcaggcctggccgcccatgaagagagagcccatggtgccctggaccaggaaataacctgcctccctgcatgagaagggcaagccgaggcaacagccagtgacctttgctcccrttccgtaccggaggcctccctggtaggccctgtgttctgagagcaggtggtctctccctcacagccaagcatccacatgctttcgggagttggtyatgtgacttggaatttacatgaatcttatggataactaatatgagaaatccccactataaccaccagcccttttrtctacctgaggagatgggagctatggtgtgggatgggggctctgtacctgtgtctktscctgtgtatgcaccttgattytgtcttcactctgtctctccagtgtacgcacacaagcaggaacccccccagtattcccacacctcccggtttccatctgcaatggtggtcacagataccagcagcatcagtacactcaccaacatgtcttcaagtaaacaggtaatgccagcaggatttgcgggggttggggtgtgggcagggtgtgataaggccatggatgtgcagaggttgtggcaagcatggactcrgccagaaattagrtccttctgaggctccctgttgtttgcaaagggaatccttaaggtcccagggcaaaaaaaaagggccacaggctgaaagggcttattgctcccccagattccccaggaagagcactaaacaaggacagaagtttgataggttgctggagactggatgacatagagygcttaggcatttagattgagtgttccctaatagaatgatcaatggtccatggaaaaggtatttccaaggagggctcaggaggacagatyccctgctgaggttcatgctttgcaagagggatccctgaggatccacaaagtagtcagcggagaaagtgagtaggaagtcagaggtcctgaggctgattcccctggacccagaatgccataagctctgggaatgacccagttgtgtcaacccatggggactccccagtagacagcctggcttttccaggggtaagcatccacttggggttttatcaagaaatttagaatcaacttcctgctgcactgaaagtggggaatccagaggcttagtcactgtttcagttgatgactaagtcccacctctgaatagaggtgatggaatagtagacaggcagctgatggcgaggctcattgctgcagcttggacagctggactgcaagaagacaccgagagttagaaaacaggacaagatgtctgaacacaggtgatgattccagagtaacacaatgagaccttttagtagctggggtctgtgcagtgtgggaactgtttggcctctatcgattactagataagtaggtgrcaaccttgaacttcatgtcagaagctctcagaatttggtcttgttgawggtctttttttcatctgagccctgcaaatcacacttcatccactgccatgggcttcccaggaggttccttcatgggatcagggttctctatcctttcctttgccccratctccttccagccctagagtgcagtggagcaggtgggttctattcctggttctgccatttgcttggtgaccttgacctccctgagccttcatttcttcatctttaaagtgagagttgtaacatctgctttttctgaggattcagcaagcttgcgtagattaagtaactggtgtcttgggcactgaaacacacacacgaccagggcagctgggctctggagctgggggtagagggagaggtgtgtgggacctgctttgccactcttctctcacccaatagaagatgaaaggacaacccctcactaccctgcccttcgactcccgtgcgagttcccactctttgtagtgggcagggaaaacatttatctgtgctcacaaatctcaatcaggggggcagccaggcgcagcggccctccttgggaataccttcccctttgaaaggtttatcaatccatctgccgcttggtcagccccagacaggaccatgattaattattcctgtctttcccaagttgactttgatggttgcttgttgaaacaagtcgtctgaattcaggaaatggtctcttaatcaaaatactttaagatgctccctgagacgctgcaccagccccccactggcttctcctctccattggacagagtggccagccaaccttgaagctgcatgagtggcctcccagaactgctgtgacattgtctccatgtccccagacatttcaggagtctggcaatagactcatttctgcgatgatgaggatgattattacactcagtaaggatgaaaaatactcacgtggcacgttacagtttatacttctcatgaacattgtctcattgttttctttttactgcaacctcctaagtacaaagaaataaactaaaacccagagatgaagagtgacctgcccaaggtcacacagatgataaattctagtgctggaccttcaggctttggtctttgactccacatacttgccttccactaccatctttaaaattctacggtaactgctgccactcttgttgtctttgtggtcaggaacaagagtaaaaaataagttcacttgccatattccactcaggaaacgttcttccaacaagttgaaagagaaggaggaatgggaaaggcacagtgaagtaaaatgagggtaaaggtgctgcctcctgacagcagaaggtacccaaggtgaagacagtttgtacaaactctgttcctaaggcagagggtcagaagtgagttctgaaagagacctgatggcaattctgcttttttggttttgttttaaggtcttatattccaacaggaatttcaaattcatttctggcgtgttcagatttattgcttatagcgatgtctgtttgcttcgctataaagaaatatctgaggctgggtaaaagaggttcaaaggctcatggttctgcaggctgcacaggaagcatgatgccagcatctgcctctgctgaaggcctcagaaggtttacaagcrtggcggaaggtgcagacagggcaggtgcatcacgtggtgagagtgtgagcaggagggagaagggagaggccctgccctgggytcttatttatttatttatatttttatgttttgagacagggtcccgttctgtcacccaggctggagtgcagtggcgcaatcacagctcactgcagctttaacctcctgggctcaatcagtcctcccgcctcagcctccagagtagctgagactacaggcgcacaccacaatgacaggctaaatttttgcattttttttgttttgccatgttgcccaggctggtctcaaactcctgcgctcaagtgaactgcctgccttggcctcccaaagtgctgggattacmggtgtgagccaccatgcctagccctagactcttttaaacagccagatctcacgtgaactaactcaagcatgaattcctcacccatcaccatgatccattacctcccactgagccccacctccaasactgggaatcacatttcaacatgagatttggaggggacacacatccagaccatatcattccacccctggcctcccaaatctcatgtccttctcacattgagaaatacagtcatcccttcccactagtccctgaaagtcttaactcattacagcattaactcaaagtccagagtctcatctgagactcaagagcaagtccttccacctatgagcttgtaaaataaaaaaactatatacttacttccaaaatacaatggtggtacaggcattgggcagacgttcccatcccaaaagaaataaattggccaaaagaaaggggtaacaccccatgcaagtctgaaacccaacagggcaggcattaaatcttaaagctccaaaataatccttgattccatgtcccacatcctgggcacattggtgtgccaggtgggctcccaaggccttgggcagctstgttcctgtggcttttccatgctgaggttgcaagctgctagtggctttaccattcygaggtctagagggtggcaggcccattcccacagctccattaggcagtatcctggtagggactctgtgtgtggggcgggtggggctccaatcccacatttcccctcagcactgccctagtggaggttctctgtgggggctctgcccctgcagcaagcttctgcctgggcacccaggctttctgatamagcctttgaaatctaggtggaagctgccaaacctccttcactcttgcattctgtgcatctgcaggcttaacatcacatgaaacccaccaaagcttacagactgcaccctctagagtggtggtctgagctgtacctgggkcyctttgagccagggctgaagctagagcagcatgtatgcagggagcagtgtcccaaggctgtgcagggcagcagggcctttggtctggcccccaaaaccatattttcttcctaggcctctgggcctctagtgggaggggctgcctagaagatgtctgaaatacttcagtgccttttttccattgtcttggctatagcatgcagccctctttagtcaagctaatctctctagcaagctgttgctccataggccacttgaattccttctctaccacagggttaggctgcaaattttccaaacttttacgctctgcttccctttttaaatgtaaattccaacattccaaatgtaagtcattcctttgcttccgtagctactgtgggttgttagaagcagccaggccacatcatgaatgttttaccgcttagaaatgtcttctgttagataccctaggctatcattctgaagttcaaacttccacagatccctagaatatggacacaatgcagccaagttctctgcctgggcgtaaggagggtgacctttgctctagttcccaatcagttcctcatttccatctgagatctcatcagcctggccttcactctccatagttctatcaggattttggtcacaaccacttaacaggtctctaagaaattctaaactttccttcatcttcctgtcttcttctgttcctccaaactcccaatctctgcctgttacccattgccaaagctgcttccacatcttcaagtaycttttttttttgcggggrgggggggcggcggggcggggggayggagttttgctcttgttgcccaagctggagtacaatggtgtgatctcagctcactgcagcctccacctcccaggttcaagcgattctgcctcagagtcctgagtagctaggattacaggcacaggccaccacgcctggctaattttttgtatttttagtagaaacagggattcaccatgttggccagcctggtctcgaactcctgacctcaggtgatccacctgcctcagcctcccaaagtgctgggattacaggcgtgagccactgcacctggccatcttcaagtatctttatagtaatgccccactcccaggaccagttttttgtgttagtccatttgcatcactataaaggaatacctgaggctgggtaacttaaaaagaaaatatgtttaattggctcatggctctgcaggttgtggtgccagcatctgcwtctggtgagggccttaggaagcttacagtcagggcagaaggtaaagggggaataggcatgtcatatggtgagataaagagcaagagagagaaagggaagatcccagactcttaaacaaccagatcttgtgtgaattaacttgagcgagagctcacttatcaccaaggggatggcgctgagccattcataagggatctgcccctgtgatccaatatctyccaccaggycttacctccaacactgggtatcgtatttcaacatgagatttggaagggacacacatctaaaccatatcactaggtatcaaggacatacgagtgaggggagagaaggatttcttggtcaaatatgttgggggaactgctggattacacaaagttaaatgctactgggcagggcttctcagagcatttcacttgctgatgtgtgcactgaaccgggcaattagcgtgcaccctgctcgagtcaaagggacacatcctgagcagtgctattttagaggtattgtacagtggtaggaaacgccagcagacctgagctactttcagcttcatcaccccctggtatgtgaccttgggcagttaattccctgtagggagactcagtttcttcatctataaatggagaaaatcccacccccatctcacaaatattcaatgtgccttacagaatggctagtacatagtcaagtattcaaatggtagccccctccctgttttctctcccggtcttgaatctcttagaaataattgtctcccctttcagagaccctttttttttcttttttttttttgagaaagggattctattcttgtccccaagctggagagcaaaggggggggcctaattaaatgcacctctccctattgggacacacaatcttcccgccacctctcaagaatggaatacagcgcggccccccactaggtatttttgtttttataaaaacgggtttatttgttggccggcgtctcattcccaccctgaattcccgcctgcctcaaaggtggaataaagggagccctgacccgctaatatcttannnnnnnnnnnnnnnnnnnntctcccaccaggccttacctcccaacactgggtatcgtatttcaacatgagatttggaagggacacacatctaaaccatatcactaggtatcaaggacatacgagtgaggggagagaaggatttcttggtcaaatatgttgggggaactgctggattacacaaagttaaatgctactgggcagggcttctcagagcatttcacttgctgatgtgtgcactgaaccgggcaattagcgtgcaccctgctcgagtcaaagggacacatcctgagcagtgctattttagaggtattgtacagtggtaggaaacgccagcagacctgagctactttcagcttcatcaccccctggtatgtgaccttgggcagttaattccctgttgggagactcagtttcttcatctataaatggggaaaatcccacccccatctcacaaaatattcaatgtgcctaacagaatgcctagtacatagtcaagtattcaaagtggtagccccctccctgttttctctcccgtctgtgatcctttaggagatagttgtctccccttccagtgactcttttttttttttttttttttttttgagatggaatctcactctgtcacccaggctggagtgcaatggtgtggtctcagctcactgcaacctccgcctactgggtacaagcaattctcccgcctcagcctcccaagtaactggaactacaggcacaggccaccacacctggctaattttttgtatttttagtagagacggggtttcactatgttggccaggctgctctcaaattcctgacctcgtgatctgcccgcctctgcctcccaaagtgctggaattacaggtgtgagccactggacccggcctagtgactctttcaatatccaattcagtgcttggtctacatgcagtcaaaggaggctgggagaagaaaatgtctcaggattactaccatctctcaagcacatcctacctcttgggcctgggytccggatccctgtttcccattctcctgctgatacacagactccctgctcacctatttcccaggaaaaaagcaaatagttcagggcctgtcaaagcacccataccctttgggcttagccaaatgcctgggctatattagatgttcagtaaataacaaagaatgaatgaacgaacgaacgaatgaatgcagaacccgtgttttttgatgcctccattttccaagcagcaccccagatgcttttctagcttacatttcctggagaaccctcttacccattctgcaaggtcgttatttttatacctgatttacaaagcagaaaactgaggttcaaagatgggtatggatctggtcaagttcaaacagatcataaattccagagctggacttccagactggctttctcactccaaactcattaaacaacgttcatcttccaatatccacttttaagcacccataataacaacccaaggttatgcaggtataaggctaaagccaggatttgtacttgtatctgtctgatcccagtacttcctgttgtcaaggcagacatgccccaagggccttggggattacaggtcaggaaccccaggctgggacttctcgcgccaagaatccttctgcatctactgccatctgtcccttccagagcacatacgtctccctccttctcaactcttgggtgctggcaagttatctctgagtgggtttgtgcktgagttcaacaatgcccckctagtctggaaacaagaccacagcaaccactgacctcagttagaacaagtgcaggcaggttgtgagccaactcctgtttccacagtgttctctccccgctgcttgacttcctagtttatgggaaggtgaagagagggcccccagagcagtaactagtcagggcactgacaagggggcaggtgggtggcctcatcatctatccccttcggctattcctctcccagcttcttcactgggtgaggaagcagagtgttctgatggttgggagcatcgacctrggagttaggcagatctgggctcaacattctaccactttctacctgtgtgacctcagagaaatgtcttagcctctttgagcctctgtttgctcacctgtaaaatgaagataatgatacctctttcatgggatcactgaaaggactaactgcacgaagacctgtaaaatacttcactcagcgcatgtcccaaaggaaacacccagcccatggaagctgggtcaytcttggcttcccctgctagcacccctgagcggctctgagtttgggaaaagggtcttacgtggcaaagggcatttatttccccgtgttgagggggttgaaagaagtgctcttacataggggtgaagagcacaagccttgctgttgtgagaccccggccaacttacttatcacctctccaggccacrcttccctcatctgtaaaaccggaattataatcatgacttttaattaatggagccacaatgaatctcacataagttcatggtcatagaagtgacttatctgtcctcactgtctccacttcctcaccctcaattctctcttgagatcactgcagactggcctttatcctcacgcctcactgtgtccagctcacgatcccctccatgctgctgaaaccaatggttacttttcaacctctgtctctgacacagctgatctctccctccttttttccatgggagtttgggatactaccattcctggttcttctacggcactggccacttctcatctcctcagctggcaactcatcttcccaatatttatgtgttggagggccccgggcctcattctttggcctcttctcatctgtgctcactcctgggtgatctcctccagtcccatggctttaggtcaagtgtacacgccgatggttcctgtaattctgtgtacagtccggtcttmcctactgagtgctcactcacagatccagtgctgcttcggcagggacagacgcatgtctaaaatatctaataagcctcttgaattcaacgtgcctaaaataggaactcttcattttgccctatttcatcctatcaaaattgcttcccccatgggcttctccatttccaaaactggtaccagttgttcaagtgagagagctgagagtatccctgattcttctctccacatcacatcagtctctcaataagttctactaggggaccctcagaatacatcctaaatctgacctcttctcacactcccatcaggactgccctagtcccagcccaggcccccttgtctctccctgatctccttaggtggcccttgcctgtctcccacttccacccttgccccactgggggctgttcgccagagtgatctcttacaaagagacatcaagcatgtcaatcccctgtcaaaactctccaatagctttccatcacaaccaaactaaaacagagacatacaggaccctatgtgattatgcccctgccagtgtcgccgttctcacctccttcctccctccatcacccgctcagctttagctgtgccagggctgaagagatcccactccaggactcctgcatttgtggtgtctgcctggagctctttttttctgtgcatttttacatgcttgccccttcacttcattcagctcaaatgttaccatttcaaagaggcctcgcctgattcccatatctaagttaatctctttttcctcaagctgccctaacctctatgcttatttttctatggagtgctcatctccmcctaaagttgtagtgtgtgtgtgtgtgtgtgtgtgtgtgtgcacgcatttgtttacttgtttattattcaaagccttcactaggaggtaaagcctgtgaagaagtgggcagggtgttgtttacagctgcatctccagtgtctaaaaaagtgccaagtacacagtaggcactcaaacgtgttaaatgaattcacgataatcacctacttcaaagggtcgacgtaagaactcgaggcagtgatgcttgtgaagcccttggtatggtgcctggcacacagtaggatgtcrataaatgttagctcttaccattatgtaacaaatcctcttagaataaggatgtccttcacatttgccacagctaccacacctttcagacggagggccccgcggtctctcagagatcttctgggccaggcccccgtggggctgcgtgtgctgggcctccagttctaagggaccacagtgcaccccttatcagatgtttgtgtttagactctgraggaggcaaataactctagttcttttgacaacattttgggctctgccaccattttattatgtgagcaaacatttgatagctgggaagcccatccctaatgacaggccatagaatctcactggcgtctccttatctgcccttcttgtttgctcttcttttgaaacctgcaaggtcacaagccgttttctctctcctccacctgaaatctgaaaattggaaaaaggctgatagtgggaagtaaagagacttgagagtgggggtgggccaggggaggaagaggaggcaaagggtatcagaggaccctgaccaacgtctcaagaatgtggaagggtcagaagcctgtctcctcacatgcacgcactgctcagcccccctcttttttttttttttttttttttttggtgagaccaagtcttgctctgtcgcccaggctggagtgcagtagcataatatcggctcaccacaacctccgcctcctgggttcaaacgattctcttgcctcagcctctcaagtagctgggactacaggtgtgcaccaccatgcccagctaatttttgtatttttagtagggatgtggtttcactatgttggccaggctgatctcgatctccygaccttgtgatccacctgccttggcctctcaaagtgctgggattacaggcgtgaggcactgcgccaggccttcagccccactcttaagagtactgaggagcagcaggggcttgggcygaagaaccccatgttaataataacaattgtgccaaggaccatgctcaggactccacaggtgttgactcatctaatcacacaacaactcccatattataggggaagaaactgaggcacagagagagtaacttgtccaagagcacaaagcttagtagaaggctcctcacctccaagcatgattgaaagagcacatgctgagtggccacctagacagctagtttgaagctgtggctccacactctcctagttcttaaaccatggacaattcactgactctcttttagccttgttttcctaatytgtcaaatagacataatggtatcctcatatagggttatggttggagcactgatcaatgcgataacagtggcctttagtggtattggtaggtgtaagtgtgtgtgtgtgtgtgtgtgtgtgtgtgtgtgtgtgtgtgtgtgtgtttggggggatcttgagagaataagccactaagtcaaaggcagaaccttagatgccggcaaaagcaaaagggaaggaggagacacagggagacaaaaagagactccccagaagtgaaaaggaaagcagtgacactccatgacagttcaaatgaataaggcccaggcactggagggcaaggctgccctgagttgggtgaggtggcttctctcgagggcttctccagccattctggggtctcctgccctggcccacccacaaggatggcatcagaggccttcagcctttggatcctttccctggtcctctgagtttcttatgctaaagtaagaaacccgtagaaagcactttgcaatttgcaaagctccttcctgatgagtagtttgagtggtcattttctcgtgtgctttctggccttgctgccctaggtgagcagcactggcacaccctgggaacttgttagaaatgcagactcttaggtgcaccccaggcctacaagtcagaattaaaccagaatccacattttcacaggctctctggtacttgtgggtccgttaaagttcgagaagcattagtataggaggcctctgctcttagcggtcttaggaagagacccttgcttccacgagaggcaagagctcaccatccagctgccttttcaagtacactaagcactctataaatgccactgtcacagaaagaggagcccagcttcaggattcaggtcagcaagttaagactacttcaaggtccccagcaattcacttctttcttctgaagtggccaggaaagccggctcccgggttttcctgcaggaagtgtgcctcagcatgaaaactgcagaactgagcagacacgaggcccccagccctccacctgctgctctttgctggttgagttgggcatcatctcccttagagaagccaaactaatggcccatgaccctgccaaatgacacagctgagcaccctctctcctctctctctgcagtgtcctctacaagcctggtgatgcccacacaccacttacttcgtgcgcaacaacaaggaccctgttttccacaccatcaccctctgggcagctgtcatggaaaagcccagtgacctgacmrgcacctgcgagaggtccctgcttacctgacggacgtcctgctggcacctcagacaatccactctcaggaggcgcagcccgaagcccagtttcccttctatgcagtattgccacaatgcctctcccacgatgtcaaggactcctgtctgtcctggaggtgggagacaaggaaccwccgaagaggaagcaagaaagccgtactgtctatgttgtgatccttcatcgaacaaactgatgcgaaaacttgaatctgttactgaaatgaggagagaaggacatgtgctrttgaactgagccaaacacactgtaaatatccacagactccctcccctgcccccatcccamatgatcttgagatttcttttaaagaagtaaatttgtccaatggctgtaaactataaactactgtaattaagtgcaatttcccctctgtgtcctctcccctctgccctgtatataatactaaagtgtctattagttttctttgtaaaggtcagagtcaaaatttcaaaagtgatctgtcccctctcccctcatggagaaacatcctaagtgggaagtgaagccccttgtcctctcccgcgggcctggacacttatggggacagcataccttggactgactaccagctaactccagtctcctgacattaagacacacctctggatccctggaggggctgaatgtagtgtgtcagagtaacatgccagcttcctgtgggccaggagctcagccgtgcactccctaagaaaccccagggcagggaaactggctgtttgatagcagaagaaaaagttgcagtctcagaaagccttccattaaaasaatttattttatcactacccagagtctcatatttctgtctctgatactttccctgccatggttccaccgagaacccctggcccctggtctccttggaattttctgtatactccactgggatcctgtagtgtgtcatctaggggtgtagagaggtgggtggccttctcttgccgtcatgctcccagtgtctgtgtaggctttactgctgattgaggtgaagaagagttgaatsccccagtaagactccacaagtcgctcagagggaatctggccagagcaggagctagcacccttttcttccctgcaactcacaggggtaaagtcatagagtcaattcttggtgggtgacatgtgatagaaacagacaaaaagtaggatgaatgaaaactctgcgggtaaattgtttagcctcatttaaagcattaattccagcctttcttcctgccctccttttccttcccttacagctctcagtcactaagtgaatgggctcttgtggacgtcacctcttgcccaagattctctctctggtggggatgctaaggaatacaaatagtccaaacagtaaaaagccaaaggcccagagactccaccagcagggactttaccacaaataattcagtgctgactccagaagaaaggaagatggacctgtcttctttgctgtttccttttttgccaaacagcataggcctactgccctgtggttcttcgcttttaggcagagcatgtcccaatgaaagtggaagcaaagattgtgctaaccaggccatgagtgatggattttttcaaaatcccattgtagtgggagattcaattctcagtgagctgggcaaatttactgagtacctagtctgtggccagagcagcaatggatggacaaggaaatactgactttaattgattcctagctccccctaacaatgtaatttggattgaaacagtgaagagaaaagttcatgactgggttgaggagggctgaggacaaggccgagcactgcatatggagagaggccaagatcccctttcattagctgagctgtcctgttggatggctcctgtgagctccgggaagaggaaaggaacataggcctcaagctccagccccaattgaagccctatatctggactcgtgttgtttctagaaaagcaagcatctgcttttgatagattttagatcttgcatttagaccctgaaaacccagaaggtcatatttatctaacaggtcatctgggcagaggtgtagatggaagagagggaggatggctgggttggggacagtctctagagagttttcctaacgaaatcctatttgaacgaagatatgtagacagctgaccctggcaactgagagccccaaggatggttagcttcacctttctaaatcaaacagggacctccctccactggctatacaagggccaaggggaatcacacactctgaagattcattggcaagcttcaacccccacaccttcctcccaccacctgatggaccaacaatctccagggtgtcttttcataccctgaccccaggctcacagacagatggttccatttttatcagagccagctgtcactttctagggtgagcctgaggaaggcaaatttcattttaacatccatggataggaaataaaaccagtactgaaaactcgccttaaactgtattaaacttttccatgctaaccagttatggggtattccaccaaaggcagagataacgcagtgttagctgctgaattcaggtagataagaaagaatacaatgcagacagtcagggaatctgagctcttggcccacagttgggggcaagtctttgaattacctttggagccaaaattccttgatcagaatctccaactccaccatttaacctccctggcccttagtgtcctgctatgtgaaacaggaatgataatggtagtacctactttattagattgtttgagaagtaagagggttaatatatgttaaacacttagaactgtatatacaatgggtattgtgtgttagtatcatctcaccccagagtgccttctcctgtagtcttgtgtagtcttctgggtttggttgacatttccagataacttcatcaccaacttgacgtttggttaaaaaaaaaacaaaaaaacaaaaaaaacctgccaataattggtaacgtttttgttcttctgtatggtatatggcaaatctcagtggtaaaccaaggctgagtcaggaaggagaggcctgaggagaagagaaaggcttcactggagagagtctttgtcctccttaggaaaagaagaagataaaatgtgatgatcttatatgagtgggagggccacagagagcactgggaagatggaactaaaactggctttgtgttctaaaaagtgggttggggatcatggaggaatccagtgagcaaggaagagtgagggtcaggaagaggtgggagctaacttctgtccaaggaaaatcagggtcaaggtgtcccctttgacttaggaattaattcaaacacgccatccaaagctgctctggaaaatgagatatgacatatccatgccttaatgcttcaaacacatcccaacagcatcacacaggctgaatatttatgagaaattgcaatcagctgaaccaagtgcctgttaggcccttcctccccacccccctccctcctcctcttctcctgggtgcagaggtcattctagctggacaaatactggattgtctgccgagatttataacatgactattttacaaatgaatctttagagtttgcaggactttgcacgtgcctggatgaacattcctttttcctgggtgcatgcctatagagaaaacactttctaagggagaacctgcaaagcaaatatgagggggaccacatcaaaagcaggaaacaccaaagcaggcttcacacgatctgcatatgtacgtttacgccaacagatcacgcaacacaaaaacaagatgtttctttcccccgtcttttattttttcaccagatacacactgttatattccccaaagaaagatttctttcctgtgccatattgtcttgacatcattaatgaactgatatattagattatccccaattaattatgaaggttgaaggtaataaatggataaagctaattttttaaaaagaccaaaaaataccagtataaggaaaacatgtctgatttcctgagccattacaagatcttctgtgtatatctttgcttttgtaaatacataattcaaaataatatttccccttcatttattcaagaaatacttactggcacttactgcatgtcaggtactatcgttctagacactggagatctatcagtagaccaaatagataaaaatccttaccttcatgaaccctacattctagtcagggagataacaaataaatgtgtgaatatatgtatgtgtatgtgtgtgtgtcagatgattttaaaaatctatgcaaattggccgggcgcagtggctcatgcctgtaatcccagcactttgggaggccgaggcaggcggatcacctgaggtcaggagtttgagaccagcctgaccaatatggggaaaccctgtctctactaaaaatacaaaattagccaggcatggtggcacatgcctgtaatcccagctattcgggaggctgaggcaggagaagcgcttgaacccgggaggcggaggttgtggtgagcagagatcgtgccgttgcactccagcctgggcaacaagagtgaactccgtctcaaaaaaaaaaaaaaaaaaaaaaaatctatgcaaattatagcaggtaaaggagatactaggggtagccatttatttttatttatttatttttaatttttttttgagacagagtctcactctgtggcccaggctggagtacggtgacacgatatcggcacactgcaacctccacctcccgggttcaagcaattctcctgcctcagcctcctgagtagctggaactacaagcacacgctaccatgcccggctaatttttgtattttttagtagagactaaacatgggttttgccatgttggccaggctggtctggaactcctgacctcaggtgatctgcctaccttggcctccctaagtgctgggattacaggcatgagccactgtgcccagcctggtagccattttaaacagtatggacaaggaagaagagagtggccactgagaacgtgacgtctgagagccctaaggctgctgagtcagccatrtggacatctaggaggagagcattccaggcagaggtaatagcaagtgcaaaggccctggggcaggaagagaaacatatagcagagccgctagagcagagagagagggatagttctggttcacagagataaacaggtgcaggggcacaatgacaaagggccttgtgaccatttgtaagcacttcggccaactggtgtaagaactttggcttttactttgtgtgagctgggagccagcagagaattttgaatacagcaaggacaagatacgacttctgttttaaaaggatccctctgattgctgagattttggggaagggagtgccaacagtgacagcaaagagattatcaggaagttgttgccataatctaagcataggtgatgagagctgatctgattctgtattttgaaggtacaggatttgaagataccaggatttcctgwtggtttagatgtagaatgtgagaaagagtgataaaaaataattccaagatttgggccctaaacaaagtaggaaatagaaattagtgttgttggccaggtgtggtagctcacacccataatcccagcactttgggaggccaaggcaagaggatctcttgaaccctggagtttgtgaccagcctgggcaacatagcaagactttgtctccactaaaaattaagaaaatccaggtatggtggcgtgcacctgtggtcccagctactcagaaagctaaggcaagaggattgcttgaggaggtcaaggctgcagtgagccaagattgcaccactgcactccagcctgggcaacagagcgagaccctgtctcaaaaaaaaataaaataaaataaaaaataaaaataaaaataaaccctgctgttgtagaaagtgaaaaacaatgttacacaaacataggctgtatcttggtttttctttaaagtggtaccttaggaagcatcttagtagtatgttatgctgtaatgtgatattatcatatccctaatatgatgtcaggctcttcagtaacatgacattcatttggttgatgtattagtccattctcacactgctataaagacatacctgagactgtataatttataaagaaaagaggtttaatcagctcacggttatgtgggctatacaggcttctgcttctggggaggcctcaggaaacttactatgatggtggaagtcgaagtggaagcaagcacgtcttacatggcaggcaggaggaggagagagaagggggacatgctacacacttcctttttttttttttggatggtagtttcgttttattttattttatatatatatatatttttttatcatactttaagttctagggtacatgtgcacaacgtgcagttttgttacatatgtatacatgtgccatgctggtgtgctgcacccattaactcatcatttacatgaggtatatctcctaatgctatccctcccccctcccccaccccacaacaggccctggtgtgtggtgttccccttcctgtgtccaagtgttctcattattcaattcccacctatgagtgagaacatgcagtgtttggttttttgtccttgtgatagtttgctgagaatgatggtttccagcttcatccatgtccctacaaaggacatgaactcatcattttttatgactgcatagtattccttggtgtatatgtgccacattttcttaatccagtctatcattgttggacatttgggttggttccaagtctttgctattgtgaatagtgccacaataaacatacatgtgcatgtgtctttatagcagcatgatttataatcctttgggtatatacccagtaatgggatggcggggtcaaatggtatttctagttctagatccctgaggaatcgccacactgacttccacaatggttgaactagtttacagtcccaccaacagtgtaaaagtgttcctatttctccacaccctctccagcacctgttgcttcctgactttttaatgattgccattctaactggtgtgagatggtatctcattgtggt

SEQ ID NO: 12358 - DNA, 44982 bp, Homo sapiens
caagtcctaagtaatctccttccacccaacccagataaaaatctcgcgcatacagagccatctgacttctcctaagtctagctcagaatgtctcaactgtggcaccattgacattttagactgaataactcattgtggggcccagtcctgtgcactgtaggatgttcagcagcatccctggcctctacccagtagagggtacatctcccaggagtacctctccccaggcatgacagtgaaaaatgtctcaagacattgacgaacattgattgggtctacaattgcttccagttaataatcatttgtctagcctcatattcaacccattttggaatttccactgtttttacatttggccacattttttactttctgaaattgttcaaaagcagtgtgtaaaattgtctttggccttggaatttcaaaaaccttgtcgttaccagattgtaaccctcaatcggcattcacttataatacgtccacattaacccctgatttagagtggggaattcatctggccaggttacacaagaatacagttgttcaaaactgtccttactaatacctgtattcctcttctgaatgccctccaggaggggttagccatgtgcagagttttgcctattgctttcaggtaagcacattccatccctcaagagggcacctctgtcatttaggtagcaagtaagagaaaacgcaatctaaaccgacttcagcaacaaagggaattttttggtgcaggtaaacaagaagtccgatggaatggcagcttttgaaacaagctgatctgggcttgggcttacaaatatgagtgccatttatttcagtttcctcttctccataagtcagtttcgtcttccaactggcttccttcagggtggcaaaatggcagaagcagttctggccttacgtccacacatctcattacttagaagataatgcctttctagccaagcaaaagccctgagcttcgtcgtaactgagctagcttttgtaatgtgcctaaggctgaagcatccaatcaatgccaacagaggaaggtcataggttgactggctgaggcccttaaaccaattacagtagctaaggggggaagtgatgtcaatgggttcagaacagtggttctcaaagtatgctccctgaccagtggcattaacatcatctgggaacttactaaaaatgcaaattcttgggcctactgatccagaaactctggaggtggggcccagcaatctatgttttaacaagccttccaagtgattctgatggaagctaaaatgcatgacccactgattttgaccatcaggtcctactcatggagcctagaaggggggaatcccactcatttccctgggctgtcacacaattagaaaataatggaatggaggcctgtgaagttaccatcgaaacacttcagaaggggatggccccagaagaggacagctcatttcacatcttactttctatgctgaggctgtggggtagaaatcacagtgatgagtactacaaattagcaaattggtttgaagattatttcagatgccaatattatcagtctaaggatcttgaagaaaaataatgataagcatcaaccttagcattttctatgggtcctaacctactcccttaggagaaatttgacaaattaatttacacaaatatgacagaagtaaacctacttagcaattaaacggcactgaagaagtcattctctaaaacagtttcttaatcatgactaatcctaagaatcaactagaatagggttacatatacagattcctgggttctaccctagaccaattgaatcaggatcatcaacggaggggcctgagaatctgtacttttagcagacatagccagtgatacacagggattatatatgtttggaaaatgcttcaaggagataaagccaaaaaaatcaaggagaaaaatctcatggaggaattatttgaatgcttctgactaatcaaacggtagtttcttccccttatttttattattattttttttgagacacggctccctgaatcacccaggcagcagtacaatggcatgatcacagctcactgcagcctcaccctccaggcctcaagcaattctcttgcctcaggcccccctccacccccagtagctgagtctataggtgcgcaccaccacgtccagctagttttttgtattttttgtggggttttgccatgatgcccaggctggtcttgaactcctgagctcaggtgatctgcctgcctcggcctctcaaagtgttggtattacaggtgtgagctaccacacccagcctcctctactttcttcaatgcactccctcactactggggcctctaactaatgtttcttcctctagtctgaccctatcccacaccctaaacaagttgctttccataccattgtcacagtaaaagaaactggatgtcaggcctctgatcaaaatctatcacaagtccttactatggttcacaggataaaatccaaagccttagcatgacatcctagactccagctaatccagtccttgcctttcttcttcagccttacttcacattgttagtccatttgaaccccacccttgaatcaccctgaatcccttccattgccttgaatagatactgctgttttgcctttgtgccctctgctcaccatggttttccttccctcttcccctggtgtatcagtcaggttaacactaggttatgctgaggtaacaaaatctcagtagatgaagatgacaaagatttactactctctcacccgttctatgttaggggttggcaagtttgtttgatttttttttttttctaaaggactagatggtaaatattttaggctttgggagcaacatacagtctctgttgcacactattcctcttctttgtaaaactctttttaaatgtaaagatcactcttatttgtaggccatacaaaagcaggtgactggctagacttggcccatgagccctagtttgctaacctctactctatgtgaccagtgctaaagacacatagacagcagggaactactcacatgggtagttctaaatgaatcgaatcactcggagacctgggctaatgcagcagccacctcttaaacatttcttgtcaccacgcagacacaaagagagggtttcacataagcaattaagtgctccggtctgaaagtggcaccctgtaacttaggctcacaaataattagccaaagttagtctttcgaccccatccaaccataagggggccaggacgtccaatcctaccatgtgtccagaagtagggagaattcagatcaccgggtaaaaattatgaaaaaagctcagagacaaacgctctgtgaagccttttctgataccttcatcctgcagccagaatagctgcttcttccttgcaatcttctagcactttaagcatctcttaatcagagtgctatacatagggtactacagttgcccacttgcctgcctcccctaccagatgctgagcttcctagataagcacttctgtatgcccactactttgcacagtgcccgttagccagggatgctcactatgtgttgcttcaacaaataaatgaatgtggtggattgtaggagtgaatgggattgcctctgcatttacctgacggcgtcgggaatccagcagtgtcaacttctctgaacccagttagttcaaccatttcagtctccacttatgatcaattagctctgttagttcaaccacttcaatatccacttatcatcaatttatctttttagttattagctactttctatcataatccaatgaatttctccatacaacctttttcttctaataaacaacaccttgcagagagctggtccttgaggccacggagcactttgatataatgtggcttggctttcttttcagtttacaggccaaaaggcagacacagagaggcacagtgatttttcccaagttacacagtcaatcagagatggagccaaaagttatgctttcttttgagtcaacaaaaaagctacaggattgaatacagagctgcagctaagttcactgaaagtttatttatatcccttggagaattagaaagtactcacacacgtttttcaaagttaagtcttattataccatatcaatgtatagcttgtagtatacctgtatctctgagtaaagtattaaaaacaagtcatatgactgtttattaatgctgcctctttttgtattgattccacccatcccttctactcctttcctcttctgtaaagcagtagctcatcagatggcatttcagaaccctgagaatatgaaagacatcatgcactaaggttttcctatcacatctcaatgccattaggtgaataacaccggcatgcatcttcactactaaatgtcatacaaacaaatttcagttgtttcacatgcaacctgtgtggctgctgcagtttgtatcaactatgtaaccacagggtgggcaaaatagcattcaaaatgagctatagtgcaagataccatccatacgtagagttaagccctttcatgcttagcagtcacaatcaggatatctttggcccacagaaacctatcctgactggaattttcctctcctgtgtgtctcctggatatagtaagttcctaataaacatctcctctgattgctagccttgacaaatttccaggagaaccagggcaaggagaagacagtgaggcagtgcccgctgctcttcagatcaccaacagaatagagtcagaatatgatattattgaaaccttccaagtttgaattaagataaaaacaactttttcaaaataccaaaaaccttttatttaagaaagtgaaatcgctcgatgtgccctcccactctggttagatgctcaacagaccacagcagacaatgcacctcaaccagggctaagtgtgcaagaaaactgaagtacacaaaaagcaaattatagactcaggtactgtcaggcacaaaagaagaaccaaccctttctaggagtcttgtctttgcttcctttattctttcctcgattcttgtaattgaatgttacaaagtatatcaagaggaataaacgtatggggcccctctcttccaaacaagaaaaggttaagcttttaattacaggccctcaaactatcattttgtgcaattagcaattaactataatcgttgatgagcaaatgcaaagctgcgctagcaatttcccttctcctcatcccaggctgggttatttcagtcttgttctattacagaggaccagmcacaaccgcgcgcactctctttcaaacatacacactctctcacttaaagacacatttagttttcggcaaaacggcatctcagcgtgcgattgagaccggcatcccaaaccccacwtttgagcagcccaaacgtttggagcccctccgcttcatcactttctgagtggatagaggaggcccgaagaagatgctacctaccagcctctctcaggggcgcaggagagggtggtagagagatgcttgttgcccctggaaactgcaagtaccccccaggtgcacgccccgtcagtggggaggcggtggcaacagcaacgatagttgcatcagcgctaactgctgctgctgctgcgtgttctgccggaggctgccgggagggtacagtaatgactgtagggagcgcacagccgctgcggcggcaggttccctggatcaggaaattaggacaggcaccsgggattggaggcgagggcggcgcgcgagccaaccagcggtcgccccgggcccccgtgagccccaggcgaacgcgcggagcagccgggcccctagagcggtccgggtggcggcggcggcagccacgaccacgaccgcggtcactcacgcacgctcacactcgcacgctccccgcgcgggcacccggctgcccggcgcgtgcaagaggagcgcgtcgagggaaaggagggccgaagccgccgcgctcccgcccgcccgccgcgcctcccgttgaccacgccccctccggccccctccccgctgctcaccccgctctccggccgccgccggtgcgggtgctccgctaccggctcctctccgttctgtgctctcttctgctctcggctccccaccccctctcccttccctcctctccccttgcctcccctcctctgcagcgcctgcattattttctgcccgcaggctcggcttgcactgctgctgcagcccggggaggtggctgggtgggtggggaggagactgtgcaagttgtaggggagggggtgccctcttcttccccgctcccttcccccgccaactccttcccctccttctccccctttcccctccccgcccccaccttcttcctcctttcggaaggactggtaacttgtcgtgcggagcgracggcggcggcggcggcggcggcggcaccatccaggcgggcaccatgggcacgtccgcgctctgggcgctctggctgctgctcgcgctgtgctgggcgccccgggagagcggcgccaccggaaccggtgagtraggacgcgcccctccgccggcgggcgggacccagccggggcaccgggagaccccgaggcgtaggtctccgtttgcccacccgcctcctaggaggcgcctctcggttctcctcgccttccctccctcccctccgtggtggcgcctctgagctgtcagcgccgaggctaaagggagccgggcttggggaacagcggggttcggggtgccccgacgcctcgcctgaactagtcttctgcccctcactccgcctcccccagagccgctgcttygcctcgyttctcgccctcttgacgggcgccgaggtgcgtgggcttctgagcattgaacaatggttctgcctcctctgccaggcgcagtgttgggaaggaggcagagggccaagacgtgtgcggcagcctcgggcgcaccctcgaaccccggggagtgcgggagcggacggggggagaaggtgagcgcctccggggacgcggagcgccaggggccggccgggcttcwgagtcttccggcggccgcgagctggcgcacgttcggtgggcggcggccgggaggctccgcggagccgagggcacccggactgcgactcccccggcgcggggccgcctctccggcgtgcggggtaggggagcggcggggctttacgcaggactctgctctgggcgcttctcctctcccttttccccgcctcgggcggcgtttggaaaccgctcggstctcccgtgtagctgaacgcggagggggagtggaggggagacttaatcwggttagtttgctgaccctccttcccggtgacgtttcctcgagaggaattgagtcctaggctagtgactgtaattagccttcattctacacaatagctcaaaggagcagcgcgagagcgagcgtgtggccctgtcttgttgggaagggcggcggtgactactgtcgggtccccagactctgccgcgggggcctgggggccccgcctggtcgtcagccacgttcccacttggggcctcgtaactttcctggacaggcgacaggaagcctttctgagaggactcagtcggaatcctagcgcgtccccgaagtgatcttcagatgtgacgccgaggggcttgcttgccagctgcagggaattgggactgaaagccgcccaggcccttaacacccgttccagagtccctggctcccgtcgccgggtggcttcaggggccctgccggcctgcagtcacgtgctcctgaagtgagagcgaactttaaagcatgtggtcaaggagcctgtcgggcagcgcctggggtttttacgtctccgaatgcccctgccctttggttgccactgtccggagcgtgtgaactgrgactggcctttccgccctctgcgattggttagcggtgcgatcacgtttaggttggtcacatggttccgcggactcttaagtgrgcagcatgggcagtgttattttcaatggaaagtaggagactccacaggctcttacgggctgttctctcaaatgccttcccctgcctggactctttgaagaggacgaatgtgtagtgaacatggaatctgatgtgtaacaagcctgagagcctagaaaagctctgcttacaagagtttccaaacgctagcattaatcattaatagatgagtaatactaacttattaaacgatttctcagtatagtgccatgacttgcattatgccttttgtaacatttcaaaacgctaaggtataccagaaggagggacaattatccaggaaggtgagagaaaagtttcgtttttgctgcatgtcccttccactagaggttaactttaccttatagaatgctaggaatgcacctaawctactgacatgagttagtcaaagccagatgttcaccttgtattgggcaggtgaggatccttttcactttgtcacatgtgaartatttgacatgccatgaacaatggaaaaacaaattcttcaaaggagaggaagcagattcttccagaactggaggaaatttgggctgaggcagttattgaccctaaaccaatcccaaccggcatctgtcttaagttcaaagtctcagggcatgtgggctgactttctaccctggagcttctacacataccccttctgtccactggcacatggtgctgttccacaatactcctggacaagacaggtgaacactgagactctggcaaggaacttaaggctaacaagaagttggtatacctgattgcacaattcctgggggttctgggacattttccttcagcctaagtagtcaagattaagatctgtggtatgatatattctttaaggccagagtctaaaagaaccaaggttttttgagagctattcatatatggctagcaactagcctaagaatagaaagaaaattccctcattgtgagaagtgggttggtggtactggtggtagtaatagacctggaggtaggaaactggttggcatggaaagtaaacttggctcatccagatagcaccaatgaaggtatgacgatgatagtaccccttatcaaagactgatcactcatgtgagcagggactgcgtaaaggaaggtcaccagccaagccctccttggcagtaacagcttcatgaaatcyagtgtagctttgttccctggatcaccctcttgcccactttatgtggcatttacctatagtgcctgtcctgtgtcattttgattgtttgcttttatggcctgagtccccagatacttaaagcatgtataaaggtcaagtagagctgccaaatattaagactttagtacaatagactgctatttaacactaaacattgctagcaaaggtgacagtctccatgctcaaaagaagtgaagacctgatccaagtgtctctacctgtcataaaattgaataaccgtaaacttgacttgagtagkttcattacagttttggaagaggaaaaaagttgttacaagccccttctgctccaggagaggtatcaaattgataagacttaacaagaactcctagagtagaacatgaccataagatcaagggaacacatagtacccagccgtgtggcttcgggttttgatcccaaaccttgaagacttggcacacagcatagaaatacagctaattcattttaaatatctagcccattttctgtttctcacagaatgtaaatttgttcttttcagtgcagggaaaagtgtttaagacaaggcagttgcctacgtgacttaaagtaatgattgcattcactttggatactgactttcatttggaaaaccaccttcacatactagcctataagaaattaaatgtattaaagggcttgatgaggtctataatgatgttcgttgtaaatgtacctgccttagggagctccttgtggtggctaatacaactgccctctacatggttagttgataaattcaaaattgcttagtttggtccctactaatttaatctcaaaagaatacttggacaacagagtgatagactactttcaaggcaaacagtccaaaaatactgtctgctgaggttatgggcgagatatacttgttaagcggaagtaagtagtccagggacaattttttctgccacctaaagagttttgggctagaaaatctgaggactgatagtttttctgaagagttggggcagagtctaacctagctataggcgaatctggcttttaagtaaaaatcatctcaattttactgtctgcatttttcaaactaaatcagtgtctctttgctaagttcgtctattggcttgcaacaaaaactstaaacactgttaataccacttagttaagtacactaactgcactgcaggaaccaaatgagatggcaggtgataacacaggttaagtgtcctttatctgaaatacttgaaaccagaagggttccacagagtttagattttttcagattttgggacattcacacatacataataaggtatcttggggatgggacccaagtctaaacatgaaattcgtttatatttcacatayaccttatacacatagcctgaaggtaattttatagactatttttaatgattttrtacaagaaacaaagttttgactgcaacttgtcacgtgatgtcaggtgtggaatttccacacttacggcatcatgtcagcactcaaagttttggattttggagcatctcagattgcggattagggatgctcaacctggaccataaatttagcatacttttccccttgagtgaagtctcctaggaaagcttgggcccaacagttattttgagtctctaagcaagagaatgcctgttaggtcctgtgagagtaagtgtggagattctgttagaaatgtttcaatgcttgcttagagatcctttgcctactttgtagtttagagatgctggaaactataagatgaagcctctggctagagcagctgattttgccaacttgggggccatctgggkagcctttatgtatgtagacgaggtggtggggatggggggacttgcaatttgccaaccaagggacataacaaagcctcggcgatagacagcatttgtgagttacatcacatgttagaacttaatagttctcccacatgctgtgaataaacagggtttctattttatagactgcctctaatctttcattttcttaagaaagacttccccasatctgaggtattaactgatctgtatgttcactaagtaggttgcagattgatgttggtcatctttgtgcatcttctggaaaccacttaatgtacatctactgagtacctaccatatggcaccaggcatggggacagagtgaccatagcactggtggttccttcctttgtggcacttagtctagtaggggaatcaaagcaggaaacagccaaagaccgcttggaatagaagctctgaagaggagtgagcagatccagtgtttaagacttaatcataaaagaggcagatagcagctggagatttctggaatttccatatgctatctgggttctagcttatgaagtttccctaaaattaccaagaacttagactttaatttcaaaaagccagaaataattctatgtctgcagataatcctacaaaagtgatatgactaaagcaacaatggattacwgccagtattaccaaagagcattaaaacatgtcagaagtaaaatctgcgtctgatatatcacactcaactttaccagttagccgctgctaaccttctcaggtgttggaacctctcttttcacatggaaatgaagccaacacacccaaagggacacactcattctgacagacaagtgtgtgaaaatgcactgtttttaaatgataaattgcaacaaagaggccgggcgcggtggctcaaacctataatcccagtgcttttggaggccgaggcaggcagatcacgaggtcaggagttcgagaccagcctggccaacatagtgaaagcccatctctactaaaaatacaaaaaaattagctgggtgtggtggtgcgagcctgtaatcccagctactcaggaggctgaggcaggagaatcgcttgaacccgggtggcagagatttcagtgagccgagataacgccactgcactccagcctgggctacagtgcgagamtccatctcaaaaaaaaaaaaaaaaaattgctacaaagatgaggtgaaggtaccctcataggcctagggaacagggacctttataacctagagtctttsaaagtattctagctagtaaaacaaccagtcacacttggtttcaagttctgaaaaagctgggggaaatgtttttgacaaaagtttttagttcagaccagctttattagtaaactaataaatcaactcatgcacccaagactaccaactagtgcctagagaatataggatgtcaggcaccaggtcctgagttacaaatgtgaactgcagcccatgccttaggggatctctgtgtctaaaggtgaaaaatggtagctgaactcatctccttgggtgatggctctgtgacagggactattatgagaaagcagccagaccatacctagtttttccaaaaaaggcattgaggcctcattcaagaatacaatctgagcccactcctggtgaatgggtggacaagggcaacatgaacaaactgagacaaagcagccatgaggaagggcaaagccatggggaagtgagtgggtcccctttgagctgttagctcagcccgtatagcagatggtgggtagtgaccaatagggaaaagtctgaggaaattagtagggaacttaatcctagagatagtggtaagccaagaaatgaccccattcttggctattctaggttgcttgaatcactaggttgcttgatatgggtagagaatgtggcagcctggaggcaaaggaacaagacatttaaattgacatcaggtgagaggagggcttgggcatagccagggattgatggccaaatgtcagggaagaatttgggctcatttctggagtactgatttagagtaagtaatggggccaatcaaagatagactacacagggagggaaggatggattttagaagaacctctgcctagtaagacacccaaataaattttttctgcaaaatagttttgagggctttactcacatgttactatcatgtgtattgtaaaagaggcatttatctcctgtgtccctcctgtgatgaacattaggccttatgagggtgttattggtatatgctacaaccctgaaaatgaaagagccacttacattatgggtagaagctgtagcttcttaaccttagtgcagtggttctcamagtgtggaccgaaattggcaacattaattcaatgttaattgagttcatgtgtcaacattgactcattagaaatgcaaacttaggccctgttctagacctgctgaatcagaatccaggctggggcccagcattctgtgttttaacaagccttcctggggattctgatgcacacgggagcttgagaacgactgacttagtttaccactcacagaagctaacgattttcaaggtatatccgatggagggcctttcctctgacttgaaccctagacaagaaaaccaagagctataatccttttagaagacttgctgaggaattctagaaacatttttaaaaacttagaatgaggaaggaaagcaggcctccatctcaacaacaaggctaaatctaagttgatgcttagtaacacagtatctagagccagtgcctgggttcaactcctagctctgcccagggcaatctgggacaagtgactgtactttccttctctaccaggtttcctgatctgtaaaagaggaataatagggccaactgtgcaggattaagaattttaaaagctaagagatgtgaagtcttagagcagtgtttgaccaacaacaaaaacgattcgattatgtccatgattcttaagatcaatttgatgtaaatggaaattgaatgtaactgacaattgaactgtaaaattcacttatttccatgactcagaagaattagcctacatattcaccactttttagtggcccccraactagtgtttttgttgctgtttgtttgtttgttttcgagatggagtttcactcttgttgcccaggctggagtgcaatggcactatctcggctcactgcaacttctacctcccaggttcaaacaattctcctgcatcagcctcccmaggagctgggattacaggtgtgtgtaatgcctggctaatttttgtatttttagcagacactgggtttcaccatgttgaccaggctggtcttgaacccctgacctcaggtgatctgccygcctcagcctcccaaagtgctgggattacaggcatgagccaccgtgcctggcccaaactggttcttacaatgtttcagaggctgactttaaggccagagcacaatctttgtgcttgacagctcagaacatttcccttaacacctgttgtggtactttgcctcttacaaacccttctccccttaggaaaacttttttgctgactcagaaatttgcttgtcctgaaaggagttttagcttacaaatagaaacactgtcattaaagtggcaagcagtagaagtgaactagactaaaaataaatgcccttggtggccccagaagtgccaaaacaaatggacggaaggaattccagcaagtaacacccatatgctcaagcaatgagtaagggcatgagagatgtaaatgcttggccctggtggccccagcagtgtggcagcatgagcctctgtgcaggctgaagtacgctctgagcctggtacccagagacactttctctatattctgggcatgcatcttggagtgctcctgccagggtgctgctcggagccccatagggagatttgtagtccgtttggaaggcttggtatttactcgaaggcctatgcagttttttactgaagcttatgtattagtcctccatgtcaaccgctacagggaaaattagacaatggcggctgacttctatatgcattaaaaaccctgagtttccctctaggacattggtctagacaaggaatttatgaaaragacctcaaaagcttaggccacaaaaacaaaatagacaaatgggacttaattaaactaaaaagcttctgcacagcaaaagaaataatcaacaaagtgaagaacaacctgccgaatgggagaaaatatttgcaaactattatctgacaggagactaatatccagaatatacaaactcaaacaatggggaaaaaataatcccattaaaaagtggagaaaggacatgaatagacatttctcaaaagaggacataaaaataaccaacagatacatgaaaaaatcgttaccattactaatcatyagagaaaygcaaaccaaaaccaaaatgacatataatcttataccagtcagaatggctattaataaaaagacaaaatacaacagatgttgctgaggatatggagaaaagggaagtcttatacactgctggtgagaatgtaaactaatacagccaccaaggaaaacaatatgcagatttcccaaaaaactaaaactggaattaacatttgatccagcaatccctctactgggtatctacccaaaggaaaaatcagtatatccaagggatacctgcactggcatgtttattgcagcactattcacagtaacaaagatacagaatcaacctaaatgcccatcaataatgaaagggtaaagaaaatatggtacatatacacaatggaatactattcagccatgaaaatgaatgaaatcatgccatttgcagcagcatggggatggaattggaggtcattatgctaagggaaataagccaggcacagcargacaaatatcttatgttctcaatcgtatgtggaagcttaaatatttcattccatggaggtagatggtagaaagatgacagagactcagaagtagggggaaagggagagcagrtgaaaggaagtgggttaaagaatacaaacctacagtaaggtagaagaaataacgtcartgactgtagttaacaaaaacgtgctcgcgtgatggacaccctaaatcctcggatttcatcagtatagattcattacatacatgtaacaaaattttacatgtacctcataaatttatacaaacaccaccaagaagaaccctgtttttcttggagccagtgaactgccaatgtgtctgtgtagcaaagttaactayttagagaagcaaggctcccaggaaaataggtccttgaagttagtgtgcatattctatagtctgattccatctatataagtgacagtaaaagtgagaattttttgacgctccaggaattcattcattacaaatttaaataggcacataagtgagtaggtacaagcgacttccaaccccctcacccaaaggagcagagatattctaaggattagagctggaagaaaacctagacaatttcttaatagaacccttttcaaattcttacaccaaaatccaatattcaaaagaaagtcttggtagaggcagaggtggaacacmcagggcctctgctactgtggcctttccctccacttcaaccacccctctagcctgaggcattcttgtgaaacctcatggctttaaggaacccactaacaattgcattttgccccatcttctcacctgtctgagcagaaatgcctagcacttctacttccaaggtattttttgmggtgtcattggctttagtttagcctgaagaattaaaagaatctcgagtgtagatgatttcaagctcaacttgttccctttatgaaagtataatactgaatttgagacgtaactttcatggatggaaatagactgcaggtccacaatcctataatcccaaagctttggaaaccaaaagcctcttaactcatttggtgctttcagttctcctagagctctgcacagcagcagtcccagctgagcaccagaggtggataggtagaaccttttaaaaacttgaacagaaaacttaacagtgttccagtcaggtggctaagggctgggcattcgatttagtgtctgagctctccctctctgtgggaagcagagaattaaacagaactagggagcactttctgcccagtagcagtccctcaaaacaaagtgcttaggaaactaggaaacgaagaggcatagccataaagcttaaggtctttatttgcctgtctttaaagagtcctttataaagccagcttgtcttcccacccccaccccaatgtcattcttttaaacaggcagggacattttagtagcacactgtactcctaatgcctgttgctactccttattggagagagagagagagagtgtgtgtgtgtgtgtgtgtgtgtgtgtgtgtgtgtgtgtggttgagagagagggagtaaaacacagctttatgatgatcaggcagaagcttgagtaaagtggaaatatctcggataagaaaagctagaaattaaactcctttttggcttcggatattttcttagtagaaaatgctgatgcctgtcctgagtctcctcaatatagactcttagagcagagctgctaggattttaatagaatttattactgttgatagcttgtatattacaactaaattcagagaccctctttaaggcaatagtagagtaaatatcagccttgggatactgtatgcccatacttaatccsaggccactctgagtgcctaggaaatctgtagcttcaaactcattcttaaggaggttgtcttccrggtaccttaaccctgaggtgggaaactatcaattgacattgacctttaagttgctattcaaatctgattacaaggtttccattttgattatgtagatatcartgtcaatgttgttgtctcattttgacttaataacctttggtaactaaaaccttaaaaaaaaaatcagaggctttcagtctttactgtatcttaactccaacctgactattctttccaagtatatttatacctatgttctcagactacaaatcattcttttcctgattactcaaggtagagtcttaccactttcacagtccccaaaggtagtaaggtcatatagaactgcaagacacgtaccctcagcattgagaatattgcaaacatattaagaatccagtggcaatgaggggagaggggagaggcaccaggtacctcagatttggtttagcagtataaaacaacacaggtgatgcttcctgacaacaatctctaccctcctctagttccccttctaaatccctagtatattacaaccaataaaacgtgaagaatgaaaaagtattatgaaatgaaggtaggaaaccattctgctttgtagctgggtcctagcttaattagactcatgggagcagagtgatagatgcagttttaaaagcaacatatttaatatccaaggaagtaaccacacccatatggtcatcttgatttgggccaaattttaatctccctgggaagagccacaaagcacgaaatgctcccagacagcagggagtagctgacactagggagaccaactagggtattgtgcacgtaacacaagagttccagtctgtgcttgtctctgtaatatcagttcttatgccagcatgccacagctgcaaatgctgaaaggtggcaggaaatcggaaggccttctgctgggacaccctccctaagtaatctgcgtgaactatatgattccactgtttttctcaaatatttgcagtatatttgctttaagggccacatctgtgccttttatcgtgaagcaatcacatccgccagaaggacggaactgctaatgataggaagcacctgaacattagctggcctgtgccgggcaaaacaccaactgtcccacttagaagtcttagttcacaccattgtgtgaattaaatatccatacattaagcatagaaaaccagattcagagaaatcgaatctacatcttcagctccacctcactttcctttcctctcctctttaaatgacaaatgatcttcctttccctcttaactatactttcttgttgcttttatcttggagctgttttttaaagctgtgtttttccaattagacctcagtttctaagaggaggaatcatgtattaaatctctatttctaccctattcttgctgctccttctaaatcttcttcactgtgcttgtaatagaaacatcattaatggataatagtatggatgtggacaagaaatgccattaaaggattaggacttggctgattatagccacacacgtagtttcaacaaatgagagaaatgagtccacaggcagagatgatgccccttgtggtctctgggcaatctggattccttctattttcgtctggctccatttgcccgagatcactattccagccaccatgcccaattttcaggtaccaggaatgaasagatggaaagaaaatggatcctctatcctcttaaggacatttcccaaagttgtatataccattttagtttacattccattagtcagaatgtagccccttggctgcacctcactgagaaagaggcttgaaaatctagtatttagtcttagcatgcacccagctaagaacgcaattactgtcagtcactggctgaagagccatcctactctggcccttaggatgtcatagcctgccgagtctgcagtatccttctgagaaggtccccatccatgggtattaggtatcttgaatctataaccaatccttgctttaccgaatgttcccttcttattctagggagaaaagccaaatgtgaaccctcccaattccagtgcacaaatggtcgctgtattacgctgttgtggaaatgtgatggggatgaagactgtrttgacggcagtgatgaaaagaactgtggtaagtaaagagtttgatgacttatgcattttgttaaaatatgatgttatcttagtctgcaaatgtattgagattctgaaaataaaatccacttctaacaattgctttgaaagaatctatacttctctgtgtaaaggaataaaattgaatgtttgacgtggggttatcaacttgagaatggaatgataaggtgatgttccatttaaatgacaggacctagtttatcttagatcagacaaacgtggaataggaatctgggagaagggagaagaggaccagaaatagagacaaacagaagattgcttagaaggggcttttttccccttttaattttcaaatggctctgatcctagaaaagaaggcaagccatggacatgagaaaatcccataaagtttcagggggttaattaacccttgacatagaaactacaagccagcacagatcaaagatcagataaggattcttttttaattctctgcctacaatagttgctaattctaaagcattagcagggcggaagacattctctccccaagagaatggggatacagtrtcacagccatcaatcagcatctattaaaagatcaytgtgagaaatgcctatgtatgcaatctatacaacctcatgtcaagccaaaatagctgagaactgcatggcaagattacatttacataccatgaatacatgctgaaatttgctctacgatccctttgttcagggttgtaaacattctgaaacaatattctatgtgaatattggtgctaacattgtcatttatcttttaaaagatgttatataaagatgttcactatacaaggtagaaatacagaagaaaagtagagtctaaatgtaggtttcatcaactgccatcttgttatgcctttacctacttcttcatgcatcattattaaaatgctrtaaagtatgcatcatggcagaccttgttctacacctgatctctcagagcagtatcacaggtgttttcatgccaatgtgtaaagcagatcagtagctcctttagaagcataagaaagtccattctaccatctcagggaagaaacttacatccagtctcaggaccaagaatagttctcctgtgcaacactttatcatcatttgcattttaacactaagattttaatctattccacaagacactgagtctcatgctatttctgggttacctaggtaatttagttctcttactaaatatctccttagagagtcctcactcttgtcaactattttcctgttgtaagttgcaattttttttcctctcttctaaacgatatatttggcaaaacccattgcttgttcttaaaaagtaattattctctttgtgttgcacaagtctttttttaccatgtgactcagtaggaactaacctgggtcaacttgggatttttctaaaatagtcytgtataagtactctctactagccacatggtaggagagtttggcaaagaaaaagaggtagatgtatatctaatcaagatcatttgaggcaggaaaaattatatccttagccaaaatttgtctctacttcctgtgtgtgacagtagagaaagaaagtagaaatattacaatcagggaaggtctgagtgcttactttgtttctctatggaagaggaaagctatagaattacttaaaacttccaaagctgcctcctatttttagtctaacctcttaatatggaacttggttacaatatttagcttagttctttatttccagtatgtcaatgggcatagtcaacttaaccttagattctattagccatgtgcttctgttggtcccattaactcattcttttataatgttaggctgagctaattaatcagcaacctaagtactctaaatatgtaactgctaattctcttcctctgtagcacatctaaattcctatttgtctctcaaggcccagttcacatatcctttctttaccctcccagtctatgctccaaatgaagagagakaaccatacggcaatttgtctgtctctgtttatcttttgctcaaacactgtggtatacagccaatctttcacatcctccttacgttttctaagacttaaaatcatggagggccgggtgcggtggctcacgcctataatcccagcactttgggcggcctaggcaggcgaatcacgaggtcaggagatcgagaccaccctggctaacacagtgaaaccccgtctccactaaaaatacaaaaaaatttagccggacatggtggcaggtgcctgtagtcccagctactcgggaggctgaggcaggagaatggcgtgaacccgggaggcggagcttgcagtgagccaagaccacgccactgcactccagcctgggtgacagagcgagactccatctcaaaaaaataaataaaaataaataaaaaatcaatcaatcaatcaatcatggggtctctttacagccattccgctactccctcttttgtagcttccaaagaatatcacaggttgaattatagcaactaaccctgcagaccctctgacttcttcctccatgctcaggagaacayagaccttgaatagcacttaattcattaacattagtgtttgagtttttcagtgattttagaaacaggcatgaatctaaagctagcatggccagtcttgtttccttggctgtgtaattcaaggagataatcctttatagatcatcataatttgtcaacccatcttgagttctagaaattaactgtaatcactgtctctctcctttacaatatcttactctcaaccagagtggtccaagggcacactctaagctctgagagttctacctgctttaaaccagtgatttgagaaacagtccctttcaaatgttcatcaaattgtgaatttttcacttatttaccttcacagaatatatgttatagaggaatgttttaaaatagaaattgggtagaaggtataagcatataggcaagaaagaatataatctaagaaagataagcttagggtatcctgtgtggctactttatatcaagattcatcctgctccgtgattccttcatgggtaggataatcaagctgcccgatttgcttaggacagtcctggtttatgcttatcttccagatataattaaaagtgtcccctttctgctgagactgtcccagtttggacaaaaaattgcatggtaaccctaagtataggggaaagacctgccccaggaagaattagcaacagaatcaattcctctccttaggctattttaacattagcagkcagttatggatattagcactgacagcttcaatgacttttagctggttgatgttagcctaccccttggctagaaaggctaaaatcttctctcccttgaattctaagtacaacatctcttgttacactgattgagttttctcccctttctacctgatgagtttctttgcccctgtagaccagtatgggtgacaatattcagtactggggtttggccttcattctccacactaaacacatgtgttgttaggggatgccccttgaacagtatattagtcagctcagactgctgtcacaaaaataccataagtgggtggctgaaacaacagaaatttatttctcatagttgtggaggctgagaagagacctgccagtagatctgatatcaggtgagggctgtctttctggtttgcagatgaccatcttctcactgtgtccttacatagtagataacaaagagagagagagtaagcgctctggtttctttttatgagggtgctaatcccattcatgggggctccaccctcatgacttaattacctcccagaggccctacctcctaataacatcatgttaggggttaggatttccacacgtgaattctgggtggagacaaacattcagtccccagcaagcagttctactatgatccagtcagaagatggaatgtttagctgttaaatgaagtacttgaatgacttggaagaaatgcatgtagaaaatgaaagtgttacttaatctcaacattataaaacaggcaggaagttaaatgtaaggtatctccgagttgtaagataatgggcaacctctgtctgaccttgacttcagtttcctccaagtctctcaaatgagcatcttcctcctctgaaaaaaaataataatttttctgaagtttcccctggatattggcagttgagtgcccattgactcagcttttttttagagcaaaacatgccaaaatgcagtatgagccctcatgtgaagctagggctgtgggtaaatgacttcaactttaacccttcaaataaacgtttgtagtaaagaagacgtgtgctgaatctgacttcgtgtgcaacaatggccagtgtgttcccagccgatggaagtgtgatggagatcctgactgcgaagatggttcagatgaaagcccagaacagtgccgtgagtgtaacttgctttggccttgaactttgccaagttgttcggtgtctaacatttctaagtattgcttaatctcctacttggtattcatttttctttgcctgccttaaagtttaggtcaattgactccaagggcagtcaaatcattaccagtttatcagcctcctttaaagaatgttctccctggtccaacaagactgacattctcttgggtagcttcactattgaatacttaaaactgaagtcagcagattcaatcaagaactccttgactaggtgcatagatttcaaatgtctgtttataataactgagcagatggtactctggtcctggaagctaagtcaagaagtgagggttccctatgggccaagcaaaagcttttagaagcacagcttatcatactattaaaaagctattactgaagaggtaaggtagctagtaattgggtgatatagtgactcctgacacacatgtaacctcaagttactaaaatggagatcttacagcatrttcttaaataagagaaacttcataggtatgcaagtatatacctgtgtccttaggaaaaagtctatgagaccataaagaatgatggtttgggatcatataaattgagatcacacgaatgtcaaggcaaagaaagtcttagagtttgagtcagtagaggcctgcactggtagaaacactaaaaaaggactaacatgaacacagtttaggtctaaagtgtgattatgaaagaaaatcaaatagaaaggaagataaggctgttactttcarttttctagataagaagtgaggggagtaatattggtcaaggcaagtgagttcaaggcctgtgagctaaagacaggttgtgtaaagattcagcctcaacttttagtggagaatgacctggtcaagtcaagcattagggcatgcttctactttgcaagatgtcaatctaaaggacattgtgaaggaggcccataaaggaatctaggcaatagaagattttgtaggtgtttgaccatctgacttttcatgtatttgagattagatgacaatatctaggtgtgcccacttgacatccaacagataaatagtggtctaggagcaggccagccaataaacttcaccacgccaagtaaaacaaaagccagaactgagcacgccatgggaccttgaaggagtgacgtggtcaaagctgtcacgtacactgccaggtagcataggttggcacagcttctaaggagtggagctgatgaaagagctccccgggcttcagccagttagtagaatttcaccagtgtgccaggctactgagtcacaggtattagcgcttccaggcagcacaggagcagcagctttgcattgatcagttctgaggctcttttgagactgtatatcatcaacagatatgagaacatgccgcatacatgaaatcagctgtggcgcccattctactcagtgtatcccagtgtcctggagatgtgatggtgaaaatgattgtgacagtggagaagatgaagaaaactgtggtaagaagatcagtgttgagtgacgtaacccaaagacccttttcctaaaggaagggtgggcaggggaaactaatctaagcctraagacgcactgacattgactcacttttcagtgacttcactatctgctcaattacttgtccttcataactgccctaaaaccctaaaagacattcatgtggcaattgaccatcgcttggtgtttcttttaggcaaatagaaataagaaggtaagtcattcaaggcacttatatatagaagtagctcagggaagcagcaattgtgtgggcttttgttttgacagtaattcatgtgtcttttgcactttggcacaataaaattagaaggtgagtagggttggcaaacacattcataggtctaaatttgattgggttattggaataaattatttgagtattatacaagcatttctttgcccatgaactagattctggcataactttcccagaaaaaaaaaaaaaaaagacacagaagcatgaattaacatcttgcctcagatacccaaagaaaagtctacccaactggtgatacctttgtctcctgttgcagttcctgtctctgaaagctaactctgcttcctattctttcatgtttctggtcttggaaaatctttaataaaatgctgcatgttgaaggtgagggcctgggaaaatcactaggttgaacaaacagtgctttgaatgttctttcaagctactgccctttttatagggcctctaaaacctacagctcccaagtctgacaagcatgggcctcctgatatggtagtagtcaagggagctcagggcacttacagttgaaacaccagtcttgtgtgtagaagtcgcctcctgaggtcaataccactgcacctagtccaatgagttttagtgttcaatcctagaattgggttttctgtattggtaagccctggtgctgccaagtgtttcccttataaatctagactttgcttcccaagagagtcgtggtctctattctaattgccaccaaattgtgaccttgaaacatttggcaggaatttaagtcaaagtaccaattggctagtaggactagcttatcattgtcagcatacctgattgttaaatggtgattatagccctggcagtgactttttcaaaatggaaagtgtttaagacttgttattcctgatccttatttaaaggaccaaaaagaggaaccatatatggtggtatgtggttcacctcttttggtgacaaagtcttaatgcttgttgtgagtattacgttgcatgatattctcaactagtgataagatctgacaagcagtatgttgattcaaggacaactcaatctctgccttccaaattgaaatcccttgttacagtttgttatttatgatggccacttttagaatcaattgtggttctcatctcaaattaatttccagtcttcaactattttcttggttctttatttctgttcttcttatttattgtgtgscttcattttttgtacaatgagactgtacaaaagttcttgatttaactccattgtagcctttaagttgggctagtaagttaggattaatgaataaagatcaatgtattagattttgggacaagaatcttgaacggaccaatcttgatgcattttcagtggggcatcctytctcttaataggcaatataacatgtastccygacgagttcacctgctccagtggccgctgcatctccaggaactttgtatgcaatggccaggatgactgcagcgatggcagtgatgagctggactgtgccccgccaacctgtggcgcccatgagttccagtgcagcacctcctcctgcatccccatcagctgggtatgcgacgatgatgcagactgctccgaccaatctgatgagtccctggagcagtgtggccgtcagccagtcatacacaccaagtgtccagccagcgaaatccagtgcggctctggcgagtgcatccataagaagtggcgatgtgatggggaccctgactgcaaggatggcagtgatgaggtcaactgtcgtaagtagctttctagcatggcatgttcagttctcttccctgtatcaactgggacaatttgctggcttcattccatggtgtttcctccctttgtagcctctcgaacttgccgacctgaccaatttgaatgtgaggatggcagctgcatccatggcagcaggcagtgtaatggtatccgagactgtgtcgatggttccgatgaagtcaactgcaaaaatggtaagggtttcttcttgttggttaagcaatggattgctctgaccagacccactcatggaatctctcttctttgtttctcttygtagtcaatcagtgcttgggccctggaaaattcaagtgcagaagtggagaatgcatagatatcagcaaagtatgtaaccaggagcaggactgcagggactggagtgatgagcccctgaaagagtgtcgtaagtgtacttgttgttcaagtacagatcctggaagtttgacacaatccagtatagctaacactgtgtggaccccccgtgatggctagttaaacttttgaatgtactgaagttcaattgtagacttcagagtgaaactttatgacttaaaagcccaggtaggacaaactagtttatagtttttgtttttgttgttttttttttttttttttttttgagatggagttccactcttgttgcccaggctggagtgcaatgatgcaatctcggctcactgcaacctctgcctcccgggttcaagcagttcttctgcctcagcctcctgagtagctgggactataggcgcccaccaccacgcccggctaatttttttttttttttttgtatttttagtagagacagggtttcaccatgttggccaggctggtctcgaactcctgacctcgtgatccacccgcctcggccttccaaagtgctgggattacaggcatgagccaccgcgcccggcccaaactagtttatagtttaacctccttaaagataactgatcatcaatagagaaacttgactaaatgcttgaccarctggtaacttgccgaggagttagataatccaccctgaaatatatacctataaaataaatgattaggtcttagacaaatcgtgggtttgaccaggccaactagataagttatcacaaatagcctgggttttaaatgtgaaagatattaattgaaaataagttgtcaagtgactactacatttttattccagatataaacgaatgcttggtaaataatggtggatgttctcatatctgcaaagacctagttataggctacragtgtgactgtgcagctgggtttgaactgatagataggaaaacctgtggaggtgagtctaagaagaaaaccyggaccctgcaggtgatgggaaaggatagtatgtacctagtaaggtataggagcagcaagactaattctgatttccctccyagatattgatgaatgccaaaatccaggaatctgcagtcaaatttgtatcaacttaaaaggcggttacaagtgtgaatgtagtcgtggctatcaaatggatcttgctactggcgtgtgcaaggcagtaggtaaatgaacttggactggtatggctrttgtacctttatgagtaagtgcctctaaaaggtacagccagtgactacaatagtcaaactaaacatgaaattgtacttgagaacaatgctgstaacctcataatacagcrgtataggtcaaatagcagatctctcccctagatatgtaccttgatcattccttttgcatatgataccatgaatacctaccaggtttgcatgctctgtttccaaaacttgagtccaactcaaacaagtgacttattcatcactcaccctgttcttgaaggctgtaaccccacgactgccttcctaaactgtaggaagcacttgcaggtcccaggggcaggaactccagaacagatactactgaggtattccacaatacctttattttctaagtgctcctctgctgggaggaggtggtttagaaagaccttgccttcttaaagcaaaactaagtaacccwgacttccatcttgcaggcaaagagccaagtctgatcttcactaatcgaagagacatcaggaagattggcttagagaggaaagaatatatccaactagttgaacagctaagaaacactgtggctctcgatgctgacattgctgcccagaaactattctgggcygatctaagccaaaaggctatcttcaggtaactttcagttccttttgtggtgtcktgacataagtcattgtcacttgggaagtgatctgtgggatagtttggaggagtttcttttgtgtctagccccatctagcatcgaattacctggggacattaaatctaatgctaattctttattaaactgttatcacttcctaattagaaactaacaattgtctatgaagtaaaagatgacatctttcatattttttatattttctcccttttctctacagttaattgagaactgttcattgttgctacaaatagaaatggtagtacagccttttcttaatgggaactatagaaactcagatgatggatactgaaacaaatagcttcacttagaaatttgttgttcttgtatatagaatacataccagcaactagataatctacagcattattaatttaggatcagtaagcagcatggttaaataatttgagtggtgagctgtggtgttaactggatttctttctgaacaaagtcattgaccattttgtaagcaaaaagtccattctccaagctctaattgtgtcaaactcttaaatttcttgtgacctattctgtttcagtgcctcaattgatgacaaggttggtagacatgttaaaatgatcgacaatgtctataatcctgcagccattgctgttgattgggtgtacaagaccatctactggactgatgcggcttctaagactatttcagtagctaccctagatggaaccaagaggaagttcctgtttaactctgacttgcgagagcctgcctccatagctgtggacccactgtctgggtttgtagtctgttttccatcacagactttggaatggtatctgtgtaggtcaggagctttctcatacctgaattagtactcaaatctcaaggtttatgagccttctgcaacaaagaattagaattctaatttaagatatcagttttgccccaggtgagtgaccctgggatgtccttatctatatgacaggtcctcctgtctgactctcgtatgactgattgctggctgacattaatgaattaacattcctgatttgatgtgtgtaccaaaagctgtatctgaacccttttgtccacccagtttctacgcaagtgattttttaatttttgactgaaagctttgctgggctagctctggatgatcaaacctaaacgacagcctgaattgtgaggatttgggtaaccacattgcatctaagtgtgcaagttgtctgaaagtccagcagaaataaacagacctttctagaaacatttcactaagggggttctgtaaattgccactaagtaacatagaagagcagctcaggaagttgactaaggctgtagttgtcatcacaactggcccccgtgcagcctcattagaactcagtcagccagccaacccctgctatgaaatttgaaggatgttcgtcttgcactcctctgtaagaactgaccttttaaaaaggaaacataaccttgtgactttgggccgaaatttaaatgtcagacaaacatagattattatagttaataatgagcttgtagattcttaatattcaattttatttacctagaacataatttagacccttaagtgttactatttgtcactagagaatgccttgagttttctgctcaaattttaaatttttgtttccagctactacaactttattccttctaaaccactgaggcttatttctcatttaatttttcacagctttgtttactggtcagactggggtgaaccagctaaaatagaaaaagcaggaatgaatggattcgatagacgtccactggtgacagcggatatccagtggcctaayggaattacacttggtatgtatgttcttccttctcgaccacccactcaactatcttcatagtgtttccatttatctccatggtgaattctggactagcagatgactctactgcttccgcctaaattctagcaggaattttcaatgggagtaactgaacaacacaagtaaaatggtggattarcaaattacacattccataattactggcctgttgtccagctgggcctaatatgtgacacaaattcagtgaacgttgggtcttgggtgcactcatactaaatattctgggcatgagtgccttagcatttcctgaattgcaggcttttaacagttttcttctggctttttggaggagaacaacaaaatggtagcctcttttaatattttctgtaatgtgagtaatatttcttaagtcatttgctttgagaatctcaggtaccctgttagtccccaaaaatgaacgtggatacaggctctgcatgctgcttcgcaaggtttatggtgaccccgttaagaaaccctgctggggaaagaaccgtgaaagtagattattaattcattagatatttttaatggaagccagagtagtagtggcttgtcatgtaatgacaattcttttcctacctagaccttataaaaagtcgcctctattggcttgattctaagttgcacatgttatccagcgtggacttgaatggccaagatcrtaggatagtactaaagtctctggagttcctagctcatcctcttgcactaacaatatttgaggtaagatgtgtctcacatcaaagtgtgtacctttgagctactatatcactttgagaagaaataacagacatagcgggaggagggaagagcagctgaacatggcttgagaaactgctttcacttaaaacctggtacaaatcagacactaagtcccagaagcactccacacctaaacttgattcttttacagttttatatccagtgtcccagttcagcattcagtaaacttagtccattaaatgagaagtaaatgatgatgaccttagaaatggacttgtgttaatcctggatgtacatgctaattgtgggcttctgttttaggatcgtgtctactggatagatggggaaaatgaagcagtctatggtgccaataaattcactggatcagagctagccactctagtcaacaacctgaatgatgcccargacatcattgtctatcatgaacttgtacagccatcaggtaccgtggagaagcacagtccttaataactactttaagggaagcagcatgacacagaacctgctggatgtcagtagctcttggcaactcagttttctttaaaagggaacttttgccctcctgtaccctaccttaaacatttcacatgttatttttttatttctgctgcctcagagaaatggcttctcaacttcagctcctggctttcctcccaagcctcagtgtcagagcttttatttctgtttcattcatgtccccttggccttcagcccctcttgccaagactattgcagtagcctccaaagtagcttttgtgctacaagctttctctactgttagtttgctaggatttttgcaatgaagtaccacagactatcttaaacaacagaaatttattgtctcaaaactctggaggccagaagtttgaaatcaaggtgccaggagggttggtgcctcttgagggctgtgagggaagggtctgttccaggcctcttcttggtctgttgatggtgctcttccccctttgtctcttcacatcatcgtccctctgtatatgctcgtgtccagctttcttgctttctttctttttctgttttttggagactgactcttgctctgtcacccaggctggagtgcagtggcacaatctcggctcactgcaacctccgcctcctgtgttcaagcaattctcctgcctcagcctcccgagtagctgggactacaggagtgagccaccacgtccagctaaactttgtatctttagtagagatggggtttcaccatgttggccagactggtctcgaactcctgacccaaagtaatctgcctgcctcggcctcctaaagtgccggaattacaggcgtgagctgtaataacagtcatattggattagagcccaccttaatgacctcattttaacttgattacctctgtaaatatcctatcctcaatatctccaaataagatcacattctgaggtactaggacttcawtatatgaattttagggaggaacaccattcaactcataacacctactttccccctgtgacacacctgatataggattgtgtagattctcaaacacatcgggttatattatctcctgctgaaaacacttggctggttctatctaaataaagccttcaaaccttcctaaggctgagtttccttccactttgttggagcaagtcaagagaaaaccaggagaacatgcctagtctcctttctctgagccttcacgctaaacctcgggcaaatagtgagagccagtcctggtccctcacctcccttccccacctcctcttttggcatctgtctcttaaaggcataacttttacagtctatctcgaagaggtcccttatctggtgtccttagagcatgctgcctgtacctgtatacttattcttccttgatactgttctcacttgaaggattagcagagtagacaagtttaagctcttgggggcaaggactcaggtcttcaacatgtagaacaaggctttatatatactaggcaccggaatacccattttaatggtattttttttcctgactaggtaaaaattggtgtgaagaagacatggagaatggaggatgtgaatacctatgcctgccagcaccacagattaatgatcactctccaaaatatacctgttcctgtcccagtgggtacaatgtagaggaaaatggccgagactgtcaaagtaaggcattttgtgtttcaaccacaagtagaacctacaacaagcaatataataagacacaagcttggatttttaagaattctgtcttagctaattcwttgaatagatttgagaagatatctgctattgtatgccgggttatcatgtcatttctttagaactgactttaacccatttcaacattaaatgagtttataggagactaaagtgtcaacataccttacactaatttgtacctagtcccttaacagcactgagctagccaacttgcaggtaattaaatgaggccttaacatttttcctcaaaaggaggaggacagaaattatgcttaaggaaggccatggttacagaaacctcattgcctcagtgggtgacgctaccctaaaataacacttaggctgaatttgcatttagtcttctgttcttaacttttgattaagtggcaaattaaagtcatttgtgtgatcaaggagcttgtatggtgaggctgatgaggtttttattagcgtaattcatggtcaggcagggattagctcagtttaccaagaaattagttgcaagacagtctggtatgcctggtataccagagcatcttgagaacatttctcgtagtttccaggaacatgggatgttgtttagagggataaaatgtggttgtccatcattttgaattgtcaaattccaaacaccgactgtccttcccaaagtttcatgtatctcttttttgcatgaagattgctatttcaatgttgacacatcagctgtacaacttagttcagcagtggtttgtctattttacctggttttaaaataaccttttacrtggcttgyctggacaaaacagctagccatgctggaaccctggcaytaaccaggttcttggtttttataattcaggtactgcaactactgtgacttacagtgagacaaaagatacgaacacaacagaaatttcagcaactagtggactagttcctggaggtattgagttcagtactgcaaactgttaatctcaactaacagccacactctttgtatctacagcttaaataattaatgcagcctttaactactatttctgccccaattggtaacctatatttaaacaccaaagacttaaaacttgcatatcttttcctgactgatcttaaaggtttctagtagagaactgtcagtgaaatggctactacagcatgkgactcaaatacttctaagccagagttgttcctggtgttcaattgttgtagatactgaacatcaatattggatgcaaaggttttggctccttaccygatgggtaaatttctaagtctgaatacagatccttctaaactgattccttttattcctctgtagggatcaatgtgaccacagcagtatcagaggtcagtgttcccccaaaagggacttctgccgcatgggccattcttcctctctgtaagtakatttcctacaagtctgggttcaagaacttcttagataccagatgaagattttttgttcatctggagctacccctttcatgggcctttatgctgtctagcatttatgacactgaattacgttcgctttctcccccacataatacactaaattaaggcccatatctttctcttcagttgtacctttggcacagtaactggcaatgataagtgttcaacggttaatgctttctacttccgcactgttaacctggcttatccccttttataataagtctctttaactagtgtactgttctgttccccctttgaaatgtgtgtaatgcttcatacagaggagatgcacaaatgcttaaatgctaagagttacaggacttgttgaggataaattaaaagcagttaagaattttcaaacctatggaaaaggacctctaaacgagacacgcaaattctaaggactttgctataaaaacctttgtcctaaatgaagagacccaagcttagctaacacgccaggaccacctgaatagctctccagaaccttctgcaattttaatttggtgagcctaaggtgggaccgaggaccctgcccttgcctggatggatgtggctagtccagctccagtgcacagagctacctctgggctgaacttgtttcaagctcctggcccatgtgtattccaacttctagttatcctagctccataaaacatggcatttttactaatgtcaattattatggattcctgaacgttattacctttcttgtatgttccaatactagacttagctcacttagctaccctctgatttttttcagtgctcttagtgatggcagcagtaggtggctacttgatgtggcggaattggcaacacaagaacatgaaaagcatgaactttgacaatcctgtgtacttgaaaaccactgaagaggacctctccatagacattggtagacacagtgcttctgttggacacacgtacccagcagtaagtcagctttgtgtctttatacaccatggcttgaagtgagacttttcagaaaggagacctgggtgagagagagagagccattaggatgatggagttaccaaacacttcatctgctacctggctattagacagacagtatagcctgttagaacataagtcactcagttgatcagcatctaaccctcaccaactgacaagtgggtcaacttaaagtcaccactatattaagatatttttggttatagaaatgacatgtaaatactagcatgaaccaagtagctcattactgaactattaaatccattgcctactggatatttgaaagtaaattagcatatcatatataggggagttggcttaaagtcagtgtattgagtaasattcacttagccaaaattattatatgctttgctttaaaaaggtatcccaccgcccttagtatagctagcttttcttccagcaatagtcastcacttgttcttcagatgaaacccaagtggagtatttggccttcacgtaggaaacaggctgaacaaaacaagtattgatcactcccctctcaaactccggtgaaacatggaacagtggtcaattcttgacacacacatggcttttcacatttttccccaagacttatgatcattaagtagaaaagacagaattagtcacactatcttatctcactaccaagcaggtatagttgaattcaagttaaatgcatgaatgatacaactcagtattcttttgtatctgactgacttttcttctaagcactctgagtgtttgaatgaccaactcaaaagcaaggtccattttaaagactagagttgccatcagtgagtgatcaccaagctcattctatacttcttcttttccacagatatcagttgtaagcacagatgatgatctagcttgacttctgtgacaaatgttgacctttgaggtctaaacaaataatacccccgtcggaatggtaaccgagccagcagctgaagtctctttttcttcctctcggctggaagaacatcaagatacctttgcgtggatcaagcttgtgtacttgaccgtttttatattacttttgtaaatattcttrtccacattctacttcagctttggatgtggttaccgagtatctgtaacccttgaatttctagacagtattgccacctctggccaaatatgcactttccctagaaagccatattccagcagtgaaacttgtgctatagtgtataccacctgtacatacattgtataggccatctgtaaatatcccagagaacaatcactattcttaagcactttgaaaatatttctatgtaaattattgtaaactttttcaatggttgggacaatggcaataggacaaaacgggttactaagatgaaattgccaaaaaaatttataaactaattttgtacgtatgaatgatatctttgacctcaatggaggtttgcaaagacygagtgttcaaactactgtacattttttttcaagtgctaaaaaattaaaccaagcagcttaaccatggtttgtgcctgttcctctaggatgaactcctatcctgagtagtaccaagtgttctaactaaatgtgtgagctgtagttcttgatgttgtataactaagcctgtaattgggctggtttctcttacaccctagcacagttaaaaaatgaagtactgtttaacatttgctcccgaaatatttcttactgtgtaaaagaagctagcttagtctgtacctagaattcctcttggttagaggagtgagtttcttttttttccattaacttgtttcctgatcgagaaacacgtgctaagatttctatgaattctgcttctttatagttaagtctctgttttccatgttctgtcatttatataggtcaaggacaagtgccttctaaggcatggataagggctttcttcttatgaaagtctagactgtcttactgtgaagatggccagggaggatagcaagcaatggcattcttgaacagtctaaggcaggtttctcagtgtggtcctgagaacagaagcatctgcatcacctgggaatgtattagaaatgcaagttcccagccccatcccagacctactgaatcagaaactctgggggcgagggctgaaacctgctttcataagcccttcaggcgatactgatgtaaactaaagcttaaaaaccaccgttttactgtgacttcatgaagaatataattgcaatatcacctaaatttttatcctggctgggatggggcagattcttactatggacaatttctggaacttacagtatgaagagcagatgaggagtttgagacaaagaaaaaattgtacagggagtttagtgaattttccatcaggttggccattactttctttctctaaagtctcaggatgtctggaagcaaggaaagacaaaagacttgaagcaccgggtgcatgctgtgtgtcacaagtgaggtggagagttggctgtggaaggtacagcaattcctctggaattaaatgaccgaccaacacagtaccaagaggatgaagagaagatgttttgcgttgctacgtgaatcagtggatgactcatatttcacttgcatatgaaatataaggcagttaacatcttgtttgtggcttaagcaaggacattaatcctactagatgaaggggaagttggttctgttgtcttaagggatgcccccttgtgattttggtcaactgaatgaaaaagaaaagatagccttggacttttttttcatgggaggtttggaggtcaagcatgtagaaggaaaaggctgtagtcatgaatatagaactgtctgctctccaccttttcctcactctacatttagtcatcacactgaacaggatgtggcctgctgacagtgagtagctgaagtgcctgtttggtaagtaggttagcattcatcatgaactctgaaagccatttcagagtttggctgctgctctgaccctgctgtggtacaaaaaacatggatttttttttttttaactggagtaataccaaattccctttagaagcttgaagtttgatactattgctttccccattataaggattatacagtattaattaattataaggcccaaagtttgttttggcaaataaagtattattctctatcatcatcttttgaattcctgtccctagtatgttctttcatgttctgggtaaaatttccaaccctcaaagagtctaaaacgtctcatttttttttaccacgtcctccccagtaagaagccaaggtacaactcattgtacctacgaggtacaaactcatttgtagaaacaaagtaactagatattcctattgaaataagaatagatatattggtgggccaggcatggtggctcacgcctataatcccagcactttggaaggccaaggcaggaggatcacttgaggccaggagttcgagaccagcctgagcaacatggtgagaccctgtctctacaaaaaaaaaatttataaaaaaagaaaaaaatagttatatgactaaactactagtcaatacagcttgcaataatagtgcatgaatgataacaggcctcggctttatcacccaaaaaataacttgaattctatgtgaaatgtgttaggataagtttgctctgtctctagagttcaatgtagaagataattaagaggtaaaatatgaagcttatcatacactaaaggagaatatttggagttagatgagcctgtcacacaaagtgaaagtggaccctccagaaattttaggaattgccacaaagattgatgatagatgaataaacagatttgtggcctctggtaaagaaatccagccaagttcctctgtccaaatttttaagtgccctttgcaagctaatctatttggcaaaaaaatagtcccagttgttcaactagctcccttaaaacattctagtaggtgttttaaagcctaggtatcgctgcctctttagttcttgatgaatacaaggcaaaaaaaaaaaaaaaaaaaaaaaaaaaattgaggctttcactttggcatttgcttctgttccttgtatctgtggaagtcaagtagcccttctcaaaaatgagaagccaagctttaaatagcaaactacagggtattaaaagactaactcttcagttaagaacactgtagaaatggtagaccaacttaaagtctaccttttaacaatctttaccccaaacctaaagattctaggggtcacttatctctattacgtaatctaactggaataatttcctagaattcttactagtgaaatcttacccaagtaaaacaatttattattttgaatccaaatgaaagctatactgtttgctttcaatggtggcaaaaacttgcaaaaagcagatatacttttgctaatttaagttgaagtactatgaatacaacctgctaatcttgatccccaaatctgagcccttcagtttcataattgttttatcctgaacgtagttgtgacatagacatttctcaaaagggtctgatacatcaaactcctaacaagtaggagcagcaactagctaaagagtagaaagaagcttcccttattgtgggtgatgaggcggtgcctaaaaaccacatatatataatcccctgggtattacatattctgcaagccctgttagtggggagatggtagtggcaatagcagcgatagttgcgtcagtgctaactgctgctgctgcccgttctgttggcggctgctggccaagtgtgcacacttagccctggttgaggtgcattgtctgctgtcgtctgttaagcatctaaccggagtgggagggcacatcaagcgatttcactctcttaaagaaaaggtttttaggtatttttggtattatatagtctctaaggccagaaggggcttataatgacttctcttctagaattgtaatactaaaaaactactcgagtaaatatcctaacaagtatgatttttcttgggaaaactaaaaattgtacatccatgcttcagccatatcatgggcctaaactatgagagttcagaaatatataaaagtacaaaaatcttcaaaggtacttatttccaaatatggagggaatgaatctgaagagggaacaatggcgtttttcgaacttatttctctctaatccagcctggaggatttttagccgaaacagttgcatgtgaaggattatcagccatctttgcatatccctttcacatctaccttcacacaggaaagctgaatgcattttaccagtgaggctctagatatgaaacttagggatccatagataaataagctactaacaaactgataacagtggtgttccatctctctatcatgtctcctgagtccgtttcacgtttttgagcctggctaatgagaaaaagaacaaagtaggaccatgacccagtgttctcctgtaaatctcactgtaaaaatctcaatgcaaaaacactgagacaggagtgagaccagctgcgggtggggagtttgtgctccgcaggttacctcatggcatatcaaaaatggcttttttcttcactgcgctcaaggaaaaagtcagatgggtgacaaggtggttctgtttagaagcagcaggcaatgtagttaacagcatagacttccgtgtcttgtgtgtggtaccttgggcaagttactaactccctctgtaaagtagagacgatggggactgtctcactgtgacaaggtaagatttaagtgagatgcacacaaaaagctcagcacagtgtctggcatctaatatgtgcagggcagatgtcactactgaatatcacatcaatgctagggctgtatttactgtcgcacacaggcaccggtaagtgactttaccggtgaaagtcacaggtacctttatctatgatgaatgtaatgtgttagatggtgaccgaagtgttctccactacacctgtctgaagagatctaagtctgatatttaaggagtgatagcatcttgcatacttaagaaggcttaaaagactgcatggtttaaaccctagaaacataaatggaatgtttctgcctcagttcttttgactacctcctaggacatggaaacaaatatttgggagcctgcatagtctttagatggctgccaaagcacttaaaatctcctttaaattcttaccatatgcttacttttgtactaagtaagtgctcccaagtcttttacttgctcttcacagcaaccctaataggtatctccattttacataggtaaaaactgaggctacaaacaatctatggttccaaatcctatgtgcttactgccgtcttctcttagaaggggatgcagtactgtacaaagatygagctggatgtcgcattgcatgtttgctgagtcctcctcattgctgatgttaggatccttcaacagtttctcagatgccagctatggctggcatccagtatggtggtgtaatggaagtgtactactagcactactacatcaggtcagcacagattaactcagttacgtgttataccttcaagacgctagacattccagaattattttccttggccatccaagtgaagtagaagtagattgttggattgcaaagaaaatgataaagattccctaaaggaatttataagcaggcaacttcattcctatgtataagatattgggagaaaacaaactgtaccacaacaaatcttaagtttcaaggctctcctatagggagaaacatggccaaaaagacaggaagaactgtggcttgtaactcaatgatgctataactccagcactggatcttaagtattctggaatataccagattggtagaactaccagacttgggtatttctcagttaacacacatgcaaggaggaagagagtttttttgaacaaaatgactggctttgacaaaactatcttgctctttttaaatgtcacttgatactagaatgcgatttaaaagcatgtaatgcctcaggagtccggcatatacaaccaaattatcatgctcaggatcttcagaattctaaaggcacatgttagaatgcagagtcctgatgacctgtcaataaacttttttttactaatgaactgtacatttaaataaaagtttatttttgggataattgtgagcctttcctttctctagagaccttttataaaagcttttactcaaatctttttccttttctcaactgaatcactgaagatgactcagtcacccctttctaggaacaagtagggccacccaggtctggacacttcaggctgaaaaactgagagatggtccctttcttgccatatttagtacagttagtgcctcaccatggacagccagtatattatcctctcaaatttcccctctctacccttcccatgaaaaagacagaagtcaaagctactgttacttagttaggaatgttagcctagcacttccttcttgtaggtgactgagaacaggccacacctggctaaaggggggcatatcccagggcggcaggacaggaaaggacattacaagtaaaatcattttgatgctgtctcctcgttagttcttagatggtctgtgttgaaattcgtttataaggctaaaacttttgtgagtcgtagatatattccacctaaaacttttctaagcaatggccccagttgttcgaattagttgggcactaaaccttgaaattgactcagaggatccaaaagagtaggagaaaaataagtaaatcgaaggaaagagaaacagtcaaaaaaatattttaaagctcaacagtgagtctgtaataagtgagatattgcattttgtttgagatgttgatctcaccagctttgcagtgaggt

SEQ ID NO: 12359 - DNA, 23597 bp, Homo sapiens
gctctcctccttatgggttgtgtagacttgaatgaggtcccctctccaagcctttatttactcattgctgcaatgacagcaacctctctgcttcataaaagggtatatgaagcaaccctagcatggtctccaataagctcagtgggcattccttctctgtccccaccatatccatatggcctttctacaactatttctatgtttaaaagagctaaacctgcctgttatcccatttattataattctttcatttcgtatgtctaactgcacttgagtcctcacaattcagatggatagagtgaaggcttttcagaccctcaactgattaggtgaggcccacccacactcaatggggccacctgctttcatcacatggatatgctgaagacagattgttgaaatattctttgtttttaatttaaacttgtttcatcatactggttcttttgaggtgattttcatctcactttcaggtcgtttgagagtttcatcttactatataatggttgaaaaaggaaaggaagtcatcacttgcccaaggtggtggtgaattcccattctgttaccagccaagggaagggattaggggaaaatatttcacccagaaaagtgctgtgttgtttgagttcgccttttggttattaagggtactaatatatttttcatcaacaatgacttaaggcccctagaagttcatgaacctggtgtgggtgtgtgtttcccactcagatgtgctgtgtaacttgcacctgagggtaacacgaactctccctgggcaagatgtaaccagggaaagaaaggagaaggcagagctcagagcaagcagaaagccaagcaggagaccaaaagaggcctcagaggccatgtttgcatcttccacagagggacagacacattctctgcctctccagtaaacacaaacatgcaaacatgcacacacagagacatgcacacacacggaccatacacaccacaccacacacacacacacacaactacttatgtttctgaatattacaaacatcattacaaaatatgaaatgtacaaagaacaattcccggtggctcatgcttgtaatcccagaactttgggaagccgaggcaggtagatcacccgaggtcaggagttcaagactagcctgatcaacatggtgaaaccccgtctctattaaaaaatacaaaaattagccaggcacagtggtgggcgcctgtaatcccagctactcaggaggctgaggcaggagaattgcttgaacccaggaggcggaggttgcagtgagctgagattacaccattgcactccagcctgggcaacagagcaagcctccgtcttaaaaaaaaaaaaaggaacaattcctgaagcttctgatgatttctggctgaccatgaggttggaagtgggaacacattaagggcttaatgatgggacacagtgatgtaaccactgtggagccacaattgaagtgctgagattcagcattggaagacatctctgtcaccaaatgaacacgcctccctaaagagctctggcagtgagtcaaaggcttcatttgggtcaagacagagttattatacaaaaagccaagtttcattctacaaatccacatcggggtcaatattttaaagtgatttcccccaagttctgtgtagagcaagctgacagagaagaaatggctctgagatatctggcaaggtgcagatggactgaccacaagccgcttatccccactgtagctccgggctcccttctaccacagtggccatatctgtgaggttctgccctttccctggggccactgcatcagtcagggctctccagagaaacggaatccacaggaggtatacctatagcatacacaaaggctttattataaggaattggcccatgcaattatggaagctgacacatccaatgtctataggtccaaggtcccagttccagtcctaagaggattctcctagttagagacttctctctaactagggagagtgttggctttttgtcttcaataacagtctactcaggccctcaactaattgggtgaggctcacccacactaggaagggccatctgctctcctcagtctactgactcacttgtcaatctcatccagaaaccccctcacagacacattcagaataatgtttgaccacatatctgggcaccccatgccccagtcaagttcacacatacaattaaccatcataactatctgttagaccccaccttgcagggggcagtcctcctctggaaaccttcaggacttgaagtgtcaagctcatgtgtgcaaactgtgaccaacacacattttcctgagaagaggcctcagacaaacaaaaaaatatcatgcatgcacatttactcagataatgactgtctgttgcagcctttacgctaaacagagctaagagtagagatagtgcagattaactcagacccagaaacttggggaggcaccctgggatcctggaagcagatgctgggagggcagaggggaccgagaaaggaggtgcatttactcagctcttctgagacaattctgctctcctgcggtgcactcgttctgctggagaaagggctcactttgagtttgaatcttaaaactgcatgtcctttaaccacactgtacctgctcaccaggctgtggacactaaattgttgggaaagtgaatatatttcatttttttaattaaaaaagcatgtaaggttatattacataattgtgatatataatacatttattcaaatcatatttaagtttggggccacatgattttcaaaagtatacagatataactcatagtatctttcaattttattcccataagcctagatttgatttaaagtctaagcgcaaaggtagagaaattttttagttgtttagtacctgccattttatttttctccaactttttattatggaaaaagttcaaagatacaaagaaggagaacagattgtacaaccccttccctaaatccaccacgtagaaccaataatcaccaaccttttgtcatatcagcttatgtgcacgtactgtgctgaacaatttaaaataagttttagacatgaagacattttaccctttaatacttcagcagcacctcctaaaattaaagccattctcctaaacaaacattatgccattatcacacctaaaaacattaacaataattctatactatcagtcaatatcccctccaatttgtaatttcctccaaaatgtttttgtgtgcgtgtgtgtgtgctgatttgtccagctgggagtcaatccggatttgtacttattgttatacttcttcttttcagctgttcttataccagaagaatccttcacccctttttcttgacattgattttttttggaagagctcaggactgcagaatgcccacactctggtagtccagtttttcccatggtgtcatttaactcatggctcaaactcttccatttcctgtaaacttgcagtaaagtctagaggctttgcaattgattcaattgaagcatctttggcaagcacacagcaacaatgatgttgtgtgtttcttttgcatcacataatgccaggttgagccagtattagtgacactgagtttgatcttcctgtaaggtacagccagatgtctccataaaaaaatggaaaatggaaaacctttttcttttttttttccaattagcacccgttcgcctgcacactttcacctaagggtttgacacccactagtgcacactgcctgatttaattatttcattaagggttacagaatggggatttcctcattctcgcatttctacgtttatgagctggcattcttctgttaaactgctttcacttgtgaaacaggatgcagaggaggagacttattcaacagaattgtagggagggctgtttctctcaaaaggagtggtgagagaagatggtctctaccggggcatggagggctccttgtcagagtctagtgtctgagctttaaggcccaggaagagggcagcagatgggggtggggcagtgggtgagtgagaggcccgtgtgtggggagacccactgaggacagggatcgttagggaaacggagcctcactgaaagaggaatttcagtgatgccatgggtcagatcctgggtctctcttagggaaacctgccataaagcatgagagccacattactcctcaggccttctgggctccgattccgcagactagttttggaggcatcaccacgcctcaaggttgctctgttatatcagggtaactgactttctctaggaacggagacttgggtgccccttaaaacaaccctcagccagtatcctagcagtaaatttttcatcacgggaagcaactaattgaacagaggtgtgatgaacctactgaccactttggtaatatagacacagtggccacagtatgggggattgttatcctggttgtgaccaatgccaaaggagcatgtttccttcttttcttgacttgatgctgtaggagtccaacaaagggaagcacattcaggcccacatgaaacttgggacagaagtggcttctcagagccgtgcaccaggcactttgaacaagttggaaggctacagtgccggragactccacagtagcacaggcgaagtggcttaggcgaaaacgctgggaagtaccccagctcccgggggccagagcctctagggctggcagcctcagcaggcagagtcacttgcctccttcagctcaattgctgagggcttgcgtttctctgcagggaacaggagtgccgccgacttccactcttggtgcccttcaccgctcaaactgcaccccaaataagcgtatgcaccctgctccaagagaaggatgcgctgggctgatcctctggaggcaagagggcaaaagacagaaagtaacgagcggcctttgcacaaagaatcctcaactctctgcagcggcccctgcggcccaatcctgccggcccaggaatgcacggtcggataacaggcctctccttgctttttcgtcttcttcctcccgcttctctcctctctccttttcctcctcctcctttttctttaattttctcctttctccccaagcttctacagttgtttctgtgttcgctcaatcatggcctttggcattgattgaaaatttggcagttccttctctcggaattctgtttgaagccttcatatggatttattattattattattatttttgccacacaaaaggggcaaatccgcgtgaggaagggggtcgcatgggggtcggctgagatctgctggctgccggtctaggaggggcgctgctctgtgccggagtgggctctggtgcaccagcagaggctgggggagagtgctgcccccgcctggagcccaagtctctgcgtgcctgggggtagagcgcggagagggaccaggcaggcgccggaggggacccgcgmggaaaaggaagaagcccaaacaaaaacgctgtccggcgccaggcgcccacctgcaagcccaagccggtgctcggccagttacaaaagaaatggtcaggatctggacaacgataatgatagtattaatcctcctattaagaatcggcccaaacaaaccctcgctgtcagggcgacaggcgcccgcccaagcccagacctcggacctggttccaagcctgttcccgctgggtctctgggcgcccggtttctgcacctggagctcgcccgatgaggacaaggtctggaggccggcctgggaacaggggccgaagggcgagccggaccctaggggattggtagggtcggggagaaggggtccaggctaggggcgggcggggcgcasggagaccaggcggcttgagcgggaggtggggagctggaggagtgccgggttcgcgggcgggggacggggagaggggggcggggagaggggcgggagtcgggggcggcgaggggaggggcggagcgcgggtcccgccccggcgggccgctggaaaagtttagtctctgactcgctcgggcagaggccgaggaagccggttccggggacgggcaacagggactcagggaccagaaggcggctgcaggacgcgaccgagcaggaccccaggcccgggaacgacgtcgcgagcgctgagactgccgggcctcccagcccatctggcattcgagcgcaggaccgggcgccccggcaccgccgcgcgccacccgctaggatgccggtggccccagcgccctcagccgacggaggtgagaggcgggcccgggcggggcgcggaaccagggtggggggctgggggccgaaggacccacctttccaacaaaatccccaccgatcccgggcgcgacggggacttgggcgcgccacggcggccggagcgctccacatcagcacccctcccccagagccgctgcaggaacagggaggaggccttttccaccgcacccggarcgtttacaacgggctggagctgaatacctggatgaaagtggagaggctgttcgtggagaagttccatcagtcgttttccttggacaattaacaagttaggcttccacagtgccagggcctggggatgctggacgtgggagagggttgtggtcgttagcctgggaaaatcattcttttaaacaatattcgccggaaaattagttttttcctaacatttctcaaacaaggcaattagggccgtcagaatcggtgctggaagacgaagtccccacagtgcaataatgaggttcccacggaaaatcagtacgttgtgttcgtaactgagataacagctagagaaggggctttgggctttttgagtctcccaatagtcagtctctctctctctctctctctctctcttcctctgactttctggctttggacactcccaatggtatatttctttgtggtgtttttatatttggatataagagaggaacttcttgttggatttttaagggaacacacttcgttttgacccttccaataaggaaaggggagctacaggaacagagagctctttagaaggttacttttaaatggaggcccccccattcatggtacccactcccacttggacctctgagacctccagaattaggcatcattctaaaatctggacattagaagtcacagactttgtatataaccacatattcataatttatcttttcaatgttttttattcatagatgaaaatcttgcaggcatagttaagaaaaatataattcctagaaagtacaagggaaggattatgctctgcagatacatgactaacaaggatagctggccatgcccagggctggtgttggttgaggaggtggtgatggtgcggggcatgtgtgtgtgtgtgtgtgtgygcgcttgaggagttgtggaagtgttcatatctgtaaagtattatttcatggatgcagaccttaatgctaggttgaataactttgttgccatagaagaagaaccgcacgtcaggcttttttcattagcaaaccagtaagcactcactttgggcctytgaaatcacttccatcacctaacaccagagatacaaactgaagctagcccttaagagcctccccctaagatttagagagaatgatttctcaaccagttttcatctttgaaagtgccatttctccctttatcattgtgatttttattcaaatgcatgagtctctgattttctaccatatacaaagggtagagactacagtttcctatagaagaaacttcacatagtggccgaaggatcttatttctcaaaattcaggaactggtttcctctttctggaaattatgacattaacttgatttcatggtatctctttcatcttcctcaatgcctgtgctgtatgtatatttttattatatactgtaggtatatttttattaccaaaaaaaggagaatttgagcatgccacaatcttgaaaaatctgaggttgccctgctgtagaaccctttaactgccaggactttgtactgtttcccaagtgttaccagagccaggccgccagccttatgcagtctgtttaccttagctggaaccagggtgctgtgctgtgggttctatgaaactttctgtttcttcatatttggctttgtaattcctttcttatcagttttggaggcatttcctattattcctctgccatatgttttctgccaaattaattgccttaagattttccttaagcttttggaaatgtataatgtttgagaaaaaagaaaaagaatagactgagtggaatcgtatctagtttcagttaataacaygtttcagttgatgttactgttatagctactgggcataaagtctccttcccttttttgaatcctatttttgaggcattgaagctgtgtctgtaagagacaataggccagttgggttaaatcagtgacgagattgtccagtgcagattggtgcccagtgagtggatcttcactgctcacaggccggactggggtcagctcacacagcgaggtgacggtccgctcctcaagcagtggatggtgctcttcggccttgcagatgccgctccattttcctggcttcaaaattttccagatatttcagtgcccccagaatgacatgctaacattctgctggcatgggagcatgaggcagtttgtctctaaaacatgccagagaatctcttgtcactacctaggcaaagaaccagtggcaaggtggcagcctcccaaagagctcatccctaatgtgacatcctggaatcagatggcacggacaccggcccagccccttcccagctctgtgactaaggacaagtgacacccyccctcccccagcctcggtctcctcctgtgtacattcagaaggcagatgctgccatgaggccatgtgtgctatgtccatggtgcaaggtggcacgcatgccgagtcaccaggtgagactgccgctttgggaagggataggaaggatctccggtagccttcgtgggcaggatgcctcttatttgaatgtgcctttagccacctcacagagcctatttccacatccctgtggattcatccctgtggaaatcttgagaatcatttatcctatgctgtcatgaagcagcagcagaatggagaaggtttaaaaagactcatggacaggcaaagcggtcaaacacctcctggctcagacgcacttgccttcccacacacaagtctggaagctcaggatggtgttcacggaggcagatgctcggggccggggcctgagtttcctggggcacagcctccatatctggggttccctggactatgcccagatagctcataatgtcccagccttatttgtgatggagaaggacttggggaaaagccaccgggaagcagtaagtctaaccagggaagtgcactgacttgcatgctttgaagaagagaagggagaaaagatacaaaaccctcacctggtttgtctgtaacagttgttatttctcaggggagctgcattaatgggccaagcctgtgcagctgggtgtgtgaagcatgcattttgcaatggactgtctccaaaagcagagcgaggtcacccaagaaatctagagcaagggaaaatactcattagcaaaggaattttgctggagccttgtaacggccgactcattatttcctttccaagttattttaaatgaaattttaaaaaacatcttgctttccaagaaattttgcttgttggcatatgtttggtgttttgattcagtttggaggatgaactagttaatttccctgggagtacatgcctattaaaaatatagcatcctgcatctgaccaagatgctatcttactatcttattgtgcctatcttttatgcggagagagaaaggggggtgttgggaaggagaccagactgtggaaacattttctttattttttctctttttcttccttttatagtttgtttatttttcaacttgacatgggtagagaaagcgaatcgctagtatagaaagcacatctggaatccatccggcctcctctctctggctcaccctcctcccagcaatgtttctccttggaagttgggggaaggtaggcacctctgaccttggcagggtctaacttggggtcatccactgcatactcatcttccagaaggcgtcttattcctcctcgacaaaaaaaaaatgtgttggtattaaaatgctttgaggtaggctggatgaacccagcttagtgargatgacatgaaaacccttagctaatggggtctttattgagtagaactcaggtaagttcagatgtaagcagtgtctctcagtaaacatgaaaagactgaagatgcagacaatcaaatacttaagtctcttgaagagctgggtggtgggcgggggtcttcccaggtggtcagggagatgtgttagtgtagcacttggaagagagtggaacgaccaggcaaggatgtgccgtggaggtgggcagtgggagcagcccagtgtcagcatctgtattggttagaagaccaccgctaatgaggaggagcgtctctaccctgcagctgtctgtactcctgtgtcttccgtaatgtgccaagctctctgaatatatgcaaaactagtctgcaaaragccatatgtctcagcatctggctttatttctaagtgttcaggtggaatttaagccgcgatcaaatttacaatgtcactgccagctctggacacttacttttggaataaagcaaagagtgaacactaatactgcatcagtcttgccctctgttaggggccgccccttctccccacaccagttttgcaagatgggctggctggggtctgagaaacccagtgcctccgagtcatggttaaagcccatctcagacaccaacacaccgctcacaaatcaacatcgacctgcgaaaacatggacatgtgttcgccaagagaacatcctcaatcaatcccagcagtgctacttgatgataatcaacacatgggccatggaagaaattaccccatgtccataaacaagaatgaatagagggtagtgtatctacccacaccatgagagcaagaatattcagcatgcaggtgcatctatgtgcatgactcgtacaagcatcatggggagaggaaagcaatggacacaattgtatcctgtagggtttcattcacgtgaaggtcagaagcaggctaaactcacctaggggagagtcctatcccaggtagtggtcatgcttggggacaggtggtgactaggaggggcacaaggaaggctgcagsgtccggcccatcttgttgctggcctgggtgctggtctcactgatctctgtgtggtggggcaggtcagcctcccaggcctgctggtgcctgcagtgcccagcactcctgccgtgcctggcagtgttagtaccaatccgccagagtgactgactcccctcttgccctgagtagggcttgctgactccaggagcctcagggcggggtgggctttgagctttcttctagcaaacttgaggtctgtggctggtacccctcaggagcggaggggaactcttgtccatgagatgcttttaaccgtgcgcaataatgtgtagacgcatccaaaatcaatctggcctttagcccagcacttaactcttgggatgaggcctgctttgtaaatgttgataatccagagaaaatgagcttttagattccaaagacagccagatatcttccacttatgcaaaatgcagagaatcatatttaacaaaagatgttctggacaaatatgcttcttgagggatgaatatttaattataagggaaatgataaatcaaacattaatgggaaaatatgtttgccctcaagattcatgattttgatgggtctctggcaaatcttatactatgtttattggggttattttattgctggttattagtttttaattgtttgcttgttttctgctctgatcaatttttgtataagccgtgggtctattcaccctcttctctccattcccgggagcaagtccacatctggctgttggatgcatggcaaaagcaaaggtgtggagaaggttcagaggagacaggacatgtataaaatggtagggtcaggttgtcatgggggaaactgaggcacaggaggcaagctgagttagtacaagaacagtctgaatcataacgacatgccagtattacctaaaaggatgaggaacatggagctgtacttgaatccctacgtgagctggggaaaaggggcctcaggaatcactgacattggaaccaaggtttgtctgcagcttgtcggtttctgggacagaaacccaacatactggagtgggtatcccagcratctgtaggataaaccaggacactgtggtgtcatggatagctggctgtctgccaggtgatggcccctctggttgcaatgtgagccgggcaggtcatccatttggcagcatggtgagggctctggccccagttgctatgggagggaggatgctggcacagggcactgttcacagactgcctttgctccatgccttttccatgagcatgagtggctgttcgtgtgggaaacggcagagccctcgcrgtccccatcagcactgtgcagtggtaccggaggtggcaggagacagcctgatggcccaggttgtcttcatacccggcttcatgccagggtgcatgccgggcatagcacatgtgtccctgagaggcccctgatcaggggtggaaacccagcaaagtgaaaatcagaaatagtgattctccagttcctgttcacagataaagaaagaaagaaataataagcaatactaggcctggtgtggtagttcacacctgtaatcccagcactttgggaggccaaggcaggcaatcacttgaggtcaggagttcaagaccagcctggccaacatggtgaaaccccgtctctactaaaaatacaaatattagccgggcatggtggcgggcgcctgtagtcccagctactcaggaggctgaggcagaagaatcgcttgaaccggggaggcggagggtgtggtgagccgggatcgcaccgctgcactccagcctgggtgacagaatgagactccatcccaaaaacaaaacaaaacaaaacaaaaaacaaacaaaaacaactaaaaggacagtatctttttagcacccatcagtgtacaggatgctggggagggtactgtgaacttacccatggtgaaagtccctgtgttaatggataagctcaatgctcagaaaatgctgctgactgtggtattgccccatttaaagagacagtttgcagtacgttttcagaagtggcatgcagcctcagagaaaagtcaccaggggctggcatgattccagaaaatgttacagagcaagtggaatttgacttgaggcttgaaggatgggcaagatttaaataaaattcagaaacggtagagagggaggggctggggggaaggctgcccactggactgtcctgtttgcctccaggagaacctacaggcaagacatggtctcttctcaggtgaatgggaagccaagtagggctggcatgggtgagccacagctcgaggaggcaggccccgggccctgcgctgcctgtcatggctcatgagtgatgggagagatctgggcaggcaacctcctctcatcctgcatcatcagcctggacttggaacttggctgctttttctttctgcagttagcrgagggccttggccaacacataagcctttctgccagcacttggcattccagctgacctcgacccaaggcctctgtgacttcaggaggcggcagctgggaagggtcagggcagttccaggcagagcacagacgtcagctcagacatcctaccccccgccaaccccccgcccccggggtttccagagcaaccaacaccaccaagctccaggacactggaaaaaaaatctttgcaaagaagcaaggggccatctcagaaaatccaggtcccccaaattgatgtagggagaggagggctttgacagcattcagcactccagagggtcacgaggatacagaaaccatttggagccacctctgcttctcagccccacccaggcaagccctggatcttcaagggactgatttgtacctgggaataaactcatgcatggatgagattcagagtcaatcacaccctaaaatgcagagcccatagtattggtgagttgttcatgtgtctctgaagcaaatttagggctgtggttcaaacatcgtaaaagttaaaaaaaattcactggatacacacagtaggctcttttaaattagcctcatttgaacttaattacatatttaaatactcaaataataaatgatggctgggtgcggtgtctcatgcctgtaatcccagcactttgggaggctgaggcaggctgatcacttgaggtcaggagttcgagcccagcctggccaacatggtgaaaccccgtctctactaaaaatacaaaaattagccatgcatggtggcgggtgcctgtaatcccagctacttgggaggctgaggcagcagaagcacttgaacccaggaggcagtggttgcaatgagccgagatcgcaccactgcattccagcctgggtgacagagcaacactgtgtctcaaaagaaaattttttttaataaaaataaaaaataaaataaaataagtgagtccactgaaagcggtttctaccttgatagttgggtgtgtggcgtcatcaacatcacagaaggctgatcgatattaccaggtgtggttgagtgcaagtgtttgaggtctcgtgggggaagagtttggaattcagaatccattgaggccttcactcaccactttccctctctcgctgtgttcccaaatgtgccacttttctgttggctcacatgcacccatgctctatttgatattcagggctctgaatttcaagccagactcagtcagtgtgattgtcactgctttcctgtccttcctttatcatctgtagacttgggtcccgtttttgcaggttgatgttctgtcttcgctgggctctggactcactgctcacgagtgcggtgtctgcatgggcactgcccagacatgcactgttggtccctcgatggctgcatggtcaggcctcagggctctctgccaggccgacctacagcccatacagacctgatttctgggcctggatccaggggatgccatctgggaagtgcgggatcttcccacgatgtcactgtaaaactcaccagggaggttttagaaattgaaccggcatcattcagattccatcctgctttttggtcctgagaaaatcctgcttttccctgagtaactgggataatgggtcaccagctcccatgccctagatgaggactagttagcattttctagtgcctggagatttccagatggaagctgtacttgggtctgtgtatctttgttacaggattcaataattcatgcactgaatttcccttcccggcaactccagacaccaaatcgcttcccatggtgtcccccaatcacttaggaatttagcctgtgtctaaagaccctctctgcagcctgacgtggctmgccatcccagtacttccacgtttttcrtgcctttctccaacagcgttgccgtggccccttaggcggcgatcgttttatcaatggtcgctccctctttttatctgttggcaggagccctttttcaacgccctcgctggagtctggcctgcacgccttgctgaatgaagccggaacctcagccccgcttccctttgaaatgaatgttcctggggcgccctctcgtggattttggagctaatcgtctgtgaatgccaagtgatggcaactgccctcccgccgcgtctccagccggtgcgggggaacgagaccctgcgggagcattaccagtacgtggggaagttggcgggcaggctgaaggaggcctccgagggcagcacgctcaccaccgtgctcttcttggtcatctgcagcttcatcgtcttggagaacctgatggttttgattgccatctggaaaaacaataaatttcacaaccgcatgtactttttcattggcaacctggctctctgcgacctgctggccggcatcgcttacaaggtcaacattctgatgtctggcaagaagacgttcagcctgtctcccacggtctggttcctcagggagggcagtatgttcgtggcccttggggcgtccacctgcagcttactggccatcgccatcgagcggcacttgacaatgatcaaaatgaggccttacgacgccaacaagaggcaccgcgtcttcctcctgatcgggatgtgctggctcattgccttyaygctgggcgccctgcccattctgggctggaactgcctgcacaatctccctgactgctctaccatcctgcccctctactccaagaagtacattgccttctgcatcagcatcttcacggccatcctggtgacsatcgtgatcctctacgcacgcatctacttcctggtgaagtccagcagccgtaaggtggccaaccacaacaactcggagcggtccatggcactgctgcrgaccgtggtgattgtggtgagcgtgttcatcgcctgctggtccccactcttcatcctcttcctcattgatgtggcctgcagggtgcaggcgtgccccatcctcttcaaggctcagtggttcatcgtgttggctgtgctcaactccgccatgaacccggtcatctacacgctggccagcaaggagatgcggcgggccttcttccgtctggtctgcaactgcctggtcaggggacggggggcccgcgcctcacccatccagcctgcgctcgacccaagcagaagtaaatcaagcagcagcaacaatagcagccactctccgaaggtcaaggaagacctgccccacacagccccctcatcctgcatcatggacaagaacgcagcacttcagaatgggatcttctgcaactgatcgtctccatgcgccctgctctgcggctgtgttcttatttattgcatgcgtcgcttccacaggggcccctcaagagctgtgactcgggagagctaccttactttgaccaacagcctgcccagtgtggatgtctcttacagagggggcccaaggaatcaccaccccgcttcagtgtaaacaacgtgccttgtccactttgggctccagagtctttcagatgtactaagctgctgacatcatccactgccttctgctgcatcctagacaccctccctgttgttcacagagagggaaggtcgtgggccacacaatgctgtgtgaccctctccgtgtgcctctgaatggtgttttgatgattttacactacatttcctgtgcgtagaatggatgcttgtatattcgtacatctctatgttacacagaatttgtgttgcaggtgtttgccatgtggtacctacatagaatctccatacaacacacaggtaacaggttatacaagtggattcagactgaacccccagtacaaggacattgttttgaactaggtggacatgccatccctggtctccttagactgacatgattctcatgttaaccaagttttaaaagttcaaattccccaaaaaggcttgtccaaggctggccccagatgtgtgggtctgacccacaccagccctgtgtcctgtcctttcagtcatttgtccctgcgtaattttaatcgtattccaaagcccaattatgtgatggttttcaggtttctgcaaattacagaagagccagccaagatcacccaggagcttgtgcccccagatgggccaaagaaagagcctatgaaggagaagcagaagcagacggctggcctggctcaccttcccacgccagtggggcaggggtctgcttcaggaaatggaagctgtccaggaaatgagcagagattcacaagacagcactttgattctatgttgagtttgtttctatattagaaaagcagcaagtcagtaatcccccgtggcatcacagctaagtagctgtggccaccggcagtttcacagcatcctgaaagctggcactgatcgtgactatcagtgaaagaagtttaattttcaggttagaaaatgtgatctggcagtttatgcattcttcagagtaatgtaataatacctatgtgatgctgtaattttacttttcaacataagttgaacccgtagcagtctgtttaccttgtaaagggattacttagaagacatttttgtacatgctcttccccaaggattgtacgtattatacaaatagatggaaagaaaagtgaacacgtttgtagaactttcataagcacacagttgctgtgttgagttctctttaaaaacaaggacaaaaccaaccagcgttcaaaggaacctcccatcagagtcccctaaagtattttaggttcagtgagcatttgcctgaataaaacctaaaagagtagtcttaacacattactaactttttctaagagaaattgattcctgttttgtcatctgatgcaatttgctcttataaagagacattttcataggttcagagtaactcacctccatgggctgaccaaaggcttttctaatttttgttactgatgagatgaaacctatttgtaaggagatcttccccaggagcatttctgttgccttcttgacatcaatgaaaagtagcatattctcttatgaaatagcatgagaaaacacagggcatttctaggacagtaaaacgttaaagtactggattaagaaaacaacaacaggctgggcgcagtggctcacacctgtaatcccagcactttgggaggctgaggcgggtggatcacctgaggtcaggagtttgtgaccagcctggccaacatagtgaaatcctgtttctactaaaaatacaaaaattagctggatgcgatagcacgtgcctgtagtcccagctactcgggaggctgaggctggagagttgctcaaacccgggaggcggagattgcagtgagccaagatcgcaccactgcactccagcctgggtgacagagcgaccctctgtctcaaaaaataataataataataaataaaacaacaacaaaatgcatcagagagccaaaacattcagtattgcattttcacataggtgatgaaatgactttggaactttatctgtgttatagttatgagttgctttgggagacttggagctctctgtagctattgttcataacactttgctccataaccctgatgtccgcagtatctaagtatctcagccttcatccattaactctactagggagcccacagccaccatttccactaggaggtatcaatatttgtggtatgacataaggctcccttgaaataacaagacttttgagcaatctgaattaaaaatacatcaaaaaagtaatagcgctcatttgctaaatgcaaaaaataatcacctttgataccaatgtgcaccaatatgcctaactagctagccagctggagataatttaccagggaatgtttcaaagccctaactttgaagtttggaaacaggtggtcttctatgctgcagagaaactatgcattaggtctcttttcaattagaaacctttactatttccaatgtatgtttgttaaaaataataataataaaaccaaaagcctttgtggaaacccactcttcgtagtccatgtgatgggattgttttatcgttttcaccgggtgccctccccactgcaggggtgcgcactgttgttgcaggcttgctacccacctgtgtttcttagcatttcaggaattaaaccacattcagaaccccaaataacctttcccctttcttcttacccactatcataggtggtattttaatgaagcatctgtgccttgggtgctatttacaccaattttggtaggtcatactattttgagaatggtcttttgatagggagaaatttctaagacccatggtaataaaagtgcagctcaaagacatgggacctcttgtcctgccccatttgctgttgtttatgcagcaggagagaataggtcagaaccaacctttgcacactagctttctcccacacaaacggtccattttagcctctctgtcccacttgctatgtaaagaggaggccagtgctcggcataactgttctggtagcgatgcttgttacaactcatgatgaaatgtcccaacgcaagtgaggacgcagctgcccgccccagagctagaaggtaaggtgagttctctaggagtacatctgcccggatgcattttcattccgcagccttgatgaatgggacgaggctttgttgtgactgttttttaagcagtcccccagggaatcactgaaaatacctacttcttagagaaaagtttcaagctcccctcctctcttttgtgaggcaatacaaaatccatcatccaaatgaaagatacttttcacaacagcctttattgcctgcagacttacatgtatagtcctttaaacaattaactgtttagaaaatggttgtttctctcaacccttgagccagttattccacgctggtaagaccctttcacagaaatgtaacaaggtgcattttatagaaaacatctaattaaatcaccagtttcatgcttttaagttgtatctacaagtgcaaaactgcaacacccaaatgtttttagtatctaagtcagatatccaaaagttagctccataatcagaaatgcgcacaccactgttctgataataaaggcacattttccaataaccaattataacaagaagtgcagcattacctaaattgggtgtgtcatcttcccctcctgggtcacaggatgacacctggggatgcgatgccgtgcctgcacttggcgatcccaggagcacagaaatgcaccagacagatcatgaagggctaatgcttggaaaccacaccatttcctgacagagtgaagggatccctgtggatttatcaaaagggaggagggaatttaagctaattctcttcacctgctgtattctcaaatctccaaaacaccagataacttaggttttttcatttgtcatagaacaaagattagagaacttgaaattcgttttgcatttccactcctcagggatgtcaaaaaagccagttctgttccagcacaaagtagaaagtggtgaattggcaatacgccaagacatagactgttacagtaattctttttgtttcacaaaagttaatggaaacaaaacaactttcagataatattcatttgtcagtatgtataatttgccatccaaatgctttttaaaaagttattatcttattattacacattaaatttacatggagttgtctcctaatcctgggattttaacaccaaatgtttaattctgaatacaaagaaacattcacatacttaattttacaatattctggaacaagttatattcaaaagtcaaatgaacagagaacattccacttgcaaccaacacatagctgttaacaaaattaaccccattaatatttaaagacggatttatccattaatgcctgttttaattgtcacttgattttgatggttagaaactttggttatggtaaaaatgatcacatgagtgggaattcattacctcaaagctcaggaccacagctccccatgtgcatgtttttctgtctgcagtatttcaaggtgagacaacaaaatagacacctaaaattgtatgagattttattcctggtgctttttcagcgagaaccatttttccagacctagggaaggagcctgtgtgtttttggcctgaaggattcatcaattcagagcatctgtgacagccaggaggaggaaagaagggaggctgggatcacctcccgccccttctagcatctctactgagagtgacaactccaggctgtccacccccatcctgagccttccacactcttctccatgccactaacactcagtatctgacgcctgcagtgcgaagcctccagagtccccagactgacctgggcactccacccttgctggttctactttacttggacacacgggtaccttaaggcttgtcacactccaacacctttgtgtgtgtgtgtctttatttctttctaggttataaactcaggcagaggcctcatacattcacttctctatcccaccatcccagtacagggccagccacatattaactaatgcacaaatgaggccaagaaactggctagaaatcccaagaaactgtgccaagtatatgcagctgcacctgggaatacacgaaagcatgacatcacgagcacagcctcctccaccacaccttccctttctcctccttccctgctggcctcagacagctatgcatggctgcatgaaggaagatctaaatctggacttgttttatcctccccttcccttcttctcacctttattctgcctccaccttcttctttctttgtcttcccccgctggcttctctgtcatttcccacagtgggttcccccaatccctgtggtcctcatgtcctgttcttgttctctttgtgctggatctcacatcctacagcatccaggaccatcctccatggctgatgccacagcctgccaattcccaaattcttcacgtttgtttgacttcctacttagctgtaaaaccaaagcccagggaggagtcccaaggtgcacaacacagagccaatctgcgtgtgtacagagatgcagatccgtttttaatcaatgtaagtatatgcgtatatgtatatacatatgcaattcacattcacaagtcctggtataaagttgcaatttttctggctgctataaaatgtgccagttttaaaactgtgcatttgttgcttgcaaacttataaatatgtataaaccccattataaataaattatggctggcagatggcatttaagctgccagcaatggttgcatggagttataaatgcttattaattctccacttttaaattcacagcacggaccctgggatctgtgacatgaagtggtgtgaaagcataattataaattagaggggggaaagccatcaataagagacaggtaagggctggaaactctcactagtgagtggttctcaaagtcaagacttcagagcagctgcaccagcatcacctcgagattttttgaaatgcaaattcccgggccccactccagacctagggagtcaggaacttggcggggccaggggggtggaagggcctgcaatctttgtctgaaccagctcacagggtggttctgatgcctgccttccactcgaagtctgcttgtcacgaacgcctgtctcagctcagggacatccccggcttaggaagtatgctcaggtgtgtgcagggccagtcagaaattgtttccagaaacagcctttcataagtgatagacttggtgaataaataccccagctgtctccccgccttgctgggtgaactctggggtgtcagctctgtctctcggggttccccagtgggattcagctccagttgtgcacatgacggtaacttacttgataatgcacgccttccccgtcagcttccttctctccctacttccgggatcttcactcagataaactacataacctcaagtcctctctcagggtctccttctggaggaaccccaactaagaggaagtagaaacactgtctctcccatctgaatgactcaggcttttatgcattttgagatggagcacagatgtagaacccctggagggaagcactgcttgccatttccgtggggcagggggct

SEQ ID NO: 12360 - DNA, 23489 bp, Homo sapiens
  misc_feature (1)...(23489): n = A,T,C or G, or insertion/deletion polymorphism (see Tables 1-2)
ggagggatctagacaaatgggcacacttaccagcagtcaactgctaattcaaatctattgagacctggccaggcacagtggctcatgcctttaatcccagcagtttgggaggccaaggcgggcagatcacccaaggtcaggagttcgagactaggctggccaacacggtgaaaccccatctctactaaaaatacaaaaagtagccgggcgtggtggcacatccctgtggtcccagctacttgggaggttgaggcagaagaatcgcttgaacatgagaggcggaggctgcagtcagccaagatcgtgccactgcactccagcctgggtaacagagcaagacttcatctcaaaaaatatatatataatatatattttatatttatatatttaatatctattatatatatatgtagagagagagagactttttcctcaccagattgacagagagtttttaaaataaaaatgctggctaggcatggtggctcatgcctgtaatcccaacactttgggaggatgagaagagaaggtcacatgagcccaagagttcaatcccagcctgggcaacacagcaagacccatctctacaaaaaaaaaatatatatatatatatataggctgggtctggtggcatgagcctgtagtcccagttacttgggaggctaaggtagaaagatcaccttccttctgggaggtcaaggctgcaatgagccatgatcacaccactgcactccagcctgggtaacagagcaagaccccgtgtcaaaaaaaaaaaaaaaaaacacttagtaagactgcagggaaacaggtgctctctatgcagtaatgcagtactggtagcacatacacagtccagcctatccgaatgccaggtcagcatcacacgtcaatgaatagtagttaagtcacactgatttgtcctgtaaratctctgttatccttcaagcaacatcacacgtgctccagtgtggggagtgatagttcgtatgtccaagcttcattcattcactcaacacacattcttggagcacctaggacttagttgggtattaagatatggaaaggactaagcccccacctgtgccttcaaggggttcccaggccagtggcaaagaccaacaagcgtccagaaaatgactgcattccagcatggcaggtgatgtgtaaggagggttgccatccagcccacacctggggcagggagggtctcaaacatcaggggaggctgagcctcctctcagaagtcataacctgacaaggcccctgccctcagggactttgcattctagtgtgggaaaacagacagccaacctgtaaacaagtaagcaaataaaatcatttcaaatagtgacaagtgctacaagaaattgagaagaagtgacggggctggcacatagaaggtctactctgagagaggggtcaaggaaagctttttgaggaagtagcattgggctgggcttggaataaacggtaagaagctaggggaacagcccttctgacagcaactacctcagggcaagggccccgaagcaggcctagcatggccagttaaaaggcaggaggaagagtggacaggcttgagcatagagaacggagccaggaactgtgtgaggccgagagtgggcagcagctgagccaggtgggcttttgcaggccaatgagtatttgtggaatgcattaactctctgagaagtggaaaccaatattggtcaaattaatatgcagctattgagagagtcctgaggagctggaggaaacagagggagtcaggggtgccctgggaggctggagggatcacaggcctagtcccggaaccttggctatgagtttcagcctgatcctcaggccctgggcacccatgggagggttttaggcaggatgacattatctggatttgcactttagaaaggtaggtaaataatgcctcacaaacaccttccatgtgtcacacactcggcctttaatcctcaaaaccccctgaggtgatgggggtggcattccagcacttccccacctctaccacataacagtgagggtttggtgagccaaactcatgagctcagatgagcaggaaattgccagaaaaaaataggcccagttctgtggtactcccaaagatcctcttacagtgacttttctcttctaggatcccatcaggctccttggaaagtgcttctacttccgaagccaaccctgaggggcactcagccagctctgaccaggaccctgtggcagacagagagggcagcccggtctccggcagcagccccttccagctcacggctttctccgatgaagacattatagacttgaagtaacagagttgaatctcatttgccatctttagttttcttatggaggtttatactctttaaacagttytgatgtaatttctcaacaaaatgtggcttttagcctgtcagtgatctattggaccaaaccttctgcacactcggccagttccctctccaatgtccggtgccatctttcctgacctttgtttctttctgttcaggaaccatcagtccccttgtaataaaggtggtagatttcattgaggttttagattgaaactttgaataaatcaaaaatactcattcttatttactgcaaccttctcatattttatatacttagatggaaaattattttttcattacagttttgatttatgtcacataatgtgtttcttttataaagaaaagtcgttgctttttaactttattataagtaagttttttttctgcacctttggccccggttgctgtttcagttcaccgtgattggaaccagctgcattcctgcctgtagacttttgagaaaagttgaatggttagatcttagaagctcctccttcttccctgcatctcatgaaaaatattaaggcataggagcttgtcaaaagtcttcagattattttgtgtggttttattgttactctgcaataatgtaaccagagaacagctactccttgtggttaaaagtattctcattgtaatcccagtgctttggaaggccaaggtggaaggatcccttgtgcccaggagtttaaggctgcagtgagctaagattgcaccactgttctccagtctgggcaacagagggagaccctgtctcaaaaaaaaaaaaaaaaaaaagaaaagaaaagaaaaaaaaaagaaagcattttcaaactcctccttctttttgagtccccctcactctttcacataaatgatatgaagataataatttggtttatctgcctttcctggctccctctccagtgtgaacagaaagaaatgtggactgggccaagtgcaaaagaaatagtgaaatctcagccactagccaaggggagatccagtttcactagcattgtttgcaaatattttaatctgtgtgaagaaggtattttacctttggctttagtctagccaattcaattttattctgtctcttcctacttatattattacattattcatcaaaggaaacttcctgttaccccgttaaagcagctcagaagagttcttctgcaggcttttttttttttttttttttagacagagtcttactctattgcccaggctggagtgcagtggcacgatctcggctctctgcaacctccacctcccaggttcaagccattctgctgcctcagcctcctaagtagctgggattacaggcacgcatcaccacacccagctaatttttgtattttagtagagatggggtttcaccatgttggccaggctggtctcgaactcctgacctcgtgatccgcccaccttggcctcccaaaatgctgggattataggtgtgagccactatgcccggccagcaggccttctttgtgagtgtggagaactgagtttgacaggaccttggtctgacagattttatagaagtttgggtcgtacctcctagtgggccttgcacactgtggggaaagttcccctctctgtcttttgtacaaacagatcagcatgatagcccaagctgaaggttgcttggttcatctttggcagaaggcaagagtcaagagtagtaaagacagtgctttttaggtatacccagatggggctgtttataaccaaatgtgtctgctcatattctttgcagcagttagcatgcccattcttcctttgtgtgttttatgcccttttcctatatagggggaaaaaaacactgtgtctcaaccccaccaacagtttaatgaattatgttttattattcttgcttttcaaataaggaaataggcttaggaaggggcaatggtttgaacctgcaagttctttgactccagagcccttgctttccccacgtctgccatgcagagccaggctcagtgccttgtgtcagctggatctggctggtgtttttcatgttaaactaatttgtaagctttatgagcttgtatctgtgtttttcctttttttctggaagtttcttgcttcacagtgtagcataaaaaaaacccaaggactattttagagcattcttccaaatcagcagcattagagccacccacaatttgacaagagtcacaggtctgaggagtgatgtagcaagggcaagaggtggaccctactgatcaggctgatggtgctttgcctatgaaaagggggcaggaggctgttctggcaacattatttgtctacaaaggccaagaagtgagttctgcacactcacgggaagggaagccatcggccacagggtaggagcaccctgcctacataatcctttctgtgtacccgactggctgagtcacacagaaaatcatctaactgcagtgtctgcctatggagttggaggcattgatccactctgcacacaccaagtgcctcctctccagaggaggtcatgtccattgggggaaggacggaagtaaacaagggatcacaaagcagtgataaatgctgtgataagaatacacatctagtgctcgagttatcaagcattagatgctgtgggagtacagaagggcagttgcctaagtctttaaggataggcttgtggtcaggactgaaaaatgttggttgctagaaccatcaagtgactgcaacatatcagatgactgtcttcatcataccggttagcctttgagtgcttcacatgtcttatatacattaccttgcttcacaactctcctggaagataatggtcatccccacttagagatgaggaaacacaaggcccagagagggattacaagccaagcctcttactcccatgccctggctctttccagaattacaccagcattccaccacagctgcctgcacccagagtgttgggtatgaatcgggtacaactggtgagatccaacagtgcctcatcattcgacttgggtgcacacgggagaaggtggcattaaaatccacagggaactcaaaatatggaggcaggtagatgaagattcaagagtcaggactccctgtgaagtgagtgacacttaagagggggagtggagcccagatctgtcacacatacggcgtgggggaccccacctaccactggtcctcagcacctggagacccgagccttcagcaatctgggaagcatgaaagtgggtttcggtgcacagggccacgcctccgccgccagcagcccagcgggagcgtctgaccagtctcgccctccgagaggagagagaggcggcccaggacggtctgcttagaggctctctcccctgcagagctgggcccaggcataggtcagacgcctccaatacagtccccagggcagcgattaaagcggagcaggaactgcagacccgaccgggcaggacaggtgcagcttctcggagttgggggcgggaagtctcgggctgagrcccacgtgcttcgccttcgccccgcctctaccctcattggttgaagccagattgagaggaggtgccagaaaaaaaactcctccctccaacctcattggccagctcagttctgaggcagctctctggccccgtctatgggctcgcactacactccaattgggtggttgttctcccagacggaaactccgccccacctgtaccttggaccgctccgccctaggggcggttccagcgcgcttcgctaatcggttctatgctcccattggtctgctttaatgtgaagggcgggtcctagctgaktcgctagccccgccttgcgttcctattggctgctcctgctctgcggttccgatcccgcccagcaccgtcccccaccccccgccgcccattggctgcgagaggccggtgcgggccgcactcgcagggcccgtggcggttcaggcgccagagctggccgatcggcgttggccgccgacatgacgcccgaggacccagaggaaacccagccgcttctggggcctcctggcggcaggtgagctccggggaacccgggcccggatgcggcctcgccctcccgcccctccgcgtccgctccgctcaccctcggccctgtccccccagcgcgccccgcggccgccgcgtcttcctcgccgccttcgccgctgccctgggcccactcagcttcggcttcgcgctcggctacagctccccggccatccctagcctgcagcgcgccgcgcccccggccccgcgcctggacgacgccgccgcctcctggttcggggtgaggccccgggctcgctcctcccgccctgggaccccacgccctcctctcgggacgggcatcgggaccctccgccccccacccttcccctcgggacaggcatcgggccccgccgccaccacctttccccacgagacaggcattgggcctctctgccccccatcccttccctcgggacgggcatcgagcccctcagcccccacccctcccctcgggacgagcaccgggcccctcagccccctacccctcccctcgggacgggcgcggggccccggctcttttacctctgagcccgcggggagtgggtggagggggaggatgggctgcggcttcggcgccccctcctcagcagccgcccgcctccaggctgtcgtgaccctgggtgccgcggcggggggagtgctgggcggctggctggtggaccgcgccgggcgcaagctgagcctcttgctgtgctccgtgcccttcgtggccggctttgccgtcatcaccgcggcccaggacgtgtggatgctgctggggggccgcctcctcaccggcctggcctgcggtgttgcctccctagtggccccggtgagtgtcccgtctctcgagtgtcctgtctcgcggcctgagaccgagggggagtgggacaaaccgctccccaggcctgggggcgcggctccccctggcgggaccttctgggtgccaggcttgaagtccctgcgttatctcgcggtccctcccgtcgaccctgggaaggatcctactgttctctccattttacactgaggtcatgacatgcagtctcggaaaggtgaagtcctttgcccaggcgaggtccacagctagtcagaggggaagcagttgcaggaacccagggttgtcccacttagccgtgcccctcttttgctctgcaaacctgcggatgatccacaggagcccactccctacattttggttttcatccctggcttcgggtcaatgactgcaattagcaggaagttcctgtcctgatttctcttggggcaaaggctgctggcctctgtgttccccttcccttctcacaggccagcccctctggcttccccatcttccccctttccccctcctgacccaggctgcccacttgggagccccgaacatctgggtcaaatcctggttctgccactaacctgagcagagtgcctccctgggcctcagtttccttctctggaaaacagggattatggcattagcccctgaggtagtggtcaggattcagtgggactttggatagacagcccctggcatggcttgtagaggactggatcctgacagcttggtgacccatgaactgcccccagccatgggcttggacaatatctcccccaagtgaggttgaaagcagccactcaggcccctccctgggtgctcatttcaccaacgtttgctaaccggcagcagcagctggaccagaagagggtggggaagaagctgggccttttatgtctttggtttttttaactgggcagaaacacacctgtgttaggggcctaagctatggaataaccttagatgcatgggtgagggcctggtggcctgtgggcccaggagggagctagtggcagccactggtagtgaccgaggcagagagttcgtgcttctagtccaaggccaccactcaaagcgtgggccctgggctaggatcctgggtgggcgtcacgtggagctggttaacaaggtggaatctttcgcctgtccagacctactgcatcggaatctatgatttatccagggtgtctgtgcacattaaacgaaggcttgagaagctctgtgcccaccgcctctcgtcatcatatgcagccctctccgttacccttaatcccctttaaacacctgccacagatctttcagtggtggggacctggggatggctctgctcacctaggcaggttccactaaggggcttcagggcctgccgtaaccccctgcaaggactttcctcagctctgaatggctgagacctttccattttaagaactcttggagcctgagtaaagcctcatctttttttttttttttttaatttttatttaaaaatttcggagtttcgctcttgttgcccaggctggagtgcaatggtgggatcttggctcaccgcaacctccacctccagggttcaagtgattctcctccctcaacctcctgagtagctgggattacagatgtgtgccactaggcccagctaattttgtatttttagtagagatggggtttctccctgttggtcaggccagtctcaaactcccaacctctggtgatctgcccgcctcggcctcccagagtgctgggattgcaggcatgagccactgcgcccagccataaatcctcatctgattgctggcaggtctacatctccgaaatcgcctacccagcagtccgggggttgctsggctcctgtgtgcagctaatggtcgtcgtcggcatcctcctggcctacctggcaggtatagttgtcattatctcttgcttcctgtttgtggtcatgtggccattttacagatgtgtaaacagaggttcagtgaggtcaagggacttgtctgaggtcacatagccagtgcccaacatgccaggctcgccttcctgggaccttgggataggtgagtctttttttttttttttttgagacagagtcccgctctgtcgcccaggctggagtgcagtggtggctctctgcaacctctgcctcctgggttcaagcgattctcctgtctcagcttcccaagtagctgggactacaggcatgtgccaccacacctggctaattgtttgtatttttggtagaaagggggtttcaccgtgttagccaggatggtcttgatctcctgacctcatgaaccgccaaacctcagcttcccaaagtgctgggattacaggtgtgagccaccgcgcccggccgataggtgtgtcttatgactgagttccagggacagctggagaaggtgataccctcagctttcctgaagccccctctaggggtgtgggaagggctgactgcttaggtcagtaccttactgtgcagtgacaaaccagagggctccagaggtgggtgggtccctgtaaaaatcttcagcccgggcgagtaaagggctgagcaagtcccctgagaatgtcagtgccagattcaccatgtcggcgagttgcaacgtgaaggaggccggggtcctggggaccccgaggggcaaagctgggccagcatgaagaaacttcaggagacaggtgtgttctcattagaaagaggccaggctttagaggccagacccagtggctcacacctgtaatcccagcactttgggaggcagaggtgggcggatcacttgaggtcaggagttcgagatcagcctggccaacatggtgaaaacccatttctatttaaaatacaaaaattagccaggcgtggtggtgggcacctgtaatcccagctacctggggggctgaggcacaagaattgcttgaacccagaaggctgaggtttcagtgagctgagatcgcgccactgcactccagtgtgggcgacacagtgagactctgtctcaaaaagaaagaaaaaacaagggcaggcttcaaatctgaccatcctgagtttggggatagcctctcctacgtgctgtgtgaccttggccaagtcataccacctctgaaagcctcagtttctctgtcttgaaatgggcataacctcatctagtccagtacctgtccattaaattaattgacacatgaaaagtgcctaacagtgggttccaaatgagaattgtcaagggatgacttgagaaccatggggatcatcggggtaggaggcctcgggggcctgacgggctatggcctggcccagggcacaagccctctgcatcgtcagggcggatgatacacaggtctttggtgtttcatttttacccacttaaccaccctaacaaattcagaatcctgccagcgatctggctaccttgggagacctgagtaaaccaaagcccccactgtgtgcaggtgttgacattcatcatttcggggacaggtactgggtgtccacccacccgtggcactatcttcagctcatcttaatatgtgcttgttgcttctcctgcctttcctgatcaatttctgtgagtttcgatccactggggtgggtgaactctgataactccacaaagtgacatggtggtggcacgtttgcttcacattggggcaatcatgttccaacgactagacttcatagaacaattgtctgcacccccagcacagaagaaaaatagggacatcatggctaccttagaggtatttttccactgggaaccagggatgggtaagccttgggcttaggaaaaattagtaattagagcagcaatgccctagactcatttattccagggcccctttgtaagagaaccttttaactttatataaaactaggtaattctgcacttatgctgttcttcatacgtcaagacagcaaaatcctctcacctctctactttcatgtatactttgaatagataatgcattcaaatgactcaacactcaagtgccagagtggagagatgtccagtgaaaagcttcctccgcctctgtccctttcttgtctgggggagtccccattgcctgtttcttggtagccttcagagagtctgttcatatgagggacatgcatatttatcctccctcccccacctcttctacaaatggtgccacatcataccatgcggacacgcagcaagcacctcatccttcatttttgtggctacataaatgtttcgttgaacggatgcagcctagtaatgtccgcgttgtcatacccactgtcgcttccgcagctggtgtgattggcccgtgccatgtgccttcatgaacagttgtgataatggcaatgtcagtagcraacatgagggcagatgtgcagaggcagcgaggccccatctctgaagctgagtctttgaggctggcaaggcccaggctggctcaccctggctctgacgccagcctccyccacccaccccccgcaggctgggtgctggagtggcgctggctggctgtgctgggctgcgtgcccccctycctcatgctgcttctcatgtgcttcatgcccgagaccccgcgcttcctgctgactcagcacaggcgccargaggccatggccgccctgcggttcctgtggggctcygagcagggctgggaagacccccccatcggggctgagcaggtgagaggctggaaggcagagctgacaggagtgggacagcagtcacgggagggtagcacagcctgttcccaaggccacacacttggggggtgggggacagggaggtgcctatccaccctccaccctcagcgaggacaggcccagtgtgtcctgtctttgagcaggccaagacagctggagccccacggagctgggccctggcctccaaagtcaccagcaaagcccgagctttgacccttactgtcccaggaagagaatggccaggcctggtgggggatacagaggcagagctgaggacttggatttaacaaaggagttgcaaggcagggtagagggctaaaagtctgggttttagagtcacccaggcatgggtttgaagcccccacgctgcccctcacctaagctttagctcttcacctgtgatgtgggagtcagcacctgcttcacagtgctgggtgggactcagtgggggaaaggaaggcggggcttagggaggaggggggctcagtggggagggtggggtcagcgaggaggatgggttcagtggggaggggagggtcagggctgtaggaggtgcttagctagggccaggcccagacctgaggcaggtgctggatgtgttggtggtggcagggatgagggcagcagcttgctctttgcccagattacctctttgtggctcccccccacctatcaggaagtgccctgggcaggtgagggtcatctcacctgacacatggggaggctgggacttgtctgcacacctgaggacacagggggtgctgggatgaggagccaagacgtgggagtcagygctccccaagccttaggacagtagacccccagaggggggccgcttgcgggaggggagagagaaatcctgatggccagtatccrtcagagcagagctttcacctggccctgctgcggcagcccggcayctacaagcccttcatcatcggygtctccctgatggccttccagcagctgtcgggggtcaacgccgtcatgttctatgcagagaccatctttgaagaggccaagttcaaggtaaaagggccctgcctggcctgcctcgtccagcccccacatagatggagcttcctccccaagcccagggcccagccatccagcacaggcctggagagggagggacccagctctcagctggcccacctgacctgcctgggctctgtctcccccaggacagcagcctggcctcggtcgtcgtgggtgtcatccaggtgctgttcacagctgtggcggctctcatcatggacagagcagggcggaggctgctcctggtcttgtcaggtgagggttcacccctgtgcagcctccccgccatgskggggagggccttcgccaaggccaccacactgcaggaggaggacagggagcatttgtgatgacaaacatcatggactaatgcggccatgatttgacagcagcttgtcaccaagcactcactgcaggcctgtccatgccagtggcactcccacaccacgcctttaacctctgtggtgaacccaccagaaggcactctcacagccccagcttatgacgggaaaactgagggccaggaaggtgaagtgactcaagagtttgtgggtccttttggacaagtgactttacctctctgagcctcagtctccccctctgggaagtgggggtaatggcagtgcctccctcagcaccattttgaggagtgggaggtgatccacgtgaggccttcagcaagagctgcggcccacggacatttggtacccagcagctgctgcgaagacgaccgtcggggctgagggttactcgctgctgcttctgygccggtacctcccatttcctcggcccagagggtctgctccgggaactttttgcagttcgctgaggtccaaggcggggtggctgccacccagtcagggctyctgcggccaaggtgccagaacaccaagctggccgttctctgggagccgggcctgcccctctcagaggcatccaggccatgctgctgcgccctgggccgttccccgggtgccccgcccactgccgccctcccgcctgcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggtaagggggcctgtgggaggctgggcgaggagtgggaggtgatccccccggccctgctgtggcggctycmggcaggtggggtcttccccagcctcacctctcctctcgtaagttccaagytctgcatttctagctctgaccacatgcagctgtggaactaggcccctctgcgttcctttcacttaatcccctgagcagccctcgagcaggccccgttgtgaccccatctcagagacagagcctgtgcctgaggagggaagaggctggccgaggccttggcaggaaagcatggagctggygggaccacactgggatccgggaccccacagccccacaggctgggaagctgggtctcttggctctgcagcaagctgaggagcccagccctgcggaccctgatgcctgtcttgcctgtctcgctcccacaggctttgcggtgggctgggggcccatcccctggctcctcatgtcagagatcttccctctgcatgtcaagggcgtggcgacaggcatctgcgtcctcaccaactggctcatggcctttctygtgaccaaggagttcagcagcctcatggtgagggcaggctccaccagcaccgcgttcgtgcagtcagccragaagcactttctaaaaccacttgtattgcagaagacccagggtcgtggccttacatgcagcctgagccccaccatgcctgggccactggccatcttgggcaaggcgacgtggaggcagatgggctaggccagatggggaacccaggctgtgaccccttgggagtcctctgcctgtcttggcagtcagacagcacagctggcctctccccttagtgaacgtcaggaaagcgggccttgagcctaaggtcttacatgggaagagttgacagggctgggctgcagccccaccctggctacttccttgctgtgtgaccttgggtatgatgcttaccttctctgagcccgcttctttggctgaaactggaggagagtaacagcagcttgctcttaagacggatgggagcattaattcagttcatcctgttgctgccttctcacggatggactggcacaggtgtggcccctgtcccggggcttcccagccaacagagagacagttctggggtagatgatctggttgtttgttcagtcatttgtgccctccaggtctcctggcatgtgccatgtccaggcccattcaaggcgccagggagagcaatgaacaagatggacagggtcccctttatgacaaggacgggaaaggccatggcagtggtgggagaatgaaccccagtggggctgggttaggatgtggtggggcgggtcatgaggggccagcctggagtctgtgcagagcttgggacccgcttaggcaggactgcccggggagcacatcgagggggccaggccgatgcctgggggtggagattacttgctgcagctgggaggggatgcgcagcaaaggaaggaggaaaagaagccaagaaggaggtgacaaaggacctaacagtccttttttaggagagaaaatgtccaagaggccaagagaaggccttcgaggagggagagatcrccaggtcccagaggaccaggagctgaraagcacctttttagttctggcacgtgggaggtcacagtggtggtggatggcagggacaggttctgactgaaggccccatgtgctcctggggccatgctcgctttgccctgtctcacccatttccaccacactatgaaagaacccaccgggggcctcagggtggggccaaagctgagggtggagggttggtctgtgggccctggagtcagacctggaacaggagcccagctgtcactggatagcgggtctctggccttgaggcagtcacttcattgctgtgagcctcagtttccccagccatacgacctcggtatcttggacagtgctcggcccaagccaccagactggatgccagactatcctccatgtcccagagctgggtggagataaaatgggtgtggccttgggcagggcaggctggggtcaggggactrgaccccctggtggcagagctgtctcagtgatcgcgtggggcttcctgatctctccccgygtccacccatggcctttcctctctctgcaggaggtcctcaggccctatggagccttctggcttgcctccgctttctgcatcttcagtgtccttttcactttgttctgtgtccctgaaactaaaggaaagactctggaacaaatcacagcccattttgaggggcgatgacagccactcactaggggatggagcaagcctgtgactccaagctgggcccaagcccagagcccctgcctgccccaggggagccagaatccagccccttggagccttggtctgcagggtcyctccttcctgtcatgctccctccagcccatgacccggggctaggaggctcactgcctcctgttccagctcctgctgctgctctgaggactcaggaacaccttcgagctttgcagacctgcggtcagccctccatgcgcaagactaaagcagcggaagaggaggtgggcctctaggatctttgtcttctggctggaggtgcttttggaggttgggtgctgggcattcrgtcgctcctctcacgcggctgccttatcgggaaggaaatttgtttgccaaataaagactgacacagaaaatcaggtcagtgtctctgggctttgtgcaagctcagtttgaaaagggtttattcccwtcactgcccaggacaccctgtggctttacttgctcatggtcagccaagcttacccttcacactgagaagtcatttctggctacttccttgggctcagttccctgggtcatcagccatcaaatcttgttgagtttaaaaaataaacagcaaaaaaaaacaaaacaaaacaaaaaaaaacaccttttgttctgttgactttaatggagccagaagtcttttataattttattattaattagctaatatgtgttcattgtagggaaattaaaaaagatttaatatcatttttatagctgttaaccagctgctatgcactgtcctaagcactttacaaatattaactcatttatttggataaacaatgataaaactatttacagccacccctttccagagataacatctctgttgggattttgttctgccaggcacggtggctcacacctttaatcccagtgctttgggaggctgaggcaggaggatctcttgagcccagaaattcgaggctgcacgcacctcggcatccgcattaccagtgcttgcgtggcagtccactaatcgggtgagaaccatattgctttttgcatctcaatgaagcaatagtagcaatttatcaagcacttttttttccagactggtataaaattgtatgtgcttttgtaaaccatttaacaataaaagtaaaatacaaaagggaacagggcacggtggctcacgcctgtaatcccaacactttgggaggccaaggcgtgtggagtcaggagttcaagaccagcctgactaacatggtgaaaccctcgtctctgctaaaaatagaaaattagccgggcgtggtggcacatgcctgtaatcccagctactcaggaggctgaggcaagagaattcgctgaggctgaggtgagagaatcccttgaacccaggaggcagaggttgcagtgagccaagatcgtgccactgnnnnnnnnnnnnnnnnnnnnacagttaaacggatctcacttccaacacacatgctgtctagcaacactaagtagaggggaccattcttcccaactcacggctgctttgtccacttcccagacctgcagccccagcacctgcccaccttggcatctcccattaagtcacataatgagggcagagagcaggggcctgtttttgcggacacttgaagtacagcatggaccaggcagagcaaggcgccggatcagatcagttccagaagatatgcagcagctgctctgatttcagtgaaatgtgtgaaaccatgcacaggactttggacaactctcagctgtagcaaatccagtttccccttgggccttccagaagcagggtcctgtctccacgcaggagcatctcccgtggcaatggctgcacctcggcatctgcattaccagtgcttgcgtggcagtccactaatcaggtgagaaccatattgctttttgcatctcaatgaagcaatagtagcaatttatcaagcacttttttttccagactggtataaaattgtatgtgcttttgtaaaccatttaacaataaaagtaaaatacaaaagggaacagggcacggtggctcacgcctgtaatcccaacactttgggaggccaaggcgtgtggagtcaggagttcaagaccagcctgactaacatggtgaaaccctcgtctctgctaaaaatagaaaattagccgggcgtggtggcacatgcctgtaatcccagctactcaggaggctgaggcaagagaattcgctgaggctgaggtgagagaatcccttgaacccaggaggcagaggttgcagtgagccaagatcgtgccactgcactccagcctgggggacagagtgagactctgtctcaaaaatacatacatacataaaataaagatcattagagatatattctctttccaccagctttgtgcctggaggttatggatgtggggctctggctgccctcttgccaccgactggagcttcagactgaagcttaacatgggccaaagcaagcatgtaggagagatagggaggttgggggagatgatggggaggtgggggagatggggaggtgggggagacgatggggaggtggggggagatgatggggaggtgggggagatgatggggagatgatgaggtgggggagatgatggggaggtagggagagatgacggggagatgatgaggtgggggagatggggaggtagggggagatgatggggaggtgggggagacgatggggaggtgggggggagacgatggggaggtgggggggagacgatggggaggcggggggagatgatagggaggtggggaaaaagatggggaggtcgggggagatgatggggagatgggggagatgatgaggaggtgggggagacgatggggaggtagggggagatgatggggaggtgggggagacgatagggaggtgggggagacgatggggagatgatggggaggtggaggaagatgatggggaggtggggggagatgatggagaggtgggggagatgatggggaggtggggggagatgatggagaggtggggtagacgatggggaggtggggggagatgatgaggtgggggaggtcatgtggggggagctgatggggtgggggaggtgatggggaggtgggagaggtgatggggaagtgggggaggtgatggggaggtgggaggtgatggggaggtaggggagatgatggggaggtggggggagatgatagtgaggtgggggtaggtgatggggagatgatggggaggtggggggaggtgaggggagatgatggggaggtgcacatcaaaatgtgaacagtgctgccctgccacttgactttttgaaagctgccttgaaaataagctttctgggtccaaatgatcctttgctcaagcaaagccactgatacatggctttaggttagtaatatataaaacccagagcttatgagttcggggaggaagtattcacaacattatggttatataaacatcgttactgtaaacctaatgaaatggacttaaagacataatcctatgtcagtcagcctgtgttactcaaaaaggaatattctaagcagcaatataaaatggattttctcttatactacatcagttaattaaaataatgccagatttgagtttgtaccttatttaggacatgataatattagatttcttttttacctggagttttgttgttgttgtttttccttcttaagaaacgtgtcattttcttcaccatatgactgaggtctttcccctttgtaataatgctagctgttgcatggaatccatttttttctccttctgacctcttgttttgggggacctgcggcaaagctgttttcgtttcattgattcctgggttaatttctctgcttcttgggttccacaccttgctccttggattccatttcttttttctttctttttttttttttttttgagacggggtttcgctcttgttccccaggctggagtgcaatggctcgatctcggctcactgcaacctccgcctcctgggttcaagtgattctcctgcctcagcctcccgagtagctggcattacaggcacccgccaccatgccaggctaacttcttgtatttttagtagagacggggtttcaccatgttggccaggctggtcttgaactcttgacctcaagtgatccgcccacctcagcctcccaaagtgctgggattacaggcatgaaccaccgcgcccggcctcttggattccatttcaatttgcagggctacaccttcacagggctaccatgtctgatatcagtcattttttcaggacaggtacagagggagcgagtttctgcatgcctaaaaagcctttattttactgtcactttttttttctttcttttttgtagagacagggcgagtccatacagtaaagtgaaagcaagtttattagcaaagtaaaggactaaagaaaagctgctccatagagcagccccgagcgctgctggttgcccatttttatggttatttcttgattatatgctaaacaagaggcggattattcatgccacccttttttagaccatattaagtaacttcctggcattgccacggcatctgtaacctgtcatggcgctggcaggagtgtggcagtgaggacgaccaagatcactctggttgccatcttggttttggtgggttttgggccgccttctttaccgcaacctgttttatcagcaaggtctttacgacctgtatcttgtgatgacctcctatctcatcctattacttagaatgccttcaccattggcattggcagtgcagcccagtaggtctcagcctcattttaccccgcccctactcaagatgaagttgctctggttcaaacgcctctgataccatgagattttgaatctcgatactttcttctgggaacttgttcttcttttacttcttcattctcacatcccagcccctgattttctctgtttcctctttctgaaacttctagtagacactgtacttcctggcacagtatcctccctcaatttttcacttatatactcttttagtgtcttcgtattctaggaattttttttttacttaatcctctagctcttctacaaaatgttctgttttgttaatcatgtttaacataattttgatccttttaaatgtattgagacctatcttggtgaatgttccatgtgcaattgaaaagaatatgtactgtgctgttgctgggcggagtgttctataaatgtcacttaggtcaagttgtttaatagtctgcttcatgtcttctgtattaatcagggttctccagagattaaactaatggtgtgtgtgtgtgkgggggggggatgtatgtgtatgtagagagagatacatagagagagaaataagaaatcagttcacatgatggccaagcacggtggctcacgcctgtaaccccagcactttgggaggccaaggcaggcagaccacttgaggtcaggagttcgagaccagcatggccaacatgatgaaaccctgtctctactaaaaatacaaaaaaattagctgggcatggtggcatactcctgtaatcccagccacttgggaggcaggagaattacttgaacctgggaggcagaggctgcagtgagccgagatcgcaccactgcactccagcctgggcaacagagactccgtctcaaaaaaaaaaaaaaaaaaaaaaagagaagaaatcagttcacatgattatgaaggctgaggtcacaagatctgcagggtgagttagcagctggaggcccaggagagctgatggtgcagttccaatccaaaggccagcaggctggagatacaggaagaaccaatattgcagttcaagtctgaaggcaggaaaagactgtcagtcatccccactcaagagagtcaggaagcgtttccccttactttcgttctactcaggccttcatggattggatgaggctcacctacattgaggggggcaatccgcttcactcagtctactgattcaaatgttaatttcatccaaaacacctttacagaataatatttgacctgtcaggttgacacataaaattaactatcatgtcttctaaatccaggttttctgtccactgattctgtcgattactgagagagggtgttggaatctcacctctgcatgtgtattgtccagctctgtagttcgttggcctttgtctggcactttggagctctgctcttaggcacctgtgcatttaggattgtaccgttctcctgactgctccatcctttatctttaggaaatggtcctctttatccctggtactgccccttgttctgaggtctgaccctgtctgacatgaaaatcgccactctgttttggcagtaatttctaatattgtcttattccctgtgcctttttattttatttattattatttttttaattttcctggtttccttggtgtcttctaaacctgtgcctttttcgtagcatcctgtgctcttctttttaatggcttgcctgtttgaatttctctaaggatacatattttcactttttaaatatcagctttaggctgggcacagtggctcacacctgaaatcccaacactttgggaggccaacgtgggcggatcatttgaggtcaggagttcgagaccagcctggccaacatggcaaatccttgtctctactaaaaatacaaaaattagccaggcgtggtggtgcatgcctctaattccagctatttgggaggctgaggcaggagaattgcttgaacctggaaggaggaggttgtagtgagctgagatcacaccactgtactccagcctgggtgacagagcatgactctgtctccaaaagaaacaaaaaacaaaaaaaaccagctttgattgaggcattatttacttaagtaaaattcaataattgtaagtataaaatttaatgacttatgacaaatgtatacagtcatgtaactgtcaggcctctgagcccaagcctgcacgtatacatccagatagcctgaagaatcacaaaagaagtgaaaaatggccagtttctgccttaactgatgacattaccttgtgaaattccttctcctggctcagaagttccttcactgagcaccttgtgacccctacccctgcccgtaagagaacgaccccctttgactataattttccactgcccacccaaatcccataaaagtgccccaccccatctccctttgctgact

SEQ ID NO: 12361 - DNA, 23866 bp, Homo sapiens
gtgatggtgccgcagtggggcactcaccagaccgtgcacctgcctggccagctgccccagcatgagtacctcaaggtaatggggagtgatggagcctgggagtgtggaaaagctggtgcgattcctgtctgtggatgggattcagctctgtactcctctttacctataggagatggaacccttaggttggatccacactcagcccaatgagtccccgcagttatcaccccaggatgtcaccacccaygccaagatcatggctgacaacccatcttgggatggcgagaagaccattatcatcacatgcaggtgggcctgggctccttgggaggaagtatggtggggcagggattgcaggccagggcccagaacagtggcctragctgttactctgtcctcgttcctcccccagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtaagtgggaggagcctggggatgtggggatagcagtagggataaggtgaggccatcgccctttgcacttggggcctggctggcttggaggtggcgcaggctgcatgaggcaggagccctgttaacattggctgtttccttctccccgaaggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccrtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaataggagttcaggggctggtttgttttttttttcccccccaaactcaaattctggatttaggtctaacaggaggctggactggagcggttcacagcaagatgctgggctcggctgtgaaggggggagtatgaggcccccttcctattcagggctttggggtagatagcccctggactcagtggagacctgaggcagggctgggctttcacactccgctgccttgaccacatttgctgctttttccacaaaactacttggaagctctcgcctcctttccacagttttgggagcagttgccctttcccgggtctaggaactctgtggcttgtgctgagcggctgcggtgtccagcccagccctttaagctttctgtgtcagtcctggtcaggaaaacaagcacacaggcaggcagtttgtgtacagccgggcggaggccagagaccggctgcctacctgtcacctctcgcctggagcgggccactgccaagttggccccatgactccaaacgggcggagcctggattgggcctgtggggagggctccactcaagtgaccacttgcagccctgaacctcagctcttggacgcctggctggaagttggctgtcttgtttcctgtgaccttgggggtggaaaggacagagcccaggcgacctagggcactatctccctaccccacgccttctcccttcctcgttcctccctacccttatcgcttctaccccgcccacaccgccctaaacggcttcctggggcggaactgtttcgcttttccccgtcccagtggagggtggggtgggggggtcgcagccctaagcctctgggagacatggagcccaggagggcggcgcccggggtgcctggctgggggtctcgggaggccgcggggtcggcatcggccgcggagcttgtgtaccatctagccggggccctgggcactgagctgcaggatctggcgcgccgtttcgggccggaggcggcggccgggctggtgccgctagtggtgcgggcgctggagctcttggaacaggctgccgtggggcccgccccggactcggtgagtcatggccctcccttcgccacccacggggycggcagggccgaagcctgagacccgggtctccccagctgcaggtgtcgrcgcagccggcggagcaggagctgcggcggctgcgggaggagaacgagcgcctccgcagggagctgcgcgcggggccacagggtaagcgcagccccggccagggcagggcgggtgacgacctgctcgggtcctcccctccctcccgcgggccgcgcgccgccgccgctaagaacgccccttcctcagaggagcgcgcgctgctgcggcagctcaaggaggtcacggaccgacagcgggacgaactccgggcgcacaaccgcgacctgcggcagcgcggccaggagaccgaggcggtgagggcggggcggggctctggggcggggcgggggcggagcgtggcaggcgctgggcggggctccgggggcgggggcggagcgaggcaggcgctgggcggggctccggggggccctcggtgccccgcccaccccaccctttgctccgctcccagttgcaggagcagctgcagcgcctcctgctggtgaacgctgagctgcggcacaagctggcggccatgcagacccagctgcgcgccgcgcaggaccgcgagagggagcgccagcagcctggcgaagccgcgactccgcaggctaaagagcgagcgcgggggcaggccgggcggcccgggcaccagcacggacaggagcccgaatgggcgaccgccggcgcaggcgccccagggaaccctgaggacccggtgagtgccgtatgagggcaaggacccagcccaggacgcagcgtccagccctcggtgggcactcaagcaaggtttgcatgctgcacagcaggtcggccaggaagcggggaggtggcagacagatctgcgcccccggccggcctcggcccccgctctcagctggagcactgctctgttatctgttagggcacccttgtcccccaagtctcccggcccgtcacttcctctagcattcccatgatggccctggggcgggggaacgccagccgaggcgaccctctgactgtgcctgtccttccaaaggcggaggccgcgcagcagctcgggcgcccctcggaggcagggcagtgccgcttcagtcgggaggagtttgagcagatccttcaggagcggaatgaactcaaagccaaagtgttcctgctcaaggaggaactggcctacttccagcggtgaggacgctgggaagccggggggcctccgatcaccccacctcattctccagtcattgacatgtccacagtgacatgtgccaggcctgcgctgggaactgggaggacatgaattgtacagcccttgccctcctgcaatgtcatccagacaggggagagggacagtacaaagggttgcagctgcagcagccagggaatctctcctaggagggggccacggggccacctaatttaaggtctgagggtgtcagcaaggcagagcgcttcccgtgttcagggaagagctgcgtgcacaggtaccaggagtgaggactgcggctggcatctccactgctggcatccccatggctggcatcaccagggctttctccctccctgccccttttctttagggagctgctcacagaccaccrggtcccyrgccttctgctcgaggccatgaaggtggctgtccggaagcagcggaagaagatcaaggccaagatgttagggacaccagaggaagcagagagcaggtaggtccctgcctgcattcccacggagccaggcctccctccctcattctgctgagcctgatgacccagcctggtcaccctctgagcccattgtctcagactgaggctgtcaccccaacccggtcaccccttgagcctccctagcctggccgcttctagggcctgctgacctgctctggctgtgtcccatggccgctgtccagcctgcgcccttctccctggatctcaccactccccttgccttgcctgccatccattctgcctgacaacactgcctctccacattcattcttcaagttcctgtcttggctgggtctgtttattcttacgggggtgaaactgtagccgcggctgtgtcagggcctgctgtgtgtcaagctataaaataaacccttggcagggcgcggtggctcacgcctgtaatcccagcactttgagaggctaaggtgggtagatcacctgaggtcaggagttcgagaccagcgtggccaacatggtgaaactccgtctctactaaaaatacaaaaattagccgggcatggtggcatgtgcctataatcccagctactcaggaggctgcggcaggagaatcgcttgaacttgggaggcggaggttgcagtgagctgagatcgcaccactgcactccagcctgggcgacagagtgagaccctgtctcaaaaaaaaaaaaattaaaaattaaaggctcgacatcctgcatctccccagggttgccttctctccagccccgggggccctgcagtccctccatcccccctgctggattcctgttgtccctcagggccttgatcaatggccctcacttctcctctctcctctgtctcagtgaggatgaggctggcccatggatcctgctctccgatgacaagggagaccatcccccayccccggagtccaaaatacagagtttgtatgttggggaaaggggaaaggcaagagtgtggggagggaggaagggccctggctggtccttctcaggatcccctttcccgcttctctgcccatcaccctgctgtgcttggctctaagcacaccgtcccctcctgcttctctggccctggcccccatcaccttcacactccctcaggctgccctttcttccccctctccccttttctcaccatcccctgccctcacccatatccttgacctctctggcttcctggctcaaagtgcctctggctgtctctctccagctttggcctatggtatcggggtaaagctgaatcctctgaggatgagaccagcagccctgcacccagcaagctagggggagaagaggaggcccaaccacagtctccagctcctgatccgccctgttctgccctccacgaacacctttgtctgggggcctcagccgccccagaggcctgacttaggggtctggctgtggaaggatgtgtggcctcaaatgaggacagggctcccgccttcacagccctcgccaggggtctgccccaatcctggcctgcatcagggcaggacggggtctcagcccgcctccctctctacgtctctgtaccgagcctctggggccagatataagagtgcctctctgagtctcagtttccccatccatgaaatgagagctgactgcctagctcccagggctttgtgcagacggcctgagctcatgtaataaagaactgcccgtaatacacagaaactgttcctcgcctgtctgtccatgtctgtgccacctcccaaccctgccaggagcagaggcaggctgaggggtcctcgctggtctccttgctcagtcactgggtggggtggcttcttgcagctcaggccttgctttgggagtgtggcctgatggaaagccgtggctcccagcctcagtccacccccttccctggccccggcacccagggacctgcaacttcattcttctggcccttccaggcccaggccagtcagccctgccattgcctttctttccctttctttttttgagtgtcagtctttccagccaccccctccctctcagggaggtgcctcgtggcagcccgcccctcyggcctggtttcctcaggaaaagccctgagaggaagcagkgagggggttgggagctgtgggggccagacgaacccgagcgctcccaccgagctgcctgccatggggctggggctgctgctcccgctgctgctgctctggactcgggggactcaggggtccgagctggaccccaaagggcagcacgtctgtgtggccagcaggtgggtctcgtgggagtctgatgcgtgtggccagcaggtgggtctcgtgggagtctgatgcgggtggctgaaccggtgttgaggccgttaggggaaggaggagactaggaagggggcttaggctgaaaggaagggactgctgatggcggtctggcaggtagtggccagccagggcagatggtggaagggtcagggaaggagaggggaggggctggggaccctagctgtaaagatccattaggcctccccagggggctaaggcagcctcccccactgcagccagagacagtgatccaccttcctcagggccaggctgcaccccccaccatgtccggctgacccctttttgccccacagcccctctgctgagctgcagtgctgcgcaggctggaggcagaaggatcaagaatgcaccatccgtgagtagccaggacagaccctcagccaaggagaagggaggccgtagcccagtgacaacccttccttcctaccccatggggcctgcccctcctgawaccaggagtcagggtttctcctgtgacgcacycccaggcctgaaggggcacctcttgaggaggcatggcccctggagccagtgagagggcaggggtgtcccctggtcctgctcccgtctttccaacctgggtggggtgtctttcagccatctgtgaggggccggacgcctgccagaaagacgaggtgtgtgtgaagccgggcctctgtcgatgcaagcctggattctttggggcccactgcagctcccgtgagtctcaagggccagatgaagttgctgggcagagctgggtacgggggcagtggtgtgggagcaggcgaggcaggtagccatgcagcctcaggacagcagggccagaatcccccccagcttcactgaggaattgcggtccagagacaggaagtgacacacactcccgggagatgacctgagtcaccgggtttttacccacatccacaaagcactgcccacctgagcatcttcctcttccacttctcagaaaacctgtgattccccttcattgtaaaatgagtgtattacttgcctttcccacatataccttatacatgggcagtggatggaagggggcccctggctgggctctctgccctctctggcagaaagagagggaagggaaaggggttgggaagcaggagagccagagggtgggcatcaggaatcaaggaatcactaggggaaaggtggcttctcccgacaccctggcgggcagtatccaggcctgagatcaggagaaagccagctctcctccagcccagcagagatccatctcggcagggaggagcaggcatggaggaaggcccaccaacctcggtgccacgctctgggcaagtcccctgcccactcaggatctctgagtgtgttctggaatgtgaagtggcaggctgagcctcccactaatggctaagggttttctgtaggtcagagcggagcaggaagtgagtgttgcccaggacaggctgccggatgttctgagggtctgtccccggctcttggaggatgggcccagcgccccttttccttgaggaaggggacgcagggtaagggtctgcgcgcggccctgagcccgctgacccctcccgtccccacccccgcaggctgcccgggccagtactggggccccgactgccgtgagagctgcccctgccacccgcacggccagtgcgagccagccacgggcgcgtgccagtgccaggccgaccgctggggagcccgctgcgagttcccgtgcgcctgcggcccccacgggcgctgcgaccccgcgaccggcgtgtgccactgcgaacccggctggtggtcgtccacgtgccgccgcccgtgccagtgcaacaccgcggcggcgcgctgcgagcaggccacgggcgcctgcgtgtgcaagccgggctggtgggggcgccgctgcagcttccgctgcaactgccacggctccccgtgcgagcaggactccggccgctgcgcctgccggccgggctggtggggtcccgaatgccagcagcagtgcgagtgtgtgcggggccgctgcagcgccgcctccggcgagtgcacctgcccgcccggcttccgcggagcgcgctgcgagctgccctgcccggcaggcagccacggggtgcagtgcgcacacaggtgagcgggcggggcggggacaggtgggctggcggggcgggggcggacacaagtgagcaggcggggcggggcggagacaggggggcggggcggagacagggggcggggcgaagacaggtgggcggggcggacaccggtgggcggggcggacaccggtgggcggggcgggcaccggtgggcggggcggacaccggtgggcggggaggggggccggggtggaaactggtgagcgggcagggtgggggcggggcgggcacaggtgagcggtcgggggagggggcggaggcggacacaggtgagcgaggctgcgcggagacctgtgagcgggcggggcggagcggagacaggtggccgcggcggggcgccgggaggaggggtcagggcttcgcggtgctcctctcaaaaaacatacaaagcagaggaacgagaaaggggaaaagtcggataggtggggtggctcacacctgtaatcccagcactttgggaggctgaggcgggtgcatcacctgaggtcaggagttcgagaccatcctggccaacatgctgaaacctcgtctctactaaaaacacaaaaattagccgggctgcgcctgtagtcccaggtattcggtaggctgagacaggagaatcgcttgagccctggaggcggaggttgcagtgagccgaggtcgcaccactgcactccagcctgggccagagagcaagactccgtctcaaacaaaacaaaacaaaaacttttaaaaacgctttgttgccccaggtccagcctcacctgctcatttcattgattactgctgtgcaaaatatactagcactgctagcaagccatatgtaggtaataagtggatcgagtccaacaatgatagactgggttaagaaaatgtggcacatatacaccatggaatactatgcagccataaaaaatgatgagttcatgtcctttgtagggacatggaagaaattggaaatcatcattctcagtaaactatcgcgagaacaaaaaaccaaacaccgcatattctcactcataggtgggagttgaacaatggaatcacatggacacaggaaggggaatatcacactctggggactgttgtggggtggggggaggggggagggatagcattggcagatatacttaatgctagatgacgagctagtgggtgcagcacaccaacatggcacatgtatacgtatgtaactaacctgcacaatgtgcacatgtaccctaaaacttaaagtataataataaaaaaatatatataaatatatttaaaaaaagaaaattaaaaaaatggtttcttacaaaaaaaataataaataagtggatcgagtgaccaagggtcctgagcaaggtccctttagggctcagtggctttcaaactttgactggctgcactcacagtaagaaatttcatccctggctgggcgcggtggctcacgcctgtaatcccagcactttgagaggccgaggcgggcggatcacctgaggtcaggagttcgagaccagcctggctaacatggtgaaacctcgtctctactaaaaatacaaaaattagccgggcatggtgttgggcgcctgtaatcccagctacttgggaggctgaggcaggagaatcacttgaacccgggaggcggaggttgcagtgagccaagatcgcgccactgcacgccagcctgggcgacagagtgagactcagtcttgaagaaaataataataaaataaaataagaaataaaaatgctggtcaggatcagctaaatggcttttataaactgcccttcttctcccctactaatgggtctgacccaagtatatgatcccagctagttaagcatctgagggagaaacttcaggtaactattaggcatcaatgggaaattaagatatggcaaatgtgaaattatattggtgacaacagtggtctccaaccttttggcaccagggactggtttcatggcagacaatttttctattattacactgtaatctataatgaaataataatatgactcaccataatatagaatcagtgggagccctgagcttgctttcccgcagctcgagggtcccatctgggggtgatgggagacagtgacagatcatcaggcattagatcctcgtaaagagcatggaacctggaccctcccgtgcgcagttcacaataggactggcgctcctatgagaatctgaggccaccactgatctggctggcagcggagctcaggcggtcaggctcccctgctggtcatctctacgctgtcgcccagttcctaacatgccacggactagtaccagtccatggcccagggtttgaggacccctgggtgaaaacactttacattttttgcatttcgtgtgatggggtagaagacactactgagtcccattcatgccagacctggggacggctcagtgtggaaaaaggaaaagtgaaaagagcaggagggaaggcctggcagacctcgcaaatgggactcagagcttggtggtgactcgcctgccctggctgggctgctggctcctgatggtcctgggacccagggaaagacggtcacagagcagatgcctggaaggaaagggatgggatcctgtaagagccctcatttgtcctcattgtacaacgtggggaaactgaggctcaaacctgcctgacccaggtgggacccgaacactctccagggcccccgaaggcctgcgtggagtacaggggtaggagggggtgggcgctccatccatccacccccactgttcccacgaagcccttctcttcccagctgtggccgctgcaaacacaatgagccgtgctctccagacacaggcagctgtgagtcctgcgagccgggctggaacgggacccagtgccagcagccctgcctgcctggcacctttggcragagctgcgaacagcagtgccctcactgccgacatggggaggcctgtgagccagatactggccactgtcagcgctgtgaccctggctggctggggcccaggtgagggcaccattctgttcagggtggggtacaccttcccccaggaccctcagctcagcggctctctccgagagcaccaccctccccgacacacaggttcatgcggccccaggggcctccctcctgttgaagactgggggagagcagtgggttctgggggggcctgggcaggatcccagctccctcccctctgaggcttcctgccctcctcgccctctggggacttgtagtctgtcacctgctggatttggccccaagttcaaggccctatttgcacctgagcttcactgctgaggagtggccagttgggtccttgagtccaggagcgtggggcggaggggtggggccccacagtgggggccaggcctgccttggtctccccttccccgagtcttgcctcaccccaggtgtgaagacccctgccccactggtacctttggggaagactgtggctctacctgccccacctgtgttcaggggtcctgtgatactgtgacaggggactgtgtctgcagtgccggctactgggggcccaggtaaggatggggatcccgggggcrggagagtgccaggggcctaggtcagggctctgtgcagcatttcctgaacttccctggacagtgcccagaaatctccctgcccgtctcctgcctgcctcccccacttcacccagccctcagcctgcctctccatgtcactccatagctgcaacgcctcctgcccagccggtttccatggaaacaactgctcagttccttgtgaatgcccagagggactctgccaccctgtctctgggtcctgccagccaggtaaggtggaagaaggctgcggggtgcagtagccagggaaaggcgggcccttcacatgggctccagggcaagttcctcaccagggagtctgggcccacttcagagatattcttttttttttttttttttcccttaagacgaggtcttgctctgtcacccaggccagagtgcagtggtgtgatgtcagctcactgcaacctccacctcccaggttcaagccattctcccatctcagcctctcgagtagctgggattacaggcgcacgcctccatgcctggctaatttttatattttagtagagacagggtttcaccatgttggccaggctggtctcaagctcctgacctcaggtgatctgcccacctcggcctcccaaagtgctgggattacagacgtgagccactgtgcccggcccagagacattctttatacctgagctctgtgtggatgctctggggccccctgaagatgtgacagagcccccgcccctgcgaaaccaggctagagccgtgaaatgggcagcggggtggctggacactgacatggcctcaggggcaagaacctgtggaggggacacgccagcagaggggctgcccggaggcagggagtgacccccaggaagaagcttctgggtagcaggcaactcagagcaaagacaggatgtgtaggagacaggaaggcctgaatatcccccgtttctggctcccccaggctctggcagtcgggacactgccctcatcgygggcagccttgtgcctctgctgctgctcttcctgggycttgcctgctgtgcctgctgctgctgggccccccgatcagacctcaaggacaggtgaacgccagcccgtcccttccccacacagctcaggccacagggtgggagcaggggggcatctggtttccttgtggggtggggagggctggccttgttgcccacgtgggtcagaggtgatgggggtggggagggctggccttgtcgcccccgtgggtcagaggtgatgggggtggggagggctggccttgtcgcccacgtaggtcagaggtgatggaggtagttggcagtgcccgtggcctggagacactggagacaccgggtcagctgcctgccctcctcggaagccttcaatgaggaagtttctgagttgcatgggcaccaggctggcgaaccggagcctgcagcgggaggcagaaagctgacaccggcggggaccagaggaggagggctgggaccacggaaggagcagcccggctctgggccaggagggaaagagaccaggcctcagatggcccacgaaggaaagagacatcaatgtctgtgcagtggtttagcagagagtgtagctgcctgagagacggagaggggaggaagggttgggctggtggggcccgcgcagggggcttacgcagagctttgttcctttatgaaacctcgtcacattccaggctcctttgagactcacagcagcgtggaggtttggaacagggagtgtggggccgggaggataaatgtcctcaattcccagaggacattgaggcccaaggtgatctagttggtactggcacacaggaagcccctctccacctttttggactctttgtctggtgctctcttactagttcctgccctagtccaatagcacatcctcctctgtgcttgtgcggcattcacagaggagcagatacagttgcccctggcccagggcatagagcccagggtgggaagaagcccctcgcagggacacgaggacaggtgcaaaggctgttggaggaacagtgaagagcagagcagtctcctccacatgtgggggtagagcagagtgggaacaagggaaggcttcctggagggggtgtcatttgagacaggtgsgccgggcgcagtgactcacgcctgtaatcccagcactttgggaggccraggtgagtggatcacctgaggtcaggagttcaagaccagcctggccaacatggtgaaaccccgtctctactaaaaatacaaaattagccgggtgtggtggtgcacgcctgtaatcccagctactcaggaggctgaggcaggagaatcacttgaatccaggaggcgaaggttgcggtgagccaagatcgtaccactgcactccagcctgggcaacaaaagcgagactctgtcccaaaaatagagagagagagagagagagaaacgtgagctgaggctcagctaggatgataataacaaagacctgccaggtcctgcaaaaagctcagatagatgatagatagatggdtagatagatagatagatagatagatagatagatagatagatagataggatctgttttacagatgcggaaactgaggcctagggaggtgaagtgtgaaccagagttgttactcrgctgtctgactctagagccactctttgttctgtggcaggcctgaattgtgggctcaatcatttggattttattctgtagtcaatagagagccactgaagccactgaagtagaggcagtcaccctgtcacaccctgccaaggtgacccaggtcaccgtgggtctcatgtaytgaccartgtccctaccctcctccctcaggccagcgagagatggagctaccgtgtccaggatgaagctgcaggtctgggggacactgaccagcttgggctccacgctgccctgccgttccctcagctcccacaagctaccctgggtgacaggtcagtgggcgctgggggccggggtctgggattggacagggctttgcatcaggtyctgcaggcgcytgatctggagtctctacagtctcacatcacgacccggaggtccccttcaaccacagcttcatygagccgccctctgccggctgggccactgatgactccttctcatccgatcctgagtctggagaggcagatgaggttcctrcctactgtgtgccaccccaagaaggtagccccccaacagcccacatagcccctgagcagccctgcccaccacgaccccctctttagtcctccagcaaagttatttatttttatttttttttgagactgggtcttgctctgtcgccaggctggagtgcagtggtgcgatctcagctcactgcaacctctgcctcccgggttcaagtgattcccctgcctcagcctcccaaatagctgggattacaggcgtgcaccaccacacacggctaatttttatattttagtagagaccgggtttcaccgtgttagccaggatcgtgatccacccgcctcagcctcccagagtgctgggattacaggcatgagccactgcgccyggccagcaaacagttattaagggcccattttgtgttagtcactgttcttggctccgggcatgcaagagataacaagacagattcctatcctcaccaggcttagagtcagaygggcagtcatcagacaatgacaggacacagtgatatgtgtttccatgggggacatacaagtagggactcatttgctagccatgttggggtgactggggtcagggacgatgtgtgtggcatcccagtcgagtctagcagaatcagtaggagttggccaagtgaaagtcagggagaggagggaatggtgtttcaggaagatggaacagcatacacaaaggcccagaggtgagagggatgtggctgtgtgccatygaaagagttttagcttggtaagagtgtgacagtatttcaaagtagggagaggtggtgagaaaagagtatagagaccaggtgtggtgactcacacctgtgatcccagcactttgggaggctgaggcgggaggactgcttgaggccaggggtttgataccagcctggccaacatagtgagaccccatctctacaattaaaaaaaaaaaaaaaagagtgtagaagtaacagtgtctacctgaattggtccttctgccactctcctcatccttgccctcttccttgccctatttttgaggcctcctggaagatgctgagctgtgggtaggatgcattggggtggccagttcagctccagccaagctcttctgtctcctctgccagggatggtccctgtggcccaggcagggtcgtcagaggccagcctggctgcaggtgctttccygccccctgaggacgcctccacgccattcgccatcccgcgcacctccagcctagctcgggccaagcggccatcggtctccttcgcrgaaggtaccaagtttgcaccacagagtcgccgaagctcaggggagctctccmgcccgctccgaaagcccaagargctctcccggggggcgcagtcgrgtcctgagggccgggaagccgaagagtccacaggcccagasgaagcagaagcccccgagtcctttccggcggctgccagtcccggggattcagccactggccaccggyggcccccacttggtrgccggacagtggctgagcacgtggaagccattgagggcagcgtccaggagagctcgggccctgtgaccacgatctacatgctggcagggaagccccgcggatccgaaggccctgtccgctctgtcttccgccattttggtagcttccagaaaggccaggcggaagccaaggtcaagagggccatccctaagcctccgcgccaggccctgaatcggaaaaagggcagccctggccttgcctctgkctctgtcggccagagccccaactcagccccaaaagctgggcttcctggggccacagggcctatggcagtcagaccagaggaagcggtccgggggctgggggctggcaccgagagttcaaggagagcccaggagccagtctctggctgtggctccccagaacaggatccccagaagcaggctgaagaggaaargcaggaggaacctgagtatgagaatgttgtacccatctccaggccaccagaaccctgatgaccttgaatttggggagtggggagagtggatggactagactgtgctgtgtgctggaaaatgatcccggggccaggacagacaaaccagagcctctgcgcctccacagggaaaaggcaaggcttccaggccagttggcccaggcccctggcagtgctcccggaggggcccaggaaggcctgggcagagaccctgtaggatggggtcaggaagggttgcctgcagggacttttgctctgctgtcctggaccctgtgtgcctcataagggctattctttctttcacgtgcaaaacatttttctgaaatagcaaacaacctacatgtttgctgataaaagattggctaaacaaawttttttttttttttttgagacagaatctccctctgtcccccaggctggagtgcagtggtgcgatctcggctcactgcaagctctgcctcccgggttcacgcccttctcctgcctcagcctcccgagtagctgggactacaggtgccctccaccacgcttggctaatttttttgtatatttaatagagacagggtttcaccatgttagccaggatggtctcgatctcctgacctcgtgatccacctgcctcggcctcccaaagtgctgggatgacaggcatgagccaccacgcctggtctatgaactttttaaaaaggatgtatgtgtataaaaacagattcaagggaaaggcactaaatggttttttcctctggaagatgagattgtaggtgatatttattttcttctgaaacttttgtatagtttgcaaattttctacagtgaacattcttttttacttttgttactagattgaatttgataaagtataataaaaagcaatgatctttgttaaaaaaataaaaagtactaacattacagacatgtataaagtaaaacggagatttcctttctccccagaggcgtctgtgggtcaagagagaggtagaatctacttttccctggcagctttttggtcttgtttgaattctttgctcacatattacctagtcagaaaagaaaaggggcaaccctccccccgagctttatttttttttttttaagatggagtctcagtctgtcacccaggccggagtgcagtggtatgatctcggctcactgccacctctgtctccccggttcaagcgattctcctgcctcagcctcctgagtggctgggattacaagcgcccgccaccatgcccggctaatttttgtattttttggtggagacagggtttcaccatgttggccaggctggtcttgaactcccaaactcaagggctccacagcttcggcctcccagagtgttgggattataggcatgagccaccgcgcccggccaggggcagccccttctatctcagtgctcagagagtctcatcaacagttgaggtgctttctttcagatgtttttctgtgtacatgtcaacaaatattttaaacaaaaaattttagcatactaagcatactgttcctcagcttctttttttttttttttttttctttttgagacgaagttttgctctgttgcccaggctggagtgcagtggtgcaatctcagctcactgcaacctctgcctcccgggttcaagcgattctcctgcctcagcctcctgagtagctgcaattacaggtgtgtgccaccacacccagctaatttttgtattagtagagatggggtttcaccatgttggccaggctgttctcgaactcctgacccgcctcggtctcccgaagtgctgggattacaagcgtgagccaccgcggccagcctcaacttgcttttttacttaacgacatatcctggatatagttcaatgtccataaatgtaaagctaactctctttatttaaaaaatgactacatgagattccatctagcacaattatttaaatcattcccccgccaatggaaggttgggttgttctgatctgttttgatacaataagcaatgacatagtatacaactttgtccatatttatttatttatttattttttgagatggagtttcactcttgttgcccaggctggagtgcaatggcacgatctcagctcactgcaacctcggcctcctaggttcaagcgattctcctgcctcagcctctcgagtagccgggactacaggcgcatgccaccacgtgcagctaatttttttgcatttttagtagagatggagttttgccatgttggccaggttgctctcgaactcctgacctcagaagatcttcccaccttggcctcctaaagtgccgagattacaggtgtgagccactgtgcccagccactaaagcttctaaaaagtatatataatttttgtgtgtgtgtttagccatcaacaattatatctcattacaatttaaagttctatgagtattctaaggttgtttcttttccgtcttggctcactgcaacctccgcctcccaggttcaagccattcttgtgcctcagcctcctgagtagctggaattacaggcgcccaccaccatgcccagctaatttttgtactttttgtagagatggggttttgccatgttggccaggctggtctcgaactcctgacctcaggtgatccacccacctcagcctcccaaagtgctgggattccaggtgtgagccaccgcacctggccatttgccccttttcaggagttcatgttttcattccacaaactcatattgtgcaactgctttgtgcttgcttctctatcaagggctggtcatacaaagttgaataagacaccgtcctgcccccaaagagttcatagtcaattagagaggaaggcaaacagacgaatagctaattataaaacaatgccagcagtggacaaataaagtgaacagtattaatggggagtggttagggaaggcttcccagcggaggtgctgtccaaaatgaggctatgtcgcgagctagaggagagagaacagcaggtgcagaaaccacaggcaattccatgtgactggagcatcggggaccaggcaggtcagatgtccttcagagggagggagagggaggagcctgtgtgggtcaaattggggaactggaacttttaaattttgtttatttttttgagacggagtctcgctttgttgcccaggctggagtacagtggcacaatctctgctcaccgcaacctctgcctccccagctcaagcaattctcctgcctcagcctcccaggtagctgggattacaggcgtgtgccacatcacccagatcttttttttttttttttcttttcagacaaagtttcgctcttgttgcccaggctggagtgcagtggcacgatctcggctcacttcaacttccgcctcccaggttcaagtgattctcctgcctcagcctccagagtagccgggattacaggtgtgcgccaccacacccagctaattttttgtttctttagtagagacagggtttcaccatcttggccagactggtatcgtactcctgatcttgtgatctgcccacctcggcctcccaaagtgctgggattacaggcgtgagccaccgcgcccagccatttttgtatttttagtagagacagggtttcaccatgttggccaggctggtctttaactcctgacctcaagtgatctgcccgcctcagcctcccgaagtgctggtattacaggtgtgagccaccgtgcccagccaggaactggaactttatcctgttttacaaataatagtttctgaaggattttggcagaagtcacatttacatttcccttagtgccctgggatgagatgggggctggatttgaggaactgaaatctgaaggtggctcaacaacagtagttgcgggcctaagggcacagatggaccgattaggtaaatatgtaggagatacagctgtatcagtttgatggggatgcggtgagggagaggcagaatcacagcgactgcctaacaaatgtctgatgaaaggatggttctcagcagggcactgtgagtcatgcctgtaatccctgcactttgggaggctgaggtgggaggatcacttgagcccaagacttcaagaccagcctgggcaacagggcaagaccctatctgtacaaaaaatacaaaaattagccaagtgtggtagcatgcacctgtggtcccagctacttgggaggctgaggcaggaggatcacctaagcccaggaggtcgaggctgcagtgagctatgatcatgccaccacactccagcagtctgggtgcctgagatcctgtctcaaaaaaaaaaaaaaaagaaaaagaaaaagaaaaaagacagggttcttggtatctaacttcagtagacagtagtagtatggttatctgagagaaaatgtggaggacagttctgggggatatttgaggcatgtttgagccctgcagcgccgtcaggctgctcaaagaggagggaagggtgaagaaagagatttttcagatggcagttgaaaccttgggagtgggaagggttccacagggtgaggaaccgggtaggctaccagctggagccgccccccagcaggctgacagctccaagcgttgtctgggggaggttgccctcgccaggtggcccgggcggattctagacagtagggggcacactcggactggggcaggtggagcaagaggcgtttggggctcccacagccctggggtggtggtggggttttatttttggtttttattttggtagagatggttctcgccatgctgcccaggctggtctcaaactcctgtccccaagtggccctccgaccttagcctcccaaaccgctgggattccagacgtggacaccgcgcggcagccctggggtgctaagccagccccccggagcgagccagggtgaccaaggcgattctggggcagtcagagggtcttcccgggtcgggttagtgcctcgaatccgggggacgaagacggggagctgagctttcggagcccgggcttatcagacggggacccggagccccctcgaaccctccctagcttgtaccagctggcggacgtggcccgtagcatcgccctgcagaggggaccttccctgaaagggacggggaacggggtgaaggtggccagcgcgggcagggagcacccagatgacgatcaagggtggagggtccccggaggaccgagcagtgcgtgaacacgggcggagaaaggtcagtctgatggggggagctcaggagaccccatcctaggacgggacagaccagccccaaatccccttgcagatttccaagggccaacttccagggaccgggcagacgccaccggggagaggggaaggggtcggtgcatcagcggggggcgccacggctggaccgggtccgggatcccaggccccgaatacgccgggacgggaaccaccggggcgggggagcgaggaaccaggacccaaagcccgaggcggcggggacggcggcgctgcgtggggaggaggcggggtggggattcgagagtggaaccaccgtgcggagccggcgcatctgggcgtggtgacccgcgcgcagggggcagctggggacggcggggcggccgcgggagagcccggctgggggcgctggtggcccggcggcttctggggggagtccgctgggggccgggacgcggagccggagccccagcctcgcagggtcaggccgctggagaggccgcggggcgatgtcgccggggattcccggccgcgctgtgactcgggttgaaggctgcaaagccgaggcccggcccgcagcgcccaggcccctcccgtcccccatctctcttgtttgtctccgagtccggccggaaccggcttctgctcgcggcggggcgggcggggggctggctgctgattggtcgacgcctgtttccagccccgctcagccaatcagcgggcggcagtgttttcttcttggggtcggaataaaagggctggaataaaagagggcagaaaaggcgccgggcgggcccgacacacgccggaggagccgggtgagctgcagcagggaggggatcgcggccggggcgagggcgcgggggcagaagcggccgccgaaggggcgtagggagaaaacgtgggaacaagaggagagagatggagcgatgagrggccgccagggaagagatgacgaacagatgcgggctggggaatggaggcgcgggggtccgaggccatggaaacgggcgagttgccgggggaacgcccgagatgggggtcgcgcggctggctcgcgccrccggtttgaaccggctcctcgtctcccacgctgggttcgcgtggccgcagcgcctagcgacctagacggcggccaatggcgcggcagttcctgcgccgtccggccaatgagcgcgccggggcgggccgttccgtaggtctgggcgctgatcttgtggttgaagaaaccagctctggggaagggtctcgggcgcgggcgggagggcacctgtcagggtccctgggagaggcagccctcggatctgcccctgcccacctcacgctgcgttccatgctggccccaggcgatgtcagtcctgctgcaggccaggactagttccacggccctgagcatgcgttagccccttcttgcctccatgcctcagtttacctcggagtgagctgcgggagacgtctccctgcctggccggggcggctctgtcgtagcggagggcagcggtacgagccggccgcgggctcggggtgtcccaggtccgggcagggctggggttcgcttcctctgctgcgcgcaccggccgccgcggccggggaggggtggcaatcccgagccctgcggcagcggtcggggctgctgggggcggccgcaggggctgggcaagggccggccgctgacgccgagttctgtgcgcaggtggtgcagagccggagccggagccggagccgcgccgcgccgcaccatggcgcc

SEQ ID NO: 12362 - DNA, 20270 bp, Homo sapiens
agctggctgctgttggggatgactaggaccacagctccttggtccttggcttggaccggggaagggcactcgctaggggtggcagtgagatggcatgcctcttccatgaggtggtgcccgcttcctgcccaagtgggagccaggaagccagcgggggcctgaggcatgcctgccctgtgggtagctcccgaaagattccagactcgctctttagaatcaggtggctcactgagctctgtattttgtttcctggagctttcactggtttcttcccctgagataccccaagtgacatgaaaagcatactcagggcctagagacactttactggggatgggcttctgtcacaggtcagaggtctgagaagaggggcaggccccactcctctccactagtagagaaaggttgacagagaatcatttcttgcttctcttggccgtagttttggttgtgctgggggcctcagccacagaggccttgggggctgtggctgctcgtgcccccttccttccccagaaagagctttggtggcccctgggaatcagactgcatggtttcttggtgggagaggaggcctggggtgaggagacggcctcagggactgtctcctccccttgcgcaggagtggcagaagggctgctgtccccagccatgggcaccccaggtagcaggggcaggtcggtgagggtgggctgcatctccatcctcagcaggtgctctgtcagggccgtctgttgccggtgctccctgtgcctgctcagctcctgctccagctccttgaggaagcctgggaggggccgggggtggagggtacagggtgggtggagccctgggctcagcaggagggtccctgggctcagggaagtctctggctggccccttgtcccttgtgggaaggagcctgaggctggggcccaggactgacacctggctctggcccagatgttgatctgaacttggggctcccctccccggacgccactgccaccttagcttccctcatgtcccacagggcagaggtgggctctggggaggctgaaaaccttggaaagcagkgtcacctcgttctgagcagaatgggccactcagctctgggaactcctcatcgcttgaggcttcatcctcctcatccgaaatccagcgctccaccacaggctgcccgtccaggtccaggagaagtggcagggcttctgtcaccagctcgctgcagagcagaaggagcagaggttacccaggagggcaccctggcrtggaggatgcaaagacacgcaccacagcactcacacccggaggggtggtggctcatgagctaggtaggaggtgggggagaaggtgtcatggacaggaccccaggtttgcaggctgagaggggtctgggctgagttagcaggtagagctcagccatgacctttcttcccaccctccactccttaccggtagccatcctggttggtgcagctgtttccagacaggttgaggatgagaaggctctgggggaactcatctgcacacagcaaagagagaggaaatggggttctcacttgatcttagccaaaagaccatgaagcgatgggaatggggttctcatacccactttctagtccaaagccagtacctctaggcacaaccccttgaactccctgaggatgaaatgtggacctgcaggggcatggctaatagaagcatgggcagatgggtgcagaggggagggcaggccccacaggggatgtgtttggtgagccagggcgagtgggttcctacccagcttcaatgtttctatcaggttctcagaaaggtccagaaactggaggcatgggaggtcgaggaggttttccacctgcctgatttggtttcctgccagagacaggaagctgtaggggaaggaaggggtacagaggcagagctgaatcatggaacagctggaagaaaagaggagggcacctgacaccggggcccctgggctaggcagctgatgaccagtggggacacatggccttctggggtgagggagtagatctaggcttgctggtccttgactgacaaggacccaggcttggagaaatctgaaccagttctttgggatatggctaggttcccccaacccctcttcccctgcctgagccctggcaccacataccgcaaggaggggatgcaagccaggttctcaatttgctggatcttattctgcaagaagaaaccgaagtggrgaaaccaagctgagatcagatgcgtcaggggccctttacggggacaaagccccaagaccatgtctactctgcagctggagatctggcactttgggaatgatcaccccactccttgaacaggttgccactaccttaagaaagatgattttctttccccatgtggatggttaagggtgtaaacctggggtatctaaacctgactacgtatactcttctgattccacaaccaaagagtgacctgggaatcagaaaaggaaactaagaagccaccaggaaaacggaaagggccttggtggtggcttgcatacacagagagaacaatgagcatacaggaacttgacggttaaagtttctatggggaaagttgaagcgagctgggaatactcaaccaggagaaggctgaagatcaaccaaccaccaccaccaccaccaaacagccttcaagtaggatctgaatgatgtacaggaatcttcatagtttcctcttcttcaaaacaggaaatgggctggagctatttaacgtgaaagatttagagtagatgccaaaaagaacttctagatcaagagaagtgcctaaagaacagtggaaggagcacaggtcatgttcaggatctattttgagggaattagtttttcaattcaggaccctatgtcattcgtctgggaatggtttaaatgaaggtctgcctgcctgaacaccagggaatgggcaggatgacctggttggctcctttcagatgagacagattaggtccacaggggtcaaggggaggggaagggtggagaaagaagttaccccttgcagatagagactgtgaagattctggaggccttctaagttcctgatagtagtaatcccctcccggtccaggcggacagtctgcagttcatcaagagtgtgaaacctgggaaaagagtcagtaagggtggtgttagagcaccactcatgtggtctcttagcagggaggatgggagacggaggagggaaggggtttcaaggaggggtagttggctgagtcattttaatcagatgtgagaaacatcttgacatcttgaggtggtgtctagatcatgaaaccggcttgacttgcagactcgtatctctattgttagcactgggaagggtgagagagaggagtaagggccctctgggaaattgggggatggcagcttatggtttctggagagattcagaggcaagagaaaccttcctctggccagcttggatggtggaggcaggggtgggacagagatgagacactgcagaaagatccttcctcaccttccttttgagtcgttcatggagaaaaaagcacttgttccatccacccattcattcattccacaacattgctgagtgcctactagagacaaatgacagagtctctgcccaccactaataaagaagcagggcaggctggccatggtggcttaccctgtactcccagcactttgggaggccgaggcaggaggatcgctcgagcccaggaggtcgaggctgcagtgtgccatgattatgccactgcacttcagcctgggtgacagagcaagaccctatgtcataaaaaaaaaaaaaaaagaggctgggcgaggtggctcactgtaatcccagcactttgggaggtcgaggtgggtggattgcctgaggtcaggagttcaagaccagcctggctaacatggtgaaaccccatctctactaaaaatacaaaaaaaattagccgggtgtggtggcgcacacctgtagtcccagctactcgggaggctgaggctggagaatcgcttcaactcaggaggcagacgttgcagtgagccgagatcacaccattgcactccagcctgcgcaacagagtgagactccgtctcaaaaaaaaaaaaaaaaaataggaagaaggccaaacatctatgacaagtggataacagaggcaagtacaggggaaaggaagaaggaggaggaagaagggaaagaaggaggaagaggaagaagaaagaaagaaagaaagaataaggccaaacatccctgacaagtggataacagaagcaagtacaggggacaaagggagtacataggctgtgcactaaattcacagtaggaggaatcagggaatgcttcctagaggaggtgacagatgagtaggcattagccatgaaggtggggggatatggggagaaggcatttcaagcagaaggaatagtacatgctaatacagcccttccgaaactccaatatgcccatgcagattctaattcagtagatcgggtggaggggctgagatgctccacttctaacaagccccctgtgatgccaatgctgctgtcctacccctgcaccccctcccatccacacatactctgagtagtaaggtactaaggtgtgagtacacagtgtgggaaattgtacacttgtggagagtggccagaaataaggctgaaaagcagaagtcaactcatgcttaggcattgggatttatttgggaggaagtttctatcagtgaatgcctgattagatttgttatttaaaaggatcactttggctactcaggaggctgaagtgggaggattgtttgaggagttcaagaccagtctggccaacagagcaagaccccatctctaaaaaagtaattaaaaatactttactttttgtttgttttagaaatagggtctcaccctgttgcccaggctggcatgcaatggcatgatcatagcttactgcagccacaggtacctgggttcaagtgatcctcctgtctcagccacctaggactacaggtgtgcaccaccatgctcagctagtttatttttattttttagagataggattctgtctctattgcccaggctggtctcaaactcctgggctcaagtgatcctcctgcctcagcctcccaaagtggtgggtgtgtaggagagaggtgaacacggccttatctaagacagttgagtgaggatggtgaaaaagaaatggaattattttgaagaagggaaaatcagctgggcattaccactgattgaatgtgtggagtaaggagagaaacaaagatcagttgacaaatcagtacacgtcagggacctggtcatcctgagtgtttcagccttctagcaccccttttctcccccatgcactcacatcttctctgacagttccccatcttcagggaaagtcaagttccgcttagtgataagggcttcagtgatgcagacgcccccttcctctggaccctgggctgacttccctgtgaaaagatgagtccaactgtgacacttcctcactcttggaggccttaccccgctgttttccaactgctctacccaccgtcccacctccctactcacctccagacatgatctaaaataaaaggctgctggtctgaggcgggagaggaacgaaaagagaggtcttggcggcccctaaggatggcagaactcaggatggcaggaggagagagaaactcagagacttaggagaggaggaaagggggttgattcagagaaaattgctggggtgaggtcgaagaaaacagtaaattgatgtgaagggtctggagtttgaggggtgtggaggggctttgctggcagcaagctggggtgttgtgggcaggaatggttgagaaaggagcagttcctaggaagccggagtcgttgctaagagactggacgccgagtggggaggtaaaggcgggctccgttggcccggcctagcgcatgcgtcttacggctacagccggcgggtacgcccactgcttccggccccggggttcgctaccccacaatccttagctctttccgtctccactcggcttccgtccattcttccggtggagatggctgcggccgtggcggggatgctgcgagggggtctcctgccccaggcgggtaaggagtggcccaggtcctcacggcgtgtcttgcggccgctctctagtcctcatctgccctcctctactactgattcttcccataatctctgaccccagctagatcgctggcctccttaccccgtccagttccttgtgactcgactggtaatcacagcaacaacgtccagatgttgtctgtctccagcgtttcttttgcctggaccactcctcgcccagacctttgcattatgtctccatcttaatgtgtcagtctaaatgtcacctcaggtcttcccttgactccttagccccgtcgcaatctgtaattttgcatttgtttagttgcttgtttcctctattaaactccgcaagggcagaaccatgttcattcagcatagccagcaggtggcatggtgctggatgttagtaagcgtgcggtagatatttgtttagtgaatggatttgagcacttaatataggccaggcactgtgataactatttttatatgtgttagctcatttaaatcttttaaatcatttaaatctaaagcaccctgtgagaaagacattcgcatctcctctttacagacgcagcaactgaagttcagaccagttgggtggccaaggtcacagctagtaattggcggaagagagattaaaatccagtttcggctgggcgcggtggctcacgcttgtaatcccagcactttgggaggctgaggcggagggaacacctgaggtcaagaatttgagaccagcttggccaacatggcgaaaccccaactctactaaaaatacaaaaatgagccgggtgtggtggcgcgtgcctgtagtccccgctactcaggaggctgaggcgtgagaatcgcttacacccaggaggcagaggttgcagtgggccgagatcgcattgctgcactccagcctgggcaacagagcgagactccatctcaaaaaaaaaaaaaatccagtttaatttgattccaaagcctgcctgcagtcttaacagttaggttttgtggctgctggcaataagacctcttaccccagcaaatatccatactctctgactgttagagccgccttctatctggacctttttctgaggtcacatcccagtcttggaaatgactgaaagtgggaagttctagtcttggcccttgtgttgaggattaagtggtcactttgtctcagggcttttgagtgcctcccttgttttctgtggggtgctctgtagcattatctgtaaacaggaagagaggaggaaagagaaacttgtctgagagctgtgagaatggtgtaacatttttttctcctcttcaaatcataggacagggtgtcagagcagcggttagagtggtggttttcaaactttagcatgcgtcagcatcaccaggagggcttgttagaacactatttgtgacccgtcttggtaacatagtgaaacctggtctctacaaaacaaaacaaacaaaaaacactatttgctaggctccaccccagaattgctgattcagtaggtctaggcagggcctgagaatttatgtttatttttctttctttctttctttttttttttttgagacagtcttgctctgtcacccaggccggagtgccggagtgcaatggcacaatctcggctcactgcaacctctgcctcttgggttcaagcaattctcatggctcagccacctgagtagctgggactacaggtgtgtgccaccacgcctggctaatttttgtagtttagttagagacggggtttcaccatgttggccaggttggtcttgaattcctgacctcaagtgagctgcccaccttggcctcccaaagtgttgggattacaggcgtgagccaccacacccagcaaaatttctaacaagctctcaaatgatgctgatgttgctggttggggtggaggtggggcataccttgagagccactagattagaccaggggttggcgtattatggcagggccagtcactgtgttttataaaattctattggtacatagtttctgctgtctctttaaatattgtctgtggctgcttttggcagagttgagcattagagacagattacatgggccccaaacttaaaatatttactgtttgaccattttaagaaaaagtttatttaaccttatcccctttttctttctctctctctctctctctttccttccttccttccttccttctttttttttctgagacggagtcttactctgtgcccaggctagagtgcagtggcatgatctcggctcactgcaacctccacctcccgggttcaagcgattctcctgcctcagcctctcaagtagctgggattacaggtatacaccaccacacctggctaatttttgtatttttagtagagatggggtttcactgtgttggccaggctggtctcaaactcctgacctcaagtgatctcgcccgcttcggcctaccaaagtgctggaattacaggtgtcagccaccacactcagcccccacttttcttaatgtgttcaaaatattttctcctttgttctcatttttttctcacatttctgcacattgagaagagctagagaaatggtagcctcaagagattaagtaattgacctcgggtcacttactgaaagagaagctttggaaattcaggacttttgtcagacaattccttgtcccactcttgtgttgagtctagctctgtgagctgtgcttttctctgctagagggtgtgttttttctccatttgggataaactagggcctccaggaggttgcctctaaccatgttgctatatgccctcccaggccggctgcctaccctccagacygtccgctatggctccaaggctgttacccgccaccgtcgtgtgatgcactttcagcggcagaagctgatggctgtgactgaatatatccccccgaaaccagccatccacccatcatgcctgccatctcctcccagccccccacaggaggtaaggaggaatttggrtacatgtcacttggtggtgggatggtggattaaagtaatcttgtctctggccatagtgaagtaggacactyagscattgtcatgcacgtcattatttcagtttgactgcctgatccagatattttaagatgaartccgcacttgattctgtattggcttttgggctctggattgggtgggcctcctgaatttccttcttgtctccaaaaatgtgtgtgtgagagctaccctagcaggtggggctggggagagtatctctccaatctttttttttttttttgagatggagtatcgctcttgttgcccaagctggagtacaatggcgcgatcttggctcactgcagcctctgcctcccaggttcaagtgattctcctgcctcagcctcctgagtagctgggattacaggcatgtaccaccatgcctgactaatttttgcatctttagtagagacagggtgtcaccatgttagccaggatggtcttgatctcctgacctcgtgatctgcctgcctcggcctcccaaagtgctgggattgcaggcatgagccaccctgcctggccattttttttttttttttttttttttttttgtgagacagagtctctgtcacccaggttggtgtgcagtgggacactcttggctcatcgcaacctctgcctcctgggttcaagcgattctctgcctcagcctcctgagtaactgggattataggcacatgccaccatgctcagctaattttttgtatttttagtagagatggggtttcgctatgttggtcaggctggtctcgaactcctgacctcaagcaatccacctgccttggcctcccgaagtgctgggattataggcatgagccaccgcgcccagccaartttctcaattttaaactaacactgcaaaagagttatatttatgattggcaaaataattcaacatgagtacagtgtcagattgataattgaaataattttagcaatattattgtcaagcactgttgactagggcagactgcaggcctgttttcgggggagtggatctgagcatcctcaggtttgaaaaacactgctaaagactgcaattatctaatgaaagtgaaaaggttagagtagtgggagatgttacatgtctctgagagtcagaggcccagttatcctacttgttccccgatcttttgcacatctggacatcactggaagccctagaacctaccacagagggagcaacgttgccaggagaagtggcagctgatgtacccttggtcattgctttccaacttcaggagataggcctcatcaggcttctccgccgggagatagcagcagttttccaggacaaccgaatgatagccgtctgccagaatgtggctctgagtgcagaggacaagcttcttatgcgacaccagctgcggaaacacaagatcctgatgaagrtcttccccaaccaggtagggagcaggccccttggcatgggttgcccatcttccccccacccccaccagactcagacctcaccatctgctccccagtgatgatacttcttactcctcctctccatgagtcaccctctaatctggtgtctaacctatgattaggggctgagaagacccttgggttgcaccctcagcctaatgtggcccatgacccacgaggtagctcttcctcccacttgtccccgataagccattttyccctgctgttcccaggtcctgaagcccttcctggaggattccaagtaccaaaatctgctgcccctttttgtggggcacaacatgctgctggtcagtgaagagcccaaggtcaaggagatggtacggatcttaaggactgtgccattcctgccgctgctaggtgagcaagcacccctgccagttaggggtggggtgaagaggggcctgctgccatctgctaggcttgtcttggtaaaaccgtgaacgttcttggagagagcatcctttcacggatggagcctgagtaaacagcacatttattgagggccgactgtcactcccacacctgtgttgtctcactaccccaggtcacttctgcactggagggaagactaggaaaggcagacatggagcagggagagaaaatttagataccttgagtctaacagtggggtagtaggtgctgaaaccctcacagatgaagatatttaatacaagtagcccaagtaaagggtgccgagggccagtgaccagtgtttcccagactcccctgatgctgactcacttaaggggcagagaatactgcacatgtccttggaaatccagatttcacaggtctctgtagggagggggcgggacaggaatctgattttttttttttttttttttgagatggagtctcactctatcacctaggctggagtgcggtggcacagtctcagctcactgcaacctctgtctcctgggttcaagcaattctcctgcctcagcctcctgagtagctgggattacaggcacctgccaccacgcccagctaatttttttttttkcgtatttttagtagagatggggtttcaccgtgttggccaggctggtcttgaactcctgacctcaggtgatccgccacctcagcctcccaaagtgctggggttacaggcatgagccaccgctcctggtgaatctgtgattttaataccccctcaacactccatgatatttattcaattttttaattgtaaaatacacacaaaatttaccatcttaaccattttaaatgtacagttccgtgttaagtacattcataatgctatgcaacatcaccaccatccatctccagaacgttttgtcttctaacagtgaaactctacacccattaaacaatagttccccgttacttccctccattccatgattcagggtctcactcccattgcccaggctggagtgcagtggtccggtcatggctcacagcagcctggacctccttggcttaatccatcctcccaccttaacttcctaagtagctgggactacaggcgcatgccaccatgtccagctaatttttgtattttttgtatttgtattcaccatgttgcccaggcttgtcttgaactgctagtttcaagcaattatgccaccttggcctcctgaagtgttgggattacaggcgttttccactgcacccagcctgattctttgtttttttgagacggagtttcgcagttgttgcccaggctggagtgcaatggcgtgatctcagctcactgcaacctccgcctcccaggtttaagcgattctcttgcctcagcctcccaagtagctgggattacaggtgcttgccaccatgcctggctaatttttgtatttttagtagaaacggggtttcaccatgttggccaggttgatctcaaactcctgacctcaggtgatccaccgaccttggtctcccaaagtgctgggattacaggcttgagccaccgtacccaacctcatcctgattcttttttttttttttttttttgagacgaagttttgctcttgtcacccaggctggagtgcaatggcacgatctcagcttactrtaacctctacctcccgggttcaaaygattctcctgcctcagcctcccgagtggcttggattacaggcgctcgccaccatkcctggctaatttttgtatttttagtagagacggggtttctccatgttggccaggctggtcttgaactcctgacctcaggtgatctgcctgcctcagcctcccaaagtgctgggattacaggcatgagccaccacacctggctgcctgattcttatttacaaggaagtttaggaaacactgacttaataggggtcagggccaggtggatatattaagagttttctgagggaagagtgaagaagtagggatcgatcccaagcagagtgggtgtggtgtggggcacagtggaacccaggtcctggggaaggcaggattttgagaagggcaatggagagcaagttactagggtcagaatattgttttcagagaagaaaggcaatctgcaaggagcctaactgaccctgtgttcttccaggtggctgcattgatgacaccatcctcagcaggcagggctttatcaactactccaagctccccagcctgcccctggtgcagggggagcttgtaggaggcctcacctgcctcacagcccagacccactccctgctccagcaccagcccctccagctgaccaccctgttggaccagtacatcagagagcaacgcgagaaggattctgtcatgtcggccaatgggaagccagatcctgacactgttccggactcgtagccagcctgtttagccagccctgcgcataaatacactctgcgttattggctgtgctctcctcaatgggacatgtggaagaacttggggtcgrggagtgtgtttgtcacttggttttcactagtaatgatattgtcaggtatagggccacttggagatgcagaggattccatttcagatgtcagtcaccggcttcgtccttagttttcccaacttgggacgtgataggagcaaagtctctccattctccaggtccaaggcagagatcctgaaaagatagggctattgtcccctgcctccttggtcactgcctcttgctgcacgggctcctgagcccacccccttggggcacarcctgccactgccacagtagctcaaccaagcagttgtgctgagaatggcacctggtgagagcctgctgtgtgccaggctttgtgctgagtgctgtacrtgtattagttcctttactgctgaccacattgtacccatttcacagagaaggagcagagaaattaagtggcttgctcaaggtcatgcagttagtaagtggcagaacagggacttgaaccaagccctctgctctgaagaccgcgtcctgaatttctwcactagagcttcctcatcaggttacccagaagtgggtcccatccmccatccaggtgtgcttggatgttagttctccaccctcgaggtgtacgctgtgaaaagtttgggagcmctgctttataataaaatgaaatatattctacttcctttattttgtggtttacacggttgtcctccctctaaacttactctcaggggcttctctgtcatctgactttcctcactcttgcttcccttcctaggaaaatcctcttcccctatacctgttcccacaaatggcatcccgcgcatgcttgccctattaaaggcagctgacagctgtacccactagctaacgtgtctctggtggttctggacaaaaggcctgcgggaaaactaggattctctattaatggggaattctgagagctctagggtaggaggcctcatgcaagtcttcatgaaccagaaattcctaataaaggagacgggatgcttaactcagagtccaccatcatccttgaytggagcacattctgggtggatgcaggggtgacccggggaaggtggctgttcaacattccttctcggacttgaagcaatgccaccgcttccttagtcttggacaggcactgtctggcagggwtgacctgcagcagctcttttgtggcctgggccaggaccagcttcccccagtgcctcatcctgtgctgtatgcccagggatgttcaatcactgggaagtggcttaaaaggcccttgaggctcctggatgccagagcttgtctggtcagtgctgcccagtgctcctgtccctcccagaaccctgccaggtgctaacaacaccctcctcctggggtggctggagcagcactgaggctctgaataaaggcaagacagtgggtgttcccgagagatatgtgagaccctgaaacgtaaaccaagctcggtgaggatgaagtggaagggataagtggcccatgtcacttttggggtcagagaagaaacttgaatcacatccttcacctgaggccccacctacttctttccagaaaacttagctgcgcttgaaactgtaggtctatgccacattcatttgaatgaattttagatctttgttaagagccgatttttcattagaattgagcagctgggcacagtactccagcagaagggtaaagggaagggaggggaccagcattgcagcccttttaacggcagctgtgactgccccaggcctgctcctgatcagagactgcaggctgtggggtgtcttcatacacacaagcactttcagatctccatggggcctgacctagtggggcatcaccccagtgaagggcctcagtgtggggactgctggctgtccctttcctggcttgactgcccctgctgactgtgctcttggcactctcttatggtcccagagggggcatctgtccctccaccatcaacctgatacttttgctggctccaaattttgcagtctattttcagatgtaaaatgagaggcggggggcgggggttaattaggaattggccttgggtactaacagggtcactgccatgctagtctgaataaatcctttatcaccactggcgtacagccaacagttccccagtcctctgatctatctggaaccatgcccagcagggactgtgcccccactcccaagccacatcgatgctagggcagtctgctcagccctgagtcctccggggagcaggggggcagagctgagcggcygcccggagcttggcgggaggaggggacaggggagagggaggtggggagatccggctagaggggaggctctgacatctccttccttcctggttcctgcagcagctgctgccactgctcagcgcggtgaggagggagccggtgactcggagacrgtgactcagagrcagagcggcgcaagggccaagragtactggcgtccatggaccctggggtaagggggctgcgtggcagcagctgacattcctgagaagagcttcctcccacctgaagctggtgggtctgctcctgaatagaggtggagagggggcacccacctggctcacctagacccttcacctgcctaccgatagagcctccccctctacccacaagcagtgaggggccaggatccccacagggccgggagaagggcccagagatacctgaacaccggaagagtttgagaactttcaatggctgaatgcaggagtttcctcccaggtcagcctcttgcagcaagggtccctctgccccaacctcctgggcacccgttcctgccacatccctgtcccctctgggcctcagttcctcaggtgcttgctagctccattagaagatctgggctgcttcccccacctcaaaccagcctcgcccctccagtcccctcccccgtctcacacatgcagagcctcatgcattattgatctcccggtggagccaggatggccagggccagtgccaagggtgcctgtgggcactgctgcaggacctgtgcagacctgggcatgtcctgggccccctcttctctcatgaagtatctcctttagcccaatgtcctgccctctctgggtgggtggcacttctcagagccccaaggactgtgagggtagacaggggatggtgaggctttagggggtactgagggtccaaaaagggcatcctaggggcatgtttggtgggaggagacatgggaaaatgggggctatctcaggcctcagtttctccaagcactagataatatggagattaattggtgggaggctggggagttttctgcaagatcatggcagagaagtctctgagctacggtggcagggtggaggggtcctgaaggcagaggcagctggattgaggaggtctcgcttgtccagtctctgaacccctctgtctcttcttggagcctcttctgtcactcccttgcttcacctctgagcactcccagggaagcctctaaagaaagcactgaatgtttcttggagccccagagtatgtgcccaaggcggggctgggcatatgtcttgtggttttccctgggcacctgcccgtctgctgtgtgctagttcactctcagggcagtgtccatatcaggtgaaaatgggtggggtcgggacagaggggcagacttgggagaggcttggcaggtgagcagagggtatgttggggagcccttatctcagagggtgtgggaggggctggaggtggggaaggtgatagcagagtttgcgttaagggggtctttctcttgcttcaaggaccccgtcaggagcaggtgacatccttccccttccaccctgctccctgctctacatccccagcagggagtggcctctcccttctccatggacttccaagagagggacccgcccttcctgcctgagagcgctcagtcctcaaagcccagcagtgctcagcaggtcagagagtgggaaagcggtggtgggtgggccaagcttgaaccagacagggaggggccaaggcggacgtctcaccagtgctcccctccctctgtcctggactgcaggcctctgagctgtgggaggtggtggaggagcctcgggtcaggctggggacagagggtgtcatgcctgagaggcaggaaggtcacctgctcaagaagaggaagtggcctctgaagggctggcacaaggtagggtgggcaggcaaagggagggtccagacatggggggcggggtgggaatggggggcagctgctgggcagtccaatggtgtttgcatgatgagaaggaaaagaaaagctaatttgtgtggttgccttctccctcatgcccttcctctcggcctcccgggtcctgtcactcctgggcaacatcacagagatactttgtgctcgaggacgggatccttcattatgcaacaacccggcaagacgtgagcccgggcagtggcttggggttgtgggaggagtctggccccagtatgccctgggcaggcatggggtatctggaatcgaccagagcagggtctgaatcccaggtccaccacttgctgaatgtgtgatctcgggcaagttacatccctgggccatagcttcctcacctctaatgggagagcaccatcccccaggtgcagagctgtcatggtaagggaggtcatacgtacaaggctctctggacagggcagaataagtgcccaagaaatgggggctttaccaccctcatcctggtcccattctcaggctgggaacaaggaactgaaggcctgggtacccaggatctctctgggagggtgttgccttccacaaccctgcagacccctgagggtgggaatagtttttcttgatctgtgacttcttagagaccaagatgtgacttgacgtaggggagcgttctgcacatgggaggatgattgacaagtctctactgatagtgtgacttggacatgagggtgaacctgccacctggcccttgagcctagaatggcatcagggagatggtggctctatggctctgagagcctaaaacaggtcccctctccctctaccaacgcttcacccccagatcaccaaggggaagctccatggctccatcgatgtccggctgtcggtcatgtccatcaacaaaaaggcccagcgcattgaccttgacactgaagacaacatctaccacctcaaggtgacatccctgggaggcaggacgtgtgttggcccccaacctgacagaggcattggaacacacaggggcaggggctgagggtctgtggaactcagggtctgtctctgagtttgacaaaaagtaagtttccatcctgtaaaaacagccaagggcaaacctgcacttcttggttgttgtatggacaggcacagagctaagggctcagacacctgggcgccttgcgctctgtctccctgcaagtgagccttgcacaaaccaggctctgtaagaagagaccctgcttgtctggggaccagagccctgacttcttgctcttggaaagtggtccctctcttcagatagccctccccctctccatcacttctgcagatcaaatcccaggacctattccagagctgggtggcgcagctgcgtgcccaccgcctagcccaccgcctggacatrccccgtggctcactgcccagtaytgctcaccggaaggtaaggtggaccctggggtgggggcaggtaatgtggcaattcaggggcrrgggctatggagaactgtgagacccagggaggtgggcatcatccttcctgaccctgggctcaccccacaggttcctggtgcccagctyccaacagmagctactgcctcagccctacctgggcttggaccgygggagaaagtgtcttcctggctgagggacagtgatgggytggaccgctgctctcatggtgaggggccctaggcgcagcacctccaagggtaggccccaagctggcaggtctaggaggggataatgttacctccatccctgcctcagggagccccagtttaatgagacagcctctgcctccaaggagatccagtctacctgggccctgtctaggggagtcccagtcttacagaggagtaagagtctgcctgggcacatagacagacgtggatgcagggacaggagttgtgacaaagcagatactgagtgcccacacagggcaggggcctgaggagtagcgccagggaaggggtgtgctctaggaaagggttcctgcagtagggtctgtgaagttggcctggagggagaagtgtaaaccaagtagagagagagagagggtgagcacatccccagtctgctcaaaggcagcaaaggtgaggcatggtctagagacagagcagaaattaggcttcagaccctcccaggaaaccagggggcaccacaccaacaggggtagcgacctgagctcttgaacagggaacagggagcagtatcgggatctccatgaagtcagtgttgggagagtcatgtccttgaggctgggttcggtggctcatgcctgtaatcccagcacttttggaaaccaaggtgggcagatcacctgaggtcaggagttcgaggccagcctgaccaacatagtggaaccccatctctactaaaaatacaacaaattagccaggcatggtggtgcgcacctgtaatcctagctactcgggaggctgaggcaggagaatcacttgaacctgggaggcagaggttgcagtgagccgagatcacgccattccactctagcctgggcaacaagagcaaaactccgtctcaaaaaaaaaatgaatggtgttcttgttcttgttctttttccccgcagagctctctgagtgtcaggggaagctccaggaactacacaggctcctccagagcctggagtccctgcaccgaatcccctcagcccctgttatccc

SEQ ID NO: 12363 - DNA, 304123 bp, Homo sapiens
gattatgctttagtaactacacaagactgtaatatttttgagactctcattaagattaggtttttttttttttgagatggagtctcgctctgtcacccaggctggagtgcagtggcgcagtctcggctcactgcaagctctgcctcccgggttcacgccattctcctgcctcagcctctccgagtagctgggactacaggcgcccgccaccacgcccggctaatttttttttatttttagtagagacagggtttcaccgtggtctcgatctcctgacctcatgatccacccgcctcggcctcccaaagtgctgggattacaagcgtgagccaccgcgcccggcctaagattagttttaatccgtatacacttgtttatgttctgtgatttcaagacccacatgtcaccaaatattgctatgatgaacttttagatgctctttgggcagggaaaattaaggtttagaatacacacctaaaaatgtaaacaggctaactaataggcatctcctgcttgttgcctcactaacatggatttacatgtacaggcgttcctggaagacagtgcaatttggtttcagaccaatgcaataaagtacatatcacaatgaggcaagtcacacaatttttttttatattccaatgcatatataagttatgtatacactgtactgtatactaaaatatatatatatcttaacttaaaaatactttattgccaaacaatgcaaatgatcatctgagccttctgtgagtctgtgagtcataaccttttttttttttttttttttgagtatcactcttgtcacccaggctggagtgcaatggtgcaatcttggctcactgcaacctctgcctcctgggttcaagtgattctcctacctcagcctccttagtagctaggactacaggcgtgcatcaccacgcccagataatttttgtatttttagtagagacggggtgcgatcatgttggccaggctggtcttgaactcctgacctcaaatgatccgcccgccttggactcccaaagtgctgggattacaggcgtaagccactgtgcccagcccctcataacctatttgttggaggagggtcttgcctcattgttgatgactgctggttgatcaggctggtgcttactgaaggctggagtggctgtggcaatttcttaaaaatagacaagcatgaagtttgccacattggttgactcttcctttcatgagagatttttctgtaacatgccatgccattcaatggctttttacccacaatagaacatttatcaaaattgcagtcactcctctcaaactctgctacagctttatcaattaagtttatgtaatattctaaaccctttgttgtcacttcaacaatgttcacagaatctttacgaggagaagattccatctcaagaaaccactttctttgctcatccataagaagcaactcatccatttaagttttatcatgagattgtagcaattcggtcacatcttcaggctctatttctaattctagttctctcactatttccactaaatctgcagttacttcctccactgaagttttgaacccctcaaagtcatccatgggggttggaatcaagtttatccaagcccctgttaaagctgatatttttatattcttccatgaatcaggaatgtacttaacagcatctggaatggtgaatcctttccagagggttttcaatttacttagtccagatccaccagaagaatagctatctatagcagctatagccttacaaaatgtatttcttaataagacttgagagttaaaatggctgcataataaatgtgttagcaggcatgaaaataacattcatctcctctccagcagagctcatggataactaggtacattgtcaacgagcagtaatagttggaaaagaatctttttttttttttttctgagcagtaggactcaacagtgggcttaaaatatccagtaaaccagagctgggtgtggtggctcatgcctacaattctagcaatttgagaagctaaggagggaggattgcttgagccaggagtttgagaccctgtctgtacaaaaattcaaacaattagctaggcatagggcatatgcctgtaatcccagctacatggaaggctgaagcaggacgattgcttgagcacaggaggttgaggctgcagtgagctgtgtttgtgccacagcactctagcctgggtgacagagcaagactctgtctcaaaaaaaagataatagaaaaaagaaaaaagaaattccagtgaaccatgctgtaacacatgtgctgccatctagactttgttgtgctatttctagagcacagggggagtagatctagcataattcttaagggctctaggagtttgggaatggtgaatgagcaatggcttctacttagtcaccagctgcattagcccctcacaacagagttagcctgtcctttgttctttgaagccagacactggcttcttccctctagctataaaagtcctagatggcatcctcttccaatagcaggttgttttgtctacattgaaaatctgtcattgagtatagccaccttcattagttatcttagtgagaacttctggataacttgctgcagcttctgcatcagctgcttcacctcatatttttatgttacggagccagcttctttttcttagacctcatgaatcagtctttgccagcttcatatttttcttttgcagcttcctgacctctctcagacttcatagaactgaagagagttaaggccttgctctggatcaggctttggcttcagggaatgtagtggctggtttcatgttctatccagattactacaactttctccatatcagcaaaaaggctgttttgctttcttattactcgtgtgttcactggagtagtacttttagtttccttcaagaactattcttttgcattcacaacttggctaactgtttggggcaagaggcctagcttttgatctatctcagcttttgacgtgcctttctcactaaacttaatcatttctaagttttgatttaaagagagagatttggaactcttcctttcacttgaacacttagaggcaattgtagggttattaattgacataatttcaatattgccatgtttcagggaatagagaggtccatggaaagggagaaagaaggaggaacagccagttggtagagcagtcagaacacatacaacatttactgattaggttctctaccatggacatggttcatgatgctccgaaacaattacaatagtaacatcaaagatcactgattacatattgccatcacagatacgataataatggaaaagtctgaaatattgagaattaccaaaatgtgacacagagatacaaaatgagcacatgcagttggggaagcagccccgatagacttgcttgaggcagggttgccacaaaccttcaatctgtaaaaacaaaatacaatatctgcaaagcacaataaaatgagatgtgcctgtacagaattcagccttggcagaatagatgcattttgataatggagtgcattgggaaatttaaggcagtttgcctcccagatcgcccagcaggaaacacgatgtggagtgtctctggggaaaggaaagagataacagaagagatgtcgctaagttttgtagccccaaagaccaatctcactttgcgtagctctgtcttggatcttgagggaagtaacaagtgtgataagattctattgaggaaagaactgctgggttggtggtcttcacttgccagtgatattctagatgaaaaacttgaataagtcttcttctcgtaagtcagcatctctaagcaaccacaaaacatttattcataattaaatatttcaagctattgaaagacaccgcgcatcatagcttttccttaaggcgatgttcctcaaacttctctgataataaggattacctggaccatcttaactatttccagagaggttctcattaagtatctctggagtaggaaaggcaactgtggagaattcctctttataaaacagacatcctttcctaacaggccagagtggacttgcctactttcctccctgtcctgcgagtctgtgtgcttcaaccaccatctggaccagttctgcaacacctatagaccctgcacttacattgtagctgtgttatctgaagcactaaaaacaggtgagcgcaagtaggtggtaaaaatccatctgctgagtcagagtggaggtctttgaaaggttggcatatggcctttaattgtgtcattgaaatcagctgtggatgggagaagccttagtatacccatcaacagaaaataagggtaagttcatagaaagatgctattaaacctcaaagagacagaagctgtgatgtttatactgggcagaaatatctttgggcaaggaatgcaattgatttttcttatggaaaaaataactgcctaatgacatcggagaggtgacggacacactgtacttggaaaatcctatggtggagaagtaggtgtgatattcacactgtgcgtactttacagattaatcaaaaatattttctacatcaccgttttgttgtactttagaattatattttcagaggaaactaggttttagagaaaaaaaaacaaaaggaagcctgtgaaatcaggagtaaacagtaatgccaattaagcactcgtgctgggagcaaaacagaggcctcattgtgttgagccacagctgagccaatcgcccaaaggaactggtggacttctaaaaacaaaggtcaagtttcaagtgaatcactcagcaacaaaatgaagaatattttgaccatttaataaaggctgctacaagataggagtaaagctttggttccaaaactaaccatgaagaactcatttattgcataaaatatcttagcaaatacatgataaccaggggctcagacccttcaggattgatgggctgggtcactccatgagacacgagctgagagggagagggatccaaataagagaggggatgagcatcatttactgagttcgggccagctgtagcagcactggctgttgttcatttcagtaattctcctcttatacattgcccagaaatcaggaccaacaaagatcctggacaaattgtccctggatggaaaaaacttaaagagagaagcaagtagatctgagtagcctgagaagcaagagctagacagtgctggatactactggcaccacacccagatcctaacaggccagtgcaattatcacccaacttgtgttaggatgactgctaacttctcagaactgtccccttccccagagaatgaccctcttctgaatagcagatgtcttacatgggtcggtataaccccaccctgacgcaggggcagtctgaagtcagggacaaatggacatgtttctacaaaagctaggcctcttgcctccaggtggaccagctctgtgtgtcattcttctccagagttccccagaggtccaggctgaagctgaactccatctccccatatatttagaaggagcatgccctgtgcagttttgattgctcagcagcgtcttctatgtgctgatcatgaagttcaatatttttgcatcttaatttttgtttgcttgatttgtaagtttctgaaaagtttgtattaaaatccccctctatgactgagggtttgtctttatttatatttctgtcagtcttgctttatatgatgtgaggcgatgttacaaagtgcatacaaatttaaaattgctatattttcccaatgtaataaaactttggccattccaaagtgactttatatctggtgatatggtttggatttgtgttcccgcccaaatctcgtgtcaaattggaggaggggcctggtgggaggtgattagattatggccggagatttcccccttgctgttctcgtgacagtgagttatcacgagatttgatgctttaaaagtgtgtggcacttcccctttcgctctgtctctctcctgccaccatccgaagaaggtgcgtgcttccttttcgcctcccaccataattgtaagtttcccgaggctgcccaatcatgtttcctgttaagcctgcagaagtgtgagtcagttaaacctcttttcttcatgaattacctagtctcaggtagttctttatagcagtgtgagaatgaactaatacacctggtaatgcttttttctttaaagtaatattagtgtagctgccccaggtctcttctgctgtgtatttttcatcctttttcactttctattctttaaacttctttttttcccctatgatttaaactttaacattttatctttttactttcaacctttctgaatcctaatttttgatatacttctgattgtgcatgtttgtcttttgatttagtattttgatcatttatctgcccagatttccatttgagaaaacctgctggtggcaaatagttccttttttgttgtttatttgataatgtcgttaattactaagtcttgaaagatgaatttgtcctgatataataaattcctagtgtagtttagcatttatattatctcagcacattgaatataaaataccacttcagcatcttctaacaaactaacaaacgtttctattttttttgagacggagtctcgctccgtcgcccaggctggagcgcagtgacgcgatctcggctcactgcaagctccgcctcccggtttcacgccattctcctgcctcagcctcggagtagctggaactacaggcgaccgccaccatgcccggctaattttttgtatttttagtaaagacggggtttcaccgtgttagccagggtggtctcgatctcctgacctcgtgatccgcccgcctcgacctcccaaagtgctgggattacaggtgtgagccaccgcgcccagccacaaacgtttctatttttgagaagtcagtgctcagtctatatgtttttctattgatctatctttttatatgtgtgtatatatatatatttactctttgtgtttgtttttctggaatttctccatgatggatttatgtgtggatgtctttttatctattctagttgagatttattagactcggaacttatggattggtattaattatttcttctgcttgttctctccttctggggctccagtttatgtacattagcccatcacgctttatccttcatgtctatggatctgtatttcctttgttcctttattatgtattctgaatagttcatctgacctgtttttcagttcacttatacaccttgctgcatctaaaaagctattaaaccagtcttttcagttattaatttcaaatatttatttagtttttgaaatgctatttgattttttatgtggctagctgtttttttatttcctacagatatttttaggttgctctttattgacttrtgctctaaacataatacagttattttatattatatgtctggcaatttcaaagtctaaatattttctggatctgtttttgcagtctaattttttctgaagattcttcatcatggtgtctaattttctctctctgttgcttattttttcaacaagtggtctcgaaaaatcttttacaaaattttttgagacttaagatgaaaatggtttcactagggaggatttgttttagcttttgtcagacacctaaagacaccaacagtccatagtacaaggatgaccaaaattcatggcatgtgattttttttatcacctgtgggaaggcattttgtctaaaaatctgtgctagtgcttgctcttagttataaatccttggggacaatgcttccttatgctcagcttcaaggcaaatcttgtcctctgtcttctcaagtctatggaatccaatggaagatttatagctttttcttttgctataaacaaaagttttatttaaactggataggcaaattcccttatggtagaaatgccttcaacctctgcttatattccagtattcattcttgttgcctgcatttcgcctgatgattgctgactgtcttatcagctcttggatgcttttaggaagaattaaaatttttaatatttagtctagcttttataattatatttaccaggaagcttagctagaaaatctagaccactttttctccagaaacagaagtcactggacacttctttgaatctttcacaaaatacttgagtagatgttttcacctccttgctgccacatgaactatggggcatgcttctaccttagggcctttgcacctagcctttcctataaagtactcttccctcagaaatcttttgagctcacttgatccttcacttgtttgggctgtttttcaatttttatttcagaattggggaacatgtgagggtttgttacaaaggtatattgcatgatgctgaggtttggagtacaaatgtatctgccaccaaggtagtgagtatagcactctataggtagttttgttttgttttgttttgagactgagcctcactctgttacccaggctggagtgcagtggcgcgatctcagctcactgcatcctccacctcccggattcaagcaattctcgtgcctcaggctcccaagtagctggaacamaggcgtgggccaccatgcctggctaatttttgtatctttagtagagatgggatttcactatgttggccaggctggtcttgaactcctgatctcaggtgttccacccacctcagcctcccaaagtgcagggattacagatgtgagccactgtgctcagcctctacaagtagttttttccaacccttatccccctccctccctcctccctcttgtattccccagtgtctattgttcccatctttatgtccgtgtgtacccaatgtttagctcccacttgtaagtgtgaacatgcagttttctgttttggtttcttgtttctgcattagttcacttaagtccttcgcttcctgtatattaacttcccagtcaaaccttcactgtctaccccatctaaaatgccatcaccccaatccatatttcttattttttcatttaaaacaatctttactccttagttcttttagatacccaacattctctatattttacttatcttgcccattgtccacaccactgaaatagaaggttcatcagggcaggggttttgtttgtttcacccatttgctctatccttaacacctagaacagtgcttagcacatactaggcatttaaaaatatgtattgaatgaataatggaacaactgcagtcttggatcctgtcttttaaggacatagactagtgttttagaaatgcaggactgatgtagcacaattgaattattatggaaatgttggaatagcaaattagaattacagctaaaaataaataaattgctaaactttgggtctggcaaataagggcatctgtcaatagtttaaacaggagagcaaccaatcatgcaagtcagttgtagaagagagtgtaccttgcactggaagaagaaagcataaacagtacaaagcatattatttcagagsatttgttctctactcccatagttttactttttaaaatttaaaatatatgctctttgagagtagggatttctgtcagtttagttcactgctatattctctccctcaaaagagatcttgtatatgctgtgtgcaatagttactttttgaatatgtgatattatgaatattgacattgayattattgttgagtaaattaaattatacatatgattatgacatgaatatagccatagcttactcagcaagtcttttagtgagatggtcaatagaaacccatgattcaactggatatcttgataggccacctggaattaagtcttcaatgaacaatgtttatagaaaagcggattttggtrtcaaagcaaaagctactgcagaaataagcatctcttttgtacataagtctctgcctatctaccagggtagtttagaggtattgcctataagtcacttgtagcaaaaggtatgctctgtgcatatatagatggagccactagtagtccagcctttctgtgaagaaaacagcaccctctattatggggtgactcaacacatatcagggattatggcttggagaaaatatagcaaggcctggatttcagccccatgcattccctcagccaggtgtctgtgcaaagcatgacttgcacaatccgatatagtgagctcatgtgtggatggctttccagaatgttagtttgcatgtctactagcggtgcaccgtgagcctgcctcacccatcctcttcagtgttatagtctatagtctttccagttgaaatgatgaaaaatcatatctcattgttttgttattttaccttttcttgcttacctggtgagtttgacttttgaactacatttttatgtatttcttgtttttatgacctttttctacaatttgcttattttgttggaaaactaacattttattatcaatttataaaatttgataagatatatgttgctatatatatgtgtgaatgtgtacgcatttatacatatacacraattatgtatatgaagacatatatsttgctattattttgccaagcttattataatacatagaagaatatactttttctcttcagtggttctaacagttgtagacttttagtgaaaaactgtgttcaaagtcttaaattaggaattgttaataatttttttcataaattttataaatatttctcccatttagtataggttttactttttttgtgatgtatcaaaagttcagtaaactctrttagccttttcctttgtggtttttccctttgtttttatgctattaacatgtatcaatatatttatatttataaatctatatctagctttgttccatttagaatttagttagagtttggtatcaactgaagacttaggtcattttattttgaaaaaaatagctgtccaaatatttcatcataaccattaatgtttactgtatttagaatataaggttcaattttgatttatcttttctgtgatatgatgtaaatgttaactcttgcacaaaatttattccatttttagtatcttccccataaaatgcacttaaatagttaaaagaaaaagtcttatttgccaactgccactattacagttcttttctattatgtattagtcatattgtaattatttctgcaaattaattttggaaaaccattttatgccatccacaaaagtaacatgttaagatttttagtgacatttcattaagcatttgagttaccctgtgagtaactgacatctttgttattgtctaggaagatggcatagcccttttcattgagttctaatttgatagttcgcattaaatttatgtattttctcttataaaggctccatacatttcatgcagaagtcattcttaaaagttttaaatatttgggtaaccattggctctgtgattttccctatttatatccaaatttgttattgctttacgtagataaaatatctagttttgtacrtttatcttgtatttggctacatttctgaactcttaagaattctaaaagtatttagttccttctggattcatgtatgttgctattactttgccaagcttcatgtgaggcataaaagaagatacactttcttttctcttgaatggttttaacattggtctacctctaatgaaaaactatttcccagaccataggcttgcctgaggtttgcatgaacctggggatgtggaatgattggcagaaaccatattaaccagcttcatatccattataatttcaaccaatgagtaccacagagtgagttatggtgaatcayttccacagaagaaatttcctgagagatttcaatcctgttatatatraaaattgtcagaagtaaacagcactaggtcaaaaaagttttcaacttatgtcagctcttttagcgcatacatgagacgtattttgttcatttctgtatccctagaacctagaacaggactagaaaatagtagaattcaacatctatttctttattgctgttgaatataaatttggagaagtcaaattgcctataggagaaaaataacctgatactgacaaatctataggctttggagtgtckgcagcgtctactagtgtgtatttagagggaatttttgakawgactcaagattttgagtggcattttattaagcatttgaattactttgtaactgacatctttgttattgtctasaagaatggcatagcccttttcattgaagtctaatttgatagtttgcattatattgatgtattttctcttatrtgggtttcatacatttcaygcagaagtcattcttaaagagttttgaataagactcttatccaaaattccctctaaaaacacgttagtagacattggtggttgtctgaccaattagttctctctccccttggccatgtgctcagggcaagggccaatcaccaactcaaatgaacagccatgttaatgctgtttccgccttcagtarttgtgttaggcataggcatatgacataattttgttcaacaaggcttgtgaggtagagggatcagaccttctgagaaagatctttttcattcttaaaaaggaacgttaagtcagagacatgctttacttcccagaggatattctgagtgagttktatgagttggtgaggtttagactggacacagccatctggtaaccatgaagggacaagtctgagaccagagccaacagcctgaggatgaggggcaaacacagaggaagaatctgggccccatgaggtcaacagtgagctgctaaaattaacctgaaatttccctgctgggagacattgtgttgtsaaatagttttataccatcttttactaggttttcaattaccagcagttggatgcaccctgtgatccaatggatacaaatgagatttagaagtgcactttaacttaaataaaataaatagccttgtctaatgtattaacgagaaagacatttttgtcttatttatatgtcttatgttctttgaaatgaaataaatgaccatatatgcttgtaaagagagggagtctacagatatttggagaaaggacattctgggtggagagaacacagagtgcaaaggacttgaagttaaagtgcatccagcagtctcaaggaagagtaaaggggtccatgtgagtggaataaggtgagcaagggagagaggagcaggagatggggcgcagagataagcaggtgaggtrcaggtcatggaatggctgtaggtcattcaaaaaacttttttttttttatatttccccaagaaatgaaaagattttcagcaaaagagcacagtggtctaataatggcttaagaatcattctggctaagttgtctaaggggaataagggcagaagcagggagacctgattagctgtctcccgctattcgggcaagagcagatgttgagttggagtgggagcggtggggatggtgagatgtgtgctgatgcaaaatcatttccaaaggatctgacaggaatcactgaaggatagagtgtgggcaatgagagagaacgtggactgtgaggagtcaaagatcaccctgaggttttaggcctgagcctctagaaaaatgaagttatgatttatttagatggggagggstgtaggaggagcaggtttagatgtgggktaagggaaaaacaagagcttggttttgacatgtgaaactttggatgcctgttagatctccaagagaagactctgagtagcatttgtaatatagacatatcacaaaagatagaagtatgtatgtatatacacatgtgtgtacatacatatatatatgaatatatcatttatagaaatagtcatataggagtgtatgtgagttataaatctggtagtcttcagcatagagatggtgtttaaatcctagaaactggataaaatcacctaggaaatctcttttctatatagaaatatagaagtggtccacagtcaagcatagggcatacaatagtttcaaggccaaggagatgtgaatggagacactctgcataaacaactccttaaaggagttttgctgtaaatggaaagatagaaatgatgtgacaattgaagaaggaagtacatcaaagaatttttttttttttgtacagttgggagacataacagtacactttatgctgaactggtggacaggcaaracatgataatgcaaagactggtraataaagaaagcattgcccttgtggagaggagtgggataggatccagtggacaaaggagggctggcctgcactagaaggcaggtgattcatccactcattcacactagcagaaaagaaggcagagtgcaaggtcctaaaggcagggagtgggtagttagctgacacaagcttatgaaaatttcttctaattgattttattttatgtcagtaaaataggaagaaactcattaagtgaaggtgaagattgaaaaaagatgtgttggaggtttggggaaaagaaagttatgcattagtcaactagaagaatgtaggagaagctggattggactgtgggtgattgctagaaatattaagaamccacgaaggagagcatcaggataaatagctaatgcamatgggacttaatacctaggtgatgggttgataggtgcagcaaaccaccatggcacacgttcacctaggtaacaaacctgcacgtcctgcacatgtatcccggaacttaaaataaaatattaaaraagaacccactggaaagaatagatcatgaagttaaagcgagatatgtacatttttgtcctagccttgctcagttatgtgagtgaatgtgatgataatgcagtctgctcttgtcaggattgtggtttggcctggagagtaatacaaaaatcttcaagtccagtgccactgtggcaatgtctcctgtggytgtgtttcccttaagaagtttaagtcagattcatgtgagtttctcaagtcattgtatcttgtgtgctagcatagagctttcagaactcatcagcccttctgctcatgaaagatacctatcctcagagaaaagatgaaaaatgaagagatgtatcatcaagggaataaatgagccatttggaaccacatcaagtaaataaaatatttctctaagaaatatgcattgtggtttatcaccaaaaccattgaacctcattaacctcagtgataacgtacacaattggttttgagatgtttacagctggactctaccaaaacayaagactattagagagtaaaagatatgggaaatatattcattggctggatacattattctacattaatattttccaaaggattaatttggcctcatcttggttcaatactgtcttttatggtaatatatcttcttatttagattttgaggctctgaaaaagagggccttataagkcttcacatagtctttttttctgtgtcttgtacttttgttttttttaacccagttaggagctaaatcagtatttgcttaatgaattaactaccaattaattcacaaattcagttgttcaagttttaagtgctttgtatgaataatggtccctttgatgcaatggatatttttagggagacagtcaaatatttttatattaggaactaaaaattttccattccctgaccagaaatcaatctcaaaacacggccatgataatgtctaattatgaaaccaccagggaaccaaagcttcctattttagtgtgaaaataaaatagaggatgatgttgaataagtatgtcctcattagccttcaaaacattctcacattgttggactggaaaaaccctaagaggctgttggctttatcatctacttccaggcaggatgataactaaatcataccgaaaatattgttgcctttcttaaataaaaatcttcagtgaaaactattttataaaaatgttttagttataaattttcatgatgctgtataacaaattaaaaattacagacatgatctgatttttatgtttttatcacatcaaacaattggtgtaataaatcttcgtaactaaatttttggactcaaataatggttttcttatttgatatttcatcattgtttaaatttcccagaagcaggctctgagatgaatatttgtgtgcaattttaaaacaagtgctcccaggggagactgacatcgaagtagaaggaggacaggaggtagaaaagataactgttcagtcttaggcagaagacccacagggaccggaacttagcatgattatgtttggggattctaaattataacttacacctcagagttgtctaaacctaaggcagatttgcagtttttcacccaacagtcattagttaatagctttaggagggtaaataaggaggggggaataaaaataaacatttaggcacttctgactctgcatttgttgacaragtggctcgatagtctgagggcagtgacctgaagttctacaggagctggcgcatcccacctataccaacagaagttgcgaatctcggggaacctggacaaggyagcagccatgtctgctacccatggcaggtgccttcaagatgctgagaaaatacagccaacacatataaagcagttacagtgcagtgcaaaaattaattaactagttgtcattgtaagttcaacataaattgagactgtgaagattatccatatgggctgaaagacactgatcagacattgaactaaacaggtctttaaaaatgtgaaagatttaagtacatggagaagtaagggcatttcaagtagatgcaaaagcaagatttttgaagatcaagaaacaagtgttgaggtggaattaggagtacacaaggtttgctgggaaaaggaagaagcaagattgggcagggggagccatcagacttctgtgctgacctgacattgcctctgtgccagccctgtgggaggcccttgatccatgattgccctaagattatactacatttggctcaagtggctggactctcagatcactgctttgtacagccagagacagaccatcctgagaatatcgtgaccttggttcacacctgtttttgaaggggtgaacagctggtggcgttcagcctaccctactcctcccagctggttaacaagtacttttctgaagggaattctacactatatagctttatttttgttcttatggctaagtgcaaaatgtcagaaattatgaatgcttgtgagacaatatcagactatttgtaatggaatagaaaccaccttggtaatcataagaaatattacagattgtgagaaatattcctcgggtctgtgctgcttgtatttctcatcgtcttgcaaacctggtgtcagtcttgatagtacttaatagaygtacactgaattttttttttgaataactgaatgagtctaggcamgtacttgttgctatgggaagggtatggggatgatccagtgttccagctsaatcaaagaaaaccgagttacctgagaacatgtggcagggaaggagaaagaagtaactraagtggaaaacagatgggtgcagaataaattttaccatctttattctttgaactaaggctaattctgttccaaaagaagcaattgactgtaagcacaatgctttctctataatctactagcatgattatcttgctttgtatgcctgacttttgcaagcatcgtgtttccacctcatgaagttgttgtatgagttaaacaagataaaatatcacatcttgtttattccaagaggcaattattttgttcacatttttgacaaatttgaaattggatcaatagcaatgaatggcattttgcgatctctattggtaagtcatgatgatgcacaaacatccaaagctctgactttgaaatctgcaaaactggtgtcaggaacttgcaagaaaattctgagatagtagcagagcaagtgagttgtgttgagcacgagtgggccatggtgactcaactgagttcagaaaacttctagaagttggaataaaaaatygggcagctatagaaatatacaaagagctcagcaccaaagggatttggcttctttcataggttgtattaagtaaaactgcatcacctgcacttaaggacaatatataatcagagggtgatatattgtatgaaaaacacagtcataygattccaagttgaaaagtgaatagttggactctccaaaggagttttaggaatatctcaatttrtttcacctgygttttctttttatttctatataataatatgccaatataatgatgttttggtaaacaaggaaccacatatatgatagggatcccattaaggttataaagccatatttttactgtttcttttctatgtttrcatatgtttagatatacagatacttactattgtgttacagttgtctycagcattcagtacagtaatgtcccatacagatttgyagcctggaggaaataggctataccatacagcccaggtgcgtggtaggctatcagggtgtgtatgtacactctgtgatgctcacacagtgatgaaattgcctagtgatgcacttctcagggaagaccctgttgttaagcaatgtagaactgtaatagggagatatgacaaaaaawatacttctaaataagcctaaaatatctctttcaataaatataaaattaaaatctaactgataagagcctgtgtcatagtttagtttgccacatttttttcttttacagtggtacataaaatgatgaaaaatctctcaatggatggttgtatttgataaactatggcatgraaagtaattcatacatcataagttctcaatgaaagtgaatggactggattttttttattagttgttgcttaccaatcttaaagaacttaggtaagccattataaagaattycttagaataacaaacacaataaaaataaaaatatagaagataaaccatccagttaatatcttcttgttccatagtataggtttctcattaacagaaagaagtataygctgttttyttctgcttttatatccaatcaattataaatagacstaggaagacagttaatttaaaacatgacaattaaaaaacaatgaactgcattttctttccattgtattaaatagtctttcagtacaccaggacacttctaagaatatttaggttttcaataactatttaatgtgaagcttcatttgactctacaatgccaaactgactgatttaggggctaaagtaactgaaggaacaagttgcttgaccatttcaaccagagcttgaaaggcaagtgtaatttattgtgttgcctggtcaagaggaaggcagaaggtgataggagaagtggtaatcgactgggctacccacagaggaggtaacaagctgctggctttatcattcaatacttttctcactcaagctacttttttttttttttttttttttggttactggtcttatttaccccttctttattccataaagaaattcatatcttactgttagtaattgatctagattattatatcaaataaaaatttctatgactaaatttcattttctgtttatgaaaatgaaaaagttttgtggacaattttcatcacaataaggcagtgtttatggcaatttggtcaaagaaattacatcaaaatccatataatgtcagttttataarttgaatattattatgggaaaatgcttgrgctctcatatkggcttttatactgtgattattattcccataacacgttttagtgtcttacacaactcaggacagagtctcttgaccctggcgctagcacacaacctcatgagcttctctcttcacctatggaacctgtatttagtttgttgcctgtggttcccgagtgtagctctagtggaccaggctgtgtagtaggaaaggtcttggcacagagttcagatcaaaatacacataaatgaaatatatttttaacttctggaaacttatgctatataaaatagctctatatgaatacctattagcagaagactcatacttgttttcatcatttccaactctgatatgtatgtaggatatatatatattttttattaatctattgtatataatatataaataaagcaccaatcctattgacactattccacaagataaggaaagagggaatcttccctaaatcattctatgaagccagtatcacactaataccaaaaccaggaaaggacataacaaaaaaagaaaactatagaccaatatccctgatgaacatagacacaaaaatacttaacaaaatactagctaactgaatccaatagcatatcaaaaagataatccgcaatgatcaagtgggtttcataccagggatgcagggatgatttaacatacgcaagtcaataaatgtgatacatcacataaacagaattataaacaaataccacatgatcatctcaatagatgcaaaaaaagcatttgacaaaatacagcatctttttatgattaaaactcttagcaaaatcggcatacaagggacataccttaatgtaataaaagccatctatgacaaacccacagccaacataataatgaggaaaagttgaaagcattccctctgagaactggaataagacatggatgcccactttcaccacttctcttcaacagagtactggaagtcctagccagagcaatcagccaagagaaaaaaataaattgtatccatatcagtaaagaggaagtcaaactgtcactgtttgctgatgataatattgtatacctagaaaaccataaagactcctccaaaaagctcctagaacttataaatgaattcagcaaagtttcaggatacaaaattaatgtaaacaaatcagtagctctgctatataccaacagcgaccaagctgagaatcaaatcaagaactcaaccccttttacaatagctgtaaaataaaaattaaaaaaataaaaaccttaggaatatacctaaccaagaaggtcaatgacctctacaaggaaaactacaaaacactgctgaaagaaatcacagatgacacaaacaaatggaaacacatcccatgctcatggatgggtagaatcaatattgtgaaattgatcatactgccaaaagcatctacaaattcaatgcaattcctatcaaaatgctaccatcgttcttcacagaactacaaaaaaaatcctaaaattcatatggaactaagaaagagcccacataaccaaagcaagaccaagcaaaaagaacaaatctagaggcatcacattacctgatttcaaactctactataaggccatagtcaccaaaacagcatggtactgttataaaaataggcacacagaccaatggamcagaatagaaataaacccaaatacttacagccaactgatcttcgacaaagcaaacaaaaacgtaaagcaagaaaggataccctattcaacaaatggtgctgggataattggcaagtcacatggaggagaatgaagccagatcctcatctctcaccttatataaaaatcaactcaacatggatcaaggacttaaatttaagacctgaaactataaaagttctagaagataacatcagaaaaacccttctagacattggcttaggcaaagatttaatgaccaagaaccccaaagcaaatggaacaaaaacaaagataaataggtgggacttaattaaactaaagagcttttgcatggtaaaagaaacagcagagtaaacagacaacccacagagtgggagaaamatcttcacaatctatacatctgacaaaggayacatattcagaatctacaaggctctcaaacaaatcagcaagaaaaaaacaatcccatcaaaactgggttaaggatgtaaacagacaattctcaaaagaagatatgcaaatggccaaccaatatatgaaaaaatgctcaacatcactaatgatcacraaaatgcaaatcaaaaccacaatgcaataccaccttactttcacaagaatgaccacaatcaaaaaatcatagatgttggcatggatgcagtgaacaaggaacacttttacactgctggtgggaatgtaaactagtacaaccaatatggaaaacagtgtggagattccttaaagaactaaaagtagaactatcatttgatccaccagtcacactactgggtatctaccctgaggaaaagaagtcattataagaaaaagatacttgtacatacatgcttatagcagcacaattcgcaattgcaaaaatatggaaccagcccaaatgcccatcaatcaatgaatggataaagaaactattatatatatatatacacttagccataaaaaggaatactacttagccgcaaaaaggaatgaattaatggcacttgcagcaacctggatgggagagcattattctaagtgaagtaacccaggaaggaaaaaccaaatgtcgtatgttctcactcatgagttgggggctaagagatgaggatgcaaaggcataagaatgatacaataaactttgggaacttgggggaaaagagtaggaatggggtgagggataaaaggctacaaatggggttctgtggatactgcttgggtgatgggtgcaccaaaatctcacaaatcaccactaaagaacttactcatataaccaaacaccatctgtttcccaaaaacctattaaaataaaaaattttaaatatacataatatatattttatataatgtatattatatattatataatatattttaatagtacataaaatattttgttgtatgttaaaatatataatatattaaatatataatataaaacatacatataaaacttacatattagagttggaaatgaaatatttatatacatttttatataaattatatgaatatataaaacacacatgtatatatgtttatatatgtgtgtataatatacgtgtgtgtctgtatacacacgtgtacatatgtgtgtgtatgtgtatctgttcttcatctattactagaagacactgtggacaaatacataayataatcatagaagttcagcattagagaaaactgatattcccttcaagcatgcccttgtggaaacagaatttaggaggttaagaaacctggccaaggtcttcagctattggattacaaaggcagcagcacaattcatctctgaacggttaagtctccatgccacttgtgtgcctagttacgtgtgtgcctagttacatcctcctgcttattaacagctaaataccactttaagaattaaaartctattcattggcataagaataatatttatgtgataagtttcttttcccctaaagtcaatgaaaatgactcctagawttttttcctaaaatttccttctagcatcaactagaackgccgaaatattcagaagagtgaaagaatatttctcatcccagagactcctaatatttccaggtgtttttgctatgtgggagggaaaaaaagccctctggttctgtgctaacatctggaaaagatgttaactatacacctttttttttttttttctaattccacagatctggctcagctgagaagctctttttcttggaaatgcaaacttatttttattgctgcctgggaatatttagccttcctgaaaactttggtgtgccttttactatttgaaaacctggaaggtgcctttgagtgaaaatatcattcaagtaggttttgagtgaaattgagattttttttaaactycaaacttgactgtaagtgattgtaacaattagtgccacacatatatggagagttcagtaggtgctgtttattatctaactgtagattggctttcttgatgttttttcataatagatagaattttctttgtttttatattttagttgcctaaattcatctcattacygcacgktgatttttgccttccattaagcttgaaatactaatactctcatttagttcaaaaggttgagtttaatcaacatgttattaaaawttttaaaccatttattattcatttattttataattcattctgtcagcaaatacttgttgaggcttttctctgtgcaagatactggggttacagcaaagaacaagagagaaatggtccctgctctcacagaacttgcattgaaatgggggagtagtagattattcacaagtagataaagatatggaaacaataatattagatactcgtaagtactatcaatmaaatgggataaagcgtgcttggacaggggagtggctttagacagcacaatcagggatcagcctcctctttcagaaggtggcattcraagagaagccactcagcatgtaacctgggggagagggatccttgcaaagggggcactgaggcaaagaacaagcttaggatgttctagaaacrtgagaaacagaaagcctctgaatggttggagagtagtgagtaaggggaacagtaatgagagaygaggttagacaggctgacagagccacatcacacaaggctttgtaggatttgggaagtaagtaatcaacagaaatttatggagcaatgtaataatgggaggaagaatcagtgaaagagtgagtggagatggaaggaaggaatgaaggaagggagatattgtgtaaagatacaaacgctgattttgcagagaaattaaaagtacctagaactgaattggacaagaatattctgccttttccaaggatagtratggtcagagcacggcataccttggtctgagttaatataggtaatacgataggggagcgggcagctggaaaacggaaacaagttmacaaaaagagatacacacatttgaaactgctttaaccagtactatctgtattcgtggttattcgaattgcttcaacatgtgtataatgtgtagtgtggtatgtgtaygcatacattgatccttatttgtatcatactttagatgtgctttatcagtataatgaatattagaatcagtttttaattggtgggatatatgttgtttaagttaaggggttggcttggagtgatgctcttgcataaataaagtgttaaaaccagccagcccatcagttacaccagctttgaggtacatgaggtctggaggccatgggttctggttctattcactaaagaccttgaccacaagagatttgcsaatcctgtgggtggtaaaaatgccactgaatatgcttcagaagattcagagggaagcttctatacaaagcttaggttggtatatcagaagacagaggggtagggatattacttttccagataggctgtgtgaccactcttgcgtgtttgctgataaatgcctacgtgtttggctatttcaggtctgaggctcaytttccttgtgacaaatgcctgatagtttgtggggcagaaacttacagctctcctttctccctctgttgggaaccacctgatactgctgatgttgccaaaaatccatctgaatgaccaaaccagtttgtgttggtcaactaagtcagtgtccaaaaaaaagcaaacaagtgaacaacagggcttggtatgattatttaagatcttctagccctggggakatctttatccacacccacattttgatggacaataagaactgctgtcatgtttgttcacatttacatttctgcagtstcagaccagtccttggagaagcttgaagggtcaaactgtcatattctcccaaagaatctactggagaagttataataataatgcttaatatctcacaattcaacttgcctttaaagcccggcatcactttaaagtaaaagaaaagagagattgtatccagacaagccataattaaagaaagggtttagcctagaaagagctttgatttctgatgatgaatagaagtgtatgactagaaataaagcaacaaagactggatttaccaagatttccagtcatttcctactaaaatcttgaggaaatttaccatcttatgcttgcatttcagcccctgaaatggaagcgtcatgggawtgctttctgcagtggggatgtttgmacaatgagtttattaattgatgcatgtagacaagagactgttgggtggtgctaggaagaagaaaccagcaccctcagagaagagrtaggggtagtgccctgccccgtgcagagtggactttactgaatagaacttcataccctaagaactggattgcccctcatcactctgtggccttggtatacatatgaattgcattatttttaaaggaatatgatccttgaaaacagttttaaaagacaaatgatgcactactaatagacttatgtaggaatcycctgtcccatcctcctatctccagtgtggctaccctgaagcaagaaccttcaacttctctaccctgaatcaactgcagtgccattctccccaatggcatttacctccatgtttctaagtatgtgtttgtgctgcttgtagttgatttatggtagagaagactttagctctctcatattaccattccatttcctctatacccctgcttcctaatttggtgatattaccagttttctatttgcttggttgtctatgtacatatggtttgttttccccttaatccagtgcttctacttgtcaaatttatcatgtcagatctggtaggtccattttctgttctcttgaagatctgccttctaaagcctcacattgttatatagcagtcgagagtagttgttctgcaacatagaacttgcctttgaaattccccttaacttcattatttgttcttattttcatttttcttctgagatttatctgaattcctggatcccatgtcttccctgtcttgattttttgacctgagagtagtgaatcagatcttctatcagcttcccaggaagggggccaggatgaaacatttttaaaaaccaatatatctgaaagtattttaattagcatgtatgttggatatagaattatgggctgaaaatcaccatcattctgaattccaaaaaaattgcttccaatgttactattaaagcatccaataccactctagttcctggttctctgtatgtgaccatttattctcttttggaaagttttttaaaaatattactttcctattattctgaaatttccccaagatgttccttggtttccatcattttcattcatctttttacctgttaagtgagactatccaatatggaaactcatggtcttcagtttggggaaattttcttgaacttttcttcaataattttatcccctttattatttttcctattccctttccagaactcctatcagttagacgtcaaatctcatagatcagtcatttaattttttagtctttatttgtatcagtgttttggctttcatttttaggaaacttctcctcatttatttttcaaccctyttagtgacttctttccagctaatttataattcacttttttggcactgcattcatttttgattgtcctatttttatggctgcacatttttgcaagcccggatctgcttagctctctgaggagagggattatactttcttacttaagttgcttcctgttgccttcatcatctttgtcatctgagtttctttcatttgtgctttgtttttttagttgtttgttttgacttgggtcttttattttggaggggctccttcaagttctggtgcctagtaatccttagcaatctttttattaaaagtgtggttttgaaagtcagagtgtaaattcacagtatcttagtaggacctattgagggtgagctccaccacagataatttttttatgaaagcctcaaatatttacattcatatccattgtgtgtgtttgtgtgtgtgtgtgtatatatacatatatatatgtatatatatgttgagttttctaaaaactaacaatttaatygatagcccctgagggaaataagactcgtataggccaagtaaggaarcagggtggattatcgctgttcagttggctcagtttcacttaattcctcttttctttcatactgccttctgctgtgtccagtattcctgagtctaaagcctggggtctcaattgggaaagaggtaacttcctatctgaaagatcacaggtgaaaatctgaggtcaaatttctcctgtaagagtatttatacaaatcttcttgttaacctsacacctcacacatcttgtcgctttcagtttttgaatctttgagtcttytctgcattgttgacagaagcacaatgatggagctgtccagctctacagtttccatatgtgagaggcttaatgatgtcaatactgttggaggtagagattagggaactgtcttgaatctgagtgatcagcctctgggaagcctgtcctcttatgcacagggcaagtctcggtgagaggggcagctgtgactcatcagcagttaytactgtcatcagcgagatgggtggatacatgggccccggagaggggatctgggaggcaccacaacatccactagggagacagtcagagtccagatacaaagtaacttatgaactcagagagtatttgggctttatactataaacaatggagagctactacaatattttcaatagggaatggacgtgatgaaatttgcatgctagaaagatgtcttagggagcaggataaatgtagacacaaaaagataagaataaatgcagagagaccagttgggaggctatggcaatagtgtacgaggtataagatgaagatctgaaatacatacattgaagtggaaggctagattactaagaggtgggctcaatgtgattcagggatttaccagaaaatccagatgaattgtagacaggaaccaaaggtaactctcacaattatgtctacagggaataagttaaaatgatatgattaacaaaaattgggaatataggaaaaggatctggtgttatatagattcaagctgaatccacagtcatctcagggggatacctaaggccaaaatgtcatctgacaactgatccagaatccactatatcacctgcatcctttgttgactcataaatttattattyatgttgtacattatttttagttatttttgccataaatatatatcgagtatgtaatatgtattgggcactattttagatgatggcagaaaaaagtggtagcctatgtaatggtaaactaagaaaagtaaagcaaccgatgggatctttcataatatttttctgggcaaaatgaagaaataggttcatatcagacaactcagtacacttgtaagtggttggatggcctcttcaatatgtgctaagaggctaatattgtcttaagaaagattgtatctaaacttggtcctcagcctaattttttttcaaatatcttcttaattatttgaataaaggtacagaatgtgtgctcatcatattacttttgagagggtgaaataaatataaaacaagtaaccatagttatttttaccgactggataaaagaacaaagcttagatgaaaaataataaagataaatatcaatttgtgtttggggaaaaatacacttttaaaagcacacaactgggacaacgtggcattcaaaaaagtgaatatgaccttcagttttattgggagaaatatagcatatgaaacaagaatactcaaagtactgatctattccacatccattaggccacagcttcttgaatggtttcagttgtatatatcatactttccaaaaggcatccatcccagaaaaagcaaaaatgctcagaaaatcagggttttgaaagcttgaagttataatacgtaagaaagaggtgaaggcaatgaaaatatttatctttaagaagtgtagaattgtttgggggttatatagactggggaatatactattacatcattgaatatttgattcaaggctagtggctagaatattattttaaatgtcttcttagagtagacctggaaccaaggggtgaaaccttcaaagcaattctcagaaaaggatgtggtcctcttaatttttgtttttttaccaaggccacctaattacttggcaaatatacggtatgttatcaacaaatttagttttgaactagacaacctttaaaaaataccttgaaggctgaaattctctgattgtgtaacctgaggactgaaggactccattcaaggactagggtgttttcaatctttttgaattcagttccagatgcacccggtcctttcaggcacccttcattatgcatccaacctactgctgtgtccccagccagcagaagtgagaaactcaggacctttcttggcacatgtgcgtccttgaggttctgaaaactgggaaaatggaaggagtaggtgtttccaaggcattcaatactttggttaaaaaaaaaaaaaaagaatgctaaaaggcataaatttaaagttaccctttgattttgacagagtttctgtggatccaagactttcgactgagtcaccaagtcagccacaatataactatttcaactgactgggaatattatttctgagtcatagtaatgtaatgatctgaacatttatattctctcagttacctagtacatactaacttcatttcaaaggtgaataatatattaaagagaatattgcttattgaatactacactgtatgaaaatactacaggttaaaaaatcacttaaatccattaaaaatgttcaaatatcaagtccctatttcataataaattttccctcagaaaatatgcaaggagtaaacaatacatgactcatttattaaagcttccatgtttttattgcaaattcctagttgggctttggaatagatacttcccttctatcattaccacattctctgagtcactaggtttctagatgttgacaggaaagcctgttcctatgtccttgtactatcacacgtgggcaggataaaatgtaactctagaatttgtactaaaggtgggtggaaattccactcttagatccaggcaccctcaggcgtcagccctgagccctgtgctttgcaaacttctcaagctattattatgtaaaaatagatatcttgggatattattcaaatgcactctgtgattccttagagctggggttggggcctgagaagttgcatttccataagttcccaaatgatgctgatgttgctgcaggtccatggaccacgctttaagaacaactgacttagtaattcccattctgtctcttttagrcaggcccttcccccacaggctgcagttcatgtgacttagggaacctgccaactcagaacctgtgtccttttttcctaagccgcactttggttatccaagaccccagaattacctgtccagacagcctcccaaaactgtgcatacctgtccccagtctgtccttgcaatagaagactccaccagtgtgtacacacctgtatctaagtgtggccagaaaatcagctatttgaaaaaggttaaattgtgtgggtaggggttggggggtggggggacacacagatgggcctcatgcaaaacctcccctattacagggtggagattggggtagaaacagaaatgtactatgattagaggaccttcatcgtcttcttgctccagcaggctagtgttgtggtggtcttacccttatacctacttatatataaaggacagggagaaatcccatcctattatggctcatccctgattttaaggatctgggaccacagatgattcttggatggttctatttcatgaggaaggattgcatgtacagtgctcttcttagggtgaatgaaaaatgttttcccccttccatataaccctctacacattttcccagatgaccataaatgtaggggatagtgtatgcactttggatttcagctgaaatacgactaacttcctctgtgaatttgagcaagtcagttgacctctttgccctcagtttctttatctttaaaatgggagtaagaatgtctccctgttctcttccatctccttcttatttctacccaatttaattcaatacttttttcagttttttgttcagatgctaccatctttgattagatcaagtgcctgtatctcatctggaagtaacttctcactgcacttgcaaccctttgttctttttttttgtggttttgtgttgattaatgtctttctagctcattggactctgagagagcagggatcatgtctccttagttctctgttatattcattctgtcttgcacaaaacctggcacctgatagatgctaaatccccatttgctaatgcataaataaatgtgtgattattgtcataattagagaaaacatactaaatgactggcacatagtaggtgcttagtaaatgacaccaattgtttttcagtgcaatttgtgctataaataaacatttaattttcttttctcacatttgatatatggggagaatggggtgaatttgagacaactacaatttaaactgtccaagtcaccaacaaattgtggtgtgataagctactggcctaaacagctggaagcatgacacgctttttaaagactaaagaaatgaaatatccagtttaaatcaaaggataataaatgcaagaaaaagttgtgtttgtcagatttccttgccccggccccaacccaaactccaaagagtgcatctactttaaaagcgtgtggtgaaagtaattccctacccaagtgttcccactactgtcactggcctcacccttctccacaactcagggattattttaaaggtttctttaatatcggccagtccaaatattctcttgtcaaatatttctgtggcccgtacttgaaatctgtgaacaggacactttttttttttttaatgtcaaaataaaccatctgcttgtacaactgtttctaattacttccctgcctaractctccactgaggggtttggcaccagcaccccgcccagagcagtgccgctgcccaaatcctcgcaggcagctcatcaacgcaattgcaactccggctggagccccggacctgcaagcctgggtgtccgtgggtccgtctgcccagccatctgctggtggcacctctccctcctgccgcctccctcggtgaaccccaccttgcagaagtgcagctcgcccggagcagcccaggagctcagcatgcgtcccccaggcttcaggaacttcttgctgctggcgtcctcccttctctttgctgggttgtcagctgttcctcaaagcttctcgccatctctgaggtaagtttggtttgttattcttcagtacagacctgccctgcttatgtggcagggctcaagcttgcaggatggctgccctaagccaagagctgttattaaattggacaagggataaactgttttcaacctgttccttttcctctccttatatctacagcgtgtattgcctcatgtctgtccttttgcttttcctttggaaaaatgcaatcattgaataaaaatataattttcttttctgcaaatacatatcaggaggaattcctgctgtgagttaaaatgctatgtgtaccagtatcttctcacaacatgtaaagcagaatgatctgtttcccaagggcagcaacaggaggtctgtgttacattttgtatcatcctgaaagagactgagtgaggcacactgcaatagtgaaactaaactttttaaaagtagagttcctaaagactgcttaatgcaaattatgcccgatgctatcatagcatgtctaactctttctatagattcacgttttctcttctgtaatataagtgcccattggccatcagatagcagtgggacgttttttaaaggagaactgaaaagtcagctgagtgccgtaccttggattactttgtatttaatctaaatgtgcatataagatttagtgataaactaccaaagagcagggcagttcacctctgtccacctggaggaaggacctgtgtccgggggcaggtcacccattacacattttgggccctggtcatttctctggtgggtgatacctgtttgcttgggaaaatacagcccttccaggcagcgcttggaccccagagagatgtgggcctcaggcgtcctgttcttggggttgtacgtctgcacctggaggggacactggggaggaaacgtgggttcggagcagggggcggcgtcygcgtctgacccggcctgccggttgcttgtcgcccgcgcaggagctggccgggcgccgcctgcaggctgtcccgggccgagtcsgagcgacgctgccgcgcacctgggcagcccccgggggccgcgctgtgccacggccggggccgctgcgactgcggcgtctgcatctgccacgtgactgagccgggcatgttcttcgggcccctgtgtgagtgccatgagtgggtgtgcgagacctacgacgggagcacctgtgcaggtaagagggcggygctgtctcctccctcgggaggtcgaaactcctcttctgggatttctgccactccctagaagagtgaagggtggggacacgcctcccttcacataagcaccaattaagttactgcgattgtcacactttggctagttaattctggcatcatttatcacaacacttttatcccccaggctctgaacttgaatggaagtaaagttttaaaaattcattcacttaattatatattttattgtaattatgattttttaaagttgggatcttgctatgttgccctggctggtccccccccccccccccaactcctggaatcaagctatcctccctcctgagcttcccaaagtgttgggattacaggcgtgagccactgcacctggccgtcatttgcttaattctaaaatctcacttgcctctaaagttcctcattatagactaaattccccaatgtcctcacaaatggagttattttactgggttctcctatccctatcaagaatgttaatgataatatttgtagatcttaggcctgtattttattttacataggaracagtgggagggggaatgtattattttcctccattctagggaggcaggttttgtctttgaagcctgatttgccctctcattattagaatatagttcacaggcaggagtgcatatcagaaaactgtaacaaggaaaaaagtaaacgggcacatatttacttagaatgactgttcttgcattgttctagctgcttgaatttttgagttgcaatgaaacttggtattttctgagggtggagtgaaaatacattcatttcccttgcacatttttaaggagtgattcaggttctgatattggaaagggtcaaaaaattccttcccagagaacacccttaacctctttacctgtgtcgttttacttaaggccaagagcctcaattagtgccttgtgagtgacacagaactccattagtgaaagcacaacacaatgcattccagccagggtttggcaaatttgtaggaaaaaccagccacttattttaccctcaatgtagctaagaataataagacagccaacactaacatagaaagatcaagaatgagtttatagcaaaatatttttttctcrgarcctggkcccagtagtgtataagttacttaatatgcaggctgcttggcaatgcaaaaaatagtcatagaagaaatttggaggggcgcaggtgcatctacttgatttgttttccctgtgaaggctgtggatcaactctttaaaaatactgaatgctgggtggggtggctcacacctgtaatcccagcactttgggaggccgaggcaggtgaatcacttgaggtcaggagttcaagaccagcctcgccaacttgctgaaacccagtctctactaaaaatacaaaaattagctgggcgtcgtggcatgtgcctgtaatcccagctacttgggaggccgaggcagaattgcttgaacctgggaggcagaggttgcagagagccaagatcatgccactgcactccagcctgggyracagagcgagacttcatctcaataaataaattaataaataaaattaaaatattggatgccacaacttgttatttaacttcgcagtcctacaarccgcagtatwattaagggtagccctttggaatgaaagctaagttaccgcctaatatttcattccaaatttgactgttacttggcttctctgacctatggcctctggcaagccctcttcaatatcatgaattttgaacaaattttccagggctttttctcttgttttattagagaagtaagaggtaagatgcagcctttaactggtgaaagttgtgagtgtygtcagattcactttccctgttgaagaacctaggctggtgcttttctccgagaaactatgcagaaggaatgctgtggtagacagcattcytttttccctcccatagaaaatgatatgttgtttactcatagcatcttagtcactgcattccttccttcttgataygaaatgcaggactgagtcaagcatggttttgtttggttatgcatgcatttctgtagaagatgaaatgcttctctttattttaatactgaatggaataatgaagttcattttttattctcatcttgctgactgatgcccatcaaaacttactctacagggccttgagcagaatctgtccccgcaaatgccctgaccacgtttgtggggcccatgcggagatccctacaagtagcacctagggctgccttgcgagcccgtcgatgtattccatgcttcaaatttagcttctcagttttatttttaagagatagttccagttgtatcactggaatatggaaatatagcaggtttcctatgtttatgtgcccctgtgctttcacctccatgaaagttcctgtaggtcctttccagaaatagagtaactttcggagacctctccaacttctaagaagaaaacaaaatccttctcttatagtactatatcayggagtgattaaaagtgtgggctctgggctgggtgtggtggttcatgcctataatcctagcactttggaagcctgaagcaggtggattacctgaggtcaggattcaagactagcctggagaacatggtgaaacaccatccctactaaaaaacacaaaaattagctgggcttggtggcatgtgcctgtaatcccagctacttggaaggctgaggcaggagaatcgcttgaacccggcaggcagaggttgcagtgagctgagatgatgccgttgcactctagcctaggaaacaagaatgagacgctgtctcaaaaaaaaagtgtggactctgggagacaatttccaggattcaaatcctagtcctattacttaatagctgtatgaacttgggcagttacttaaacattctgagccttgatttcttcatctgtaaaatgggaataacagtacctaacttatagagctgttgtaaggtttaacatatgtaaaatacttagactagtgtctgacatgaagtaagtgctcagtacatattaaaatgtatatatacataatattattacaatgatgcataacaagtgggctagtatggatggaaggatgggtggatggagatgacagatgggtagatagatagctggcccagtgtttgttgggcatttaatgcagtgagagcaatttacttctcttcatgtagtctgggtctgttactgattcaaggcccaaaaagtcaagtagggataactattttggcccagcctcagggcagctgtattagatacactatgcccttttaaagttaagtccattgggattattatactgtgaatcataagaaccatacttattatagtttgcgctggttgaaagtgattaggttccctccattagaagtctgtttcttccagtgtccacttgttcgtggcacrtgcatcttccacagacttttatagcataaagatccagccaagtgagtgttcctatggatgtgatggtctattaaggggtaaaataattttggtagaatggtgaaaccctgtctctactaaatatacaaaaattagctgggtgtgatggtgtgcgccttgtagtcccagctactcgggaggctgaggcaggagaattgcttgaacccaggaggcagaggttgcagtgagccaagattgcgccattgcactccagcctgrgtgacagaacgacactccatcacaaaaaaggaaagaaaaaaagaaagaatggcaaaatgtttgattgcatggaaagaaactttcagttgatatttctaaagcattcctggttgaccccatgaccagctacaatgacacttaaataatgtattgttttcttagaaatcttttgaaattgctgttgaaatatgtcacttaaagagtttcagttttagtaatttaggaagagctaattgaattcaatttagcaacacttatgaagcactgcatattttctaggctctgtcctgttgaagggagtgtaaagatgagggatagaaggcagcttaccattgagtagggagacacagagaaataccagatatctataatgtaatgcaaaatatcatctgtacaaatttttatgagggctccattgagccaggggttatatattatggctaaaagttcttgagaaagaggtagcatttgacataagcacttgagtactgggagattttttaatccaaaaagtggactgttggaattctgagtaaggaaaatcttaagcaaaagtgtagaagcagaaaaacatgtggatgtttgggaaatagggctacaagggttggcttggctggatcttagagctgtaaggaaagtaataaaagatatgttgagaattacagttgatcatattgtagagagtttgttcttgattaaacagcatataagagctattaagagtccaaatataggagtgatcattagtgctctgatttatggaaagaaatacagtcattccttgatatctgctgggaattagttctagggagcctcccccaccagtggataccaaggatgttccagtctctcatataaaatggtgtagtatttgcatgtaacctatacacatcctctagtaaactttaaatcatctcttgattacatataatacctcatgcaatgtaaatgctatgtaaatagttgttatactgtatgttagttgtattattttgtactacacttttttattttctgaatagttttaatctgccaatgaggagcccacagatatggaggcccgaccgtatggtgcccaaaagcatggcaagttaaagtagagaaccaatggggaggaactccacgggagaggcaataagaacagaattattatttttttaaaggccatttaaaagtaaaatcaatatgaattagtgtccaaggatgagtaagatgaattaaaactcatgctgggtttttaagtctgcgagatcagaagtgtgatggaactgatggagtcaagaaatcacaggaaagaaccagataaccaaatccatgacttaaagttcttttaaaagaactctcatttttaagtggaattgatataaaatgaaaaatyaatgctagcagaaagagattctgatttcattggccaccacgtttggggcaggatgggaatcttgtctgaattgttaacgtgggttaacttgtttatgttgttaaccttgagccaggtttttaatttacctgatatttagtgcctttttctgtaacagtatccttatggatatgaagaaccttctattctgtgtgacattgagcatgattttatgtatgtatgtataaatttatttaatattcatatcctttatatacttctacatttattcagactatacgccatccttagctgggtgtggtggctcacacctgtaatcccagcactttgggaggctgaggtagctgggatggcttgatctcaggagtctgagaccagcctggggaacatggtgaaactctgtctctacaaaagatacaaaaattagctgggcatggtgcacacctgtagtcccagctactagggaggctgagaggggaggatggcttgagcccaggaggcataggttgcagtgagccatgatcatgccaccgcactgcagcctgagcaacagagggaggccctgtttcaaataaataagaaataaatataaaaaataaatataagccattcttataaacattgatttatgtgttcaaatattaacaatataacaattaaaataattagaatacattgaaacatttttaatatgtaaaaattagtaattttttttcttgaagatatttgacttttatactacgaagtaagtagtatgggaattatatgtggttattcatgagaactggacttcctggctcttgaggctgcctgaggactgttcgacttgcctttcccttccaattgcatttttcttagattgttgaacgatctccctccaagcctacttgtggatttactcaggctttttctttactagtctttttctatttttcatcttctctcccttccttcaatcctcatcctgtcttccttgcccactccttcacctccgtctagcccatcttggatttaccgccccctctctttcgcaaaatagcccttccatgtctctgagtcggaggcaccaagcacgtaagaatattatctgccttgaatccccttcaccagtaaataaatgtctgtaacagacagactggctttcacattgcctctttcctgtattttcttcatagtcttcacatcgcttgtagtttttggaaacacattcaggagttccccactagctcacccactgcatgtaagccatttttcgggagctctactttcttacattcatckgtgttcgataaatgcatattgtcttagcccaagtgacgtataaaagttaaatgttttctttctgaaagcaagtgccaaacatgcacagcaattttcctcaattgtactgctttatttggacagggctctgcagctctaccatggtttcttagtctgttttgtgttgctgtaaaagaatacctgagactgggtaggttgtaaaggaaagaggtttatttggcttacagttttgcaggctgtacaagcaaggcaccagcatgtgctaggcttctggtgaggcctcaggaagcctttacttatggaaagtgaggagggactggcatgtcacatggcaagagaaggagcaagagatagagggaggggtaccacattcttttaagcaaccagctgtcctgtgaacaaatagagaactcactcatgaccttggggagggcaccaagccattcatgagggatccacccccataacccaaacacttcccacttgattccacctacaagattggggatcacatttcaacatgagatttggaggggacacacatccaaactatatcacacagagacagacataccttgccctggactaggtcatccctgcaccttgatgatctagaggaacatatttatagcattgtggtatttagataaaatagtataaatgtgagaaattcaggarttattttctatgtaaagtttccccagaatgagaaaggaaaggaacatatggaaacaaatttatttgtattacaaattttaaatttgcaaaacataaacctccctcataaggttctcagagtcttcaatatattttgaaacacaatgctaaaactgacatcgcatgttcttgatatcataaacccccacaaaagctgctcagctctctgagcctcatatacatattgttacatctgaccttgtgactcaccatgttcatgttcttgaggtaggtgatcaatgccctaggagggactgggtgtagtggctcacatcgcctgtaatcctagcactttgggaagttgaggtgggaggatccttgaagcccagtggtttgagaccggcctgggcagcatagcgagacctgctccctactaaaaattttttaaaaattgccagacccagtggtgggtgactgtagtgccagctatcaggaggctaakacaggaggctcatttgagcatgggagattgaggctgcagtgagctatgatcaggccactgcactccagcctaggtgagagaattagaccctgtctcaaaaaaataaaataaaaaattccctgggagcagagagccccgttatcattctttgggggaattccctgtctgcaaaattatgaagtaagacgagacattttgccaagcttcatatcctgcccttgtattatttttctattgctgctacaacaaattaccacaaaccttgaggcttaaacagctcagatgtcttttctagagttctgtaggtctcaaggtcccctgacatgggacttccagggccaaggtgttgatagcctctgttcttttctgaagactctaggagagaatccgtttcctggttattggtgttgagataatttagttctgtgtggttgtaagactgtggtccccagttccttgctggctgtcagttggggtccctcttgtcttctagaagctactttcgggtccttacaagtaccccactcccaaatctcaaaactggaaacaggttgtgagacctttctcacaccgctgtctcccagagcctcttccatcatcacatcccttcttaccaccgtcggaaaacatactccacttttaaggtgtattttaactagactgaacccagataatccaggataagcttcccatccaagactcataaacttcatcacatcagcaaagtcacttttgccacgtaaggtgacatatttacaggtttcaggagcaagggtatggctatctttgaaggcccatagtcttctcagcatagtcaccctcctataaagtgcagggcactctgtatgtgtgaatggcaagggagaggttccaactccattcatatctggctgttggtatgctccatcgaggatgcaagggctgagtcttttccttcttttccgaggttatctatatgatctaattgctctggcccatcttttccatatcattattttttttgagttggattctcgctgtgttgccgaggctggagtgcagtggagcaatctcagctcgctgcaacctccacctcccggggtcaagtgatactcctgcctcagcctcctgagtagctgggactgtaggcatgcgcccccacacctggctaatttttgtatgtttagtagagacagggcttcaccatgttggccaggctggtctctaacttctgacctcaggtgatccacctgccttggcctcccaaagtgctgcgattacaagcrtgagccatggcacctggccttttccatatcatttctgataaagaacactaagtgtctttctaaagcatgaagagagggacttaagcccaacagttgcctgcattcagttcctgacattgtcacttgcccactgtggagctacagggaggttacccaagaggttacaacctctgtttccttatggttgaaaagagggcaataataagaccaaatagggataatgacagtgccaaacacatatgagtgattaataaatcactggagttattatgcttaaatatgctagacacccctctcctaccctagcgtaattcctggtcctaagatatttattttcaaataagcaattttctttccatgttatatcttcctccattactaaattcatgtcttggaattactctgrtagtctttgaactattatatcccaacaagcttgcctactctatagtgccagggctgggtgtgccctcagccctggccagcatgaggaatctgagagcttactgtatcatgccccaactcactgcactgccagccgtctgagtcttgtatatgtctttgtctcagaacctgccttttgtgttcctgtccctgaaatctgtaccctgatttatatgatcataattgatctaatggaatgctccagaaccctaccctcagaactgtataattagtccttgaatttggaattttcatkctttttctctgctggaaacctttagacgtctgcaractcccagggcttactctataagtgcaattctgcttctgactcttccctccactgagatgcctgtacttctagggtgttccttgatctcctctaaattgttgatcccaaataggttgatcccagaaactgcttcttcagttgcaaaactgcagaaagcaacacaataaaaaaacaaaatcaaaataactcacatatttttaaaaatatgtaataaacattactgaatgttgtggagacattgggttgtgtgttatttaatcataagaatgcaaactactgaagattgaataggagtcattctagttctttttttttttttttttttccgagacagattctcgctgtgtcacccagactggagtgcagtggtgtgatctcagctcactgcaacctccacccsccggattcaaacgaatctcctgcctcagcctcctgagtagcagggactacaggcgcccatcatcacacctggctaatttttgtatttttagtagagactgggttggccaggctggtctgaaactcctgacctcaggcgatccacccgcctcagcctcccaaagtgctgggattacaggcatgagccaccacgcctgacccattcttaaaactcccaatgctttgttatgtacttcagcctctcttctttatcctgtttgatcccctccttctcatcacatttctgtttttttatttcactttcaaataatgttcatttttcacaaggagtttagttattatttctgtcatctcattttttgcccatccatggcctctaaaatcttggcttgtaccccaagtgttgatgtactcagatattaaggacacagacatatatgcatgtgtctgtatgtatatatgtagttttttacattctggtttattatgtatatgtatacatagaagacccagagagggtctctctctctctctmtatatatatatatgcatatgtttatatatcctcctatatattatttatgcttgtatagccaatcaaaatacatatattttacccatttatatttggtatatgtatatattttgattgcctgtacaaacataatatatatacacatatttatatatgtatacatacatatttgataccctaattttatacacatacgccatacatatgtgaatatgtaagtatgtgcacaaacatacatatatatgtgtgtttgtatatatgtgtgagtctaaatgttatacacagggacatacatgcgtaagcccttttctggtagaccactacctgcagatcgaagtcaagtccactttcaaatttctgtaatgctgacactcttgatataaaggttgcttgggattgatgccacatgtgtaaacctgctagaaatcaatatctcattggggaatacttttgtgtctttatctgtttaatgaatgccatgaaaacaatgacgtatcatttgggtgattcataattggattcttttttcactatggagttaactaaatgcttttaggctattcaagtcacattcgaattacagttaatagttggtaaatggtcctcatattgttatactaaaactgtgcaaagatagaaaagagaaaacagcttcttttcttttttcaaaataaataatagtgacattcttatgactaatatattttaatgctatatacatttttgtggagtatttggaaatgtcaccaaaattaggtttcattggaaatccttgagtctagggttggagacaaaaatcactcaggattctcttatagctgtcctctgaaagacatagtcttaaaaatataaaactatgataaattttctctatctttgaggcaataatagctgcttgtattattttgcttctaataataaattctgatatctattaacagatatgctattctttgctaaattactgtgaattttgtagtcacatctcagaaggaagaaaaaaggaaataaaataatgtgataaatcagctttagatttgtccggttttaagaccctctgccttaagaagcagcttgcatcagtggaaagataactggattaggagacaggagaaacaggccctattatctacttttccacttatctactatgtgatcttggcaaataacagtcacccatttatatttggtatggtacttctgacttttttgaagagaaggtatgaggttgaggatccctgcaatgagtaattggcagtttgtaggggctcagtaaatatatgttcagtgaataaatgagattcagcttatttaaattaccattatggctatggaataaatatttaggtaaaggcatctgaaaagattaataattgaggatagcggtaactgtagagcgtagaggataaagacactcataactttaagagcagaggtagtgatgttactgataaacagttgacaagccaaccaaaatgaagacgtggagtcagaaaggccaagaaaacttggaggggaggggatcctcttagtcatccaactaaactatggccaactttgactcatccttttcatttgctctcatatcctgccaatattgctaatgtttttacttaattttctgctgaatttagttctattgctagtgacttagcttagccttcrtttcccttgacaaggaatattagtaatagtaaagttcttatcacacctcatgcttcattcaggctgtcttcccttctgtctatcctgtataccaccacttggtgaatcaccgtaagtgacattttgtcaagtatctgtgcttttcaaattcacttcaaagatcattctaaccatttatactggccacttattctgtacccctgctttgattcacttcatgaacacacattgagggtatatactataggtatcaaatctaaattttggcttctaatctacttggccattaagacattctagaatctgattcctctttaatggcatgctgacccgcttcctctttctcaccttgtatgctcccatctctctagttagatcttaacatcactgtcacttaatacagtctacaccaaacacatttttcatgatttcacgtgttttcttatgtttacaaatatgctgaatattctgaatactagcaccatctcacatatttttctggaaactaaaaacaaaaatatttagcacaaaaaataggtatttagcacagttctgagtaaacagtacagatcgatctttcctggagctctgctttgtatggttttgaattactgtctagtgtccttttatgtcaacccgaaggaaggactcctttagaatttgttgcagggtagatggtttagtccattcaggctgctgtaacaagataccctagactgagtaatttagaaacaggacaaatttaatgctcacagttctggaggctgggaagtctagaatcaaggtgccaacagattcagtgtatggtgagggctcattttcagcttcctggatggcaactgtatcctcacatgttggaaggggtaaacaggctcccccaagcctcttttataagggcactaatcccactaatgagcctggagtgctcatgacctaatcacctcctgcaggcccacccaccttcttaatactgtcacgttggggattaggttccaaaatatgggtcaatatttatatcatagcagccggtctactagctgaccttggcaaagggaaacctcacatcagtgggacggggatattgaagcctttgtcctttgggaaatytagcttccaaacctggtctgagatttaaaggcaagagtcacatctaagaaggtggaaaagtctggtacagctagactgagagtatcaggggaatttaccagggcgtttttgggactctacgtgggtaaattctcaagctattttctaataacttctaaattgataaagatagagagctgcatgggggttgcaaatctcattttctttggaaaaggagtgctttgtctttccaagaatcacatttcctggcaaataagaaactatattttgtaatagaagtcattctcctgtctactctaaatcatcttacttaaggctgggtagaagaatgagggctttataaagagaaaagaaaaataagacttttataagggtgcttactgatttgactttgtacaaccccactcttaggttatacgataaaatcagtccctgtaccaagagccctatcgttgtaattgtttgtacatagtcactagttcaaacaccgaattatttaaagtgaatacctacccactctagtttcctgttctgttattttatctggaaacttcctagggaaaggtaggctaaatttttttttttaaaagaggtcaatgagtttgggcattgcttaaaaacttctcttacggcaaggtattaactgtaaattcatgacttagtcaatggggtagagtaaggagccaaaatcagaaaatgaaaacgtggtaaatgcatttcctaattgttcattactgctttttcaaagctatcattttctgctgagcaaaatagttagacaaaactagttatttttataaacaaagtgacttggccatttaagcagtttcctctccaaaatacaaaagacaagttatagactattttcttttctttcctgggcaacaccattagttatatgagctctaagagctgtcttgacatggaartaattcacttgcttcaagaaagaaagtatttgatttgttaactatgtgctcgagagacttctctcagttgcctgtttggataattttaagccttgaaattaatgctacattagaaatacaaatgagtaagagtagtatctacctatatttgagtatagtatgctggaaaatattttcatacatatgaattcattcactttttataataacttttaagagatagtcaaaacaattatcctccaactattgtgctaagtaagcctgaggagaaattcctcccaccccaaatcaatagaagggttttcttcagcattatagtaaaattatcctaaaagcacatatgtagggataatttcttcatgaattttggagtactgaaagaaaaacataattttcagaaactttatttacatttaaaaatataacttctttttggaaaagtagattttgattcttatttttgtcttagagagtgcatgtaaaagctcaaatggtaagaaagtactgggcaaaagaacccgttatgcatctcatgttaaagaaagtgagatagccgaaatcactgggacaaaattacttgtcgtactgataatgagcattttctcagctgtagttgaagtttttagagagattgcatttaacatcaaccatatccaaataagaaggatcctcctgagtcagcctttgaaggaactcctccataacctaatttttcttgtctataaaagtgaaagaaaaggtaggtaggagagttgaatctacatatttgttatttccttgggcattaccttacattattttgtgtattacatattttggctattacgaataagtcacatcagagattctcttttgttcttataacattacatttcataaagtgagctccaaaaatttaaacacatgcaggttttaatatacgtatagcctttttgagatcaaagctatgcgagccaacaatactgcaaagagagagaagaaaggcatttacagaaagctgaacagttttgaatggatcatcatgtaggttcactttgcatcttggaaatgaatgggtggaccgtgggtcataatatgaaggcttatggggacatcctgcctacctgggattctggatattgtggtctttcaatatttcaaatatccctgttaatacaccagttgttgccaggcgctgtggctcatgcctgtagtcccagcacttagggaggccgaggcaggtggatcacctgaggtcacgagttcgagaccagcctggccaacatgggtgaaaccctgtctctactaaaaatacaaaaattagctgggcatggtggtgggtgcctgtaatcccagctacttgggaggctgagacaggataattgcttgaaaccgggaggtggaggttgcagtgagctgagatcacaccaytgtactccagcctgggtgacaagagtgaaactccatctttccatctataaaaaaacaaaaacaaaaaacaccacaaaaacagatgttgtattttaagacctatgagtggcaatgcgctgatcttttattaaaagatagtacagtctttactgaatttaacaatcttttccttgggaaaactaagcaggcaggtttgggtaggatgaaaatgcagaggcagaatgctctggaaaatgcttgggaattggaattaaaaaacaaagctgtttgatctttctccgctattgttgctgcctgtgtgatcttgcacaaatcacgtaacttctctgagcctcagttcagttaaattcaaaaggcacttattaaacatctccagaaggatgtctagagaagaacagggaaatcttatgatcagacctagcctcattagctgtgagatttcagccatcagatggcaacaggagctggatctccagttactgtagatttgataagagggtggaaagaatttgttttcttacagttgactgcaaaacgaaatattctgttaccttagctaaccttggaagctctgctttccttgaggatttaagaactttcatatccataaataattatttaatgcatgtccagtgcttgaaagatagtataatataggcattactattttattccttttttaattaatttattttttttttttgagatggagtctcgctctgtcacccaggctggagtgcagtggcgcgatctcggctcactgcaaactccacctcctgggttccagtgattctcctgcctatgcattactattttataaagtagacgtggtgtttgtctttaattccccaactatatgcacacagtctgttaaagcacaatgaaataatgatatttgtgtgcatctcaacatttaccctctgggtgtatagttatcaaaaaccataatagtctctgctgccctttatatgaaagtcaactaggcaacctagcaagagagccatgactttgaagaacaactaatgaatgaggtgtgtgtgggaggggtggaggggtggtgtttagaagagaatagcaatagtctggaaaaaaattccttttctagtaggacaacattctatggggtgcccttaaaaatctatttaattataatcatcctatatgcttattcttaatttgaaataaggtaatgataatacagctaacatttatttagaattgctacatccttcttgtgtggtgttaaattctcccaataaacaaatagcaggataaatcatcttaccattctaaagataaaagcatgagcctcaaaaagattaaataaaatgtttaagatcacatgttgtctgaaataaaaactgtgcaatcagtcactttgttattaagttacaccatttagtacagtgacactggctaacaaatgccccaagaagtattaaatctcttttctgaattttgaattatcacatgcattattaatctaccataattmaatgtcattttcatatgtgaaagtgtgagagggagaatgctgaggagattgaaggagaaagactatatgggttccaaaactggctcgattttgggaagttagttgatttgcttgtgcctctgtttcctcttatcatagtgttattattgagaaaactcccttgcaggtaataaatcctcaacagcaacttctttttgttatcagtattatcaggccattcccatgtcactatgattaaattatatactcctcaagggcaggaatagtatctgattttctgtaagattttctcttaggtctttgttgttattgcttcaagaatgcttcattacagaccaccacaacatttagtggcttacagaaaggcaacacaaatatatatgtgtgtgtgwgwgtgtgtgtrtgtrtgtgtgtgtgtgtgtgtgtgtgtatatatatttctcactcttgggtgtgcaaatgagctacaactcagctaggcaagcctggacttcaggctgaaggctggctgcattctgctgcacgttatttttatgctacccaagctacgttttcggtattgtggatcacaggagcactagaaagtgagacgaaatacttgagatctcttaaatctttgactctgaaccaataacatgcactttatatccaaacatcactgggcaaaaggagccacaggcccaagccagatatctctgctctgcatggtgggagtgagtgaggagctcacagcagtaataccatcagtaggatttagaagggatattcaaatattcagtgaaattaatttattgacatgatcataaacatctgacatttaaatttaatttggaaataaatacattttatttttattttaagtataaccatattaatcaattacatagtaaattatattgacatcataagacattaggtctatgtttagggaattcatttttatgagattgatatgaactctcttatgtattaacttctggatgtatttttacttgtttaaaaattttcatgtcccttcacaaaaatccttaatttcctaaatatagacttaatgtcttatgagttaaagaacactgcactgaaatatatccaatatgccactttatggcaccttccaaatgctcttagtgtaaatgtatgttacaaatcccataaagcacagcaaarataacaaccaaactgttggtacaaatcatgagacagattcagtagttgtctgtttttatatgcacattcagtaagctgcttacctatgttttgttacattactttaattttcgtgcgttttctaccttaaaataatattttatgtaggataatatgcttagatctttgaataagctacttttagaatttcttgagaacttcaagagtattggaagcagtcaacatattattattcagatttctgttttgggggtttttaaaccatataactcaacttacttgagaagaaaggaaaacgtaaatggttttaaatggtgttagctctcacacaggcattgggtggccagtcaactgttttaaattaactgacaatgctattgtgaagtccattaacttaatgcagagggttgtttcattttttttaatgaggaactttaattcctttaggaactaatatttccataaagtttcatcaattttgaaatttaatatacattttgatttgatgtccatatttgtataaatatatttgacaaacatatttatccatatcaaatgaacacaatctttaagaattaaaactctaaaaatggactgctttctcatatatagagtcaaggatttatatattgatatataaattaagagttgtatatatttatgttgtgtgtataattatgttgttcaatcaacagttatttattaaggaactactatttataagatgctrtatttgtagctgcagaggttrtaaagattaaaatgtgattcttgagagggaagtggaacaagatagccaactagaaccctccaatgatcatccaccccacagaaacaccaaactgaacaattatccatgcaggaaagcacctttatgagaaccaaaaaccagatgagtgatcacagtacccggtttcaataccatatcaaagaaagaggcaatgaagaggtaggaaagacagtcttgaatcaccacaccatgcctaccccatccgcyggcagcagccatgtagtgtggagagatcatctctgtgctgttgagggagagggaacagtgattgtggaactttggattggaactcagttttgccctgtacagtggaagacaacaaggggcaggattcagctgatgcctacagacagatcattttgatcagccctagccagagcggaatcatccattctagcagttggagcctgagttctggctagcaccaccactgtggactaaagtagtctggtgttttaaataaacttgaaagacaatctagaccataagaactaagatttctgggcaagtcctgctctgtgctgggcttggagccagtggatgtgggatgcatgtgacctggtgagacaccagccagggcagccaagggagtgtgtgcatcacccctcctttgaccctaggcagtgcagctcatagctccaggaggagagggtaaagaggaatttgtcttacaacttgcataccagctcagccacaataaaatagtgtaccagagcccccattcgaggcactagctccttgtgccagaaggaaacccactaccttgaagagaaggacccagtgctggcagaattcatcacctggctaaagagcacctgggttttgaataaatatcagtggtacccaggcagtacttgctgkgggccatgggtgagacccagggccatgctagattcaggtgtgatccaacatatttcaagctgtgttggccatggagagagatttcttttgcttgaagaaaggagaaagaaaagtaaaggggactttgtcttacagcttgggcaacagcttggcccagtgggttagaggatcaagtgaatccctggggtccccagttctacagttctaggccttgactcctggatggcatttctggacccacactgggccagagggaagcccactgccctgaagggagasaccaaggcctggtagcattcaccacaagctgagccttgagtgaacattggtaccaagcctggggtggtaatggccatggatagacactctttctgactgaggaaaggagagggaagggtgggaagaactttgttttgcagcttgggtgccaactcaagtcacarcagaacagtgcactaaktagattattaagtttcctgactccaygcactggctcatggacagcatttctgggccagccttgagccagggagtagcttgctgccctraagggaggaacacaatcctggctcagtttgcaacctgctgactgaagagcccctgggccttgaacaaaattggcagtagccaggcagtgtggttgctatgagccttgggtgagacctartaccatgctggctttgggactgacccagagtagtcccagtagtagttgcwacaggggtgcttgtgttacccctcccccagttccaggcagatcagtgtgaaaagagagactacatttgtttggaggaaagtaagggaagagaacatgagtctgcctggtaattcaaggaattctcctggatcttatccaggaccaccaaggrgatacytttacaagtctgtaagaatcacggcattactgggcttggggtgccccctaatgcagacacagctgcaatgaccaaagatttagataacaacactcaattccctttgaatgcttggaaatcccttctaagaaggacagatacaaataagcctggacagtgaagacaacaataaatacctaactctttaatgcttagacatcagtgaatatccacaagcatcaaggccatccaggaaaacatgacctcaccaaacaaactraataaggcaccagggaccaatyctggagtgacagagttatgtgacctgtcaaagataatttaaaatacctgttttggggaagatcagtgaaattcaggataacacagagaaggaattcagaattctatcagataaatttagcaaagagattgaaataattaaaaaaagcagaaattctggagctgaaaaattcarttgacatactgaagaatgcatcagtatctatcaaccacagaattgatcaaacagaagaaagaattagtgagtttgaagacaggctatttgaatagtyagaagagacaaaagacaaaaagaatgaagtttgcttacaagacccagaaaatagcctcaaaagggtaaatctaagagctatttgtcttaaggagaagggggagagagagatcagcatagaaaatttattcaaagggatagccgagaaatttccaaacctagagaaatatgtcaatactcaagtacaagaaggttatagaacaycaaatagatttaacccaaataaractacctcaaggaattcaatagtcaaattcccaaaggtccaggataaagaaaagattcttaaattagcaagagaaaagaaacaagtaacattcaaaggaactccaatacattggagcagacttctcagtggaaaccctacaggccaaaagcgactggtgcaacatatttaaaatgctgatggggggcaggtggtgggggctggggaggtggggaacaacttttatcctacagtaacatattcagtgaaaatatccttcaaacataaagaagcaacaaaactttcccagataaacaaaagcttaggatttcatcaatatcagatgtgtcctatgggaaatgctagtttttcaatctaaaagaaaaggatgttaacaagcaataagaaattatctgaaggtacaaaactctctggtaatagtaagtaaacagacaaatacagaatattatagcactgtaattgtgtgtaaaatatttatattttgagtagaaagactaaaagatgaacctatcaaaaataataactccaataacttcttaagacataataacataaatagaaacaataaaaagttaaaaagtgggtggatgaagttagtgtagagttttcattagttttctctttgcttgttagttcatttttgcaatcagtgttgtcatcagtttaaaataatgaattataagatattatttgcaagcttcatagtaacctcaattccaaaaactgacagataaaaagtttaaaaatgaaattaaaacataccatcagaaaaaataatcttcacaaaaaggaagacaagaaggaaggcaagaaagaaggaaagatgacaaaacaaccagaaaacaagtaacaaaatggcaagattaagtctttacttattaataataatattgaatataartggactaaactctctaatcaaaagacatggagtgacttactggattcaaaaactaaacaaaacaaatgagacccaatgaacatttgcccacaactaacacacttcatctgtaagacacaaatagactgaaaataaagggatgaaaaaacatattccatacaaacagaaaccaaagaagagcaggaatagctatacttatgtcagacaatatagatttcaagacaaaaactatataagaggcaagtttattatgtaatgataaaggagtcaactcagcaagaagttatagcaagtgtaaatatatatacacccaaaactggagcrcctagacatgtaaagcaaatattattagagctaaagtgagagatagaccccaatacaataagagctaaagactttaacaccccactttcagcattggacagatcatctagacagaaaatcaacaaagaaacatcagacataatctgcactacagaccaattgaacctgataggtatttccaagaacatcgatggctgcaaagtgcacatgcttctcctctgcacatggatcattctcaagggtagactatatgttaggccacaaaacaagtattaaagaattcaaaaatattgaaattatatcacatatcttctcrgaccacaatggaataaaactagaaatcaataacaagaggaactttggaaactatgcagacacacagaaattaaacaatatgctcctgaatgrccaatgggtcaatgaagtaattaagaaataaattwaaaaatttcttraaacaaatggaaagactacatacccaaacctatggaatacaatgaaaacaatactaagaggaaagtttatagtaataaggacctacatcaaaaaagtacaaaaacttcaaataaacaacctagtggtgcatgttaaagaattagaaaagcaagaacaaaccaaaccccaaattaytggaagaaaatagtgaagatcatagccgaaataaatgagatcaaattaaaaaaataacaaaagatcaaccaaagggaaagttggtgttttgaaaagataaacaaaattgccaaacctttagccagactaaaaaagaagagccaaataaataaaatcagagatgaaaaaggagacattacagctgatactacagaaattcaaaggatcatttgtgactactatgaacaactatatatatgccaataaattagaaaacctggaagaaatggataaattcctagacacatacaacctatcaagattgaaccaagaagaaattcaaaacctaaatagtccaataacagtaataaaattgaaaccatagtttattgtacattgatgaaaagtttcctggcctagtaaagcccaggactcaatggtttcactgctcaattttacaaaacatttaaagaaataatacygatcctactttaactatttcaaaaaatggaggaggagggaatacttccraactaattctgtgaggctaatattaccctgataccaaaaccagacaaaaacacatcaaagtaagaaaactataggccaatatccctgataagcattggtgcaaaaatcctcaacaaaatactagcaaaccagatttaacaacacattaaaaagatcattcatcatgactaagtgggatttatccctgggatgcaaggatggttcaacatatgcaaatcaatcaacgtgatacaacatatcagcagaatgaaggacaaagccatatgatcatttcagttgatactgaaaaagcattggataagtcactattacttcatgataaaaaccctcaaaaaactgggtatagaaggaacaaacttcaacacaataaaagccacatatgacagacctatggctagtatcatactgatyggggaaaaacygaaaggctttccttgaagatcaagaacaygatacrgatgcccacttttaccagtgttattcaacacagtactggaagtcctagtcagacaatcagataagaaaaagaaataatgktcatccacatgggaaaggaagaagtcaaattatccttgtttgcaratgatatgatcttatgcttagaaaaacccacagactccaccaaaaaactattagaactgataaattcagtaaagtttcaggatataaaatcaaaatataaaaatcartagcacttctaaatgccaacagcaaacaatttgaaaaagaaatmaagaaagtaacctcatttacaacagctacaaataaaatgagttaaccaaagaagagaaagatctctacaatgaaaactataaacattgatgcaaaaaattgaagaggactcaaaaaatggaaagagatttcatgttcatggattagaagactcaatattgttaaagcatccatactacccaaagcaatctacagataaaatgtaatctctatcaaaataccaatgacattcttcacaagaatagaaaaagtaatcttaaaatttattgaactacaaaatacccagaataaccaaagccatcttgagcaaaaagaacaaaactggaggcatcatattacctgacttcaaattataacacagagctatagtaacccaaatagtatagtactagcataaaaacagacatatagactgaaggaatagaatagagaacacataaataaatccatacatctacagtgacctcatttttttataaaggtgccaagaacatacattgaggaaaacacaatctcttcaataaatggctctgggaaaactgatatccatatgcagaagaataaaactagacccttatctctcaccacatacaaaaatcaaatcaaaatgtattaaagacttaaatctaagacctcaaactaggaaactactaaaagaaacagttgaggaaactctctaggacatcgstctgggcaaagatttcttgagtaataccccacaagcacaggcaaccaaagcaaaaatggacaaatgggatcacatcaagtgaaaaagcttctgcacagcaaaggcaacaatcaacaaagtgaagagacaacccacagaataggataaaatatttgcaaactattcatttgacaagagattaatatcaagaatatataagaagcccacacaactcaacaggaaaaaaaaaatctaaaaatccaatcaaaatgggccaaagatctgaatggatattttttgaagacatacaaatagcaaacaggcatatgaaaaggtgctcaacatgacagatcatcagagaaatgcaaatcaaagctacaatgagatatcgtttcaccccagttaaagtggctttaatccaaaaggcaggcagtaacattcccaccaacagtgtatgagagtkggagaaaaaggaaccctcttacagtgttggtgggaatgaaaattagcatagccactgtgaagaacaatttggaagttcctcaaaaaactaaaaatagagctatcatatgatcaagcaatcccactgctggatacataccgaaaagaaaagaaatcagggtatggaagagatatctgcmctgttatgtttattgcagcactattcactatcacaaaagacttggaagcaacctaagtggccataaacagatgaacagttaaagaaaatgtggtatctatacacagtggagtactattcagccataaaaaatgaatgagatcttgtcatttgaaacwacatggatggaactggaggacrttattttaagtgaataagccaggaacaaaaagacagactytgcatgtcctcactaagttgtgggagctaaaaatcaatgcaattgaattcatggatacagagagtagaatgatggttactagaggctgggaagggcagtgagtggcagaggggtggaagtgggaatgagtaaagtgtacaaaratatagttagatacagtgtataagatctagtatttgatagctcaatgatgctattttttccatttgataacacaaatactagatgaatgtagggtgactacagtcaaaaataatttattgtacatttaaaaataactaaaagaatacaattggaatgtttgtaacacaaataaatgataagtgcttgaggagataaataccccatttaccctgatgtgattattacacattctatgcctgtatccaagtatctcacaccctgtaaatatatacatctaccatgtacccataaaaagtaagaataaaaaaataaattcagagtaaaaaatcatatgattttgtccttgagaaacttagtagtaggtttatagtatagcataatgcagtattagagaagtacaaagtgctttatatgtgaggagttggggttgttttgaaaatgagcatgatgttgactggtgggtatgaaaagaattgcattgtagtcaaacaagcraaattttaaggtaggatatcatggacattttgcttgcctaggccagcaggttcttttaaagawgctgttggagagraaccttcagagatcaataggagcagctcatagggagccttttaatgccaaaagatatgtgtgtgtgtgtgtgtgtgtgtatgtgtgtgtactcatatatgtgtaactatatacacacacatgcatatatatacacacacacgcatatatatatatacacacacgtgcatgtatatacacacatatatatacacawgtgcatatatatatgwatatatatatatgagagagagcatatatatacatatragagagagagagagactgtgaacgcccttggcagkcaatgtgagcagagaattggcttttccagaaaggagtttctgggacatcactcttgggataaataggaaaaagataaaagccttcaaatggaggtaccaaggagaaagctatttagctattttaatagctaatagtgaaattaataatattctaaaattttgtgggtggctataggaagaaaagggaaagaatgatgctaggcacattgtgatattatagaactgacaggaattggagactgggttaagaggtggagatggggctgcaatttggtaaatgtaasyagttatggacttctggctctcaaatattgcaagttctacaacccttcctccaccktatcccagagatatctgagtgtctttttggtttgaatttcaagttaaaaccctgaatatctggaggaacacccacgcccatcatgctctgatgttaagtactaataccttttgctcatccttggttaaatctttttaaattcattcattgttctctctatatatactcctcactaacatgcaagattttctttttattttgagttgtatatatttttatttttccccatttaatttttagttgagattaatgttgcacatattcacggtaggcaaagtgatatttcaatatatgtatacaatgtataatgatcaaatcaaggtgattagcgtatccatcaccgcaaatatttatcgtacctgggagagtcaaggggaatgtggtggggccagaaaggggaaatttagaaggcaatatttgggaggcaaaggaatgaggggcagttgttcatgaaatgacagtctgaaggtagaaagtgggggccaaagaagacatcaactcccaaagattaccagtttattacgtaatgagcatgtattagccgagaaggcttgaaaaagttgacttttgaatgcgacacattttctttaaaatattgaatctggatgtttttctagttatttaaatttttatttgtaggtatctgtctagggcactttgaccctttaggtgtgggttagccatttctcattaggactgggaaagatgagtgagaaataaaattatagattgcatgttaaaaagaaaaacactggttgtgacactgagtataggtttttttttttactatatctgaagtaaaatgatacttatctgccttgttaattatatttatttgtaaaaatagtttccatttaaatttgtcaataataaaattcctcatgaaaaatatcagaaacctactctcttttataatgaaaagaaacctaagtattagttttttatgtacctatgacatttgattacaatatggaatgaaatttaattgtagcatagtatgaaatggaaaacaccctaaatataccatgaaatttatgttatgctgtgtaataatttcctcatatactttccatatataggcactaaataaagtgaagtaatttaggttaatttaggaggcagatgtttttcaaatactcataggtgtatcaggtaggatacacctgattgtgacattatttggggtccgtataatagaaaacccaagccaagggtgtgtaaggaaaaaaattgcaatttactggaccacttaactgwagtagttaggactgtgatttccaaagtgtgattcttgaatcagcagcacacgcatcaacgggggacttgttaaaactgtgaattctcagtttcatactcacggcatcagagactctggctgtggagctcaacagcctgtgtattamcaagtcctccagcttccgatgcttccatagtcaagtttaagaaacactggtatagagctggatctatccctgggtgcaaatcaacttacggttcaaaggataccaccaggatctaaaggtggactctgctaggcactgggatagccccacayccaggcttcacatggtggctaatgacaacagtagatacatatcatcacagcaccctgtccagtggacagagaaattatctcacctggaatcctcttgatgttcctgggtagcctgactcagggagtatctctgtccttcagccaatcacaatgctgagtgaatgggatgttccagttgtcttattctagtcatattgtccactgtcaaggttgcaattaatttagtatgggggcattgccacaagaaggacaagaagatgtagaatatcattgacaatgtgtcacaaacagcaaagattcagttgtttcagaagacaacctcaggccaaaatttatttaactgaagttattgatgaaagaaaaattcagagatgctctagaagtcaatcacttgactggagaaggagaaaaatgttcacttgcacagaaaatgcacagtcccattttccaatgtcctattacctagagggcaattttagtttcataaccttgattacactattaatactgggctatttgggctagtgtggaggataggcttgatgtttgtaaaataacatttatttgaatatgtttttctaaaattcaatttttttccttcttaatataaaaattgtccttattttactatcttaccacatatttttgaaatctaatctgattgttatcacatatttctttaagtggaatggcttaaataactcagataattaaaggctaattaaaggctttgtcatcattaagataattaaagtatcaattagctttttaaaaggaagcttagccttaatcagaaatcctctattcacacagcagggcctcagatatggcagatattcctgaaatggaaaaacagtacttcaaagttkaggctctgtggaacttcgtcatgatttttcttcatcaatctctattcttttttgtagayggcatatttggtttttttttyccctgctttttgtctaactagttatatattgcttattgtagatacttttgcaaataccaaaaaaaatgaaactcccagaagcaacattttagctaatttttcccagcatttttctaagttttatttttatttttgtggttaaaagggataggtaaaaacccatcagcataaaaaatttacttctctaataccctaggaaaacaagagaattacaaaatacctagaactgaatgataatgatttctggtttcaaatatttcctgccatgaatttagttttatttatcctatcagtgattatgtatagcttttctacatggtttatttaattcttaaaaattctcagtgatttttctattccaacattgtsaattgacccaagttgagtttctggatatgaaaaccacaatatttgatatgaaaaatactatatgggattaacagcagattcacatcacagaagaaaaaacggtgaatttgaagatggagcattcgaagctatccaaattaaaacagaaaaatrtttttatttgtataaattttaggattacaagtgcagttttgctacatgaatatgttgtatagcgggggaagtctgggtttttagtgtaatcatctcctaggactattcagaaaataggttttaaaaatgaatggaacatcagttagctgtgaaacaattttaaatgatctaatagaggtataatttaatttgtgaaggacaggaactggcaaaatatttgaagaaataataatgaaaatatttcaaatttgatgaacattgtatatccacaagcacaagacgctcaataaacttgaactataaacaaagaaatctgaagacactacactgaggcatgtcaaaattaaattgctcaaaaccgttaatagggagacaatcttaaaaagcatctagagaaaaaaccgtatactgtatacagaggaacraaaataaggatgatagcagatttctcttatttcaaagacagtagaacaacatctttaaaggattgaagaaaaaatgtaaacctagaagtctaaactcagcaaaatacttttcaaaaacaaatgtgaaattaagacttttttcaggcttacaaaagagaatcatcactggtcgatgtcagctagaagaaatgctagaggaagttctgcaggcacaaggaaaatcatgccaagtggaaagatgaatctacactaagtcatgaaaagaactagaaatggtaattacatgggtaaatatatrtggtgcatttttcttttattcacatgtcttttaaagagaartttgcatcaaaaagtgggtaaaggatatgaatagacagttctcaaaaaaagatatacaaacagctaacaaacatatgaaaaaatgctcaaaatcacgaatcatcagggaaatgcaaactaaaaccwcagtgagatactaccttactcctataagaatggccgtaattaggccaggtgcggtggttcacgtcggtaatctcagcactttgggagaccgaggtgggctgatcacgaggtcaggagatcgagaccacagtgaaaccccgtctctactaaaaatacaaaaaattacctgggcgtggtggcrggcgcccgtagtcccagctgcttgggaggctgaggcaggagaatggcgtgaacccgggaggcagagcttgcagtgagccaagatcacgccactgtactccagcctggtcaacagmgygagactctgtctcaraacaaaacaaaacaaaagaatggccataattaaaacatcaaaaaaacaatagatgttggtagggatgtggtgaaaagggcacacttttacactgctggtgagaatataaattagtgtaatacaaccagtatggaaaacagtgtggagatttcttaaaaaactaaaagtagaactaccatcaatccagcaatcccactcctgggtatctacccaatggaaaagaaatcattagacraaaaagataaacgcacacatgtgtttacagcagcaccattgcaaagatgtggaaccaacctaagtgtccatcaaccaacgagtggataaaaaaaaaatgtggtatatatacaccagggaatactactcagccttgaaaaggagtgaaataatgtcttctgaagcaacttggatggagctgggggccattattctaagtgaagtaactgaggaatcaaaaaccaaatatatgttctcacttataagtaggagctaagctatgagaatgcaaaggcataagaatgatataatggactttggggacttgggagagggaagggtgtgagatgggtgagggataaaagactacccaytgggtacagtgtacactgctcaggtgatgagtgcaccaaaatctcagaaatcaccactaaagaacttcacctgtttcccraaactattgaaataaaaataaaaattagaaaagatcagagggaaagaatatgggggaaataagacccccatcaaaaaataagtgatgaaagataytggggaaaaayacaggagagcaggttactggggaaataaagactatttgagaaatgggcaaaaatgataaataatgcaaatccacaatgtaagtttcatattttaaaagtctagacctcttgcagctttgaaacttcatgatgctatttaaatgtcatgtttagtattgtaaataatggtaattttaatcattaatgctaattgctattctctgtggctatattactattcatttattcagtcaatgcatgtttgtttagcactagaaggaacataagcacacatccagtagtctgtattttatttggtttaatttcacacacccaaaaatgcctacgtaggtattaaatgtcagctcttatttttaatgctttctagattgcatcagccaaatgggaagaattataaaaaaatgtaaataactacttaaatacattcataaggtcaataataacaaaattttataatacttcttcataaaccttggatttgttttattgcttctaggttctcatagtgattttgatagcctatcttatcatttgttactatatctttgttaggtataaatgttcaggcttcacctattaccaggcatattaaatttcacaagagaaatgtgtagttayagctccaaggcaggtgttatgatcctgtcaaattgctcaggctaattttaaatcatatcaggtctgttgctgggagatgtttgaggaacacaggaaattatatggagcctgttgataacagcctgtccttatcctgtgacctaaartaataccaaacttgccacattaccaaccctcttgtttaaatgtaaaacccatattggaggtttacaccaatgtcattaaaaaaagaaagttaggattcaaaaatatgattgtaatttttgaaatcctggtagcgaaaatttagctgaaattggcaattatatttgacaaaatatttaatataaatcaatgtgatgtttagttcaattacctcaggaatatatagagttatcactgatggcctaaggccatgcattccaagcttgggtgatcataagcattacctgtggtgtgtttctgcaatacagtttcctaagccccttttccgaagtgcattccgtagatgtgcaggttaaccagtgtcctcggtgaatctcctgctcagatatactggcagcacactggcctaaagtaaggaattcttatgctttttaagaaactggatgcagagagctcttctgcatcaactgaagtatgttcagtcttagcttgtaggttttatttccttacagttcattaaggtcagaaagaagggttaatcttcctaactcaaatgatgctccgaagacaggaattgttaactaggtttgtgttcagtgtgaaactggcacagggggcctgactgcaaacagccatgcagggaggttgaggctgaggaggtggtgatggtaagaatgctgggcttcggaggaggagatcaaatgggcctccctcatgatgagaagggagagaagggatggaggatggcagggattgggacttacagtaaacagatactggtttttcttgaaggatgtttggatttcacagcccatgcttttctaaccaaggagccagccttagcattgacatttgagggagtatacaattccaaatgaggttgaagataaaggagcaattgctttttacattaaaggcacagccttttcagagcaatctgttcatcctctgttatcactttaaagggagtctagtttttagcttgatgtatacatttaactgactctctataatggcagagaagactgcatggcacttccaagttcatttctttacctttaagtggattaaggcatatgcctgcttagctttcccacgttcactgctttgaggggagtaaaactggagtgatttcaggaattgacactggaagagtttcctggtcacaggctttgaacccggaaagacctaagctgactgtcaactttaacttgagagagctgttaaccacctcagtttccttgtctaagcggaagaacagaacatgttaatagaaagtgcagtttactgagcatgtactgtgtgctcaggcattgtactaagtaccctatgtcttattcgtgaaccccccactacaacctttggagatatgtgttatgttctgacaacagcaataattttgcgtcttcctcatggaattttttgtttatgtgtgagtgataatgagattagactcattaaagattaaagaagattaaagccatgccaatattaggttcccagttctcaaaaaaaagggagttatattccttttctttcatttgtgactgttccttttcatcttttggtgttttcaggaagccattttgcctgcagccgctgaagtggcccagctgcagatgttaatggctgtttaccagtaggagccaaaacaccacactaaagaagctaggaggtgtggttattttgccttttctgtaagataaatttcttaatgctaatgcctccaaatgaagacatttgatttatctctaaagtatatttttaagtatagaaactgtaatgagtggctagattactactctgttttaaaatgtgttacaagacagctttcatcatgtcaatctacggatccaacaattaaaagaaaggttaccgaaattgtacacagatagaagtttacttcatatagccctggcattccagtctcttctaagaatgtgaaataaaggattgatagatggataaacacatggtagatggaggtctgattcaggyggtgttaaaaatcaaacaaaaatctttccaaagtagggatcaaattctacttcttttgagatataaactgtttatagctttgaaatgacagttttcacctcagcacacccattaaatttttatggaacccttcctcgtctattaatacatggcatataggaggggctcaatataatttagttccccttaaatgctttggtatgtgatttggagagagcagctgacatagttgaatatatatcagatatatggttagaaaaatatcgcatagcatctgtagcagaaaaattagttttctgaaaagagtgaatgtaaataatgccagggaagtatgcttttgaataacatttggtaagatccattctgaaagaagagagttagggaacttttattttattttatttttcacagtacaggaaaaaagcaaaacaaagcaaccaaatgtcctgcttgggatgaggtcattgatatcagaggatgctgcgatactgatcaaactgataaaatagcattcagtttgtctgactcattggtgaaaaatagaaaccagtgagaggtggactaaaggttagtgtgacggttgctagcttttagaacaagcagaaaacaaaatatttttactttaaactttgtctcatgaacttagttgcagtgatgggagcatttaataaaggtaagtagtatttttcattaaattttattagcattttgttatggactgaatatttgtttacccccaaaattctgtgttgaaattctaacccccagtgtgatggtatttggaggtggggccttttggagataattaggtttagttgagtacatgagggtggggccccataatgggatcagtacctttataagagaaggaaggaacaccaagagctttctttctccaccatgtgagggtacagcaagaaggctgccatctgcaagccaggaagagagccctcaccaagaactgaatcttcccgcactttgttcttgggcttcccagtttccagatctgtgagaaataaatgtcaattgtttaagccacctttttatggtatttttgttgtagtagtgctagctgactaagacacacttgataagtagctactatgcacagagtcctcttaaggaataaagaacagtctaaccctgaagccagtgaagacaagactaattaaaataatactactaacagggctgtgagtaatgtgttgttcacacacagtaagtagccattaattctgcctgggattatcttgtgggtggtgctgtttgagctgagtcttgaagagtaagagggatttgtagccttgagatggtacagcttctgaagacaggaaattggaaatgggcacagagaagaggctaaactacaaataagtgttttgacaaaatatgccaaacctaacacatgtaggcaaagccacatgcagtagttctggctctgtttatcttcctgctcagattttagtctgacagatttatagagagaaggggcagagtttctggttcatttgagaaatcatggctgaataacaggtttttcccttgattagctgggaatccctagggttgcccaagggccacagatacttactgacatttagtaaagaacctctaaaacatcttcagactggtctcattgttaataagtggtgtgacacacattgtgtgtgtaatgtctgtcttggtttttggtggaccacttaaaagtttataaaaatagttttttaaggttctgatgacttttctgcaatataatttgtaagtgcttatatatctccaacctgtaactatgtaaattactgtgaataattttgtccttaatgaaactctgtctgcttctctgtctgtgattaaagattatgaataaaatgcatcggtcttttttgtcctacattctcctctgcaaggtcaggagatagggtttgtcagggcccagttctagcactgtcttaaractccatcctcagaccctccttctccccgttaccatcactgcaaaacttaccctataaagcagatagcttccaaattaacctactttgaacattttttatcattatgagcaacttcatctagcagatataagtagtgaagttttattcagattgttacatttgaagggattttataatttgtcacattacggtagagagccctgtggcctcccaaattgtaacaacttttcctccatcacacattgtcattttcttatgccacacattcttctgatgatttttaagtggatttgtaagatgaaraattctgaatcacctggatgagcattgctttctttttctttatttttttttaaattatactttaagtgctgggatacatgagcagaatgtgcaggtttgttacataggtatacacatgccatggtggtttgctgcacccattaactcgtcatctgcgttaggtatttctcctaatgctatcctccccttagccctccaccccctgacagggccccggtgtgtgatgttcccctccctgggttcatatgttctcattgttcaactcccacttatgagtgagaacatgcagtgttggtgtttggatttctgttcctgggttagtttgctgagaatggtggtttccaccttcatccatgtccctgcaaaggacatgaactcatccttttttatggctgcatagtattccatagtgtatatgtgccatattttctatatccagtctatcattgatgggcatttgggttcgttccaagtctttgctattgtgaatagtgctgcaataaacatatgtgtgcatgtgtctttaaagtagaatgatttataatcctttgggtatattcccagtaatgagattgctgggtcaaatggtatttctggttcttagttcaaccattgtggaagacagcgtggtgattcctcaaggatatagtgcatcgctttcttacagaggtgtctgaaataaatgcagttccttcttttgaaagttcaaaggcgttaagtcaatatatgactgtatttgtggtcctgctcagcagttattcatttaggaggtgatttgctattttctgagaacagggatatgaaatgaatgtggttgcttttagagtccagaaatccatttggctcaatggagctgacacagtttattgcagtttttaggacctttttgtaatttacagtggatactaatttcctgctcaagttttctttggcagcttctgtacagctggaacagaagctggagctatgccctaagagggtggtctggattcacttctgtgggtctactcctctgcctcttcttctctgttccctctttcctttgcctttcttttcccaaattcctcaaagcttgaaagggtgagattttccttttctttcccttgctgccctccttggaattccattatgcaattcaccagcctcagctgttggtggaataaatggtagctaccagaggaatttagacaatcctttctcttggctctcaagtatattgtctcactgtacaatcctcttttgaattcccaaagccgaatattaactctttctttcttcgcattgcttctgtaataatcctaaacttcctcactccctttccttttccaagttcaaatgcagaagcttcaggctgcctaaggataaaatgcgtttatgaagaattcctttacacagaacttttctgggagtaaatctctgttaagcatgtagtagatgttgtacaaagtttattgtgtagataaatccatgggttaatgggwggaaggggaggtagaaattacagactttgtggaatgagtagatttcaaatcatccttggaattttcaagattttactcaaggagctgatatttagagcttagatacacctctactattttataaataaagggccagctgaacygtatgagtttcttacttagcagaattggagctcttgcttttttgtctttcatcctctatcccaaagatttgttgaaggatgatgaactgaatgaaggctgggtatctttaagaagataccaacaatgtcacttattgaaaaaaaaaaagctatttcgattacatagttttaataatcctcatgtcatgtactcttattacgattctcaatattgcagtaaattgtgttttgtggggctttgattaaaattacattttgcactcacttttatggtctggagtgattctgatctatggggggagtgataacatcagcatcaagattttctttgtccgggacgtgcttcagctgcatgacaactctcctcctgagtgatatgtgacttgtgccttcatcacctgttcatcctgccaatatattttccacatctgtcctcccattcacctaaagatttattccacatgcctgatgacaaaatgtccttgcacctgggggacctaagcctgtagaacatctatctcattttctttcttttgacacaagtccattagcttcatctgtcttgaggacaatcccggctaagagcctatctgatgtttcttctttggggamctttcagaatttcaaggttataggaaacttggctttgtgcaaagtatgttgccatctgttgctagtttctaatttcagatccatttaagagatttgccaggttagatttatatagacattttaactaattctatttctttgtacttaacccaagatcacatacttaggtttgtcctttcaatawcatttatcagaatactccactattcagccactttgaggagacacattgtttacctgccacttgctgtgataagacattacatgcagcatgtgtttatttggtagttatcaaataataatgcctggtaacagacagccaaaaagcaaacaggggatttagaggttcctgtttatttttgtttgtttgttttgttttaaataagtaaattgaaactcagagcaattatgcrgcttacttaaagtctcaaaattagctcatatttcagatgaaatttgccttcaagttctagatcacctgcagcactgaagttttggtgaccatttattcttcagattgtatttatgattccttgattaacaaatctttaaaaagttgtgaaaattattttctggcaaacattggaaaagggctaaaatatgataatactgtagtcagaaaaaaactattcaaagacacacttgtatacaaataaatatatttttattacatatgcttcatacgcactttctcacatacagagctctaacttcagtgacaataagctctttccagagatttatcttaagacaataatccagaagaaggaaaatgctatacatatgatggctataatagccaagtgttataggcaaattgtgtatccaataatataaaataaatgatagcatattaactaatgtggtaatttacagtcattaaaatgatgagtatgaagacaatatatggaaatatgatgaacaatcgagtttaaaaagccagaaccactgtattcgctttcctttcaactatatgaaaagtatacatgcataagacaaaaatgtaaaagtctatgaaatacttagtgttaggttgatgatattataagcgcttttctacttttatatttttctgtaagttaatgttggttctacaacacaccatgattacagtggtatgatatccactgccaaagaataggaatgcgttagaccaagagtgatggggattatttcacacaagtgctatatttctctacttcccatgattgacattcttaattgatgttggaagggttttgaatccttctaagttagttcttcaggttcatgaactgatcagcaagagcatggaagttgccaaccctttttaacttttatgtagtttactctatattccaaattaattgtccagaaagagtattgactttaaatgggctccaaaatatataagtagcaggaatggtggctgagacaaaactcctggtgttcattgcttagaaatgtctgatgtggaagtgatggaaatggtgggatctgagctggccgttgtcgtagctgtgaacgaattcacatttgtttcccaggccccacacaggtaatgctctgtctgtattccacagacagacasacggtcaaccccacaagggtgcttttctgttcccttcctagagtccwctcatgaaaatgtgcttgktctcatctcatcccctcaaggtttggctttctacttcactgactccccggatttaatccatgtatgggtgcagctcctcaacagtgggattgctatttgtgtaggaatcttctgggtccccacactttttttttttgtacaaagaggtaactagcaaaagggattttttttaagtaaatgatttttggtacacttccaatcagtctatatgaagggcctacctcctataaggatgggcatgagtaggggaattagaagaagattaagggggggtctttagttggagctaccagggaggtgtatgagatttcatggtgtctgtctgggacctggtaaggagtaacctttcccatttgtgtaggtgtatttacagttgacataactggtatagctttcctttatctcaagacaggacaaataatactgtaattctaggtaaaagcaattcattgagagagaaactgatatatcttacattgtatatttcataatatagtgaracattttgaaagcttacttgtcttatattggttttcttaatattctttaattttcccaccagcttcaaattccacaatttatctacatgcagatacccaccatttctcacagatacatatattccagcctatatttctccagagttgctatttcttacagaatatttctacttgaatgatttactaatatgtaacctatttttgttgcaaaacaacagatagtgctcagtgtagaatttcacactccaatccaatgtaatctagaggtagacgctcccgggcaggctagtgttcagcagggacacagccctgggcatatagttgggagacttgggctggggttttctctgccagagcacagrtctctgatcctgtaagtcatttaaattcttgtgtttcaaattccctcactgtaaaaggagtggcttgacctagatgatctcaaaagtctctccaagcttgaaaattctggttctatgattttaatatttaacaatacacataattgtgcttgtgcttgcatgataattaggcatgcatgataatggggcacagtgaatgactgtaattagctttactcctacagagaaaaaatctatttttaagtctttccacttctcatcttattggttttttaaaatattgataatcagtatcaatggcctttgactttcccttggaaccttttacccttaccatcctcaacttccttcttgccactgctctctgtcattatagcggtaatcacaaatccacacatatattagagaccattatgttgaatattaattcctgcagagctgaattcttcctgttctgactttcaggtaggacaatcctctcccatgtccttaattttcatccaataaaggtacttttgtggaagcttcctgccatatcctgaataaaggtgtccttaaaaatccagagatgaacatggaggaattaggtaaacaggatctgtttcacaggggcctgtggaaagcctgggatgttgtagtatcaggcatgtagatcatagtaaaggggatgtcaaggagccaggggagcctgggacaagcatggcagagggcaaagcccacagtgtgagaggcctgggggcctgctgacccacctgggagttctgaggccagagggaaaagagagggagagttgtccttacaggatgagagaagctagaattgtggccctttactttagaagtagccttctggctctgtaagtaaatttacctgacaatcatattaattattataactaacattaattctacaaatgtgcaaggaactgtgataagtactgtaaaagaatgatttaactcctcacattattccttttaagtaaatccttttgaatccctcaattgtaggttgatgatctaagtactagagagttctgaaaacttgatcccagtgatatgagtagcaggcgatggagccagctttagacacaaggcgatgacattttcttttcccttctactcaccccacagtccgtatgccatcctcaaaatatgtaattgcaatgtcaatttttcctgtttcgttggaccaggacatgtaaaccatggaggcagagtctgaaaagttctacgtaattgagcaaagtagtgaaaaagtgaagctggaaacgaaagacaagttttgattccacttggtgtgttttaatttaagttggccaccaggagttcctgagcaaaggtgctcactgtctctagtggtacttgtcttcctgagatggaagctctcggtccttactccccaagtgaccatgtcacgctccttaagggcagtctctccagatgatgaccaaatggtttgtagggaagattttaactctgatgtggaggggctcttcaagcaaatattttgtctcttctcagtacagtaattaagctgataattttttttttttttaccttttcgggccactacaacattctctgctcttggattcaaagatgaatgttccttccacacagtttaatacgtctacagttccagccgaggttgggggagattttgtctgatcaggatgtttttccaatagtagtgtctggttctgtgttgggatttcactcagtaaggttttccattcagttttatgatttggtactcctggtatgcacatcttaatatatctgacccttcactttaaatttttgttgcactttttcttttttttaaattttgtaccaaaaaaaaatgttctgtatccgagacctcatatagcttctattgggagttgtctccacttcaaacttacatttcctttgaaatcccagtgagtagccttactttccatatggcctgatgagaatgtatttcccttgcagatgtgaacaagctttttatttttaacttctcaaataagatgtacatccaagactgttaaaataatcttccataatgatttgtcttagagtagaaatatgtggcatatttttaatcataaatacatatacacattataattgttcttytgtatttaagttagtacctgtgatttgtttatccaagacagatggtaaggggtgatacttttgtcagcttacatctagagatctatagtagggttaatttagaattcaagtaatttttgttcaaggctttatgattttatgaagaaaaaataggaagaggttaaatgtcatcaagcattcagtttaaaaaatatacagatgacctaaataatttgttcagttgtatacttatatataggtgtatgatgtattactcagcttaaacctccagtcctttctcctagagcctaatagcatgaacggccgcagatggggattttacctaggtttctgtgttagcctgtttttaggctgctgataaagacgtacctgagtctgggtaatttatacagagaaacagatttcatggactcacagttccatgtggctggggaggcctcgcagtcatggtggaagagaaaaggcacgtcttacatggcagtgggcaaggaaagaaatgagaaccaagccccttataaaaccatcagatctcatgagacttattcactaccactagaacagtatgggggaacctgcccccatgattcaattatctccctctcacaactcatgggaattaggggagctacaactgaaygtgacatttgggtggggacacagccaaaccatatcagtttctgaatgtcctcttcaggcacaattttgccttgtgttatctgtgctctaagttcatgctgcttgtttcctggctatctgcaaaaataataaaataaaatgcagcttcagactcctgcatttgccacatatacttttcttatgctttacaaactttatcctagttatcaaagaccaggtgttgctggatatttctgctttggcttctacttttctttaattctgtcaacccctccctcatgtctttacactgcaattacatagaggtactcagtacaaaatatattgtatcagcagcatagatggctgcagagattgccttacagtagaaggcagtagaagtttttatggttttatatggagaaagaaaattgtttgctagcactcagatattcttctccttaagttcgtttctcccgactttgactttcactataaaatgccctgactcacttttggaactggagcaaagagaacaagagaagtgatctagagttgctacttcttgcttgggcaaataaatgcctcatgcttcccctgtccctttagtgtgagtcacatagaagactttggcaattgatttttctatttataatcagatatccccataggaatctttactggattactctgactttaaaaaaggagagagatttctgtatttaaaatgtttcataaaaataattggggaaaagagaaacaagaaataagagatggctcagggcttagatgcctgtgtcccctaatttgcccctgagatggaggacattcctgccttctgctgcgtcagcctccttccactggctcttcaacctcctggacctcagtgtggctttccaggtgtggccactggctggccttgggcctgtcaccactcctttcatctgatgccttcccccactgaaggccataggtttatcttccaccatcagtttgtcttattaaaactggccactcgacccttgcattttctgtggtctcacaaaataacacctaaggataaagacagtaaatccagaatacactttgtttaattcctcatgttgaggatcatttttgatcattgcctgctccaacaagccagaaaaaaaaagtccaataaaatatattatgcagtatctctttataaattgttttcttgaatagttatgagtggagtccattggattcccatttataacagagtttaatgtagtgaaattcctgctgactgatattggaaatgaaagtttcatttataaggatgcaattaaagcattgccaagttaaaaatgtcatgttgctctttgtcaatgaggttcattatgctatattattatatctgtgtgaatcctttcttctcaggagcgaaatgttctttctgaatattaaccaactgctacaaaattcttcagagattattattctttcaaattacatgaatttaaaaatcatttactaatgaatcctcctgaatttctcagaaaaagaaagaactcgagcagatttacccattggtaaaggaaactgccccttctctgatattgggttggttagtaaccattcagttgcatttttcctgcactttcatgtaagtcagtcatagatgcagaagggcatcctggtgggaagtagcattttacagcctttaagcagactgtttttctaaatataataacaatgaaaactatttggatacacatgtaagtcctytgtgaggcttgagtctagatgaaatatcagagtctactgcaacatccagtctgagggtgcctttgaaccatttcaggacaaaagcaaattaaacttggaatcctatcccaacttcattacctagctgaatgtactcacagttcatctaacctaattgctcttcctgcttcctcctgacagtaaatgaaataataatgacaattattttaaaacagtaaagggatatataacttagtggttgttattctgattactactgtgtgtctcctctgcttcacaatgggtagagtttagtttgatgggtggttcaccttttggctcctgctatttggcttaattgatgattggcaggcaatctggcttaaatctgwtgacctttcttcaggaaaggaagggtgaaatgaagagatggtaagaattcctcccatatttcctgatctatctttggtggcccaggcttccagaattccctgaatcacactcctctgcagaatccttgcagtaatggttgaccatagtatggagagtgactgtcctgttatctactgttggtgtggctagacttattctgccagcttatctgctggctcccaggaacccagtggaatgggagtcctggcatgcagtgccctgtgaattcaatttccaggcaaaaccaaggaagagctttcctttcgagaatgcagctgacactgacatcctcaacaacactttaaatacaatgattacagtaaacaaaaatacaatgtcgtaaaaaagaaaaatgactcttagatattacccagcaaggaaaccacagtgttccagagaattgtaatgccccatgatagcccttaaactccctcaccactcctactttttgatagaaagatctgtaagggctacatgaccttaggctctactccccagcaaggtcagttttgttctatggaatatactataatgttgattgttgtgttcccataaggtcagcacatctccaaggtctgtcctaacagataaacttttggatcagtggtgagcagactaggacaggtataacatgtgctccctaaccagcttcctgaagtggctcatggttgaatttttgggaatcctttatcacaaagatggagaaattggggaccagaasgttgaatgtaagccagttccttttccccagaggcttccctctcacctgaaagggcatttttgggtgagcctcatcgttgaaagaaagtgggatacaaacaaaacaaaaaataagaatgtgtattggcccccaagcagacaccctaatttagggattaatggatatcatagatataagtacacacttaaaaaaaacaactaatgctctttgatagcttaaaccttaagtctttaattttatgcacattattattttttattttccaatttaaaacatttgcttcgttaaataaaacacacattaaggaaaccacataggaccatgtgtgatataataagttatcagaaggttgaattcttacatttactactcaggctaagaaattagtctgtggccatgctggagccctgtgtcccatcctaagtttgttctcactctctttcttcaaaagagatcattatcttggtgcctagtccttcatttatttattcacttattcaacaagcattatggtgtgcctggcatatgtcaaatcttttccatctgaaagattcagaatggyctcttaggtatatgagataacattctaaattaattttattctcctggcctgcaaatttattctcaaaaactgctagttatatggttgctctgtttacttggggacaggtaggctggttcatacatttactaattaaattacttttattgctaactctgaatatttaatgccttgtttggcaattatgagagatatgagtaaaccacagtctttgcttctacaatgattatacattatccaaacataatgcaaaggaaatgttaccagtaagaatgccagaggcccttttcccctaaattctcatgtgcctcgttccaggaagaaaaaaagaaagatttaggatgtttctttctayatcagtcattcccttggagacaagagagaatgaggcaagatgtattggattgttccttagtgtttttccattatgcctctccatytacagattgtgccctccaacaatttcctccctctaattcaaacgcagtgctcttgggaacttattttatgtgtacccaataaaatggcattaatctgatagtggtttgttcaaactcacacaaaatttgaagcaagtgctgtgttccaccagccagatgtcatatttggtaaaagaaatatggggtaatcaattttaaagtcctccaagttttcctatactgtgaaatttagggaggtaaaattaggattgaggcaaaaggatctggatctcctgaaaaaatatggttgtgcacttagtgttgtacacatctttcctaaccctctattccttggactgtttgtactcagggtcagggagtggtgaggctctcattggcatgaccatttaaggggttcaggaggtgtgtactccacagaaggcattgctgaacctgtggaagaaatgctaacaagaatttgaagaatcagactccaggaatgggaaacactattctgaaataatggaggaaaagagaccacattcctttcttgggggctgggatcaagaaagggcccccaggtgggccaggaactcacctgggctggatccatgcagagtttgttcatggttattagagattatgcctttagaagtgacactagtgggcacccctgaaatgacctccaacacaccccctaggggagyacaccctgagtttcccgaaaaatraggaaccactgacaacagaaagaactggttttctttgtgtggaggggttagtccctgggagggaataatcttccttcagtctcaayagctaaaactgtggggaagtgatgaatggtagacttgagactttcctttgctgttaaggatgatggactagatgatggatgctgttaaagatgatgatgttttgggacatcagagcaaccaataactaaacagcagcctgtgataggctggagcaggttgtcactaggaagacagggagtattcaagtctggctttctctaaatcgtgaaatcattattctcactttgatggttttaggctaatttgacttggtaaagcaaagattacataaaaagttcagattgtggctgaaacacaggcatgtccttcaatctgtaaaagataaaggcaattaaaaaatgaactgtaaatgaagacatatttttgctaaatgttggaataattgttaaaaataattattttgctttataaacrtatatttccaggagggctgtcaaaggcactgtggttaggatacatacacttattttttaaaaagttaaagatctgtttttcttataaaactgttcatcccttttgtgcttgacacatgctaccagagatacaaagtagatggaaaggaatcatgccctctcagagtcacgatccagcaaagaacctgaaaatgacaatctgacacccaagtccaagctcttaactactattttacactgattctcagaattgcttggaagattaaataagatgataataagagtgcatcataaccttatggccaaatagaataccattcactaataaagcaaatgttctgtacatttccttccatatctatatcaaattattcatcaagaacatcaaaatgctattatmcatccacaactaatatttacaaccaacattttagtaagttaattttaggtaaattaattgaaacacggcctgtatatatattttatgtgaaagtattaatagtgaagtcagaaacgttgcatgagtgtctctccttagctttttatacctattctgtggaaagataatttaaagaaggtgaaatagcccttgcaaatgatagctggctggctgactcactgctatgacttgctttggtagctgctgcttctgtcttgcctgtgttttagggggaaaatatacctggcaaattcctctaatgtgcattgcaccatacttggagaaaatgaaatcttcacataatgtcaaagaaaaaaccagcatcacacagcctttttgtacaattagggataattctacctaagtggaagaagggaagggcaaaatagaacattcagcaggtcatctctccaggaagtgtttaatactgaggcgttttgggtgttcgtgttgtgctttaagctgttaccatctctcaagcctccctacttatttattataaacatttaaagctgagacctttacaaaaggccaamattaacagtgagtgcattcacacaatgaaaatgtatttgaatgagatttctctgctgttagatggatcgtcagtggcattgtctcaaaggatatttgtgcttctctccttgtcytttggctttgacaatcagaatgatgaagattcctgtagtagaagtgtgcatgtaaatggaatttttttaacctattttatgaacacttcctgagtccctactgtggactggatgtgcatgttcttgaagaactcataatctagcagaagatgtaaataaatmaatctatagagtagratgtgatgaaatgttggagagaagggtgtttatttgccctggggaccctaaacaggttgtggctaactccgcctggaggatttaggggagtaataatgaataaaacattcattatcttattcaatctgtattgaaatggataaaacatttattgtcttattcaatctttattgattgcttcagtgtatgccatgcactgtatttggtgctaggaacacatgggtgacaagacagcrttgtgaagaactgcaaaagatctgaggtttctaccctccttgccagccaatgagcttaaggctttctctccgtctgagaaaccatcaatagtcgatgttcccttcctcttcctgcttgctaatactccccagagcaattctaccactgtttgaactagccactgaataggaggacactgacaactttgggtggcagctttccagttcttcagaaactattaaactggcaacagagaagaagcggagcttgctgggactaggcctgcaggtttgaaagttgcttcagcagcagagcaccagcatctgagctcccttttttggctgcatgtcggccctgggatgacagtacagtagtgacatgagaaagagatctattagcaagagactcagctgcttctgaagaggtgggctttcctaccaagtgaatattcttttgatggcaagcctactacaatgcgctcactgtggaactaacctaaggacattcaagaatacttcagatgtcctaaaatgtgagaatgtactgctgagccaaataagacattcctgatgtgttggattttggaacttagtttgatttaggacaaaagaccaggaggcatatctctctacatttttctagcatctgtgacattgaagacagaagaaatgttaaatttgtttgattgttaaagacaaaactaacatgtgtcaaagacaatgtcataatttattttgtttattctgggataactttctagagtaatgtgtatcagattagtaatggggtcttgatgggaggcattgttgttcatagcgactctgaaagaccacatgcagcaaggtattgggatgcttagaagatttgccaagtattcagggtgaagtagcaggtgcacaaatgggcaatcagggcacagccaggtcggcagagccagaattgtccctgccctgcttccatacctctaccaaccgtcacctgcaggctgcacacatttccatatgaagagtgattcctgactcttgaggaaacataaaaggtgttgtaactgagataaaatttgcttcagcttaaagaattccttctattatttcctgtgacttgcattttattttttatttcctttgacttgtgtgacatgtaggatccttctctcctgagatctctcttgactgtaaactaattacccattgtgacatgaaaacaaaatatgcttcaaatttccaagaactgtggatcttaaagagagtcattgtttgttcagtggagatgaggggtttgaagatgtaattggaagaggtaagcttttgtgtatgaggaaaggaaatataaagacattggggaagatctgggagaaggagaactgctggggtggaggaagaagaaataagaaaaacctggttgctgaggtgaagaagacatttgggagaaaaaggaatacatgtagagaagattccttctccacgccccagtaaagtcttcccacataatatgtaaagtcaacccttttccttgcaacttcatgaaatcttcaggaagatagtggttcctcattcatctattgagaagtcagagctrtttattccctgcttttcctaccagaagttccatgagggcaggaggacagcctgctttgttctctgctttaccccggcaccaaggacagtgcttggtagagtggatatccagaaaatacttcaacaaatagatgacttacttatttacaaataaatgcttttgtttacaaataaatgcttttatttttgtgattgtgttgaacaaaaagatttttcttcacatatcatcctgcttcaaataatacctatttctagaatgattttttacctttcctaatgataaaaaatatataaattatttgatattttaaaaatacacaataatgtgaggcaagaaagcacccacaatatcatcgatgttaggaaacttaattcttttatgtagtctttcttgtcttctttgcatacaccatttttatacagcgtcatttctggctggtgttttaaggcaaaatggatatattgaggtcacagagccattggaacaactgaaggaagagattttaagactggccttttggaaataactttaaggcaaaatagatataatgaggtcacagagccattggaacaactgaaggaagagatttcaagatagcttttggaaataacttcacatttatcctgttctctttccaagttgcattcataaaacttagattgtacatagggcattgctcgcaagggagtatgggaatgtagtttttaaggcaccaaaccttttcttgtgtatttttgtagttttcttttgtctggacctctctttctgcagctggctctacaactaacctattgacatatttcaaatctgagttcaaaagtcaactctgatgagacgagagactttatctgctcactgactcacagcttacctctcccacttactctaccttattacccagtttattttctttgtagcattagtggcaatctgtaattatttatttatgtctcttggctgtctccactactagaatgtaagctccataaaagcaagaactttgtctttcaatactgtatcctcaktacctaacattttgccagggctttatgtattttatacacatttgtaatacgatcaattcaccaaaagttgtacatttagtttctttccagtttactataaacactgcatgatgagcatctttacataaaaatatttgtctacgtttctgatcatttccataagatagactggtaggagttattgaattggtaggtatggaacatcttatctcttatattygccaaactgctttataagaatatggttctatttactttcctgccagcaaagtgtgagcttccattttatcacatcatcactggaattgaatattttcatatttaaatatttgctaatttttctcactaaagcttagagggtgtgttttctgataaatattaagttttattatattatggatatttatgcttggtcatatttttgaaataaaatttacattgttttattctatgttagaagtcttacatttatatgtagtcaaatcaattgattttttatttgtgatttctgtmattattaagaaagtttttgtccagagctcagatgaatattccatatttkgttctttgatgttttcaatatttcaactctttgagaaactttttaaatcaaatttattgtaataaactgtattttaaggttttttaaaaaattctctccttycccaaacttgaaactggctcccgttagtaaagaacattggctcatattaatagaaaacattgactaaggaaccaaacataaatcacaaacaaaaaagaaaagaaaagtaaagctttcatatctgtcatattagtccattttcatgctgctgataaagacatacccaagaccgggcaatttacaaaagaaagaggtttaatggacttayagttcckcatggctggggaggcctcacaatcatggtggaaggcaaggaggagcaagtcacatcttacgtggatggtggcaggcaaagagagttgttcatggaaactcccattttttaaaccatcagatctcatgagactcattcacgatcatcagaatagcacaggaaagacctgcccccataattcaatcacctctcactaggttcctgccatgacacctgggaattgtgggaattacaattcaagatgagatttgggtggggacacagccaaaccatatagtcttttatatctgtttattcttataccagcattaagcaactctgaaaatcacattcaaacattcatccctcattttaattttatttacaaacataaattaatattctacccaggttctaaattgaataataccattggacccggtttacttagcacatgttgtgattgtttcaatattaaccgatattcaatatcattattattattggatgataaggtttgtacatggacctaatttcagatttgaaactgatcatagtgacttcccaaagcaaaaatgaatggggaaattttggttttagtgatgcacaaagccagtcatcctccgtgtctgattcyagagtgaacagaaatgacttcccatagtccctttaaagttttaacctatcaaataaagtcctttagtctaatctccttgaaaaacaccatttttcaagtttcctgttattaacttcatgtcagaattcaaatccccaatgttttaaagaatgtcattggttactataacaattaacttacttaattcaacagagtgccttcctagacatgaattatgcagtgatcttgaaagaacaaaagatagtacaaaaaagaaatccaatttctcttttttttctttaggagtactagctttaattaatttatcttttactttcagcttttattttagatataggtggtacatgtgtaggattgttacatgggtatattggacccaggttgtgaacctagtacctaataggtagtttgtaaaccagtgctcccttcctccatcccctcctctagtagtcctcagcatctattgtatctatgtttatgttcatgtgtattccatgtttagcttccacttgtaagtgagaacatgtggtatttggcttactcttcctgtattaattcacttaggattatggcctccagtttcatccatgttgctgcaaagaacatgatttcattcttttttatggttgtgtagtattctatgctatatatgtaccatattttcttgatccaatccaccattgatgggtatgtaggttgattccgtgtttttgctattgtgaatagaacagcagtgaacatctgaatgcaatataatgatctatattcctttggatatatacctagtaatgggattgctaggtcaaatggtagctctgttttaagttctttgagaaatctccaaactgatttctaaagtagttgaactaatttacattcccacgaacagtgtacgagttctctttttcctgccagccttgccagcatctgttgttttttgactttttaataatagctattttgactggtgtgagatggtatctcattgtggttttgatttgcattttgatgatgattagtgatgagcattttttcatatgtttgttgatcacatatatatcttcttttgagaagtgtctgttcatgtcttttgcccactttttaatggggttatttgttttwtgcttgttaatttgtttaagtttcctatagattctcgatatgagacctttgttggacacataatttgtgaatattttctcccattctgtatgttgtctgtttagtctgttgatgatttcttttgctgtgcagaagaagctctttagtttaattagatctcacttgtcaatttttgtttttgttgcaattgcttttagggagttggccataaatcctttaccaagcttgatgtcgatgaggatatttcctagattttcttctaggaactttatagtttgaggtcttacattcaattttcctaatttattgttttctttcttagaataatcattctcttctactccaatttgaaaaaaaagaaaacttcaggagtagaaagagagatgactttaatttgcagaaagtatgggttcacctatttaggccttatcaatgagaactcttaaagaaacagcctttgagtatacagtactgtggcacacacccctaaggaaccttctatgagtcatgaccttgtataattcctttttcttgagtggaacctgagacttgcctttagccactacaatatgacaaaagtgatagaatgtcactccagtgattttgttaacttatacacaaaggtgaaaggatttttgcagaatcattaagtccctagccttttgttttgagctaatcaaaagagaaattttactgggtggggttgacctaatcaggtaagccctttaaaggaaaagccaggccttccctggagttagagcttcaaagcagcagagactctcgccctcctttcctggctttgaagaagcaagtttccatacatcctatagccacaaggaaatgaattccacaaacaacctgtggttgctgggaggtaaagtctaccccgttcaagtctccagatgagaatgcagccagacatgcaccttcatgtcagcctcctgagtggaatacccacctaagttgtgcccagactcctgatctgcagagctgtgagatcatgagtagatgttactttaaacatcttgtttgtggtcatttgttatgctgcactggaaaatgaaaaccagaagtctccttgatggcatcagctaagggaggaagaattccttctctcagacataccaaaatgtgcaatttccttttcagtctgcagattaatttgaatgttgtcattctaatttgaaataatacccctctgacaaatagtagcagttactcctgtggattttgtgtttctttgtaattcgactactcgtcctattttttctatcctcatttaagtcattttacttccaagctcagatggatatccctcttccacttgcctttgtgtttgatgatctgatctcttcttctgcatrttatttctactttgcctttgctgggttatttctgtatttcttcctcacttctcgcttatttctatttttattcccattctgggtccactcgtgcttctcctcaggccactcaccatccaggaaatttctgtctccacgtctcttctaagatttacctgtacttaagaatttccattttctgaatgatgtttcaaatttagaaatgtggatttaggtctatttgctttgtaagatttatgtttcacaaatttatttattttccttgagaattagtgaacaaatggttaggtaaccttgagtggacatgaagcttttcatcggaattggatacagattgtatttaaacacctcatcaaagatttaggactgtgggattgtcattcataggttgtgagtgagcacaaggacccttcccatggggtggttgaccttttgttttgagagccagagtgctgcaaggaaatgtagttattctttgactggaagatgtcttttctgttctgaatgttctgaggtatgtggattcttatctataattaccttcccttaagtcaatctgcatgctaaagcctcccccaggtcctgcatctgtgcctcattctttgaagctgggattcagaatatattataacagaataaattataaagattgcttgggtgtttcctgtaccaggacatagcagtggtttggtgtcctgcccatttgtgtggcagraaattcttttgtttgtgctggtgaatygttttgtctggggcttctttctttgctaaaaatcttgcattctttcatttggcaagcattttgtcaacaactttaacttgcaagaactatgggtccacctatttaggcattatcgatgagaacttctaaaggaacagcctttgagtgtacagtactatggcacacacccctaaggaaccctctatgagtaatgggtttgtataattcctttttcttcagtggaacctaggacttgcctgatattccagagagtgtgaagagggatatttaaaaataaaaatgaaaaagtgttgcccccatagtatgtaacaaatgcctctcaggtgtgacagatgtgagttatactgtgaaggtgatattgatgagtctgggtaggtgtgcaactgcttatggcataaggcaggtacacagtaagaccagtaagactaaatgagaattactgggtatggagcttggggatccaataagcctcccaagtgattcctgtgtacactgaaatttaagaaaattattacatggtgccaaaattttgttgttgatcatgatgatcattggaagacaaaataccaaaaattttatccaacgtattatgtctttaagagaatgttataattttaaaagagaaattatatactccttaaaatcattttcattaatcaaaattacttatggctagaattcctctgcctttataatgctcttgcacttctaagtctaaagcctttaaaatggtcagtaattattatacttcaaattaatgaagaaccattgaccccatgaaatcaagttctgaaattgaccaacaagtaatgaattgttaacgaggatgtattattcacatctgcagtaattattttgcaccaatattctagatttaagtgatcttggaaaatatcatacatgtgatactcctgatctcaaagaacaacttagtaatgtataattatttttatttttctgcaataactgagaatgaagtgcatatttaaataaatatttatatagtrtttrtttattcaatgtgaatttcatcatataaagttaatgccctaaatttaatatcttttgcattattgtggcaattgtgatagttaacacatctgtaaacacaaacacatgttctgtgtttccatttgatgacctataaatgaagacacattctaaagtgagacaaaataactatatcctaaatattctatcctaaacgtccccatattcttgcattgtatgaagaagtgtgttggctggtgtrtgctaatttaatagttagatataatttggttgcttgatggaagataaagggaaacttgcagtttgaaagcagtcagaatgttaacatctgttaaaaatttgctaagtttcatcactgaaattgccatgacttagtactttagagggaataattatctcccttggaaaaaactaatcactttagaagtgcataaacacttctaagtcacaaaggtgctgtttcatgaatgacatcaaattattattattttttttggttaggaatcagttttaggagctaatttatttcctaaagtctctcatttcttctttaatgtcatttgtgtagtgagagatattaacaagctactctacaaatgatgagaaatataaaaacaaattaattgtatctattaataaccgtatctgttaatattatgaaatttccatatttctccccctagctgttgtcaacatcacatctatttattgtctgaatttcaatttctttgttatccctcatatatgaaagtttaaccttgaacctgaaatgaccactaaatatactgccttaaaaactggaatacacatgggtgtggtatgtgtgtaccctcacttattccaacttagatgccttccattccttctatccacctttgctcctgaggtcccaggctaggggaatttgggttgtactaataagcactttaatattggccaccagagggctcccatattccttccrtctaagtatgaaaatacaaagtgcaactaacataaagttcaccatcaaatagaaaatattataggaatttatgatatagttctctctagagtgaaagtgttccaaacccattgtgttcttatataaaatacttacaatgaaccaatttgggatactcaacactttcattaaaataaagttatgaaattatgtttggttttgtctttgttttgggaggttatgataagacttataatacttaattggtgattccacattttaaatattaatgttagtaaatctggatgtaaatccattatttacatatgaatgatgtaaaatacaactgattctagtcataggagtacaattttttatcacaagctagctatataaataatcctctattaaaaccccgggtatttttttttttagcccagcattttgatggtacacaaaactttagacaacaagatggtagggtttctttaagtgtgtgttggtagtaagaaatagttccattggagaaaaacaaagaattgcttcgttggtgagtctttccactagttcttgttgggttgtgttagccgagaaccatttgcagttactgagacatgctgggatacctctcagggttttagaagcagcaaaggtatctgccatttttttttctttttctttcattgatggtaatttgtttggttttgtactgaccaggtgctgaccaaagtatttatgtatgcagacatatttctgctgtgcagtagagggtagggttagccaatagtgaaactgttgtaattgacagcggaacagactttgaagtttctttaggaactctttgaatctaggtgaaacatttcatatgagtcatcagattgatcttctctgcgatgtactttaaaaattacaattcatttatcatcagtaaccgaaaatggcatttaaccattctacctttttcrattgcttttcttctagaacacattacttatatttctgcacttaaatgtgcatcaaagaggatagcaacatggaaggcctgattaactaactcaattatacacccacacctagatgctgtctttttgactgtgagactgcaatgttgtgttgcagaagaaaataaaacaatctgttcccctttttttatccattatgttattctggtctgagaattattgattgtactttttctttagaaaaagagaataaaaatgagctaattttggtgcaccttgtatttattgaaatagttttaaagcagtgttttgaattatgttttgatatgtgtttttaaaacggtttttctgaaagcaggctttctttgtttaaatcctcctctgtcccatcctttgctttcttttcatgagacaattgtgattaaaaagcactctaatctctagggttagattatcatgtctaaatgaaatgcggttataaaactatctttgtatacaatctattttggaaatttgaatagttttattcagaatcacatagtaacaaatccagtccagtttgtcctgatgattcagtgggattttgatctgataatgttcaccaggcatttgcattcaatttctgctcaaggaaatccacaatatcgcaactagtaattgactgcattttaaaaatatgcacaagcaaaagaaaaggtagaaaaaatgcaacaaccaattttgatagtgactggatattatcatagcccaaaagctaactgtattatgttcctcttagaagtctttgaattaacaagcaaggcaaattttcagggttagatagattttattcaggaacatctttgttaattatcatattatttctaagtttatactgtctaggaataaaaaatacctggaaatgttttaattagtatgttcacacacttccatgtaaactgatttgggttcctaagtttcctgaataattgctctaattttgaaattcagcattcttagataccactccaattgtatgtatttaccacttagagagaaagtttattcctatctagcttgtgtgaaatcaaattggcagagaatgaactttggcttaaaagcttctcctgacatttatttgcaaaggtttctatggctaatattcttgcactcaaggtgacattaagcttccttggtcactagggagaaatgtggcttttctcttcactgattctgggtatgagaagaaaagaatgacttgaggatatgccaacctcaccttgcttctgtctgcccctagctatattttatatttrcatttcaggcaagagaccaaaaaactgaattcccaacacagagagacagtggcgagcgagaggacctgcatcacccagctcttaaatcctacatcagtacctatgcctaaagccaccaatgatatccagagaccttcctatctgaagctattgatgtttatttttttcaagactttaagacctctcaaaaaataaaatataaaatttaacttagaatactggtgcttaattgtgactgcacgttacgctcatctaggggtgctctttaattcctaatactcaggttgcatcactgaccaattaatcagaatgactgggattcaaccagacctcagtagttttgtaagctctctctcatgactgtgactacactatgggttgagaagcactcaaagtttgagaaccactgtcttgtaaaccaggaccactaaatgatatcataatcctacatcctgacatatgtaaaggataaggatcttagactgcaaatccagatgttcaagaaatacaggttgattatgagttgtgtggtccaaattctgtaattcagccagtgtggtggagggttaatcttggccaattcagggttcttcctttccataagaatgcaagtgaattacaatgggttcagagagtgctacattatttgggggtagggctggagaggactctgtcctgggtggctacttacctgtgccagccttgctgaaatgtgcaccaaggcatctgtccacagtggatcagtggtggctcaagtccccacagcactgccccttcaccccaccaataggccattttctttcccccatgccatgttatggcatgacgtgagctggtgtgtacctgccgtgaagtgtccctcaaaattttttcctcttcggtcttctccacacttgagaaaatgactacatgtttgttgtttctcagagatttgacctcagatgaaaatgttaagaaaggaaccaatcattaaactgagactcctggtcagtacaaccgatgtttcctcttctttttaaagcaaaagcttgtaaattccttttttcaattataaggaaccataaaatcatgcatttttgtcctgaaggaacttttttagtatgcaataatttgattaaaaataatcactaaaaagtatattaccatcaatcgttatgttaagatacataatacatgaagtgttcatatacatacattgttatgttgctggataaatctaattcatctctgttttcccaaggtacttttgtcatctgtccaaacagttaagagtcacgtttaaaatggtatcaactgatacctactccagagtatttatcttaatctaatcagtgttattgctcctgtcattcagaatcttcttaattattgatttggattaattacctggtgaacatttaaagccaattcaaggggagaaaaagaacagtatattgattagcaccattactgaggatatcatttcagtttgtcttagacagggatcccccaggtatgtataatattggccttgagaaaatgtaattctgccatacaaagtctaattcaaatataatggcatttatgtttttatcaatgtaacaataatttacattaattacattcttactatgtgttggagaccatattagtacattgtaaacactgtcttgcttaatccaataatctcatggggatatttactattttatctccactttacagttgaggaaacwgctcaaatcacttttccaattactcagctagttaccacagttaggacttgcactatgtttttagctattatacttagacatacaagttgaaggcagttcttgatgttttaaagtaattgttgtaaagacagatacatgcacacccacatgcagaaaatactcctttttctaatagatactaaactttaaaaataaagtcagtggtacgcattaaaaatacgtatgttcaaatccgtaatggaatatcaaggggagcctggaaatattttgaaaataaacctttttgggggtgatgtgagagacagtacccgggcctctgcaaaaatgtttttgatatgagaatactgcactaagggcaccatagtctaccccagggctgcctgatacagctatatgcagtgatgaaaatgttcttcatttgcaatgcccagtatggttgtctattgagcacttgaaataagcgtagtgcaaattaaaaactgaatttttaatttttaaaatcttaattaggttaaatctaagtagtcatatgtggctattggctacggtactgccaagtgcaggctaatctgcacttactctgcttctttctctctctccctttactcccaccactccttccttcctgcctgtctgcctgcctgcctgcctgtcttcccttcttcctgctttccaataaagagaataaatataaagtttggatcagacaaataaaattcgctttttaataatctgagtaaatgcatgcgtttttccttcttaaatgcaaacagtaaataacaacacctacttatatcattatttttaggactaatgagacaataacagatcctgattatggtaattttttwgagctaattagataatatatgtaaagcatcaagtagacttcctgctataaatgatgatccattggtgatgataatgattatgatgatggtgatactgacactaatgctgtattcatttagcaaatgggatagaaggaggtccccatttctacatcagtgtctcatgtggtaaaaagattcagatatttactcattgatgtagtaatatatttcctgtcaataaagccatgtgtgtatatagtgatttattagtatggggtaactgctcatgtttgagcatgtcgacatgctttttgagtttagggttgaaatattagccttgtgttactagtaataaaaygaaaatccagtgagagggatttgctgcagatcacatagaatttgtactcaagttcctgtcttcttttccatctacttctctttctgtgttatcatagttcccataaaaaaataatatgaaagactctaagattcaatgaaaaacataaattttgtgggatttcttcataactttttgacacaaaataaataagatgttagaatcagtggttgagtacgatcaaaactccakatgaaattattttttgcatctctttttttaaccaattattagcagtgctttttagagagcagcatttattttgtttaaccttgcaatgagagagtttcaggcccagttttttaaatgagtgtgatagtagccaatgatagagaaaaatccagtattcctagggaataaaaattgaagaagtaatcatctggccttggaagtatgtatcagcatggccaagtcatgtatcagcttccatctttcactgttgccatagttccatggaggtgatggaatccaatcatgttcttttaaaggataaccactgctctgttcagggcaccctgctcactccgtggggaatgctggaaggatgtgggaccctgcaaggctgcctcgctggaaccaagggatttagcaaatgctaggaaagaaaagcaagtttaagctgggaatgcaagtcatttgctgagacggcaaaacaagaagagagaagccagaggattgctggccatcacaaagccaaggggcctaaaggaggtggaaatgcagcatactagaggccagatgtgcttccactcaaacccattggtggcaagggcctgagaaggaagtggtaatgagtcacaagcaggatgatacagtattaacccacatcctttagaaggcttgaacatcgtccttttgtagctgattcctgtcttagatcagaatgccgactgagagacaggattttgacagaaataaaataataaagggttaccaagtgaaagagtgataaaaagtgctggaatggaaaamtatgtagtacatttacaaactctgggtcgattcgaaagaacagaactttgctaatgtaagagctgtgtttggggcatagattctgagataatattggaaagttattcctcatccttttattcactcattatttcacttcttcattcatttccaagcatttttctagaagcaagggacatagcaacagatacaactgacgaaaatctctgcttacatgcatctttcattgtaatatgggaaacagacaataagtgagaaaataagtaaaaaataaagtaggttagatggtgataaatactacagaaaaattacatgggagggaggatcagggatttttgggccgatgagaagcaattttaaattgggttgccagggaaggcctgcaaatccaaaggacctcacttttgtatccagggaacaagacagagaccagtgtgcctggatctggaccsaagggaatgagaagggagggtgggaggagatgacgtcagaggagtgatgggtggggacagaagatgccatggagtctcatygaaccagctcgaagacctggacagaagaggattgcttctccatcctggcagcatggagaaggccttgttccctgtgtgattcccacaggagtgccgaagagcatcctgcccctttcctgatgtatccatttacaatccgcacaagtaaaattgcaacagctgtccctctggactagttcttttcctttctttctttttccttacctttccttttcttgcttttttttttctttttgtcttcagcaacagaaattcattttctcatagtcctggaggctcaggttcaagatcaagatgctgttaggattggctctaggtgaggcatctcyccttggctaacagacaccaccttctgctgtgacggcaacatggtctttatgctcacrgtgggagagaaagagagagggaggaagagggagagagagaagagagcaaagagaagagaaagagattgagtgctctggtgtcttcctattcttataaaaacaccagctctatgagatcagggccccatccttatgatgtcatttaactttaattatctcctaaaaggccttgtctctacttacagtcacatgggaagtgaagacttcaacatacgaatgttggggggacacaatttggctcataatagtatatgaactaaagatgtagcattaaaaaatgtctatattatactaataaagaccttacagactagttactttgcatccacaaagctacactacaagaaggagaagaagaaagatactcttactattccctccctccattgggccagccctggaggttatgatttctgttattcttaacacatgtcatagagaaatttgagttcagctgtgaagagccatttaagccttttgagaagaaatataccttgatcagaaccgtgatttaggaagataaacatgaactgctttgtgggaggtaggaagattaggagaagggagacttatcaagtagattttagagtactctaagaaaaattcgatgtggctattatgtgggacattgacagaagtttcctcagtcagtacatatttactgagtgtctacaatgtgcctgtatctactgtaacacatttatacagttctaggtgccaggaacaagtcagggctctttgttatttgcctttgataaaaatgatgacaagtcagatttgaggagctttaaacccagacacaagaagacattgttttgatccaggcagacaagtgacaaagagcaagcgcagagagtaggaatggaataaagtcttggagttaggacaatgaagcaatatctacaaaggacaagccgttggttacatcgctgcaggcaaaataatgccaaatggacagacatctcaaaatgcattcctctctcgtccaaagatttcacctcagatcgctcagagatgttttttcttttatgcaagttaaaaatgcagacaaatggaaataatgctgctttatgaaaattcaatctttagctacctttattagcacatatctgttctatgaaacaaatgttatttgtccatcctagctccatttgtccttgaaataaatatttggccctagctcctggatttcttaggaaattcaatttattgctggacatgtttcagtaatctgtgaatgaccccaaattacctgttcataagagaaggccaggcctggatgacaaacacagaaggcttttcatttttcccatgacttccttttttggcaaaccatcctctttgtgagagtccgcctccaagttggattagaagatgtcctggagcgtgcagttcaccacccactatattgtaagctgaaagtgtttttgctaactgaatgtcaaattaatgmggttttgctatctacatggcatgttttgacaaaaatactgtgtacctttattgacagtgaaccttctgctcyggagtaatgctaatccargactgctggtttttcatgttaaaacccataaacttgttattagagcagatgacttccaaaacgtcaaaactaaagatgttgcttattcactagaggagtttatgttgttcacatttaagatgatttatttttattcacttgacaacacttcgaacttcaaatggwtgcacacaagccaattcttggagggttgtgactgcagaaaaaaaattaaatcttgtgctcatgtgttgctccatcatagtaatcctcagttttgtcccagaagtagcatgtgtcacttccagtgattcaggaccagctggtagaaaggacggacatttcatgctgccatgagcaactgcygtgtggtccaggatgacttttccaaaagcttcactcactgctcctcagaccacgtctgtttttgtagaggcaaaatgagatggctgagagaattgtggactctggccaaatgagtagtcattccctggctgtaagtgggtgaaagagaggtgacagaaccatttttactgcagtgcagtgtgattaatctgtgtcttcttaatgagattaaggggaaaaacaaactttttttttaatttttttttttttttaactagctctcctctatactgcaagttaaacaacttattctggcagaaggttgaaagaagggaacaattgctcctttgctagaaattctcttcattaggagcatagcctttcaaaaaacaatgccactcatgatatgcttcagattctatataatcatctcatgttgcacttctyctaatttattttataaaagaagttcttttttggtgagagatagattgtaaaactcaatgtattcttattcttttttttttttgcaattattcctgaatacaaaacttaaaaaatgacaccagggctttatrtctagagtagactgtgaaaaaaatgaatacacatttatttgggaaagatattggtggtcattatgccaattgacatatagttgtcatcactgatgtaattttgcatttgtttgtgtaattatttaattaacatctgtttctcctactgtagtatcaggttcttttttagtgagagatagattgtaaaactcaatgtattcttattctttttttttttttgcaaatattcctgaataccaaaattaaaaaatgacactagggctttatatctagggtagactatgaaaaaaatgaatacacatttatttgggaaagatattggtggtcattacgccaactgacgtatagctgtcatcactgatgtaattttgcatttgtttgtgtaattatttaattaacatctgtttctcctactgtagtatcaggtatatgtagaggtaatcacagatgcatcggctcaacactgcttttggagggctgcacacaaccttggcacatggttggcactccatttgtatgtttgttggtgaaaggatgaatgaatacctataattgaaattttatgcaatttattttttatttttgtagtgcttgtccaagcttttttgagcacctctagctatagagaaaaagttttcttcataagggtgctcaatgtgttttcagaagttttggatattacaaagttttttcttttattgaactgatatatgttcatatatagactttaccatttaaaaataaaataattgtatggaaaaatgactgatattaagggacaaccttctttatgtaatttatgtcctgattaatggacttttcttgtttgggattcattccttttcattcaagcattgttcacaaaactggattagttgttaattacaaatggcctaaactattttaagaaagaattttattatggaaaaataagagtactataaaaaargtcagttggggtcaccttgtctattgcaactaaaatagaattgactcagagctacattttcgtcacctccttttcctacctctttcttggcccccttrttctggccttagattactctgcagaaacacaggcaccttgttttttttttttwatgtggaaaaaattaggtttctttttcttattcttccactattccagatgaattccgtgtctattttctaataaatgttaactattttgaagagaaatgcattactcccatagaaagaacaaatacttgcaatcagtgatgttttacacttactrtttctattttaatttgtatttattataaaaataggggatatgtgcacacttgaaaacattctcgttgtgtaacattagagtattacagttaaaactgaagccctctttaagcagtaatacctctattattaagcatttaaatatatatgcatatatacatatatcattgtttttatgggttttgatatgtggtacctcaagactctcttctctctatttttccaaatcaatatcagtgaatcataaattttgcattttcatatatgttcatatatatttctgatatatgttgtttgtttttacttttgaaaaataacaaccctattttgattacttcacatcaagaagtctgtttcactcttacctttagattgttctgccttcaaatacaaacattttacttgaaactgtggcagtaagaactctggagccaaaggctagtttcttcttcttcttcttcttcttcttttttttttttttttaaatactttaagttctgggatacatatgcagaacgtgcaagtttgttacataggtatacacatgtcgtggtggtttgctgcacccatcaatccgtcatctacattaggtatttcttctaatgctatcccttccctagccccccaccccctgacaggccccggtgtgtgatgttctcctccccatgtccatgtattctcattgttcaactcccacttatgtttattgcagcactattcacaatagcaaagacttggagtcaacccaaatgcccatcaatgatagactggataaagaaaatgtggcacagatacaccatagaatagtatgcagccataaaaaaggatgagttcatgtccttttcagggacatggatgaagctggaaaccattattctcagcaaactaacacaggaatagaaagccaaaggctagtttctaggcgctcttttggtttgattttgaaatctgaaaaatcagcattgaagttatakgtgtgtgtgtgtgtgtgtgtgtgtgtatgtaagaaaagttcagtaaacacctttagcacccaaattaaacactagttagcatttttctataatatatttttatgtttattcatctataatgccatcatagatttatgtattatctgcttataattttttctgaattatttgataagttgcaggtatcatggcattctacccccaaatactccagcttgcatttactaaaaataagaacattttcttgtatcaacataatgccataatcacacccaagaaaaataataatttcttatataatatctaatttaaagtaacattttcctattatttccagaatatttttaaagctagataccttctttgattctatgccaacaaaaattcagacaccctagttatgtctctttagtctcttttttaaaaaatcacatctattaagataaaatttgamttcaatgaatcgcacccatttaaagtatacactttagtgcatattgcccatacatgcatgtttgattctaacttcatgatcaagatacaaaacaatatcatcatctccaaaatatttcctcatgtcccttgactattcatctctccttccatcagcccataggcaaccactgagctactttctgttgttaaaagttagtttgcatttcctataatgtaatataaaaggaatgttgtacattgtactcttctgtgtccaacatcttttgctctgcatgcttttgagattcatccatgctgttgcatatagtagtacatgtatggatatatcactatttccttcaccattcaactatggatggtcatttgagttgtttccatttgaggctatcatgaataaaactatgatgtatattcattcctaagttttcatgtaggcatgtgttttgtttctcttgagtaaatgcaataatacatttaattttagaagaaactgcgaaacagttttacataatcctcaacaatgtctgggagttctggttactctgtatctgtcaagacttgtttttttcagagttttaatttagccattctaataatgtgctcaactttcactgatatcaaatttcagttaaattttactagtatcaaatttcactgataagtatgttttgaatattttcatatggttattggccatttatayacattcatttggaaagtgaatgttcaaattttatcgtatttatttaggaatttgtcttctcattactcagaagaacatttatatattcttgataggaatcctttggcaggtatacgtattgcaagtaatttttcccattccatagcttgccttttacttttcttattgtatgctttgaaggtaaaatgtttatggttttgctaaaatccaatttgtagattattttttctttaatggctcatatgttttgtttgctatataagcaacctggtgttttcttcttggaaaatgttttattacaaagttattgtttttatataaaaatatatataggtttattaatatttaatggtttattaatatttttcttttttgtcagtttttatatttctgtctttcagtgaatttatccatttaatctaagttttcaatttattggcatagagctatttataatattgtcttattgcctttataatattcaaggaatctctagttgtgctcactctaatttagaatattgtaatttgtttattacttgtgtttttaacataaatgtttgtgtacattgttgtttataaatttcagtgatctttccaagaagtcagcttttggcctcattgatttttctctatagtttgtttttttatttcctttattttagcccttatatttattaatttatttgtgccatgttgtgttcttcttttcctagattcataaggagaactcttagatcattgatttttagcattttattttgttattattttgcttaaaatattttttaaatttatttgtgattccttattttacctatggtttagaaacaagttgtttgttctccacatactgaatgtatataatgaatgttctgtcaaagtcgttaagtagttcttaaaatgaaattaacagaagagggagctttgtaaaggtaaacaaggatttctgaacttcaaaattatggatcaagtaattttctataaaaataagcatagcaaaatatttaggcccaatcccatagtaagatattgtaagacaaaagagaatgagacaaataacatccctagaggtaataaaaactagtcaaataaaataaataaaaatatcaacttgtatttcaaaactagctaaatgacattaagaatataatgcaaaacatggaataacattataaaacagaattagaaaaactcaaaaattaggcactataccatagggaaaaatagaaatgaaagaaaataataatttcagaaatgaagactaaactagaaatatcaaaagaacaaataaacacatggataatgctttaagaaaaaccgaagttgaaagtagaaaaaaattgagaaagagaaatgcagaaagaaatacawataatttgagagagaaattgaaacgtggaatatgaataaagaacttcttaaatatggttaataggcatctctaaagaaaaaaaaagcaagggaaagaactgatactaaaatctataattcagaaaaagtttctgcagtgagaaaaagatgaaaaagatttcaaactacgtgttgaaacagcataccaaatgccacattgaccagaattaaccaagaccaaaatatgttctaataaaactaccagattctaaagaaaaagaaagaaaaaataacaactgggcatccagaaagaacagtaagtgacactggaaaaagaaaactatgttagcatccctatttttggcaagtatagtttactccagaagaaaatgaggctacatagttcatgtggtttggctctgtgtcaccaccttgaattgtaatccccacgtgttgagggagaaacccagtgggaggtgattggatcacgggggtggtttccctcatgctgttctcatgatagtgagtgagctctcatgatatctgatggtttaaaagtggcacttctgcctttgctcgttttctcctgccgccataaaagacttgctttgcttccccttctgccatgatttaagtttcctgaagtccctgcagccragtagaactgtgagtcaattaaacctccttcctttgtgaattacctagtctcaggtagttctttttggcagtgtgaaaacgaactaattcagcagttaagataatcaagaaaaaaataacttgtgagcccacaattttctatctaaaaaaatcaccttccagtataaaaggcgtagacaaactgttatctataaggaagaactcagggaatattgagtaatctaataaagaaacagcctaaaacaaccaaaatgcctagagagaagagacaggtggtacacattaaacactggtgggaagcattaaaaacatagttacttttgttgacaagtcttactttagtacgaagactagaacaagtcttagtgtagaactatgactaaatgcaggttaatgggggaaaagtatgaaatgtaattatatatagagagagagagagcgcgaggggagagagagagtagtgatggacaatcaaattacattttcactttaaagaaaataatatactatagtgatgtctactagtatcttataagtaagagtaattataataatattagcaattgccttgctgcttctgtgccaggcataattgggtgccatgtatcagggtgatccttttccccacccagggttttgcttagatggttctcccttaaaaatgcttttgccactgtcttctagtttcccagcccttcccttttggtggaaggcttccaaaaccaagactgaaagtcaagtttgtttatgctgatgtgtactctctggacatttttcttgtaatagaaatcagtgttattttattttacatcctgatattttatatattttatctaaatttgtttgaatatgtttggtaatttacatatgtagcctttagcttacaaaaaaattaacacacacattaaatcttcaattttatctaatctaatacactgatgagattttgattctttaggttggctattgacctaaaaacacatttttgggatatgtcgcatgtaagcagcaacagtttctaatgaaatcttcttggactgactatcaacttcaaattcttgaagggcaaaccacatttacttagtgtctggttgggtctagattcatcttaaaaaatcactaagaaaagtaaaatcatgttcgaaagtccatggaggtttcttgtctttctttctttgaactactagaggagctgtaatataggaagaaatattagaggatttttttttattttaaaaactttggaggcatacaggataaactttcaataatggctaagtttatgaaatttaactgaaatgtgtgtactatatatttagttgtaactgttgattttaaaaaaacgtatactagttggttctaatcagaaattgtcaatatttatgtaatgtaagtgactaaaagttatggaatacaaaaaagtaaacaattgtttacatgatatgttttcggggctctgatatttctgctgctgctccactgaattgcagtttaacttagctgtaacttaaagyttcagtttcagtttttgctaatcattaatattcattcacttattcagttcttaaatatttatccaggtcctgctacttttgtgggtgtgatattgtgctgttttaaagcaatactctggaaaggattaaaaagccattaacaatatagagtgaagtcaaggtcagtgagtaggattttgcagaattggaagtaagacatttgcactcgaaaacaggggtagttggtttctggaacacgctacacccgattacttcatagcgtatttttttggggggggggatttactttatttcttaagtagtttaggtattttattagtgattttgatttttcttgaaggttttattttttttattttgttatttattttgttatttatttatttatttatttatttatttatgttttttagacggagtctcgctctgtggctcaggctggggtgcagtggtgcgatcttgactcactgcaagctccgcctcccaaggttcatgccattctcctgcctcagcctcccaagtagctgggacaacaggcgcctgccacaggcctggctaattttttttatttttttggtagagacggggtttcaccatgttagccaggatggtctcgatttcctgacctcgtgatctgcccacctcggcctcccaaagtgctgggattacaggtgtgagccaccgcgcccggccagttttatactttttaatttactctccaatattcaagacatacaacatgcacatcttaaaataagttgtgtatctgtatttaaagaacgaatttttttcaagttatttcttagaagttatttatttgaagagattatttttaatcatatggttgctgttgaataaatttttaaaacaaaatatgtaaagaagtacacaaaatcattttcagtaattctctccttatccaagaaggcaagttctatcttaagaacctgcacagagtaaatattcagtacattatctatcaagtagtgtgttattcactgcaaattgaaaatcatcaaattcctarttgttctgcttaatagatgcttaactatattttagcagattccaaatatatgttaatatatatttttggaattcagcatgagtatctttagatgctaattgcaagttaatctttcttcctagaatgtaagttccatggattataaacgttattcctattgcagattttctaaatagtgtttctgctggtgaagtcttcttcactctctggtgcttaagattagaaagaaaaaaggaaagtaactgaacaaaagaaattctttgaacatgaaattatcaaatgaaactgtacatatgcaaaggaattttaaaccattgccttgcaaagtctttttttgcataacaacgttttgataaaatgaagagactgaccaaagtaacaactctaaataatrgcatttcactgccataaggatgattgtaattatcagtggaagcctagagcattaggtcccaactcctaatattagtttcaayttttatagcctggttgttcaaagacatkcaattaaactaacctagtattattggaatagaaaataaagaactactgttggaaacacaattaacaatacataatagaggggccatatttccaatggctgcatattaaaatcaacattgagctaaactaagcataggccaaagctgaatatcatcatcataggacatacttctaggattacaagagtgtatctgaaagtgactaccactttaatgatattaattttatcattaaaaggttttatggtcaaatttcaaaatcatggcattgtaatgtagggtgaaagttcctcagcactgccatgtgattatttctgcaatgaacctgctgcacatttgccattctaaaaggacactgactttcaacttgtgtctctggaagagccagacccacctctgctagtatagcttactgctaatagtcatgctgcagtaacaacattatcaagcttttctccttctctcaaagaaaatgattcaggtaatgctttgcttcctttgcaacccagggattggacctactgtcttcaaacaaagctctgtgcagtgttggtagaaatggtttctgaatatttttagaagcagacttaaaactgtagcatgatttcttgtattttccacaaatgcacttgatgctttactcattcattgagatacgtaatccttcaagtctggatccttccctatatttgatgttaaataaatgttaaatgtattggttaaaactttttgattagaagttaagtgtaaatccaaacactaagttttgttcatattattcacattctgaaactcatttggtatgatattaaactttataacagagaagactttgcagcaggtaattgagtattatgatttccaatgctgaagtacaataaaagagtttggctaagcatctcttggctaaggcctaacattagtgttttcctaatatgattcataaaacattcttttctaataaaaacaatctatttggctgctactttggacaccttgaaatcaaagaagattaaatattccattaataatgttaaattagtaaagtaggaaatggtccaattgttcaaatctttgcctattttccaagttaaaaaataagccactaaggmaacaaagaagaaataatcagagatagaaaggcattcagaaaatagtgtgtcagggaagacaaagatagtttttcaaagaaaaaataactggccaacagcatcataatcagcrcagtctaattaaacaaatatagactaccgttcttgtatccacagcacaaatgtcattgtcaacgttgaaaagaataggttcagggagtaatgacagcaaaagtttggaaggggagaaccattaatgggtggggaggaaggagaaacagcaggcataggctactctttccagaagcttgggttgggaaggaaaggataaaacaagaaataggtacgtaagtcttagaattgagaaaggttgctttcatgtttgcttttgttttttagaagaagaaataggtaggaatggttttaggttgagggcaacacactaaaagataagacaatttaaaagtgtaagagaaagatggatccaaatccaggaggaaatagaagaaggactccaagattcacatacaccagtaaggaatcaacaggcagtttcctgtttcctctaaaaatggaaagaccctggaaagggtcagtgcagaggttggacagtcacaactgacaggaccagtgagaagaaatcttagttcatgatggcctccatcttcytgatgaagcagaaaaaaaggcagcctgttagcactgaaaaggctgaagcttaggaagagggtgttaaatgttcataaaggtcaaaaagttgaaagaaggtgttggagggttttttaaggccgtaaagggcttattaagctgtgttgagtgctcagagaaatctggagaccatgattttcattccataaatctgcacataagtacaatttttttccagcagtaattattaatccaggtgkagaggagagattgtgaaattaacccagggtaaaataaaacagtgtaacataagatgttctggtggtgctacagcaaggagagatggagcatttgtcaaagatgattgtgaccaccatgcttatggccttcattctgtagctttgtttgtcatattcctcttgtcttcacagtatcttcgtcagaagcatcattgcttttactccacttgggattggctttccataattgaccccagaaagaggcttttctttctctgctgtcattggcccttagctgcattatgctcaatatatctacgtggtgataatgccctattaaaggtgaatcttcacagatgatattttaggaatcttaagtatgtttttattaactcaaaaaaaagagcaaactttcacctactccagcagaagactaggaaaagtgtactctgatgttacccagacattaccttttgatgaggcttcacccactctttcagagctccaggaggctgtgttcttctgggagtgcttggagttaatgctagaccttatagttagagaatatgatgttagctggcagagacatcctggtcaaattattttagtttaaactttcaacctctctcaaaacatctttgaatccctattaaattcatgaccagacagttttctaaaattcctctgacttgagaatctaggctgactcagagcttgtccttgtgaaaactttatctaaacttaatctaggttcagactctttccttaaggataagttgagagttcatatatcagaactgaaaacatgttgaagctaattgacataatcttcacaaacaacaacaatgacaataacaataacaacttgttcggagatattcttaagctcttcaaagatgatttgattccaaaaacttttgcgaagagtctgaaaaaaatttttccttgcaaaattttgcaattcgaatctcttcttcataatcattcttaaaagtccaagtgaaaagttctcatatggctgttaggaactataagttgaatattgataattggcttaatttgtgttgaaatagagtttttaaagtatatttctcatggttagttctgtactttagcttttgaaatagattttgtgtttgatcctcaatttattctctttaccttaaatatgaatatctggggaaggttggtggcccttttctatctttttttttaaattatactttaagttttagggtacatgtgcacattgtgcaggttagttacatatgtatacatgagataccatctcacaccagttagaatggcccttttcttttaaaaggactctgcgtggcaaataatcaaaagactaggctatacttgtttcttctaaaaacagtatttgtaccctatccctccctgaagtcaggcttactaatagaacaaattgtatttttatttttaacttctagacgctttcagtttccagaagaggaaatataaaaaacaacaactattttcaccagagtgactaatacaggaaagattatttagcataatttctaaacatatataattgtaaaataaataaccatgagggcacgcattttcttgaaagcattattgagaagaggcaaaattgagagcaattgttgaagctgagtagtattgtagaaaagagaagaccatggatattaagattgagtataactttatgatttgaggcaagtcagttggtctccctgttctaaatgttggctttctcattctcaactcataagttgtggtcaataattcattgtgctaataaatttgaggacctaggtacaatatgtattcctttcttaccctcaggatttttaatctgcctcataaagacttctgagtaaattgatgcaagacttctattatttccctatggttgtctcactagtaaataatacctttcaatacagaagatgatttctggtcaaattaatttactataatctcatattaatwattatttccagaaaatatctggagcagatgtcactggagcatatttaagaaatgaatggcatttaaaggtttaatttaaactgatcacatttaataaacttttaatacatagatattctttgcttatctctactttgagaaggatgcttttgtctgtgatgaaaacttatctacattttaaaataaaccatttcctaaacctrttctagcacccagtgtttctattccccattgtgataaaacgtatgtaagcatatagaggtgacaaggttaaagtcgtaccttctctaacattcaataatcagtctcctgagacatgtgaaattcatcatattctaatcaacttgtatattatcagccctgaaacacaaatattatatcagctctgactgcctcaaaccacatcttarcagtcagagactggctctccaggctattccatctcatttgagaagaaaaccaagaaccaaaacaaattttggtcaagtaacttaggaaatatttaaaatggaatacatatttccagtaacaaatggatgatattaaaataattttatatgaaacttaatctttagaaaaatataacatttcaaaggaaggctttgaactcagtcatgaagtctgatgatatgtggcaattttgggatgctgttgctcactgtggccttggaaaaggtcaaattaaaatgaaagtgtacattttaaatgacagtttgtttcacttagcatagagcagtatggtacsttcactaaacttcctagattcaaggttgattcaatcatcttaacaaaactaaattattaatttaaaaacacacatttttcatgtaaagcagagggttccctcttatttcccagagaattaaaattgtcatgtggatcacaatgtattaaattgctttgatcaactcccagtcatttttaccttagaatgaactttacaggtagtctatatctttagctttgtttaatggattctaagattgtttgcatgaagatccactgagttttagtcattatgattgacaggtggtcagttgcagcttaatcaacttaaagaattatacaataatttcatgaagaactgttaatcctatgtcaaactttggttacatagattaaaaactatgtttggatcatgctttaaagtctcacactaattaaagcttattaataatgtctatgcacacatacatcataattttatcagtattaggataaataagttatttgtaagagtcatttgaaggataattataatttcatgtatgtaaaacaggtttttgaccgagactcaagttttaaaatttatattggtgtaactaaggaaatgtatagtaggaaaataggatttgtagagwcaagaactagatccatattctacttttgctatttatcagtggtgtgcccataagcaaatagttctaaagaagatgaattcttagttctaaagaaggaaacagtttactggggttggggggccgtgtaaagagatgataacagactagaagtaatgaatatgaggaggcatactggggggtctagaaaagtttcctctcccatttgagggttaagaaggctttcaaatagtaaacaaaaaggaagaaacactggcttacagttgttggtagaaatgaaaattgcttataaccattttaaagaactataaggccatatctatgaaacttatgaagattggattttttaaatttacctttagaaattcatttttgaaaaacataacacgaacataataaacaaaactccagaaaaaaaatcagcacctgaaagatctcaccatagaactataaattatgaacaatttttattttacaaaattaaaaagaaagtgtttcattctaataagctaatggatatgttaacttcctggaaataagagctcaaaggagaaatgtcaggcatgtaagggaaaattacatgagagcagagataagttcttttttaaaaggatttaagaaatacttacatagtgtttattatgtgacaaacactcttaagcagtttatagtyattattttacatagaaattctgtaatgcaaatactaccattttctcattttacagatgaatattctgtgatatataaagaggttaaataacttgctcaagttcacacagcaaatccatgtagtggagctttaccatcagtggtacggttgcggagtgtgtgactttgagatttatgctgtgctgcttcttttttttttttttttttttttttttaagttttagggtacatgtgcacaacgtgcargttagttacatatgtatacatctgctgtgttggtgtgctgcacccattaactcgtcatttagcattaggtatatctcctgatgctatccctcccccctccccccactccacaacaggccccagtgtgtgatgttccccttcctgtgtccgtgtgttctcattgttcaattcccacctgtgagtgagaacatgtggtgtttggttttttatccttgtgatagcttgctgagaatgatggtttccagcttcatccatgtccctacaaaggacatgaactcatcatttttatggctgcatagtattccatggtgtatatgtgccacatttttttaattcagtctataattgttggacatttgggttggttccaagtctttgctattgtcagtagtgccgcagaaaacataggtgtgcatgtgtctttatagcaggatgatttatagtcctttgggtatatacccagtaatgggattgctgggtcaaatggtatttctagttttagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatacttcacccactttttgatggggttgtttgtttttttcttgtaaatttgtttgagttctttgtagtttctggatattagccctttgtcagatgagtagattgcaaaaattttctcccattctgtaggttgcctattcactctgatggtggcttattttgctgtgcagaagctctttactttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatacatcttgaattaatttttgtataaggtgtaaggaagggatccagtttcagctttctacatacggctagccagttttcccagcaccatttattaaatagggaatcttttccccatttcttctttttgtcaggtatgtcaaagatcagatggttgtagatatgcggcattatttctgagggctctgttctgttccattggtctatatctctgttttggtaccagtaccatgctgttttggttactatagccttgtartatagtttgaagtcaggtagtgtgatgcctccagttttgctcttttgacttaggattgacttggcaatgtgggctcttttttggttccatatgaactttaaagtagttttttccaattctgtgaagaaaatcattggtagcttgatggggatggcaattgaacctataaattactttgggcagtatggccattttcacgatatcgattcttcctgtccatgagcatggaatgttcttccattcgtttgtatgctcttttatttcattgagcagtggtttgtagttctccttgaagaggtccttcacatcccttgtaagttggattgctaggtattttattctctttgaagcaattgtgaatgggagttcactcatgatttggctctcygtttgtctgttattggtgtataagaatgcttgtgatttttgcacattgattttgtatcctgagactttgctgaagttgcctatcagcttaaggagattttgggytgagacaatggggttttctagatatacaatcaygtcatctgcaaacagggacaatttgacttcctcttttcctaattgaataccctttatttccttctcctgcctgattgccctggccagaacttscaacactatgttgwataggagtggtgagagaggacatccctgtcttgtgccagttttcaaagggaatgcttccatttttgcccattcagtatgatattggctgtgggtttgtcatagatagctcttattattttgagatacrtcccatcaatacctaatttattgagagtttttagcatgaagggttgttgaattttgtcaaaggccttttctgcatctattgagataatagayggtttttgtggttggttctgtttatatgctggattacatttattgatttttgtgtgttgaaccagccttgcatcccagggatgaagcccacttgatcacggtggataagctttttggtgtgctgctggatttggtttgccagtwttttattgaggatttctgcgtcaatgttcatcaggsatattagtcgaaaattctctttttgttgttgtgtctctgccaggctttggtatcaggatgatgctggcctcataaaataagttagggaggattccctctttttctgttgattggaatagtttcagaaggaatggtaccagctcctccttgtaccactggtagaattcggctgtgaatccatctggtcctggacttttttttggttggtaagctgttaattattgcctcaatttcagagcctattattggtctcttcagagattcaacttcttcctggtttagtcttgggaggahgtatgtgtcgaggaatttatccatttcttctagattttctagtatatttgtgtagaggtgtttatagtattctctgatggtagtttgtgtttctgtgggtttggtggtgatatcccctttatcattttttattgcttctatttgattcttctctcttttcttctttattagtcttgttagcagtctatcaattttgttgatcttttcaagaaaccagctcctggattcattgattttttgaagggttatttgtgtctctgtttccttcagttctgctctgatcttagttatttcttgccttctgctagcttttgaatgtgtttgctcttgcttttctagttcttttaattgtgatgttagggtgtcaatgttagatctttcctgctttctcttgtgggcatttagtgctataaatttccctgtacacactactttgaatgtgtctcagagattctggtaagttgtgtctttgttctcattggtttcaaagaacatctttatttctgccttcatttcgtgatgtacccagtattcattcaggagcaggttgttcagtttccatgtagttgagcggttttgagtgagtttcttaatcctgagttctagtttaattgcactgtggtctgagagacagtttgttgtaatttccgttcttttacatttgctgaggagtgctttacttccaactatatggtcaattttggaataagtgyggtgtggtgctgagaakaatgtatattctgttgatttggggtggagagttctgtagatgtctattaggtctgtttgrtgcagagctgatttcaattcctggatatccttgttaactttctgtctcgttgatctgtctaatgttgacagtggggtrttaaaatctcccattattattgtgtgggagtctaagtttctttgtaggtctctaaggacttgctttatgaatctgggtgctyctgtattgggtgcatatatatttaggatagttagstcttcttgttgaactgatccctttactattrtgtaatggccttctttgtctcttttgatctttgttggtttaaagtctgttttatcagagactaggattgcaacccctgccttttttttgttttccgtttgcttggtagatcttcttccatccttttattttgagcctgtgtgtgtctctacacgtsagatgggtttcctgaatacrgcacactgatgggtcttgactctttatccaatttgccagtctgtgtcttttaattggagcatttagcctatttacatttaaggttaatattgttatgtgtgaatttgatcctgtcattatgattttagctggttattttgttcgttagttgatgcagtttcttcctagccttgatggtctttacaatttggcatttttttgyggtggctggtactggtttttcctttccatgtttagtgcttccttcaggagctcttttagggcaggcctggtggtgacaaaatctctcagcatttgcttgtctgtaaaggattttatttctccttcacttataaagcttagtttggctggatatgaaattctgggttgaaaattcttttctttacgaatgttgaatattggcccccaccctcttctkgcttgtagagtttctgccgagagatcagctgttagtctgatgggcttccctttgtgggtaacctgacctttctctctggctgcccttaacattttttccctcatttcaactttggtgaatctgacaattatgtgtcttggggttgctcttcttgaggagtatctttgtggcgttctctgtatttcctgagtttgaatgttggcctgcctggctagattggggaagttctgctggataatatcctgcagagtgttttccaacttgrttccattctccctgtcactttcaggtacaccaatcagacgcagatttgggcttttcacatagtcccatatttcttggaggatttgttcatttcttttaattcttttttctctaaactgctcttcttgcttcattcatttgatcatccatcactgataccctttcttccagttgatcaaatcggctactgaggcttgtgcatttgtcacgtagttctcgtgccttggttttcagctccatcgggtcctttaaggacttctctgcattggttattctagttagccattcgtctaattttttttcgaggtttttaacttctttgccatgggttcgaacttcctcctttagctcggagtagtttgattgtctaacgccttcttctctcaactcatcaaagtcattctccatctagctttgttctgttgctggtgaggagctgcgttcctttggaggaggagaggtgctctgctttttagagtttccagtttttctgctctgttttttccccatctttgtggttttatctacctttggtctttgatgatggtgacgtacagatggggttttggtgtggatgtcctttctgtttgttagttttccttctaacagtcaggaccctcagctgcaggtctgttggagtttgctggaggtccactccagaccctgtttgcctgggtatcagcagyggcagctgcagaaccgcggatattggtgaacagcaaatgttgctgcctgatcgttcctctggaagttttgtctcagaggagtacctggccgtgtgaggtgtcagtctgcccctactaggggggtgcctcccagctaggctcctcgggggtcagggacccacttgaggaggcagtctgtctgttctcagttgtccagctgcatgctgggagaaccactactctbttcaaagctatcagacagggacatttaagtctgcagaggattctgctgccttttgtttggctatgccccgcccccagaggtggagtctacagagacaggcaggcctccttgagctgcggtgggctccmcccagttcaagcttcctggccgctttgtttaccttctcaagcctcggcaatggcgggcacccctccccgagccttgctgctgccttgcagtttgatctcagactrctgtgctagcaatgagcaaggctccatggtcataggaccctccaagtcaggcgcgagatataatctcctggtgtgccgtttgctaagaccattggaaaagcgcagtrttaggaaaagtgacccgattttccaggtgctgtcttttatccctttctttgactaggaaagggaattccctgaccccttgtgcttcccgggtgaggcgattcctcaccctgcttcagctcacactcggtgcgctgcacccactgtcctgcacccactttccaacacccctcagtgagatgaacccggtacctcagttggaaatgcaaaaatcgcccatcttctgcgtcgctcacactgggagctgtagactggagctgttcctatttggccatcttggccccacccctatgctgtgctgcttctaaaacagtaagatgagctggcggtgttttggagaaaaatatagaaaaaagtaaaaatactctaagaattaacagtgttagaatgaatgttgtcacaagaagaatagatgcacacaggcccattgggaacaagaaacacaggcttaaaggtattagaattgaatgaaaagtaatcaagtgttacaccaatgagtagagagaaaataatatagaaggaaaaaagggaaatccaacataaacaaaattggtgcacttgctgaagagaacagaaaacrtagaataattttcaaagatgtaattcaagattacttgttgaaaatatgtacacttttatctgtagacagggaaaaatatgtcctgggggaaaacamatattttaaaaaaacgacatataattcagcagtaaaatcttccatggtaaagttagtgcattcaaaagataaggaaaaaatctaatgggagaaccaagctaaatataaacaataaaaaaagtcatcttcttcagggaatttatagtaacagccatcactggggccctctgctgggactcatggaccagcctatgattcaacaactaaagggagaaggcagagcaaagcagcaagcctctgactgttgtatgttcagattggttactcctagttaaacattttgaatattatacctgtttataattacattcctagtatgacaactactgaaggcaatccccaaagtcccacagcagaataaagaataattttttaaaataatcatacaatgaactatatcaaggtgaaaaagaatgaaatacagctacaagtagccaaatagatgaatcttacaatattatagatattacaaacataatattgggtaaaatgttatgataaaaaataatagctttgagtgacagagttcatgtagtatgattcctttatgaacgttagaacatgtgaaattaaactggtcacatgcatatttaattcaataaaactgtaaagaaaagcaaataaatcataaacataaaattcagggtggttggtgcaattgcagtgggctacaagggatactcatgattttggttttcattgtcgaggtggtggttacatggctttaatttcattattgggtgttaaacgataggtagggtttatatrtacactttagtgtgcatgatattgtggaacaaaacaattcacatggcagaaatgaaacaaatgaaaatgaacattttaagggtccaaaatcgaagtaagaaaataacagaataaacctaaaaaagtaaagaaagataatgaaaacaaacaaaaatgatagaaataatttaaaaagtcaaatrttaagtctttgtatagtcttcctgcaaacttaattttaaaaactaacaaactcataacagaacaaacaaaggtgaaaagcaacagacaaacctaacagaaaagcaacaaagaaaaaattggtaaatatattaagaatgaaactgtatacattaactatagaattagcatagaattaagaatatagcaagcaacttttatctagcaagcttataaatttagatgaatctcaatttcccagaaatattttttaatctgactcaaaaagagatagaacatgttaaactatcaggaattaaataaggtggctaataatcacaactgttttcatatcktactgaagatgctaccaagtgaagtcaaagtagcatagcaatgtgaaggaaaaacaattctcaaatattttagtatcagtagatctctataattttagaaagaaaagaataataaaaccagagaaaataaaacacaaaataaaatcctattgattactaaaaatatctcttggaaatcttacaacaaaagtcaaacccagactgcagaccaccaagattacaaaaataatgaaaatcctgaatatcagaaatgtgtttgtgtctatataacctatttatattgtttattgacttagttagcactttattttccttttagaatttattgctaattttttcttgtttgttttgtgtatgcctatattcctcctttttgaatttattatgaaagctaatgactttgccattttactagctattgaacatattaagctcacttactcatgtgattattttctaatttattaacttctgctatcatctttaattagtccttctccttttctaagaattgatatttaatgactttatttttaattaaaagattaattttattctttcttgtttagtaagaaaaatattttaaaatacagcttttttccttaacacctctttggaagtatacaaaaagagtgttgcaaataaaaaaatctttatgcatgtaaatattaaagcctagatgaaatggatgtctgggaagggtagtggggagggaactgagatggttaatgggtacaaaaatataattacatagaacaaataagatctagtatttgacagctcaacaggatggctacagtcaaaaataatttattgtacatttttaaataactaaaatattggattgttttttaatacggagaaaggataaatgtttgacgtgatagatctgcatttaccckgatatgactattatgcgttgtatgcctgtatcaaaatatctcaggcaccctataaatacatacacctattatgcacccacaacaatgaaaaagaaaaattgctttcttacattaaatatrtgtatatatctctgtgtgtgtgtatatatatatatgtgtatatatatacacacaygtatatacacatacacacacacacaaaaagagataaagcaaactctaaaaaggtttattaaccatagttaccattttagatgtttaaaagtcttgttaccaccaagtgcttaaaacaagacaaagtgtttcacagataaacattataaaacttttaagaataagtttagttccttcttaaattctgttagaatgtagaaaagaaggtcaatttccaaagtttattcttcaaggctgcaaaacattgactatatccccagataaatatgacaatacaaaacactataccaaactcactggattgctaagcctttgagtaatgtattagcagatagaaataacagcatgtttaaggatactatgctattactaatggtgtcagtacaaaagagggaaggctggcttaatcttagtatcttttaatatcattttccatattgagagatcgatctactttaaaaatcctgtgatcatttctacagagattgaaaagctatttaacaaaatttatcttaatctatgccttaaatgtatgaccacaatttaaaatgggtgaatattttctatatatgaaaagaatgcatatcatagtcttccccaaaaagcagcattaagtttagtgcatttaagtgaagaataagaaacatatatccatgtctgttatcattttaaacattgttttatacatagaagggaaaataacaaaataagtaaaaaattgtcttcactatttaactatcattaacttgataaagatcttattatatagctaaagcaaaagaaaacaaaatatctgaaacaaaaggattattagaattaataagagaatatagtagacaatttattgaaattgacaaactgtttctatattataaattattgtatatctgtgaatttaccttacattaatctttatgtttaatgtgattaactactctctccaagaaattccaagatttatttttggaattaaataagctgagttgaaaaataaaggcttaaaatgaagaatacaaaagggacatcagacctaccaattattttttaaaaatacattattacacttgaacatttaaaagtctggcagtcacacatgaattcacgcataaattgagatcagcagatatcaacataagattatacagagttgagaaaaagataaatattcaggaatgtagtatttaacaaaggtgactttaaataaatgagaaagaaataagttgttaattaatggtccttcaaaaacctgtctagccatatggaaaaaataaatatggacagtaaccatattttatggacatacgataaccatattttatgtccatatttatggacagtaaccatattatcttacagtataaaatttccagatttatgcataaaatcaaactttcaagaagaaagcataagagaatttgatcatatgatttaggagtgtgagaaactttatatatgtcacaaaacttagaattcataaattaaataattttcaagcaataaatattaaaattttatggaaaaatgccatttattaaaagtcaaaagatcaaaaataaactgaaaaatggctgcaacatgatggaagtaaaaggctgaaaacaacatacagaattgaatgcccagaaaaataatgaaaatgttcaagactcagtagaaaataagccaaatatatgaggagaacttctaagaaaattttttaaaagattttttatataacaaaaacgatttataaaccaatgagaagattttgaatcttattcacagttgacacatgtcagtgaaaatatccagtataattttcagtgccaagattgacacaagttatttggtaattttttttttgttatgtgttggtaagtgtattcttacacattgtcggtgaaaataaatttaatataactttgaaaacaaatctggctatatctattaacaatgtattgatatacatagctttcatccgtaaattcaacatataataattgatctcagaggtctagtcacacttctgcacaaagatgctcctgtaaggaagaatatttatgatgatataatttgtagtggtaaatggtcaaaaactagttagttaataaaggactgctagatgattatggctatatactatagtcacaaattatgcatctattcaaaagaataagtctttttctatgagctgggatatagatatgtttagatattgggagaaaattctccatgggcctcttgtgtttgcatatttttgtcaacataggccctgactaattttgttccagactatcttttcatggctgtttgttcagagaacagcctgggaagacagacatggtgcctgcctctggagaaaaagagtatatttatagcataatataataaactactgtctccttctggggcaaaggtcaggaatacttactgcccactgtgaaagagcagggaccccstatcctgagggttcctctcctggaacacaaccaactgcatgttcaaacaccacttggttctcattgtgttgccttttgggaagtaaaacttgataactatctcaaattgatattccagttactgatcttgccattataaagccccttgacgctgattcaagagtctcatgtcttctgccagaatccgtgaaactgtggcaggctaatttgttagtttgaaagtaaggtgaaatctaatcccagtcccctttcacagttctcaacaaaagttctccaagatatattgtaggtggaaaaataaaccaaggctcagagcagtatgtatggtagagtaataaatttaagaaaactgataagtgtgtgcttgtggaagattaaacttcacattctttatcttgaakgtgcaaaggaaatatttcttttaattcctttctattttctctgatgtttctcatgagctttcttcctatttttcaactgctcactgaatgccaggaaaaaaaatagaacaaagcttaataaaacataacttagttcaagcctacttaaaacttagtgtgattcagtcatgtgaagaatatctttaggtttaattaacattcttcagaatacatgttccagtcttgttcttttatttgcttcatcgcttcttggatgcactggggtgtatggattttgctgaccctctgtcatcatgtaggcatgatggagaggggtgaggatacagaggaggatggggagggtaggagaaagaagagaagttgtcaaaagacaaagaagcaacaaatgaggtaaggatttaacaggcaattgaactaagcagtgaaaagcatattagtttatcttagagaaatgtcagtaggatggtgggaataaaatctgattgtaaataaaaggtgagwcttggaatgaaacctaccttcgcctaatgtagtactgattatattttgtaaagaacaggagacacttgctcagttgtatggtttaaggggaggtatcgaaaatgaagccaaggttgaaatagagaagagagaggaattcgggacccaaagaaccagaaggcaaagaagtcaaggctccttgaaaggaatggacctagacatggccttgggkgctggagaaaagggagcaagatggatcaggaaggaagttcaggaagggaggggatttctgtcttgctcctcagctccagggtacctgagctgggtaagtgacttgagaaattggctaaaaatttggaggaatcatgaaaagacattcaccaagaatttccttttctagaagtgaggatgattatgttttctgtttttcatgccattttgcaartcaaagtgatttttaactcagaagattaacatatgcttatgttattttatgcattataaacttggtaaagctattttccaaagtaaatattggtatgccaatgcaaaaggaagacaagatgtattatctagaatgattaaaaatgagatagtttgtaaatgtaaaactaagtgaagattatctatcatgacagattttcagaatgtggggtgatatagcccatgggtcaagagcagggagggcagccttgatgggggtggtgagttttgaactgatcatattttcatgggaagatattcctttttgtcgaagtgattkccaccactgttttcatgctctttcctcaatctccaagctccttggttttaaatggcttcaaaacagctgtgcatactggccactctagcaacctttccttaactgcatacctgagtacagtttgcagtccctttaccaaaatacatgatttctatgagagttctacttgctgaatgaactgtgtccagtgtttagtcctcaagaaaggagatggggcatcagaacagagagagagtatcatatcctgcaaaatattgcttggcttatggatttattctcaatttaatttttctgtctactgatctaggtgtttttttttaaatagaatcaaaagtgacaattcatttgaaatatttctcccttgtccatgaattgctttgtaaatcttgtgagctacttcacgagttatgaagtttttaagaataaatagcaatgaactcactttagtctccatgccaaatgyagatgtttttgtgatagctgatcttgttttgtaggaaaactcttgccttcaagtccttctattggctttcaagagaataatttccttgttttaagtcagatcaagcaaactgtcaataatgtttattaactacccactttacaacagcttacagtggaggttccctagggagttagagttaatagaaaagtcattgcaattagaggatttacaataaagttaactcaaaatataaatgtttgttaattttgaactgagtgagaaggaaagaaaaataaattattgcaatcttctccttttcagttgggtgaggagaagataacattccaaagaattgagtgatcataacatttgtagatcataaggtgattattggtaatctttgtgttagccatttcacaaatttatttgaaggagcagtaaaaatgttctctctgtctatgaaacatcttctcctcaggcatratttgtcagctttgtgtgggggattctttacacagcccactggaattcagtgatgcaatgttgttagtaggagaggactgacatttttttcagacaaagaaagtggtcttgttttttagacaacaaactttggggaatggaggaatcccaagtagaattagaaagagaagtcatggagagacatttggcctgttacttagtgattgcctcagctgtgtgtttcattatatgggagatttctattgcttttctttcctactgcctttagacacatgttagcaaggagaaatatatacttttgttaagaactttttgccttctgatgtaattttcaggatggccctgggtatgtcaggtacaatattcagatttaattatttctcccaagattcatgtaaatttcaaccctcatttatgaggtcacctcttaagcatatatattaaaatgcattaatatgtcaatgtgtggcagttactttttgaaactgcaaactcagaaacgcaaaatgatataccttcattttcctacaatttttgaagactgtaccttgagtttctgccttggtttgcaagggttactataacagagtgccacaaacgggatggttttgaattacagaaattttttgtcacaatgttttggagaccagaaggctgagatcaaggtgttggcagacttggttcctcctgagggttatgcgagtggctctgttctatactcccttgggagcttctggcggctgatgacccttggcttgtagacacattgccccgatccctgccttcatcttcacaaggcattctcggtgtgcctgccgctgtgtccatatttcccccctttttttgagacagagtttctctcattgcccaggcagaagtccaatggcacgatctcggctcaccgcaacatctgccttccaggttcaagcaattcaactgyctcaacctcccaagtagctgggattacaggcatgcaccaccacactcagctaattttgtatttttagtagagacgggttttctccatgttggtcaggctggtctcgaactcccaacctcaggtgatcctcctgtctcggcctcccaaagttctgggattacaggcatgagcccccgctgtgcccggccgaggtttcccctttttataaggataacagtcatatcagattaagggcccacctaatccagtgtgatctcaactaattctatctacaaccaccctatttccaaataaggttacattctgtggtactggggtctaagttttcaatatatgaattgtaggaggacacaacttagcccataacagctctcagtccactgatgacagaatgttattaaattccatttaggttgctctcaatcaatgtggattttcccyggagtcaagacaataatccttgggagtaaactgttcacagttcacagggctttgccactgtcacctggtccctgcttatgtctcatttctctagctgctgtcttacacgatgacatctgtatttgccatgtggtcaatggtgggcagtccttgtgggcccatctacttgttctcaccataggtcctcttcagayagcaaccttcctttgaagcaattatggttgttctcatgagccatgctgcgtctgtggaacatttggtggcctrtgtcaggcatgtgtggccttaacagccacaagtgccttattctgttgaaattgttctgagatgattcagagaaaatttgcaactctccagggatatgcagtttggacctgaggctctgtctttccctgtctgtactccacccctcctggggtggggcaggggacagggcccttttgtggagtgccacacaattcatagcttttctatgcatttctcatactggcatcacatttttctgaataatagtgtccttttcatttaaatagtcattaattacattctcttggctcttcacagcccctcaggttgcaaagattagtattactctgtcttcccccaggcagtgacttatgaatgtgtcaggatactatgagttgtaacatctcttgatttcactgaaatcccaaaacaacatcatagttaaacaacatctttaatattactgcttacagaaagactgtttctgacatatgtttttccttttttaaatttttgagtgaaatattatcataaagtataaaaagtgacaatattaatattgtgtgttcatcacccagcttaaaaaatagaatttttcttatagctttgcaaatctaagcttacatcaattcaaaacttttttgattacacatcaaaagtgaaacttacacatacatgcatattcatttataatttatataggcatattttacgtcaatatgttgtgcacataaaatgtacaaaataaccatttttaaagataaaacaaaaataaggatatgtattaattctagtgttttcttcttgtatcccaaatatttttttttgtactccctcaacgagggccctatattttggaaaccaccagtgtgtatcaggacctttgctctgaagatgaaaaacacagaaaaattaatttttgctgttggttatgtttctrttgcttttccaaaggcagctgatgtcaaggtataatatggatatgggaaggggtggcgtttaggaatcttaaaataatacacagacaacgcacacaagaaaatatatatgcatgtatttaagtatctacatatatgtatgtgtatatatatgcatgtatttaagtgttttgtgtgtgtgtgtgtatgttttatatagataaaacattggttagcactttaaagtctttaaattcttatctggctccaattggttttgaattcatctgttagtaggtttgtctgttagttttgtggacattctccaggaaaatttcttatctctgtaacccagatgcactattagtatttgatcagggatttttgtgtgccatatgagagaaggactcagactcagaattttcacttaatgtcctttatttcattctgcaaaagtacttcttcatttaagcttagggttgtgatggtcaagacagttgtgttagggcaacctgctctccaaacactttcagtgtggatagtaatagctatgatttgactgataagcagtgttctaagtgctttgtgcgtactgacttattccatacatttaacagctctatgggagaggggctatcattagctcctttttcacaaaggaagacacagagataatgagaggtgttatgagttgaactgggtctccccaaaagatgtgttgaagttctaacacccagtacctcaggatgtgatcttatttggaaattgggccttgcagagataatttattaagttgagatcatactggagtagagtgggtccttaatctgatatggctggtatccttataagaagaagaaaagaagctgggcrcggtggctcatgcctgtaatcccagcactttgggaggccgaggcaggcggatcccctgaggtcgggagttcgagaccagcctgaccaacatggagaaaccctgtcactactaaaaatacaaaatagccaggggtggtggcacatgcctgtaatcccagctactcgggaggctgaggcagaattgcttgaactccagaggcggaggttgtggtgagccgagattgtgccattgcactccagcctgggcaacaagagggaaattccgtctcaaaaaaaaaagtagaagaagaaaagagacacagagacatgactggagaaggccatgtaattggagtgattggagaggcaaagatctgagtgatgcaactgtgagctgagaaactccaagaaatgtaggtcactgccrgaagccaaaataaggcaatgaaggattctactcagagtctcaagagaccctggtcctgttcgcaccttggttttggacttcgagtctccagaaatatgagacaaaacatttttgttgtctggagttactcaatttgtgggactttgttatggcagttcttaggaaactaatatgatggattaaatagttgcctaaakttacatagtgagcaagtcatacaagcagaatttgagtcaagcagtctgtcattggagcctgcactccacagccctgccttatccctcctcaggggacagacagagcggtgccatgctgatgcacagctcctgctggggcatgaggaataaggctgtgggcagagatttttccttaggcaaccagtggaacttaggatgaagaacgcagcactgtcagatgaagaatattattaatgtttatcaaagatgcacattcaagatttctgaaaaacattttcaacactggaaggcatgttaaatatcatctcattacacagtgcttttactttgagtcgccatttaaaagataaagtttatagccttgctgatctccttggcatatgcttacatacatatgtgaatacatagacacacatatatgcacatataaatgtgcatgtcgttcttcatttaaccagattccttgtgcccctgtattaaaaatggtcaagtttctatttcaaaccatgcaataattataatatcagataaagaattctttcacaatcttttcttagaattctagatgtgacttagtttccttcctctacagtgagggaggaaataagagtgatttgtgaagatgcatattttttttcagtaaaacwggggaggtttcacytatctcgggtctcctattctggatacaacatttcaagagtcttggattcctgtttgattatcaagttcacttccactgaccaataaatattggtagaygttaagttctcaggcttgagaggcttctgtcatttggtgtgtccgatgctaacagacactcttaaataaaatgcctcatgaggggccgggcacggtggctcatgcctgtaatcccagcactttgggaggccgaggtgggcggatcatgaggtcaggagattgagaccatcctggctaaaatggtgaaacgatgtttctactaaaaatacaaaaattagccaggcatggtgrtgcactcctgtaatcccagctacttgtgagactaaggcaggagaattgcttgaattcgggaggcggaggttgcagtgagccgagatcgcgccactccagcctgggagacagagcaaaactccgtctcaaaaaaaaaaaaaaaaaaaaaaaaaaagcctaacgagaaggtaaaagagcaaggaggaaactaaagcaaggattrcttttattgcaaaagaggtggaggaatctttaaagatttctgatacagcagaaaatcagatattgcatgttctcacttacaagagaatgagctaaacaatgagtacacagggacataaagatagacataagatactgrggactccagaaacggggagggagggagaaggtggaggttggaaggttaccttttggatataatgttcattatttggatgatgggtacactagaagctcagtccccaccattaggcaatatacccatgtaacaaacatgcactgctaccccctgaatctaaattttttaaaaaagatttctgacaaatagagtcttagaactgaaagctagaaggtgacaaagagaacggagaatgtctgtcatcaaatctagtggtcttccctttctctcgttcccttctcaggacacctgagatatgccatactctcttttattatcatggattctctggtagggaaagggtcaccaagtttttgggatttacgtggatgaaacggcagaggaagataattccgataccctcttaaagggacatgccttgcctccctcaagaaattctgatctcatatacatttttaatttaccagacaaaaatattgggaccagaaaaattaaaagattaaccatctggctgaaggccacagagctagcagtgacataatctatactaacacctagaggtttcctgaatcccaaactagtgcttgtgtatttgtatttgtgtgtgtatgtgtgtgtgtgtgtgtgtttatataactttcatgaatttgatacatgaatatatgtttgactttataaaattttctaagttcagccaaaatactgtgttttgctttactataatttcaatttcatcctttagtcacaggttattagaaaaccccctaattttagtagcattaatgcaaacacaccttaacaataaacatatcatgattatctgcaatactttaatggatactctgaatgacacatagaattttaactggtcatggttgcttttagtagcaaacaagatctgatcacaattaattgatgtctgtcacccccttgttttaatagattgagtgcccaatttgaaaatactactttgttgtgagaaaaagaaaataattgaggatatagtatgggattttgcagatgaagggaatcttggggctattcaatccaatctcttaattttgcatgtgaatacagtgaagtaggtcaagaaaaatttcatgactagatttctgaattatttcatgtagttttagcattattcaattttaaatcgtgaagttcaataatttactgttatagttctttcaccaaggattgtgaataatccaattctaagcatgtgtgtttcaaaggaagcagtaaaaataaaaccagtgctatccaacaaccaatccatagcttttactaacaccactcttcctacagcaaaagagtcctttcaagtccattgctaaattccagaactaaacagataatgttggctgtcatgggaaaaacatagcttttgagcttaccagctatatgaccttgagccaaaccaaactacttaaactctgctcagtcttttcacttgtagaatggaaaaacaaagcccatctcactggctcattatgaaaatcagactaacttgcataaagtacttatcatagtactggaagccaataattattagattccctttcttctcttcttttttattttccttcaagattacatggctagttagtgtccaggcaggacaagagtggagaccttttaatttcgaggcagtggaaccctctatattcttccgttgtccacatgaaaatgctctcaggaatgaaaagcagaaatacctaaggaacattttttttctcagcttgagaagcaagccagggactggtgccctgtcttaaaaatggtgaagtttctatctcaaatcatgaaataattgtactgtcagataaagaattctttcacaatcttttcttagaattctagatgttacattgtttttttgtttcttattactagagaaggcttaggaatctatggtggctcaaaaatgactagagaaaaattgagtttatctgttataaactgagcatatttgaatacactggaaaataggacacaaaacaggtttttggaatttacatatttgaacaaagcaaatgaattttagctggcagagtcaactaagtgttcaaattaaaatacccctatttcaaggttatcatgaggctgtagcagtggtacacctagcttatcagatgcacagagagaataaatttttaatacctatccttctctatgtgataaaattgttgccagtaataatcatgaagagataattaacaatcagatttttaaatttgttttttagtcttaaaacaagtaacagtgtatgtagaataatacatttacttttaaaagatattgcaaaattaagttaaataatttatatatgaacaaaaatttgcacttacctcaaaagttatgcattacatccctctgtatgctgttttaaaatgtaaaacaagtaaacattccaagtggttaagaagacaaatacaagtaactcaaattatcctttttttgtatttacaatctctgagctataattgtttatttccaatatacatgtaaatgcagggctgtgtagcatcacargttttggggatgggagctatagttattctttacccttgatgaacttatttgcaaagtgtctgtaagattttggtttccacttagggatgtagaaagttacaaagtgtgattcccattcttacactgaagaaaagtgggacgaattaaaaatccccatgtgtttctgaattcatccaagatctgaagtcacaggaaaagcaactggccccaaatctggagatagataggcagatgaagggagagaaatgagctcgggcttagctgggtagacataattaggtgctgagaagggtggtgggaaagttggtagcggccaagtatgccctcgtgaatgagcatgaagccccgggtgctgcagaatttgagagagcccaaaccctcttcagatttgtatctataaatcctactgagctctcacagaaaggactggaagatgcttttgaaaacagatccaggaagtggggaactcaaggaagagaggagcarctcctccaggatggtcatgaaactatccagacatttagtacctgtttcccctataaaacaaaatctttcactgtcggggaaagggtaatacatctccttgctcttagggcacttgtaagtatccatggcagctatgggaaggaaacaggaacataaataaatgaaagctcgacatagataaataacgaagaaaacatatcacacaaaaacaaagaggtggacttatcattttcaaattaccaaacacaaaaacaaacagaaactcttacaggcagttacagaaaaagaaacatatgcagaggaacaaagatactaatgacaggggacttcttgtcagaaaccatgcaagcgtggggaaaatggagagacgtctttgaaagcctgaaagaaataaatgttagcattgaattctatatccagcaaaaagtatattccagaaatgaaaacaattaaggatttttatgaggctattcattacagcagacctaccctaaataaatgtaaaggaagttctttagacaaaaggaatgtgatacttgacaaacttgaatctacacaaagaaatgaagagcaatgaaaatggaataaattaaagtgtaatagcattatagttttatttttagttgctctaaaaataactgactgtctaaaacaaaattaatggcagtagattgtgtgtctataggaaatgtgtgtgtgtttatgcaaaaataaaatggcacaaagaatgggaggaaagagctgggaatttaatgttttaactcttasagttttaactctttcctagaattacatataaagtggtacaatattatttgaatgtaaactctggttggttaaagatatataatgtatacactaggacaaccactaaaaatcaaagtatacaaatagcagaggaaatagaataaaaaataatgctcaataaacaaaacagaaagcagaaaaaagaggcaaaaacaagaactgataaagctaataaaaattgcttagaaagttggtagatttatatccagcartgtaaaaaatcatgttaaatgtgatctctttaaactcaccagttaaaagatagagattgtcagattgtataaaaactgagacacgactaatctataagaaatgactttaagacattgacaggttaaatataaatgaatgggaaaggtattctatgcaaacacccgtcaaatgaatactggatcaactatactgatgatagacaaagtaggctttaggacaagaaataatatcaaggataaagagagatattacacaatgaaaaagtaattatatcctaagttttaaaatgctaagtatatatacacataaagcatttcaaaatacataaatttaaaraatgacagactgaaaggggaaaaaatccacaattgtagtcaatgtcaatactcctttctcatagtcgacagaacaagtagatagaaaattagtgaggatatagcaaacctgaacaaaactatattaccagcttgaccaaattgacatttatagaacagcagaagatacattattttaaaatgcacaaggaaaattgaacaagatagatcatcttctgggtcataatagaagccttcagaaatttaaaagaaactgtattatcatataataatgtgattaaactagaaattacagaaatagatctgaaaaaaatttgaacaacacacttctacataacccataggttaataggaaatctcaaaggatattaaaaatattttaatgaatgaaaataaaataatttataaataaaaatatttaactgaatgaaaataaaatataacatatcaaaaatttgtggattgcagctaacatagtacttagagaaaaatttacagaattaaatgtttatattagaacagaagaagtgtttaaaattaatttatacttctaccctagaaaatagaaaaaaaagacctaattaaatccaaaaacaggagaaggaagaaaataataaagattagagaaaaaaatagtgaaattgaaaagagaaaaacaataaagaaaatcaataaaaccaaaagctgattatttgaaaataacaataaaattgatttatttttaagcagactgatcaagaaacatacaggacatacaaatattaccagcatcagcatgaaataacatacataatatccaacactatgcatgttaaaaagatagtaagcttatgatataagcaagtctatgcctgttaagttcaggaatttaaatgaaatgggccaagtccttgaaagacacaatctgccaaaaatcaattaaaaagaaatagatgayttgaatagccaatattggtcaagcaaagtgaatcatagttaaacatttgtaaaaatgaatattctaggctccaatgattttactagcaaattctaccaaacccttaaggataaaataatgctgattctatactacctcttccaaaaactaggagattagagaatacatttcaaatcatttcactagggcaaaattttccttatcctaaaagtagacaaagaccttacaacaaacaaaactgcatgccagtatgatttataaacatagaacaccaaatctktaatagaatattagcaaatggaatccaatatataaagaaatatataaaaatataatacttattaccaaccaaatgaggtatatctcaagatgcaaggctggtacaacattaaaaaatcaaccaatgtatttcactgtagtcacagactaaatattgttaagatggcaattctctctacttttatctatagattcaatgcaatccctatcaaaatctgtgcaagcttttttgctgatgtcaacatactgattctagactttatatagaaaatcaaaggaactacaagagctgaaataattttttaaaaagaacaaagttggagttctcagaatacttgatttccatacttactataaattagggtaatcaagactgtggttgtagcagaagaataagcctagagttaggcaaaggtttttcaagtagataccacaaaaaccactattaaagaaaaaacttgataaattggatttaattaagatcaaaaccttttactcttcaaaagatactgttaatagaacaaaaggcaagtcacaaattgggagagaatatttgcaaattacatttgtgacaatgaacttctatccaggagatacgtacatatatatgtatatacaacaatttatatacatatatatccgtacatatatgtatatataacaatatataacaatttatgtacatatatatgtatcctggatatgcatgtatatatgtgtatatgttgatatatatatatatgtttttatatatacatatatatgacaatgaacttgtatccaggataaacatacatatacatgtatgtataaatttttaaacatatatatagaaacacaggtatatatgtatgtgtatatgtacatatatgtatatgtaattatatatgttatatagtcatatataaaaaatgactctgcaatttcaatacaaaaatgggcaaaagaagatagatgtccctaaaacttaaagtataataataataaaatttaaaaaaagaagatagatgtattgcaaataagcatatgaaaggatatgcagtatcatcagagcagagttacactgccacaagccaagaaatgcccaagattacctgcaaccaccagcaactgagagagaggcatggaacagtttctccctcaggtcctccagaactaaccaacccgatttcaggttccagtcttcatcactgtgagagaataaatttctgtttttttaagccaccaagtttgtggtgctttgttatggaagattcaggaaactaacacataacaaataaattattttgaaaaatgaggtgttttttgaagccatgttattgacactgtaatggagattaccttgccacaataatatagcaacctaatcccccgaggtctgctaaagctcttactaaccttagaaaaaattgtaaacaatagtctgaatactattttktaaatatatatttatctttaaacaaggttacacaggctatttgataattcttgacagtcagaaatcaattcctattcaatgagttttcctaaatggaagaaaatgaatcatggaacccttactgggcataaagcttagaaagaatgtaaaggcagatggccctgtctgacattagctgtcatctttgcctccaaacagatgctaaggaagaagctgaaaacacattacagtgtctgacacagtgttagtctaagcatgtgcctaagatgctaatacaggttatgagaaaaggggcctcgtagccaaagttttgcaaattctaagctaaaaamattaaaaatatttttcatgataggatatatgaggctcattagtgtgctgatatatatcgtgacacattagaacagaagayagcagactcttttccatgtttattttaccctagaatcttctgtgaagagagtttcatgaaactgagcctccatgaacycacttcaggggataagcaacttagaatattkcttctattgatgcgtcattgggtcaatttggaagggatggatctctccctatcctgtatacattttgtttattttccccctttctttctatttttaaccatctcacctttaaaaagatgttcctttgacccacaaattatttcccatctctactgtgtatactttaggatctaagatgtcctatttaatataaaattwaaaaaatcacattgagtagtcttttattcctgattcaccaaattactgctaccataatgctttatcttctaaatcatttctattttctttactgtttattggtgtggaaccataagaaacagctgatattcaacttatgaaagtggcaattccatatggttcaaccaaatacattaatgttattaaagagtcaacacagtttccaagatagttgatttatcaaagagccttaaccactgcaagaatttggcttaatgcttttataaataggctaggtggttgacaggtgagatcacttatgcttaaaaatgataccaagttgggcaagaytgacaatattttgtagggccaggcaggaatgcaaaatgatgcagtcaatttgagggagtaatgtgtgctgaatagaatgaattcctaataaaatacttgcaaggttttggttataaaatagaataattaattttataaatgcaacagaaataggaacatttacatggactggtccacataaagagcagttttaaagtcacagccaatcacagattcaggctctgccaaacatgcccaaatgggcagcctccaagccattcatactgaccaaccatctggaccttatcccttggatttcagctaccatgttgaatcagatcaatgacttcatgtggcctatgaattttaggcatttagacatagtagtattgtcttgagtaatatatgtacactcttcctgtaacccattcaaaatctgctcaactttcaagggccagttaacagtcaaggaagtccagaaagtctctgctgttacgtctataggtcatagactttatcgctcagcttaactcaagrtgacaatcacttctggctgacaatcacatcagcttctttgtatattagccttgactttgaagtttgtacattctttgaggacaaggaccaagtactgcacatgttttgcacttctgtcagactaatgtgcaatcaataaaaacattagtaggcttcatcaagcaggacttaataacattactgatcacaacaatgaaaacaacatgcattaaagcaaaatgactattgagaacattaaagattgagaaatttatgtggaggcagatgaatatgaaacaaaatatatacgtattttatgtccatattactgaagttggtatttaatatatccataaatttcattacatgcttaattcgagttaacagtaaggccagtgtttagtttagtagagtttcatgtaagagtctttattcatggtttgtggtttaatgtgttatgtaaaatacagtaaactagaagtattttttcgttggacttttgtctcttaaatactgagatgctggatagaatggtttttcagtgctgaattttctgaccctgtgatttattaggctttttaatgtattatcctaatgtctttataaattaatgtttttataatttatcggttgactattgaaataaaattttcatattccattgcattttatataatagcattacccctcagccactgcgatatacatgagtttcartttattatagctcagtcccaaatcaatgtcactgttaagagtatgtgttacagtagtggttatctttggaaaacaatttgagtctgactagatgttgttcaatccccagrccatggtaagtgtgactgtggcaagtgcaagtgtgaccagggatggtatggggatgcttgccagtacccaactaactgtgacttgacaaagaagaaaagtaaccaaatgtgcaagaattcacaagacatcatctgctctaatkcaggtaagaagtataccctgtgaaaattgttaagtggaataatcaaattttgtttttaatggaaatatgtgggcgtggagaaatgttgaatctcagagtgagtctgcttttgagtatgttttttagaagtgaaattcagataaatcaatagaaaaaaaatgccatcttgctgagactggcaagtttgatgctttccagctgttycaaatgcctccttctagcaggatattcactggaaacaacaccccaaccacattttatgtaaattgtgagccatgatattgaataccggattacatctgttaaaaaggatttatataaactgacttaattattttctgttacagatcacgggtgctttgaatttttaccttcgcaaaatagaaccaaatactttaaatttgatagaagtttcagatatactggttataaagctctttgaaggatacagtcacagaaagattttttgtttgatcaaaatattttttatttcatagaagttatttgaaaatattttttacaaaattgtagcaatgctgttaaaatttattagcaaaatcatataaaagagttgcagtttaggtttcaatggtatttagcgagtgttaccgtaattaaatattctttttacatttgggcaggtgaagcctcaaaatcagattttctcaaccgtggttgaacatcagcatcccaaggagaaaggaataaactgtcagttctcatgtagtacaccagaggttctgtttcaagtgctttggtgtgtggccttgacgttggtggtttttttaaagctctctgggtgattttaatatagatgagtgtgtgacccattgctctaaatgctaaaggtgaggatttgacttcacgaatgagtacctttcttcctgaagctcacattgttggtagggcccatctctaaccagagctgagaattccccacagtctgattgcaacagattgtgtgttttagactgagctcarttaaaggtgttttgctgataggaatcagaccatatccaaagcgaggtgtgagtggatccgtcaggggtcatgacaaatggtcttagcagttaggtccctttctgtgttcatgatgttctcatcatatttctctagcacttcagtctttctttcttcttagtmggatttctctacgtccaattcataacacccacccctccaaacacacacacacacacacacacacacacacacacwcttctctacttccaattcataacacccacccctccatacacacacacacacgcgcacgcgcgcgcatgccccatagcgtctttcatcttgaaaaaattattcttttcaaacttgtttcagtaacaagacttgaattctgttttgggtttgaaatctattttgggatttatttatttattgtttgcaaatcaaatttagggtttttttttagagaacattataatcaaatgtggtagtctaggattctaaagatgtttaatattaaggaatctaaacatgtaattcaccacattaacatatcttaaaggagaaaacatacagaagtgtttcagtagatgataaaacatatttgatacaatgtaaaygcatttctaggacatctgtactctctcattttttaagcatggatgcaatacctttgttcataacctgctttagtcaagggacccagtaatgtcctgtatagcgttttcctctccttacaggattcagactattgaaaatgttatgtttatatctctctttagtcttctttaatctgggtcatttccacagactttggctttagagcattgaaacttgtgaagaaagttgtccccattttattaaaagaaaagtgtacttatcttggatttgtctgatgtctcccccgccatgattagattcataatacatattcttaggtaaaacactagagaaatggttttgtgttctcaaaatgtttcatctggaagcacatgatgtccatctgctcatattggtgatgtcagttttgatgagctggtcaaggtgttggctggtgtcttaactgtgttatttctgacttaccctcttcacaaatgtgcattctatgaggaaatactttaaagccatacatgtatcacattcctcactaaaattaccccagatttaacatccgctgatgacaatcacctgacacagtattgacaatgatgactggaaaatgatgatttatgaactgtaacattctctctgaattgactagttggcactcagtattccaccacaaacaggaatcctcctctctcatttatcagttatttgttatttcatttacttagtgacttattatcagtctagaagcacaattcttattatttcattgatttgttattcattttgtacataattattctggtgcacagagttttccagattaggtattaaagcccatcaggctagcttttgtgtttttgtgacatgcctgccttttgtttttgttttttgttttgtttttgcaattctttacttgttggcataataacatattccagggtcatattggacctgcttcactgcacctttggaatcatccacttatccaaacagccctgattccttttagtgaaaatggtatttgaataaaaattgtgggcacagggatacttatttccactggagggtatttgcttcttggccctttctgcaaataggcttgtgtcaaaaaagtagattgaagcataatacaatttttattttatctgagcaaacaatgattcatgaatcaggcagctccaaatcagaagtgattcaggtgcttcattgagggaatgcaagtgggaggcttttatagggtgaacagaaaaagaaagcaaagaaaaatagttggttggctaatgttatatggttgccttrtttagtctatcctgttggaaagtccctagttatataattataagtttgttggttgcttctgattggttaaacttaagttctgttcttctttaatgtagacatttataagaaataacttaagctaagtttcacttatttttgcctgtcaggcaaggttaggatcatttatgaggcctaactggcttagtctgctcaggggttctttaggccttgtctccattttaatttatcttgacactagtaaatatatgcctgtgcatatacacacaaatacatatacacatacttgcacacagatatgcatgtacacatacacatacatgcatattttagaaatcatgaatttacaccagtgcatctaattccagtccaacctcacaggattacttcttgttttctccattccatatttgcatgtcccattttcacagggagaaccctggctcccaataccaccaacatatttacttatttgctcaatcctatactacatctctagttacttctagaagtgctgcagacacaccactaaaccaagcaaatgtaccaaaagagattaggatttgcagtccacccctctccacttccccccactcactgtacctcaatcatgcccaagattggggtatgtagtcgaatgacgtgttcataagtcactcagacttattttattttcttctcttttagtgtggttatggtactcatttgaaatacaatttagcttatttatttcagatcactttcaattttaggttttataattccttcccatctgtattaatatattttataatgtatagtacactaacatgcttctaaaagtcataactatgcagaaaagtatactcagagaatcatccctctcttcctcaaacsttgcaccctgcttaccctcaccttatagataaccaactttattgctctcttccttctctgtgcatgtatttctttttgtgtaaagataaatagacatatttgtgtgttattatttctcatttttttcctgtgcaaatggttgtgctttcattccatgtgttcttttgcactctgcttttacgactcaacataatctcctggaattcactccaaatcagttcatagaaatccttctctttattttttcaaaagcacaggactggattctatgtatgcaatgtaatttattcaatcaagctcttatgcttgagcatttagacagtagtcagtattttggattgtaaataatagtgcacagaatgatctagtgcacatatatttttatatttttggaggtgtgtattcaaggcaaattaccagaaatgcaattggccaaaagatacatttatattcagtgttacatttaatcttttctgtctcatttactcttgtagaaatatctaagcctttcatgtttactttggcagtctcattctcacctgtctttcttttaatacccacttccaccctccgagttcaggaccattttccccaaattgcattagcctatgaagtctctctattaatccttccctttcatatcacagtgtggttttctgaagtagtttggagcagaaggggaagaggagttaaatggattggggaatgagactgaagggcagaatgaggcagagctggggatcaaagtgttccagaggctaactttgtgggaaaagtagaagggaggtccagtgtgcagagcagggtgaggccccggcaccactgtacaggagtgtgggctggtgtacatgtctggtcagtcatcctagagagagtcagttctattgggcactatgaaaaatgagagctaaaaatcatcaagtgtaaggcagaagaccartcctagaggctgagttaactggcaaccacragagagaagctgtgtgtgtcatagcatgagcacaggagtctggagcttttgcctgggcgtccatatgccatgtcttggaggctccgttgtgaattctgctttatgggtgagacaggaagtctctgagctgttgtaaacttcccacatcagccgggaatgtttccgatgtgtggatgagagggagctgcctatgggggacttcagtgaggagtcatagaatttggaggcagaggctgttccttcccatctttcctgaaaaaacttcctcatacacagtcctaaccaagtgacttcctgctctcatattatatatgagaggcccatattatatatggttacatgtataatatttgtataggtttatatttgtagttataaaacaagaaaacatatgacacaaaggcttttgcaatagacttgtggcaaatgctatacaaaatgtattaatagggtatctcttcctggtctatgatttacttaattttaagcatctcattattttctatagcacttagttccttgcaaacaacataacagataacaagaaagcttaatggctggatatgtgggtggttgagagacaggatgaataaatgtgaaaatgaaaaagaagggtgataattagagaacaaaaactagatgaagcaatagcataaattatagcattagatttcaaattacttttatgaattgagttagcttttagggaaaaatgcaataaaatgaagtttaatgacaggaaaattcacatgagtatttgcaagatagaaaaataaattctgcaaaatcaccatttatatgtaactgtgagtgaaaaatttatagataatagtgacttgcaagtgatctgggtaacagaatcatgcagaggatatgaaaacaaggatattgtcagcatccataaatatattttctggagaaaatgtttgtaaatatgatgaatatactctatatcttaatgggagaagaggaagaacccaaattttctcaaatcctactatgtactaggtgcagcagtgcttctagaaacatgactgggtacatattcatcacttggtattggcagcagttctatgaagcagagattatttgcagatatggaatctgggaattagaaatgaaagcaatgcctttaaaaatgcatagctcatgaggattaaaactcggaattcagctacagctctaccttactcacaagttcattctctttctaatagatcacatrtagatttgctaatatctagtaattcaaaccaaattakcaacagcttccttggttccttcccatccttcacyctttacactcagtcaccaaatgccctctactctttctcctaaaaatatccccaratgtatttgttccattctaaactcatcgcatcatgtgtctagccactgtcttctttcctgcagacaaatataacagccttttaactcatttctttgcatccacttttgcctcatttcagttcattcactcttatgctattgcttcatctagtttttgttacatgacaaccagagtaatctggtaaaaattcatacatgatcacaggactcccttgcttctatgtcttccaattatttttggattaaagctggaaatctttaacatgacctataagacttccatgaactgcacctcaggttgctttattcatttcatgccacttttcatgctgttctgtatacctcaatcccatgtggtgtttttccttcacttccccttttattgcagagcctgtgctattgtctcrtgctggaagtaagcctcttcaccatctcacttctcttagctatgctttttctcttggcttttagttctcagctacttcctcagggactctgactttgacctactggtctcagttaaatccccttgctatgtgcttctgcaacactttgcacttctgtatttattttatcacattggtttttgctcatataaaactctgagaggagggttatggctgacttgattcccgttggattttcagagtccagggtggtttcttgtgagagatcaagtctcagttgatacatggtgatggctgtgatgagcattaaaactcaaaatagataaattaacaaggaaatttctcaagtgggcattctacctctcaaaattgtttgagtgcaatattaatgttggtgaaattacatttgggggatgtggtagaatcttcagacttggatgagtatatggctcgtggtagaccagatgactaccatgcctctctaacgtggaggtcccctgagaatctggtgagttaccagcaatccatgcctaaggaaatccactcttgtcccattattgtaaggacatgtgtatcagtataagttaatgctgaggaggagaaattatcaggggcacatatgatttttatttatgcatttgataataaattatttccacaaatatttattayataaatagtatgttcaaacatagtgcaaaacattgaataaatactggtgaggaagataagcaaggttgcttccctcacaaagcttagaatttgctgctttatttcacttcagacccaggtgtaatcagaagacattcatgcattggttggatggctatatgtggagtagctctgcacttggagaggtcaaatttacattcattaaaccattagaggtcaataataatagttgtgtgatctaaaatataattgccatgctaaaataacctcaagaaagagtagcatgtgctttacctcaccatgcccacagaaatatctaattgaaatattaaattgatttggattatctactctcttgagagagatggtataaaaattcattaattataattttatgtgcatgtaacaaacagtcttttttgttttcatggtttaggtacatgtcactgtggcaggtgtaagtgtgataattcagatggaagtggacttgtgtatggtaaattttgtgagtgtgacgatagagaatgcatagacgatgaaacagaagaaatatgtggaggtatgtatattggctctgtagaaattaataaaagtacctgtttttttcacctatttcattgttcttttatctctacataagtttctgctctaggtgtgctaatgtagtttaaacctatgtttatctggaaaacatttcacataaggagagtgagactatggcattaagagtagactagtactttttagatgcaaagccaaattgtccccagaggagagctgtgtcattatggcaacaggccaactgcatagctctgaagtagtcctagtagaataccatctcctctgctcaccttagtcacttttattttcctttctcctactctcttaagtgtacattttcatttctttgtttttccctttctaaaacatgagtctcatgtcctatcagggacaatgaaggtcaatagggttattagcctagagtttacctccccctctctgtccctaaacacttaaataacattttcaatgaccttttctgtgtaccaccattactcaattcatttttctgttgtagcagttcttgcatgtttgctagtgacaaattctgcaataagtgctttacattcattatgttttgtctcacaacatcactctaggctaagaattatgtttatctacatagatagatgtggaacctgggacgtggataaattaggtaacgaacccagggtcagtccaccaataatagtagaatttgggctcgtgtctgtgtgatgccaaagtctatgttcctgatgcctcaccactcacgactgcatcagtgccttagagctcagagctccacaagaggagtctctcctcaccacttgcagttttcatctcttctgctcaacctgcaagcctgtgcccagagttcccatttgcaaccttgactggtgtaggaaaagaaaagtagaaagcagagagaatcatttggtttaggtaaatttttctctgctctgaacttatatttcactcctatctcatgggattccagttgaaggaagactgccctgcgtgcagaaatggtagttttagaagtattgtttttctggaaggactagggcccaatggggccacgtggaaccagagaaccctgagaaactgtggctagcataggacaagcttgttcttttgtttacatttcggtagcttcaattcctgtgagtcatccaaatacacttattttaggcctgattggccctccctccttgatctcctggctgtacaaactrcctggataaaacaaacaaacacaaaaaccttattttcatttttccgagccaatgacctaagcaagatgctgctcagacaattctytcttaaagggctcagtccaaaataattagatcaattagacaaatccatccacaaatatatgtgtttgtcctcttgatgtttagtttccaattattatagatgatgaaaaaaaaaaaaagaagaagacgggaacatgctttggggccagtgtgtgttgataaacaccacaaaagcagagtctatttgcatgtatcaatagaaaaatgtaacttgaaacaacacaacagaaaatgtttaactttcaaactttctagttgttatttccatttgtttgaggcttaagcaatttcatggtgcaaagtctctgaacaaggacaccagcactgcagtaaacaccctctgggggtgacattgcctgggattgtaaatctttccatgtgtcattcacatgaaaccaatctgctgagagatgattccacagttcatcagtgaagtagtacaaatagacattttcttgctctatcagtttgcacaaagcaaagaattatgtttattgtctggaatatgtattgtcctaaagcacacattttaatctcaattattcagatgtgtcttgttcaatatttttatttgagttatgtggatatttgtttaattttccatacctgcatagacgtgtattgttacataatttttgcttccttatttacctctaactcaaaggtttcttagtaaaaccctaattcagtactgaattgtataaatattcaaagaatttggatgtgagaaatatagattttctatcatttattaatatagtaatccttacttatgttgcaccttctgtataaattttctgaaattacagagaaaataaattccgtagtctaaaaaggtgattgggtcgtacaaacctgactcctaagaaaagcaattaatatacactattgcttttttttcagtgtaatccttgagttcttgaggcctgtgatatatcactaggatgtgatttgtgtgtgcaagtagacaccattttaagttcataaataagatatatagatgatatattctgtactgattaaatcacttgacagcctttgcatttgcttaagtaaacaaatttaaaattcaaattcrttgtggaaatggtcattgatttttaggttaacaagtgattttctttgaatatcccaattataacttatttagacagagaacatggcattgggtccctgtctctttctctgtgtctcactatagcactctttctgttcatctctctggctctgtctctcagatgtgtatcttcttgatggaagtctcatctgctggacatgaatagcgtaggataccagaatattctgttgtacttcttgcttcttatgtgagttttacaggtcctattaatgttcttgccattggccagaaataccatagtgttagaatgataaatatgcttataagacaatgaaaagtagtctcataatcagttttgcattgtcttttggggagtttggctgtaagagaagagagatggaaagaacaaagactttagccatagactgataaaacacaaactcctataatacagaaagaatagactaaaaacaaaacaagaacaaggacatacatttatacttaggtgatataactacaaagatgagagtataagaagtaaaatttgggataaatgccatctttggggaatttgcagaaggattgctagrtgtggatgaggaaagcaatggtgcgataattcactacagatggcttggaggcaagtgcagatgagcaggtaacaggttacagagaggtgggagctgaaagagggcatctggacacaaaatggtgagtgcccttacctgtcatttgtatccccttgacaagtagaaagggaatttgattgcgtggccaagggcccatggtattttgtttgtctaaatgaggattaaacatggactaggctgaaaacctctctttcacatggtggaacacaacagcttgtggggcacagttgagtgaaaagatgaaatatttattctgctttaaagagttgtttggtcattcataatgtctatctaggtaaatatgcaccattggtttctcaatagttgatttcaaatgaaatattttaataactaattcaagaaacgtccttagagtgaatgctcatatatatttgggtttgatgtgtgcatttgagatggaaaagtaatagactgtcatggtcattcatgtcatttctttaaaaatacttttaatcagttccctgtctaggccaagttaaaggacactttgctctttttgtatgattaagcaggtataggcacaaccatgatgtgtttggagaaagctgtataatttgattattttaggcaaggaatgtggagctgtgacagtatttcagaaggcaaaaatgatcacaaagagatagaaagttaattctgcttatgaaagttgcttttttcctcactgtataaaattcattttgggtaaaggccatgggaagtgttactgtggaaactgctactgcaaggctggttggcatggagataaatgtgaattccagtgygatatcaccccctgggaaagcaagcgaagatgcacgtctccagatggcaaaatctgcagtaacagaggtgtgtcattcatacatgttactacataatggggaggcaaacaaagcttttaattgttaacacttcttttctttgtatttcctctagtgtgggaggaagttatcttctaaccatttactttgatgtaaatcaacatttactatcccaacaatcttttctgtcttgttttttattgagtagaaaagagaaagataagaaagttgctgtcattctttaagcttcactgaataaacagttaacttagggactgtaatttctttggcagccctccagacatagcacagtgcagctaaaaggcaattcctttagatacttctgttaaatgtctcttgactaacagaaccatctacagcatgagcatctaattatccgtagagaattcagaaaaccctcttgtcttaattatgagtatatggaaggcttggttgaaatgcagatttgatatggactaatttaacttccgtgtgcaataataaaaatttgatattgaatacaatagatatacaaagtatgtatccaatagccataggaaatgtacactgactttacaaaggaagttaacaaatatattaatattgctaaactataatttaaaggtagttaactaacttttgatgtaaaatcaaacagtttaaacatagttttaaaattccttgaaaatacttaattttccctttgctgtagtgataaagagagccatactaaagttttcattgcctatccaatggcattaaaaagtgattatacttctttaaaactaaaaaaatctagatagctggaaaactttttttcatttctatacatgaataatgcattgcaatagataatgctaatacagaaatcgtagcataccacctgtcagaaattgacatagaggagtaaaatgtgccacatttctttacatagagaaaataaataaaaaggcaggaacttggaacaaaatcatgaagtcttcctttgtggggactaaatcttactatatatcatactaatttaccttatggtttctttttattatttattattattattatactttaagttctagggtgcattgcacaacgtgcatgtttgttacatatgtatacatgtgccatgttgstgtgctgcacccattaacttatcatttacattaggtatatctcctaatgcttcccctccccactacccccacatcacaacaggccccagtgtgtgatgttctccttcctgtgtccaatgtgttttctgcataagtccttttatgcagtaggggtcacagtcaccatttttaagtatatgaagcttgaactctggtactgtggaaaatgactatttggctgtcaaaaagagagaggtggaaaatggaattggttgggctgtggattaaggtcaggttctgcagcagagttacattggctgtgagagacgatgtccttcagaaacataagstaagccacctgcatcccacttcgctgtgcttggagcattctgacctggagctatggcagaggcagaatgggaagcagcttgcctgagcgaggctcacagcttctgagattcaggggtacttgaagacagggcagaagtgggcgctgagatgagtcatttttttttctcaaaagataatactcctgactaccctgaaagcatttctgcatcattgcatccataggtaatagaaacacactggtccctgcacatacctatcttgtcttcctttttccccatcttcaggggccaaaaaaccaatgttgcagacataagcattaatagaacaaatgtcctctattgcccatctgttttattgagtttcatagtggacccctttacacgtggctgagaagctgcttcttcgtcacatctgcatagctcctagtccctgttcctcctgaccaaactcatttatcctattatgagagcaatgcatattcattttttaaaatctagataataaagtagagtacacagaaaaataagaaagtgacccataaacctaacttccaggtgtaacctccttttacattttggtacatgagctttcagtccgtatttatttattaaaattcatttttatggctgccctatccctgtatttccttcttattaaagaaaaaaaatcaaatcatactgcacgtgctgatttgtaattttacagttttatttcatgatatatgttgtttatctttccatatttatggggcaaaaacctaatttattacttagtgattgctaggtagtccatatgtgtgtaccattactgcgctaattccccattgaacaatatttyggtcactagtaatttttcaaaaacataaatacaactatattttatatttctgaacatacacttgtgtgtactttttctttctgttgggtacattaattaaagtgagctataagtctgaataataacacagatataaaaagtacatattgcaaaatcgctacccagaaagttgtaccatttcgtactccccttcagggcaagaaagtacccattgtcccacacctttaccgagtctggatccaacaatattttccacctctgaygatctgacttctaaaataattgccaatcacgattattttgaagatctgccactgctacccacttagtagtggttgattgagtgataaacatttttcatctttatctgtcattatttctgtatgaaatttccttttgttctttccttttgtctatttcactttgggcatattaatcctttatatattcaattctatgatttatttatatgtttttgaaattgttctttgtcttttacagacatattaactacttgtttcagctttgtcagtcttttttttacagtgttttgtttccaaccaaaattttcaatttttatggaaattttcaatttccttttttagtaattgtgctttggggtcttgaataaaaagagtttagttcatattatacagttttattttgtacgtttaaatctttaatccaactggtacttattttgatgtaagaggtaagaaaaggatttaactttatgtctctatcaaatgattagctggttgccctaaagacagttactgataatccacacagagtaaacatgatgtacagctgggcatttccctctgcaaatctgcaaatgaccaagtttatgtctctcaatctgatctccaacattctctataatctgggctcatctgatctagcaaaccttacttcttagtcttttttattttttaacatgcacctcagggtccctatgcccatccctacccttctttgctcagtctttttttcttgactttctcttagttctacctccaatgtctcctagaacatttcctctaatccctatatatccaatccatccactgctaattactccaacactcattgatcctctttctccaaattcttagagcattcatgtcttagtttacaaaatatttgcacattgtttttagtgtttgttaatttttctttctaattagctttctatttgccaaatagattgcaagcttcttgggggaaaggattatatcttatataaattgttttagtgttatctttgaaggaaactaacataatactaatgacayattccaccaactcacataattatagaatagataataacttttgtttattaaggaatctctattatcaatattagatggtgtttttcctttttagaatatttttgtctgaatatatgtgtttttttcaaacacaaagtaaacagaaaataataagcgatatgtgaaatgctttctttcrtggtttttcttgactggattcttataaaattcttcttcccacctagggacttgtgtatgtggtgaatgtacctgtcacgatgttgatccgactggggactggggagatattcatggggacacctgtgaatgtgatgagagggactgtagagctgtctatgaccgatattctgatgacttctgttcaggtaagggctcttccaattcctgtttttctggagggggaggtggggcttgttaatgggtaaaaaaaaaaaaaaagcaattagaaagaataaataagacatactgttggatagcacaatagggtgactatagtcaataacttaattgtacatttttaaataatgtaaagagtataattggattgtttgtaacacaaaggataaatgcttggaggggatggataccccattctccatgatgtacttatttcacattgcatgcccgtatcaaaacatcccatgtaccccataaacatatgcatctactatgtacccacaaaaatttaaaaagtaatgaataaaaaataaaaatgcatatttccctgttttcaagatttctgattctcacataccctgtaaaagaaactgaatgtgtattctaaagcatcttatatttgcagtgctcctactggtaacttggaaaacctccagagaattcccaaagttggcaaagactagagatgagagggcacccactcttttaaagttagtctaattcctcacccaggagaaccattagctctagatagctactcagttcaactctgagactacaaaactagcagagctgttgacaatgaacaggatagttatcattagggcacctatattaatgtattacaaaacaggataatacagtgctcagggttattttgtgcattaactctttgataggctttaatgttattctgcaatgtagtctgtaattaaatatcaattagtagattcaaaaatctttgactgtaaatactgtggggcagatactgtctgttagggactgagtgacatctgggctactggtgtagtaggagccagtaggggacaggagacagccatgaactttgacttcatggagtttgcaatctaaatgcaaataaataaaatatgtaagtccaggatgtctaatagtgcaaagaaaaagaaagcagtcagaartctatctgaaaaggtatcatttagcaaaaatggarttatagattttcagtccagttctatttgataacccataaggtagacacatacacatatacatcttgytaagcttgactgcctcattggtgcatgcagatggatagaaactcctctggtctcctgaaagtttgccagcaaagggagataaaagaactgtcccatttaattatgagtgtgcaacttcaaaggcttctccagactgactggggaaagcctgctgctaaatcttcccattgcagaagrgtttccctcttctgataatctcttgtgctccagaggatttcctaaacattttgtgaacactattctcttgagggtatttttttctattattaattatacatgctcatgttcttcattatcattgctgtcaacacagtggtaataaaagagctcatgactagtgagtggcktctgtgttccaaagagatgatgagaatagtggggaagaggcctgttggagattttaattaggatgatgtggctcttcacagtggtggtgatgtagggmtcatgaattgcaggaggctattggatcacagtgcatgtgggttttatcctaaaaaaaataggcttgcaggtaaagaaagatgagaggggcattccaagcagaaggaacagagggatagaatctgtgtataggaccagactcagtttgaaattaccagaatgcagaattaaggaagcatgtggtaaaaggtaaagttggttgagaaacaagaactggggggcttttyaccttcctgcagacccaggttttattctaaaggcaatgaggagctaatgatggttttaggcaatagagtgctgtcatcaccagatttctagtctgagtgtctgggaaaatgttggtgccatttactgaaatagggaatatggaaggaagctgtcaagtttgtttctagacatctccagcatagagggcaaagggtaagccaaagtttatattttttcccagcctgttgaatatgtgagtcagggtcagggttaaaccaagagaatttcaagttgtaagcatagagttggtggttaaaactatgctggcattcaggaaatgccatttgacaataycattttcttttttgagatggagtctccctctgttgcccaggctggagtgcagtggcatgatctcagctcactgcgagctccacctcccaggttcacaccattctcctgcctcagcctcccgagcagctggggctacaggtgcccaccrccacgcccggcttatttttttgtatttttagtagagaagggtttcactgtgttagccaggatggtctcaatctcctgaccttgtgatccgccagcctcggcctcccaaagtgctgggattacaggtgtgagccacctcccccggcggcaatgtcattttaagattgcttttgagataaacatgatttgacacaatttaaaataagaaaataagggaggcatatraaaggcagtattttaaaattgtaagtgtgtgacttgctgatatggagcccctttttcctatgggtattcactctcttgtgaaatccataattctgatgttgatcctgattttggactggggttgaaaaattcaaactaactacattatagcgataattcagggtcctgtgagccagtccatctcactgtgagggagtggggtcatggggtaaagatgggtgatcactcctgaactgacacttcaatcctcgtgtaagcttgtgtgcaattcccgcagcgtgtcatttagtcttggagtgcttactctaggctgagcaggtgaagtgtcattaaggaggctgcactggaatctaattttccacctcacctattcccctccaacccctcttccctgttttcctttttctcacattttcctttctttcataccctatgagattccacacagtgggtatggacaggtaggggtaggaagaggtgatggcacaattggctgtagtttgaacaagaaaacatcaatctattattgtgattttatgattcgctggttgaagtgaattgaacatggccagctttccacagcttgrctcccacacttagaatgaggaattgaggaaagaggaagaaactcatatttacagagactctactctattggacccttgctgagttcttttataaacctcattccattttatgtacacactaactcagagagggaggcattattgtctatagtttagcagaagagaaaatacrttcagagaaattaagtaacttgataaagttcacactgccataaaagtgtcatctgaaaacacatatagcctgactactcatgtaacttaatctccaggtgatgcaaatacaattctccagttttactttatttttctgaggaagaactgtcctctgggtactcagattttttwaaaataaaactaagcttctctgaacatcattacaatctggagcagacatcaacctctgcagkatttcatcattcttacagaatctgtagaattctatatactgtatggtattatgcttattagtctttaaatttttcctaattaacagtctaagttgcagtgtaagaagagtgccatatagttgattattgagtatattaatacctttgtgttatgagacagaagtaacccaatgacatcaatattctctagtctttcatgcaagactagaacataataaggctctgatgaaatgaagttttatttttagctcctattcttgccatcctgagagttttggtcttatttaagtccaagggaagtctctggacggattagtttaagttagctcttttaattgacattctcattttattcattcatttccattctctccatttatctgttcaataatgcatttaaatgtaaatattttatgcctaacacatcatgaatatagggaacacaaatatgttgaaacatggtccctgcacccaccaaataaatcaattttatttacttcttttaatcctgtctgttgttcatcatccacaaaatatgtgtgtttgtgtatgttcatttgcccatacaccaacatgactgttatactacacacatacacgcacccctcaaagacaatacggttgacacaatttgagtgtgactgaaatgatcagggcatgaatgggcatcctgacgtgtcccgactgtcctgtttgttacacccaatttactttctgattctaatataactgctttattcctaatggccgcttaccactcaggtctatttacccaaatcccataattggaaaaatacgctgcaatgtgaccttaaactttatcgttcagctttccctgcctaagaaaattatgaaaatatagggaaagttttggcttagagttacattagtttggaaaatggaatattttgatagaaccatattatgtggtgaaatttgtccctgtggattgtcaaagcattaagaaagaaactaaaggaaatgattaagtatatccagaccacattttcttgaaaggaaaaattaatatattgaatttaaaaaaaatagcaagtactacctagatctaagttattccccaaagcttttctctattgatggtcttcatgttactttgtaaacatgttaacagacgattcaaattcasrggcattttttgatcctttaaaaagaaagaagtatcctctaaagcagagaagtgtttgtctggaatagatgcaactgcacttgtgctgaaacacctgcacctgtttctggagtttggatagcataactccaaagaacacaatagttacaaataaacaagaaaaagtttagttaacaccctttcctataatggcctgagaaccttaataaytcctgccttcccagcatggcctttggaccactcaatggctgctcttgctgcaaatcttccttttcrtatgggtattttgggctgcagtcatttttatggtaggtagattataccaacaccaagcactgtattcttccattgtgtgtgtgtgtgtgtgyrtgtgtgtgtacatacagrgagatctttagagagcatttctcttatttgaattcttctgatgttcgatatcaagacaaacagcaccatgccgaatctttcatctctatttcrttgatcttctgcctacacagtttaaaggaatactggttagaagtaatgaaactaaaacctgcaggcttaacatacacataaatttgacaaaccagcatggaagcattgcatttcagatccatgtggcaaaytgatctttttttagttctgtcatttgaaagataaagcaatttgagataaggcccagaaaagatagtggcacatcagatgaaggacacaagtctcctgatttcttcttttatgaccttttcactatttgtctattaaaaaaaaaaaaaacctgatgtaatgttatggcagtctaaagggttttcatgctaaatagataccattatctctaaactcttctatatagcaaaacccaacattttcatcttcttgactttatctctaccaaatgattccttctttggcataacttttaaaattggaattgagaaactggtaaattcacaagaaaagttgcaattttgttttataattttctgtcttatcygaaaagcccaatacctgcctgrgaatctggtaccaacacctgayatttctaagtgatttttaaactctaccagttaaatatcacaaaggattttgtaggacatgtacagtttcacttaaagtggtatctctaatattctaaaatatattttgacagcacatgactaacttcttgaaatatgtagtatataatttttattactgaaaaagcaaaagttatgtttctgtttcaactctgtcaattaatctgtaataaacatttaaattaggcaataccattgtcgatactatttttattatggtaggctagaattatagaaagtttatccatgcacttttatgcttgcttcttctatgatatacagtaagatatcttgtttagaaaattctactttccccaaacaataaaaccagttctactctccccagacaataaaaccatcaaacactttctgtgccactattttgtcacttaaactggtgaccatacattcgctgactttcaggaacttcattctttatggatggcttatgtatgtcactcatatttaaatacctcttctttccttagcttgaacttgttcaattaatatcaaatcctggtggtaaagcatagaagacatatcagtggatgatttgaggaggaacattggccatcttgaactaaacaatgttctcccactttgatactttcctgtttagggctaaggtcttttatccttcagccaatcacagcaatgatacaatctcttaaattcatcccaatgtgcaagcaattggctgcaggtgtgttattgagaagattattgaggagtcatcacacacatgccaaagtwaggacacatatatattcttcccagctttgcttatagttggcaatgcctggaggtgaagcacgcatttagaagcatgatcctggagaatgttcatgatgttgcattaagtacacaggaaaagaggtgtgggagcttataggctgtattttccccctcatgtttgtagaagagcatcagaaatagcaatgggatataaaaataaagctgcaataatagaattatgttaggggaaaaaggttgagagaattaaaaactgagaaaaataaaatgataagaaaacagaacgtgcctatgggagaataaaggtgaaagaccgccaaagatttcttcctgcaggtctagagcatctgaacttaaaaaacgaaaaattattaaggcttccacagctaatctggcttttgttactaattggataggattccaactttaaaaatctcttttgaataacttctgcctttaggatttgttttattctgccacatgtttttaaagatgtcaacatgtgaatggatttcagataggaaaaaatggttgcttttaaacatggattccgactatgcaacttaagaacgttctcccttcagtcgtgtgtctccctttgtacctgcctttatccccaaggtttctattttattttccctccccagggagggaatcctcctgtggggcacgtcactgcttgtgaattcaggtgggccttagtggcagatgacattctcttgggcagttagggacttcctgggtcccgcatcggctagatgtattgttstaaccttcacagccattaaactttcaagagtggagaaactttttctccctcttcaatctggttttcaatgttattgttaaagtgtcaacaagcaatgttattgttccagtgtcaacaagtctctcgcaaatgtcagcatgttctgtactttgcccagtttcctcacaacaratctgtcgctgaaataaaaccacttgtctccaagaatttcaaagccattggctcctgtgaaacaacagaattgactgtactttaaatgtgaaatatttatgtgttaaaatcattatttatataggcatttccaatgtagatctgtttgcaatgtttgtccttaaccttacatgagggctggaaataaagaaagataggaacttctttgttttgttttttttgagttggaatttccctgtgtcacacaggctggcgtgcagtggcacagtctcggctcactgcaacctccgcctcctgggttcaagcaattctcctgcctagcctcccaagtagctgaaactacaggcatttgccaccatgcccagctaatttttgtatttttagtagagatggggtttcaccatgttggccaggctggtcttgaactcctgaactcaggttatctacctgcyttggccttccaaagtgctgggattatgggcgtgagtcaccacgtccgatgggaacttcttaaactgagatgaatgaatggcaaaagccatagaacccaacaacctatgaaatataattgttaataagcataaaccgttacaaaaattcccatactgtaaagtctaatcatattcatatgtcatgtatgtttattaataataacaattttcttttcctttcaactgaggtctagaacagataattatggcaacaatttgtcaaatagactctgttacatagcagatgatcaacaaatgagcatctgaattgaattgaatttgggattaaatgagagatttaaattcagtgatccctaatgtctcattccactttgatttatgattttgtgattttttttttactaaaaattagttaaatggtgaaaagcttctacatatgtgtattgtccagtttcttcaaattcagaagatggaaccgcaaacctcaaggaatattagtaaaatggtctagtctttactggaggccaattttcatattggatgatatacattaatatcagatgctaaagacagcatgcattttcatccattagcatttctatgtacttttaaaaagtgtaattccacttttaaaattcttcatgcatttttgcagcaattatagaaatctactttgttctrtatctgcggtgatgagtagcttcatgtttattaggaattatggaaagctcagttgaaactrtgctttcctctacttgcttataatgtgggaactgatgaatacaaaaaccagtagctcctttttatgtagcttttaaactatttaatgtacttccgaagaaatgtggattgataatatattttcttcctttttaaaatgaagaaactgaaactcagatgtggtcatttgaccagccccactctgtaggaagcagaatcaggatttgaacccattattttattgataatgtaggtcgatttttgctaaaccacaccgtttctcacaattctttgcaaactgtatattcatgtgttgaaaaatttaatatcttttctgacttctttggaatacactaggctaatcttcaaggattgtaaactccatgtaggttactggttttactctaagggtctccaggctaaacatgtagtatttgcttaaaaagtgcatgaaaataaagtgtggagactccataagataacattctgcttcggtgaagtaaccaaaacagaaattaagaaaacaattttatctgcggtcgtgtcaaaaataatatacttaggaataaaattaaccaaggatgtgaaagattattgcaccaaaaactgtaaaacattgatgagagaaattgaagacacaaataaatggaaagatatctcatgatcatggatcagaaaaatgaatattgtcaaaatattcacactacctaaggtgatctacagattcgttgcaattcctatcaaaagtcccatgactgacacccaactgattttcaacaaaagtgctaagaacacacattggaaaaaagataatattttcaataaatggtgctggagaaattggatatccatatgcagaagaatgagattaaatcactacttctcatgatatacaaaaatcaactgaaaatgcattaaagtcttaaatgtaaaacccaaagctacaaaattactagaagaaaacataggatagtactttactgtgggcaagaatttttaaaataagacctcaaaagcaaagcaacaaaaacaaatagataaatggaaggacatcaaactgacaagcttttgatcaacaaaggaagcaactaaaagaatgacaaatagacctacataatgggagaaaatagttgcaaactatatatctgacaaaggattaatattaagaatacatagggaacttaacagcaagaaaacaacccaagtaaaaataggcaaaatacattaataaatattgctcaaaagaagacattcagatgtccaacaggtatatgaagatatgatcaagatcactaattgtcagggaaatgcaaatcaactccacagtgagatacctcttcactccagttagaatcggttttattatagaattataataaaaaaagacaaaagaaaacaaatgttggcaagggaggtagagaagagaacactgacacactgtgggtgaaaatgtaaattagtatagtcactatggaaaactgtatggaggttcctccaaaaattaaaaatagagctgtgatatgcatataattcagtaatttcactactagatatatatccaaaagaagtgaaatcaatatgtcaaagatatatctgtacccctttattgcagcactatttacagtagtcaagatatggaatcaacccaagtggccattaacagatgaatggataaaaaattgtggtatatatacacaatggataattctgccataaaaagaaagaaatcctgtcatttgcaacaatatgaatggaactggaggtcatcatgttaggttaaataaggcacagaaagaccttatttcaaaacctaaaaaattggaatctaaaaataaaattgaaatcatagaagcagagagtttaaaatgtggttaccagagacgggaggaggaagatgggaggatagggaaaggttggtctgtggtccaagttacaatcagatagcaggaataagttcaacttctattatacagtaggttgaggacagttaacagtaagatatggcatattataattagaaaataattagataagcttttgaatgcccttaccacaaatgataaatgcataaggtgatcatcatgtgaaataccctaatttgatcataatgcaacctatatatgtatcaaaacatctgattctaccccataaatatgtacatataataatttttaacctctcctagcatttttaatagtaataacaaaaaaatcttaaaattcacatggaaccacaatataccccaaataactaaagcaatcttcagcaagaacaaagctgaaggcaccatagctcttgatttcaaattatattacaaaactatagtaattaaaacagtatggtactaacacaaaaacagacacatagaccagtggaacagaatagacagcatagaaataaacccatacatttatagccaattgactttaaacaaagatgacaagaacacacaatagggaaaagacagtttattcgataaatggtgttgggacaactggatgtccacatgcagaagaaagaaattagagtcttatctcatactgtatataaaaatcaactcaaaatgaattaaagacttatatgtaaaacctgaaattttaaaactactcgaagaaaygtaggagaaaagctccatgccattggtcttagcaatgatttttttttggatataacaccagaacacagacaacaaaaacaaaaataaatgagtgggactgcattgaactaaaacgtttctacagcagcaaaggaaacaacagaaatgaaaaggcaacttctggaatgagagaaaatatttgcaaaccatatatccaataaggggttaatrttcaaaatataygagttctagtccatttttgcattgctacaaagaaatacctgaggctgggtaatttataaagaaaataaatttattttgggccaggcacatggtggctcatgcctgtaatcccagcactttgggaggccgaggtgggcaaatcagttgaggaaaggagttgtagacaagtttgaccaacatggtaaaaccccgtctctactaaaaatacaaaaattagccgggcgtgttgacgcacacctgtagtcccaactactggggagggtaagacatgagaatcacttgaacctgggagttggagattgcagtgaaccgagattgtgccactgcactccagcctgggcaatagagtgagactgtgtctcaaaaaagtaaataaataactaaaaccaaaaaaccaaaaacaggtctattttgactcacatttctgcagtctgtacaggaagcatgccaccagcttctgttcctggtgaggtctcaggaagcttctgatcatggctgaaagtggaggcagagctagtgcatcacatggcgagagagaggaagacagagggaacaaaagaggttgggaggaggcgccacactcttttaaacaatcagatcttacgtgaactaccagagcaggaactccctcatcagcaaaaggacagcattaagccattcattagggatctgcccccatagtcaaaacacctcccaccaggccccatctctagttttggggattgcatttccacgtgagatttggagaggacaaacgttgaaactatatctaactcrtacaactcaatagcaaaaaaaatcaaacaaccagattaaaaaaatgggcaaatgacctgaatagacatttttccaaagaagatatgcaaatggccagtgggtatatgaaaaaagtgcttaacatcactaatarggaaatgcaaatcaaaaccacaatgaaatatgacctcacaactgttaggatggctgttatcaaaaagtcaaaagatagatgttggcagggttgtggagaaaaggaaaacttccatgttgttggtgaggatgtaaattgatacagccattatggacgatactatggagtttccttaaaaaatcaaaaagagaattatatgatctaggaatttctggatttatgtacaaaggaaattaaatcactatcttgaagagctgtctgcactcccatggtcactgcagcattactcctaataaccaagatatgaaaacaacacaagtgtctgttgtaagatgaatgggtaaagaaaatgtgagatatatatctatatatgtaacatgatgttttgatatgcatatgcataatatgcatatatttacatatgtgtgtgtgtgtatatatatatctatatatacacaaatacccagtggaatagtattcgtcctttaagaaggaaatcctttcatttgccacaacatggatgaacctggaggacattctgctaagtaaaataagccagacrtagacaaaaaaacactgcacgatctcactcatatgtggaatctaaaaacgttgaactcttagaaayagagtagaagggtggttacccagggccaaggggtaggagaaatggggagactttgcatacaaactttcaaagttataagatgaatacgttctggagatctaatgtacagcatggttactatagtttgtaatactgtctacttgcattgtatgaggagagtacatcttagatattcccactgcacatagacacacacacaaagttaactgtgtgaggtgatggatatgtttattatcttggttgtggtaatcatttcacaatgcatatgcatatctaaacatcatgttacatactttaagaatctacaattttttggtcacttatacctcaataaatcttggggaagaaaagagcgacctcttctgaattctagatttcatgctttttgtcagttcatggcccccagtttgaccgtggttgtgagaccttaataaatagcgatccattaaatggttaatttaaaaaaatcctgctctgaataatattccattctttggatataccacagtttatttatccatagaggaatcttagatgcatattaccaactgaaaaaaaaactgaaaggactacatatactgtatgactccaactatataacattaaggaaaaggcaaaattatggaggacagtgaaaagatcaggttgtcagggattggggaaaggtgtgggagagggacggatgactaggcagatcacagagggttttcagggcagtgaaattactgtgtatgagtagtgaattcatgtcactatatgtttactcacactcatacaatgtacactaagagtrgaccctaatgtcaactattcactttgggtaatagtgatgtgtcaatgtacgctcatcagttacagcaagtgtacttctctggtgggaattgttgataatggagaaggctatgcacgtgagggagaaggaggtatatggaatatctccgcrtctctctcagttttgctgtgcacctaaaactgctctaaaaagaaaacagtcttaaaagaatatgtactctctctgatattktttgttagcgtgctctataaatgttaattatgtctactgggctgttaatgtcaacttttctatatccatactgattttaatttcactaattgcattaattactgagaaaggagcgtttatatattaaaaagtagtctaaaaagcaaaaaaaaaaaaaaaaaaaatcctgcttcaaaaatacagttagtccttccctgtgactcccctccatgcaaattaattgccaaatccaccaaatactcctttccgttttttctttttttgttgttttttttgtttttttgttttttttgagacggagtctccctctgtcgctcaggctggagtgcagtggcatgaacctggcttgctgcaatgtctgcccccctgggttcaagtgactctcctgcctcagccccctaagtagctgggattacaggtgcacgccaccatgcctggctaattttcatatttttagtagagaccggggtttcaccatgttcgtcaggctggtctcaaactcctgacctcgtgatcttccctcctcgccctcccaaagtgctgggattatagacatgagccacagcgcccggcccaaatactcctttaaggccccagcaaaccaatacaatcacatgcacctggaatttgacagcttgaagtttatagccttactaaactgtttatcttatctgttgcttttctctacccctcaagatcaattcatataagtcagttatttaagaatttgagaaaaatgtgcgtttgccttaatatgttatattatgttcatcaagatcctgactcatttgtgacatttgctgttagaatgaaaactaattccaacttcattatctttatgtrcatttttattttttgccactctcactgtgaaggtcatggacagtgtaattgcggaagatgtgactgcaaagcaggctggtatgggaagaagtgtgagcacccacagtcctgcacgctgtcagctgaggagagcatcaggaagtgccagggaagctcggatctgccttgctctgggaggggtaagtgaggtctctcagggcttcccacggcctctccatcacaattcaaatgaattcaatgcacacacatctttttgtttgtttgtttgttttttgttttctgctttttggtttttttgttttttatttttttattttattttttattattataytttaagttttagtgtacatgtgcgcaatgtgcaggtttgttacatatgtatacatgtgccatgatgatgtgctgcatgcattaactggtcatttagcattaggtatatctcctaatgctatccctccccgctgcccccaccacacaacagtccccagtgtgtgatgttccccttcctgtgaccatgtgttctcattgttcaattcccacctatgagtgagaatatgccgtgtttggttttttgtccttgcratagtttgctgagaatgatggtttccagtttcatccatgtccctacaaaggacatgaactcatccttttttatggctgcacagtattccatgctgtatatgtgccatatttccttaatccagtctatcattgttggacatttgagttggttccaagtctttgctattgtgaatagtgccgcaataaacatacgtgtgcatgtgtctttatagcagcatgatttataatcccctgggtatatgcccagtaatgggatggctgagtcaaatggtatttctagttctagatccctgaggaattgtcacaccgacttccacaaaggttgaactagtttacagtcccaccaacagtgtaaaagtgttcctatttctccatatcatctccagcacctgttgtttcctgactttttaatgattgccattctaactggtgtgagatggtatctcattgtggttttgatttgcatttctctgatggccagtgatgatgagcatttgttcatgtgtcttttggctgcataaatgtcttcttttgagaagtgtctgttcatatcctttgcccactttttgatggggttgtttgtttttttcttgtaaatttgtttgagttcattgtagattctggatattagccctttctcagatgagtaggttgcaaaaattttctcccattctgtaggttgcctgttcactctgatggtagtttcttttgctgtgcagaagctctttagtttaattagatcccatttgtcaattttgacttttgttgccattgcttttggtgttttagacatgaagtccttgcccatgcctatgtcctgaatggtattgcctaggtttttcttctagggtttttatggttttaggtctgacatgtaagtctttaatccatcttgaattaatttttgtataaggtgtaaggaagggatccagtttcagctttctacatatggctagccagttttcccagcaccatttattaaatagggaatcctttccccatttcttctttttgtcaggtttgtcaaagatcaaatagttgtagatatgcggcattatttctgagggctctgttctgttccattgatctatatctctgttttggtaccagtaccatgctgttttggttactgtagccttgtagtatagtttgaagtcaggttgcgtgatgcctccagctttgttcttttggcttaggattgacttggcaatgtgggctcttttttggttccatatgaactttaaagtagttttttccaattctgtgaagaaagtcattggtagattgatggcgatggcattgaatctgtaaagtaccttgggcagtatggccattttcacratattgattcttcctatccatgagcatggaatgttctttcatttgtttgtatgctcttttatttccttgagcagtggtttgtagttctccttgaagaggtccttcacatcccttgtaagttggattgctaggtattttattctctttgaagcaattgtgaatgggagttcactcatgatttggctctctgtttgtctgttgttggtgtataagaatgcttgtgatttttgcacattgattttgtatcctgagactttgctgaagttgcctatcagcttaaggagattttgggctgagacaatggggttttctagatatacaatcatgtcatctgcaaacagggacaatttgacttcctcttttcctaattgaatgccgtttattcccttctcctgcctgattgccctggccagaacttccaacactatgttgaataggagtggtgagagagggcatccctgtcttgtgccagttttcaaagggaatgcttccagtttttgtccattcagtatgatattggctgtgggtttgtcatagatagctcttattattttgagatacatcccatcaatacctaatttattgagagtttttagcatgaagggttgttgaattttgtcaaaggccttttctgcatgtattgagataatcatgtgatttttgtctttggttctgtttatatgctggattacagttattgatttgcatatgttgtaccagccttgcatcccagggatgaagcccacttgatcatagtggataagctttttgatgtgttgctggtttcggtttgccagtatttgattgaggatttttgcattgatgttcatcagggatattggtctaaaattctctttttttgttgtgtctctgccaggctttggtatcaggatgatgctgacctcataaaatgagttagggaggattccctctttttctattgattggaatagtttcagaaggaatggtaccagctcctccttgtacctctggtagaattcggctgtgaatccatctagtcgtggactgtgtttggttggtaagctattattgcctcaatttcagagcctgttattggtctattcagagattcaacttcttcctggtttagtcttgggagagtgtatgtgttgaggaaatttatccatttcttctagattttctagtttatttgcgtagaggtgtttatagtattctctgatggtagtttgtatttctgtgggattggtggtgatatcccctttgtcattttttattgagtctatttgattcttctctcttttcttctttattagtcttgctagyggtctatcaattttgttgaacttttcaaaaaaccagctcctggattcattgattttttgaagggttttttgtgtctctatttccttcagttctgctctgatcttagttatttcctgctttctgctagcttttgagtgtgtttgctcttgcttctctagttcttttaattgtgatgttaggttgtcaattttagatctttcctgctttctcttgtgggcatttagtgctataaatttccctctacacactgctttgaatgtgtcccagagattctggtatgttgtgtctttgttctcattggtttcaaagaacatctttatttcttccttcatttcgttatgtacccagtattcattcaggagcaggttgttctgtttccatgtagttgagtggttttgagtgagtttcttaatcctgagttctagtttgattgcactgtggtctgmgagacagtttgatataatttctgttcttttacatttgctgaggagtgctttacttccaagtatgtggtcaattttggaataggtgtggtctggaatgcacacacatcttaatttaaaaaacagctgagatccctgaatgaggggctattagtctttttagaactaataataaatccaatttccatgaatgaaagtacatggagaaatatgattctctttctctctttatatatatcttttgcacacagacactctcactcactgtcagsytactttagccttaaggtatgttcaatttcagttcagttcagttcaatgttacattaaaaaacacagtttagacgtttgcttaaagttttctgaatgagaccatctaattgtccactgacatttatgaaacccagtaacattattttgaggacagtgttggcttttgaaaattcattgtataaacaaatagctatgaataagcttttgtcatttgagaaggaaggcatgtagcctcaggtgtgttcttggtatcagatcagtacaaattggagaaggacaaattcatctagaagaacacgtgttccattcctcttgatttatcaaaataagaaatgcaatttcacttcccacatgagaataacaaagttaatatgaaatatgcttttgaagaagtcgtaattgacattattaccaattttgttcaagaaaggaaacaaagactttcttcacttgaacattagatcagaaatttaattttatgttgcgtttttcttttttaaaaaatatatgttaatagagatataattcacataccacaaaattcacataccactcagtattttgatatrttaacataattatgcagccatcaccactgtccarttccaaaaaaaaagtttatcatcataaaataccctgttaccctatagcagccactccccattctcttgtcccagaacccctggaaaccaccaatctactttgtctctatggacttgtctattctgagtattccatacaaatggaatcataaaatatgtgatcttctcgcatctggcttttttcacttagcataagtgtttgcaaggkttatcaaagttgtagcatatgtcagtccttcattgctttttatggctgaataatatcctgttgtatggatacaccaccgttatttaacccttcatcagttaatgggcatttggacataggatttctactttttggtcgttatgaataatgctgctacaaacattcctgtgcgactttttgggtggacatgtcttttaatttctttggggtctgtatctgtgagtggaattgctgggtcatagagtgactctgttttaccttttgaggtagcacaggaccgtcttcaaaatgacartaccattttacattccaccagcagcgtgtggagtttccagtttgtccacatccttgccatttcttggtattgtctgtctttttgattctttagagtattctttataaagaaaactccakaaagtgtctcargttgtttgcagcacagatattttctcatatccattattttcccctaagggttgtaagtagaagagtggaggagtaggatatgggtataataatctttttaatgtcaaaagtatttttgactagccctgtatttcaccagtaaccccagacaggaaccattgttctatctgcattggaatattgtcattatagtgctgcataagccatcatgcttttaaagtaacaaagattraaattcatatccctcagactgcttagttaccaacacttgtaatctacagcaaaaaataattttacattattattttacatttacacaaagctttatctgttgggcccagacatgtaaaaaaaatgaccataggaaggctaaccactgtctcttttttaaaaaaaaatgtgtgtgtattttcaaaaatgtattataatcctagggacaattccatttcaaattaaaaaccttgggaagtaaagaaaatgacttcatctcaaaaatagatttttgatcttgaggatactttttcagttacatttaagttagagaactttaggtacagtgatttttactgttatcttaaagtggtaaacaaagcaaagggtgatctgatatcttaaaacattatttaaagggtttacatttggtaaaattatttaaactccaaatggttatgttgctagtagaagtaaacagaacagaaaccaatagggatatgcacttatattttaaaacaaagaaatgaacaaaatgtatacttttaacaaatgcttttatattttgaagttaaaaatgtcaaaccatataatagaaagataagaaaagcatacaaaatagctctcaaacagagaaaatcactgtaagtatatacttatagcaatggtttttcatttgtctctaaattttttaatatgtagaacaagtaaaatgaaattattggggacttaatatattgatcttttataaactccactaggtttttcctcaaacatgcatrtttcctgtctttctggagattcactaacttatttagctaccattttttaagcaatagagtatgtttaaactttattttattaaaaaggtgttgagtaaatgtatagaattatgatttttaaaattgtttataattcatttcagcctcttgaagtactttaaaactaaataagcttcatcagtttccttacatgagcaaartaattttgcagggaatcatgacagtatgtaagatttttgaaaacgaaaaccaagaatttatgacagccagttgagtgcctttggtcaaggtcacggaccctttctttctcatagtgctacatctgcaaacacattggtactggatgttttgaagcaaatgaccagtatgaaaacttgtaaagagttcgttttgcaatttatgaatgaaaactgcagctgtggttacatgagttaggaaagcaattataagacccatcagtttctcaatcctgacagccgccatcacctcaccagctggaaaaaaaaatcctagaagaatatactgaagtttgtcagggaccaggtgaaggcaatatatatatatatatatatatatatatatatatatatatatacacacacacacacatatatatgtgcatatatgtgtgtatatatacgcatgtatatatgtgtacatgtgtatatgtatatatacatatatgcgtacatgtgtatatgtatatatacatatatgcgtatatgtgtatatgtatatatacatatacgcatatatgtgtatatgtgtatatgtgtatatacatatatgcgtatatgtgtatatgtgtatatatgtatatgtgtaaatatacatgtgtatatgtgtatatatacatatgtgtgtgtatatgcgtatatatgcacatatagacataggcatgtgtgtatatgcgtatatatacacatatagacataggcatgtgtgtatatgcgtatatatacacatatagacataggcatgtgtgtatatgcgtatatatacacatatataggcatgtatatatgcatatgcgtatatatatatacacatatctagacatgtatgtgtgcatatgcgtatatatacacatatatgggcatgtatgtgtgtatatgcgtatatatacacatatatagacatgtatatgcgtatatatacacatatatagacatatgtatatgcgtatatatacacatatatagacatgtatatgcgatatatacacacatagacatatgtatatgcgtatatatacacgtatttagacatatgtatatgcgtatatatacacgtatttagacacgtacgtgtgtatatgcgtatatatatacacgtatgtagacatgtatgtgtgtatgcgtatgcacgtatgtagacatgtatgtgtttatgcgtatacacgtatgtagacttatgtatgtgcgtatatgcgtgtacacgtatgtagacatatgtatgtgcgtatatgtgtgtacacgtgtgtaggcatatgtatgtgcgtatatgtgtgtactcgtgtgtagacatgtatgtgcatatgtgtatatatacgcatatacatatgtatgtgtgtatatgtgtatatatacacatatatagacatgtatgcgtgcatgtgtatatatacacatatatagacatatgtatgcgtgtatgtgtatatatacacatayacacatatatatgcatatatgtgtatatatatgtgtatatatacacatatatatgtatatatgttatatagcatatatatgatataaggctatccttgtatatatatgtgatatatatatatgctatatatatatatrykctctctctctctctmtatatatatatagccttcacgtggtccctgatatacttcagtatattctattaggatttttatatatatatatatatatagccttatatcatatatatatgatatatgtatcagaaattaagttaaatttctaatttcttatttctgctggtggtgactaagtgtgatcattatgtcttgaaggtagaataacttagatgatgtcttacattctgtatcctgtgattccttgatttctataccatattggctgtagatatattttcatgtaactagatgtagctcatatagccattatagrtataaagacattcgtcctaatttcggttcctgggagtaaaggtgggaaaacactttctctagtctcctagtgttgtgctcaaaaactataatggcttatggtaggctaaacgttagttttacattcttcctgattaaagaatacatcattattattatcgatgttctcctgagcatcagtttgactttggtttaaaaaaaatgtgagtaaagttaatttgcatcacatctgagcagaagctataagaagcagtgaaaaatctgccattgtctcaggcaggaggatttgcagtgctggagatcgtctctgacccattagcttggctctctgaatgaggatgggcaggagaaacctctattaatccaccaaggttctatgatgtgaatgagaaagaaacacctgttgttttaaacaagtgagattttggagggaggtgttcttgcaggagaatccctgactgataatcggttccccatataaaatgtagggaatgtggttaagccaagataaacaaacacagcaaaaatcatgtttacataatttatattttgtattatatacataatttataaatgccataatttatattcttgtagcaggattcatgtacaaatctcttagtattgattcttggatatggaatacataggtctaaaaaaaccatgcatatattttataaatgatgtgtttatgctcttctgtcaacagcatttatgtgcactttgtcaacaggtaaaatgataagaacattgaatacatttttwaaaatttcctaaaaacacaatgaggtaggaagacgtataattattattctttttacagaagaagaaattagatatctgaacagtttgccattttacataattgcaatggtgcaagtttaaaaaaaattaatacatgttctctgactccaaggttgttgttttggataacttacaggttcttgttacatgccaatttattggacratatatattaaacatatttcctgttacaaatataattctgcagaataattgaaatggctgcataatattccattatatagttgtagcaaaataattcaatcaatcctctttttattagatatctatatgttcttttattcaagttctaaatgccataatttatattcttgcagcaggattcatgtacaaatctcttagtattaattcttggatatggaatacataggtttaaatgaaaaaaaataagttaaatattttgaagaaaaaagtccaatttataatctctaaaataaattatacaggtgtgctctcctgccgggggcttaagaaaagtcttcttcccccaccactagtgacaatttraattatcagttagctcttctcaatgtatwttgctgttggtgttacaaacttttgccatttatcaaacttctttcattgacttctataatcatcaaaacgaatgatttatctgcaggcattattattcagaggcttgtgttttcagtatttgccttctttgatcatcgtttgtccttgtgtctaagtcatcctttcatttgatactgcaatcccatgtgcttttcttatctgtcctgtttgccctttggttttcttttatcagacttgttctatgcggtattgcatatgttttagttccttaaacacataaccatacacccccataagggaaggtgtgaaatgggggaagaatgatagatggaggctaattatttaatattgtaacttctagaaaatagaaaccatgtcctcatttttatcaattagcatgctttaattaatgaattaagaattgtttcaattcccttacctaggaacatactttcaaagaatagtagcatgccaaattctcaccatctggatatttttcaatgaagtcacaatttatctttcctttttattgggaaagcccatctttaatttcctgttttatttttcagagaagttttcatgatacatgctttctttcctttttttttttctttttgacctgtgtgttttttactctatgtaattttggacagctgaatcattacctttcttattcatgtttacagagagtttatttatttggaacaaagagaaagtttaaaaatttggaagttctccaaacattttcagttaagcagcataccatatacagtgattatgattatattttaaaatcctttgtggcttaactaaccatcttatcataagtttgctgctgcaggaaatgtgctgagtgtttaggtaacaagggaacccccaatgtgttcttccagtagtactttgagaaagcaagtgggattcagatttaccctattctgtgctttctgctagattgattcattatttctgccagtgctagaggaccctggaatagtcatgaactgagttatgccatttgaaacctagtttttataaactatagccaaagatgataaataaatgaccctgcaaaattaacttatttactatttcttatccaagaggaatggtcctgcttttagtgtgcatcaaatagggagaaatataaatgaattggtgagttttttcagaaggaaaggcctggactttgtcatgttatggacattaaatgacaagaataagcctgcataccaccagggagtcttccatgcacctttgatcatgctttgaactgacaatgcccactattatgggttgtatatgctctattaccatgcaatagcccataatagtaatattatatgtagaaatagaagagcctgtttatcatttgctttctttatactcattatgatatcttaaactgtatatgcatcatacatttcagaacatgtcgggaatgtaattgttatttattatgaggttattaaggatagtactgatatgagaagactgagatggagggagaattaaatagggtgcttctggtatcctttatctatctttatgatgcacttggatttctgtgttgggacattgtgtattctcatagagatagccaaaggtgcaggtgctcagaatagtcatctacttgaaggtcctagttaaatccagtattaaatctctcagtcatatgatgaagcagcatttactaagctaatgacataatctgcatatgtgaaaagaaattattaaagggaatggaaaagagccttgttaaatagaagagacgatctcattcaggttgatttttcagagattcccctttgcagtaggtatttatgttccttatttctcctcttgtgtttgatcttgcctttcatcttgctattgttatattcaacagaacagagagaaaagaagaatccagaagctgaatttaatacttttgtttatttttaagagatggtagaaaataattcagtggaaaataataaacataatatattttaattaactgaggtttttctaactaatagtccagaaaactgtattactaccaagtaagagagagtatttttttcctgttctaaataaacaatctttatctatggcaacagaacagtttgtatcaaagataggaattgatccaaataaatagacaagtttcattacattttgcattatttttatgttgtaagttgaaaaccagtgaaattctttggctaagataacttcctagtaaagactgcaaccagtattgtcaaaatgtatttgaaatgaaaatagaaaattggacttgaatttaattccaatttctccaggcaagcttaaaataaatgtgacagttatgaaaattttgttactatgattatatatttatttctattaaaatactaaaattatagtgcagattgtagtggaragctttagcagttatttacctgatttcattcaatataaacaggcaaaccagatacttttatgggaaacaatttgctctggttatcagccataatcttcatagamtcagcctcaacagatgttctttctaatagaaaaccaatgaggcacagtgttatccctttgtgtagcctgtagagtcacatagctgatcagaacctgcgatgcccctcttaggatacacaaaacttaatagggctggtcattgtgctatagttgcaaaacgaatgcagatactctacactcacagcatacagacaacatgtacatcatattttcataaacgatgttgcttatcataatcaatctaatatttattgatcttaccaccatgtatctctgggctaagctagtggtcagaaaastagggttaggcctacattctctttttgtaaataaagttttattagatcattgccatgctcatttgtttacgtatagctactttcttgctgtaatggcaaagttgagtagtggccacagagagcacagggyccacaaagcctgaaatatttctcatgcagccccttacagaaaaaacctgctacccytgagctaagcatttgtgataattgtgacaaatatgtcgggagaagggattgagtgtcttgagaatcagaggaagatgacatttgctcaatttgtgtgcaaatatggcttcatgaaatgagtgaacctagtgggtatctgcagagatgagtagtagcattaggcagataataatttagaacaaaaataaaaggacatcccaggtaggaggaagagcagggacagaaactctgagttatgatgggaataatgtgtaaagaacaggaarcatactcacttgtgatgatttagaaaaaataagaaaatggtgggagacagcctggggggaaatatgtctctccctcccacctaacttcttcttgtgtgattgacaggtttcagacagaaaaatccacttctttgcagagctctctatgtcataattgtcttatgaggttaattgttagtaaaatgatgtcatagaaatgccaagttaacgttgcttcatgcccatccattgggtcattgctaaaatgccaagttttatttaactgaatttagcgagattcaagtttttccatgaacaagacaaatactttaacatcctttcatgtgcccttctgcacctcgtatcatgtttacttaactactgacagaagatgagaaaacaagcacaaatccaaaattgttttattcgaaggcatttatatcagcaaagtattaaaatgacaactgtcagcagtcagatttgtattttgagaatgagattactattatctagatattgggtatgtatatagatgcctacatgtttaaaatgggaaagggtcacgttgcacagttagttgaacagtaagctactgggatagaggtgggcagaccctgagttagtctgggttcagtcactagccagctgtgtgacccagcaagtcatacactgaactggcagcagaacccttctcggtgaccttgaacttagctccataagcttgcattgcctccctttaacctctctttgcaataagtgaatttgacactgtgttctgactcatccggacccctagattttatatctactcaaatggacaccatgcctgtcatttctgacataccttcatagcagactttgtgtctggttttgcaaagctaactagacagactaagatctgactaactacgtctcatgagaatcatgtgactaacccatcgttctttcagactctgctttctaccaagagtctgcttgggattcaaactaatatattcttcagttatggcattctttcctttggaatataacaatttaagatggatgagattttggttctccataaatatttatttttcatgtgttgcctactatttggataaaggcaaaaaggcaagattctttggcttcctatttaagtttataaataattttggcctctttgatgctcaaaatattcatgccatgtggatgttggtaaataataccaaatggcctggcatggtacagttgtaagctgcttaagatttggatggtctctagggtgaaacagcaaatattttgaggtcatgtataaagtcctttataaagatgtgaactcttttgccaagatttctttgcagagccctgtattgtataatagttaaccaaaggaagttaaaaggaatgtgaaaaacataagaaaatatggagtatgtagtgcctggtaaagtctctcctactgcttcctttaatttgctggaagtctgggtatggttaatgatactgttgaattayagttgcaatggtgagagagaattgtaaaactcaccctcttgagtgtagcttaatgtaattataaaaaaaaaggtggtagcaaaatccaagtgacataatttatgcttgagtctagatatattctggataactctacatagagaggaaaacccagagggattgcagtttttaggttaggcttcttagtaaataagattttggatgtgttaggaggcctggagtcttgtgaccacacaagggtatgacagggtgagcacagggcgacactattcacccctgctcatctattcatcagtgatactctcctcttcactggcaaggtccctggaaacactattaacaggcatcagtttcttgttcgggtagaaagacacacatgctgccaacaccgtgccttccctcagcgtccgtagcttatcaaaacagccaggctccaactgtgagggcgtgtgctctgagggggcagggatggaagagatggccacgtggctgcatgacaccctcatagagctgatgtctcacaccacttattattaatgtgactttgtagagttttgtatttttaaaaaaactttttggacccttaactttgttatctataaaaatggcattagaacaattgctgtttactctgaaatgttgttgtgagagacccttgaaacagtatatatgaaacttctttgttaactttaatatacaattttacgggcttacaaggttttaagtagatggcataaaaatgacctccagggcatacgatttaatagagaaaacaaggtcaacgttcattcattcattcattcattcacccagtcaacatatatttaccagggtcctcctgtgttcccagaaccactctcagtgctgagaaaaaatagacaaggcaacggatgtcatagagtttgggaaaataagttaaaccagaaaacaaataatttcagatactcctatgagaagggaaatcaagagaatataagagagtggccaagatgaagtctgggggctgctgtaagtacggagggcagggaccctctcccaggaagtcatatttggccagattggagtattgaaagtgggccacatgacaactcagggaagatggcagaggaaacaggaaaacaatttcagactcaagggataaagttttctggaaggagatgtaagtcaggtgggcttcatcctttaaaaaaatcatggaggagatgagggcacttggagagcttgcagaagtatttttaaaataccagtgctgagttcccacccgacttgatttgtctgcaatatggcctgggcgtccgggattttaaaagctccctgggtgactctgctgagcagccacatgaagactcaccactctgcagggttgtataacaggcacggtcctgcagcaggaggatggacactttagtttttgccctacttcccactgagcaaacagggctttagggagtgcttaaaagttgcacaaaacttattgctctgtggtgtcctttcccaaagctttgttgaatagggataggagggaaaggaatgagtcagggacaagaggggtgggtgggtcgggtaggggtgtagagagaaatacagagaggagatcttgaacaatgaaccaccttaggcacgtttgaataccggcagcatacaggacaatgattatttgttctatatgaaagataattggctgaatagatagaattgtcaaagagtccagaaaaggggctttgtcagaaatgcattttgggttttcgccatagataatttctgctttgaaaaataatatggaggaatgtatttagccactctttttcctagaatagccatggtgatatttaataataaaatattatttagttctgttaccacaacagtactaattgttttccatgttgtcttttttcccatgcatattttcttatgtgttgaggagaggcattcctcaggattatattttccttgttaatgaaactaagaattttgtggatgagtctgtgtaggtgcagtttgagcacattttccattattaaatcaaagaactgaccagcgaatccatatcagctccctacaatctgttcccagcccagccttcctgcttggtccgctgctaagctggctccttgtctgctttgtccccaggtttttgtttgggctttcgcagctacggtgagaggcgacacttctgagaagtgaggcgcatgctcaggggagcaatgagccaaggcgagtttagcagtaaaaccattgcatgttgtccagagagaggctcctcaggaccaatgctgggagatagcccagagagagttaggctgtcctcagatgctccccagaaacccttcatttgcatagtgcttcttttgaagagcccgattttgaaacaccacttctgtcttagctgcaggtgaccccttgtgatccacattggaggtataccccaaccctgccctcaggttagattcctagggctgcaaaaacaaatgaccacatatttgatggctgaaaacaacagaaatttattcccacagctctggagatcagaaatttgaaattgaaaaatgtcaggatccctccmaaggatctaggagagaatccttccttgctgtttctaacttgtggcttttggcgttccttggcttgtgactgcatcactccctgctctgcctctctcttcacatggctatcttacctgcctctctgtgtgtccaagctcccttctcctttctcccataagcacaatagtcttcggacttagggcccaccctaaatccaggatgattcagctctagtctttaattatatctgcaaagaccctatttccaaatgaggtgacaccctggggtcctaggtggacatgaattttgaggaacactattcaactgattataccctcttaggggaaatcaagcccgcttctaccagagatatttattcagaaaataaatgtcttatccaccatatactactttatttgctgatttgtgcacattactttggcctgaatgtttgtgcccttcttaaaaattacatgttgaaacctagccccaaagttgatgatattagaaggtggggtctttgggaggtgattaggtcatgagggtggagtcctcatgaaagggaatggtgctcttacaaaagagaccccagagtgtggtagtacatgcctgtagtcccagctactcaggaggctaaggtgggaggatttcttgagcccaagagtttgaagctgcagtgagccatgatggcaccactgcaattcagccgggaagacagagaccatgtctctaaaagtaattrtaataataataaaataataaataaataacaaaagagaccccagaaagctagcttgacaattccaccatgtgaggacacagtgagaaggtgccatctatgtgtaggaagcaggctctcgctagacactgcatcttccggtggcttgatcttggacttcccagactccagagctgcaaagcatagatatctgttgtttatgagctactcatctatggtatattttatagcagctcaaatggactaagacaagtatcaaagttcaattagatacagcgtaaaaaagaaagagaaaaacataaatcattgcagtagaatgtagtaaatgctctgacggagatatttgaggtgctctctaccagcaaaattaagagggtgagggaggtcttgaatggtcagaagtttgctcctggagaaatggggaagaatatgtccaagacaggaaatcccatcacgaagcacagaaagatgaaaggatatgataagttcaggtaaytgtttcatccagcttatgtatatccaaggtaggatgggagtctttatttgtaagtagatctccagtgtgaatatgaagtattttggcttaaattctgggggtataaatctgtttcataaaactttccttctgtggtataagttgctcagaactctgagatcggctttctgccttcatagctagttttctttctttttctttttataattgtttattttttttaaatggagtctcactgttgcccaggctggagtgcagtggcgctatctcagctcactccagcctccgcctcccaggttgaagcgattctcctgcctcagtctcctaagtagctaggattacaggcatgcaccaccatgcccggctaatttttgtatttttagtagagatggggtttcaccacattggccaggctgttctcaaactcctgacttcaagcgatctacccacctcgacctcccaaagtgctgggattacaggtgtgagccgctgcaggcagccgatagctagttttctgagaggtactctctgatgtgcttccttggccagaataatctgcattgtaatgagggagttggggaatcccatatccagggactcttagcctggaattcatgcaaccccagaggatggttaggtatcagacaatgagaacaccttaaaatggcacaaatatattgtgtttaccttttaatatttttgtgcagaaggagtccatagcttctttggctagattataaaagggctccataatatcaacaaaggtggcagtgatttagacatctctgcataaaatcaaacaaagacttttagctgtcacaatatattattttgagctacatatgctttaactaggtactgtattgtttactaagtaaattagtaaattattcaaaaggtagtcaaacatagaagtaccttgtgatatccagttttatttatagtttttgattctgcttttaaaaaattggaataaaaaggtagaccaagccccaaattattttactataagtcataagaatttgtcactgaagtttcttttaaggataattggtaacaagcagaagttcaagcagagaaaagaattcctctcctgttttactctcagaagacagtgatctttgttctataattccttaggttttagtgtgtatccatgagaaggatctctattctgattaatgtggaagcactggatgctcatatgagtacaacctggcatcctagaaataataggaatacagaaacaagaagagaaataattttaatttctatgctaatcaagtttcatttgaaagtcttttaagcagactcatctcattatataaaaatacagtcttttattaaaactatagaaatttaataaaaaatataattgatgttttgcatttcctacatgactctaacctaatatttagccagtttatagactggctaaatcaaccttcagccgtattattactgttttaactttggctagtgaatatccatatgaatcttgtgaatgtgtgggatatggctaaattgtcaaagacaatttcagtgtggcagagcacccagaacctgaggagacagtagtgaagaagtattaatggatcatgaagcagtagtaacagtggtttgttgatattgaatgatccagggcctacctcctgggcttagaacaatttttttcactatatattcatgtacttaatcattcactcaatgtgattagttacattggcaatataaggtaactagagaatcttcctagtattcactttagtgaaataatttgggttgctgctatttacctcttacatatgctgcttatagattctggttgaatccacggactttgtttctatgctattaactagctacatggggggaaattatgtttagtgagaatatttgctattatttgttcaacataggcaatagattaggaaagtgttaaagaagacatggttgatgcctactatagatcaaagacttagcracaaaaagctatggtgttgctggtaccagatcacactttgcagcaatctccrgtttgggacatataaagagttgttcttcgttttctatgtcctgaaagaattctagcttcctttattacgttttaaaatcctttgtcattagttatagtgctgagcatataagaaaactatacagcatctattttaattaaaagaccttagatgaaagtggcagaatcccaattcaaacaaccagaaacaaataaatgatttatgtgctcacaaaccaaaaaggacaggggtacagatgacctttgggaagaatggtaaagggacttagacaacctcccacagactctctcactctttcactttctgtatcacacctacacccgtgtacatacgcatgcacatgggttgacgcaacagcctccaacacacacgtttctgcttttatcagccctttaatctgaatcttgtctactgcagatggatttttctccatasaggaggaacatggattttagcatcgtctaaggttatagttttactatgctctgaccaagaaagattaaaggcttttccttagcagtttaagggagaaaaaaaatattcagggggaaaactcagattgactttgcttggatgaaatggtcaggtttgaaccaatcactgatgatagagggatggtagcgttctaaatttgggtcaccactgggggcaggtgggaattggggcaacgagatgtgagactgtaagactttaaggagtccttctgagcagaccacagttttcactagatacaactgcattcaggttgatattgatcttgagtatcattgattacgtgtacagccttcttaatgtaacaaagatgatacatagcttattttcagacttataaccaaatgacagcacaacaggacaaaataattcattgatgattgtggtaggtagaatactgcccccatcaaagacacccctgtaatcccttgaatctgtgaatatgttagattacatggcaaaagggacttatgattgctaatcaaaagattatactagatcatctgggtgtgcccaatacaatcacaagggcccttacaagtggacaygggaaagaaagagtcagaatcaagtgattcaacatgagaaggactcaacctaccactactgcctttgaagatggagaaaggggaccaagagccaaagaatgcagcctgtctctaaaagcttgaaaaggccaggaaagagatcctaaagcctccagaaggaatgtagtcttgacgacaccttgatttgagcccagccaaaccattttagacttctgatctccagaactgtaagacaataaatgtgtattgtttttaggcataaagtttgtggtaatttgttattgtaggaccaggaaatgaatacagtgatctttggacatattctttggcatagtcaacagaatatacatcagaagctgtttctgaattatgtattcccatgtattttgaaaagcttttttacaaaaaatctgaaaaagaattatgtataaaagattatttcctttactgagagtatctcaactataggcataaacatagattagttgagatatgattttcttcttggcttttttcttgctttgtcttaaaatgaaaccagtcctcttataactttttccaaagcacaactttatagcttactcgttgcacctatttgaagtcttacaatttattccatgttgtaatataatcttggtatrttgtttttaatgattacacattaacatattttaaccaagcataatatgcattatattccgtcgtttaatcaatttttctatttaaatggcccatgaacataattacaatattttaatattatggcctaaattgttttactatttttacattgtaattctacattgcaatttgggatgcatgtctttgtctaacrtagataagtagattcacattttgcagggtttacattttgggagtcctttttaataaaatgaattcaaaatcaaaagtacaaagttagttaaggtgaatactaacttaggatgaaaaggcaatcagcacaaattacatttttatatcagacagataccataaacctcacaaatctagaatatgatgtaattataattttacacatctgttgtaagtggctctgtatatttcaaaacttgttcattctcaacttcttaaatgtgrgctgagcattataggatgcatacaattttattatttgatctctcgtcttaaattgtcatgacccaagagggctacagcagtatttctagaaggcatttctataccctgaaaagccacagaagtgatggtaccccactaatmgcaaaatgaatgtgtcctcaacccaccttctctttggctgaatctcagaagtacctggagtctttccagagccactggacatgagaggaaatgtggatgagtcaaagttagaatagaaggagagtcagtcatcttacttcactcaaaatttcttattttggaaaaatttaaaacacgtatgtcatctattgtcatggtccttctcagtgccagagactcccaccagtgaggaaatctaaagaatagttgctgttagttccatggtaaatgtgcctgtctctttgatgattgatactgaacaactgcacctggggctgtacccaaagtggagaacagtgagtttctgtgtcgtgactgtcattgaccttccacctttcctctccaaaagaataagaagcraatcaattgtgaagatggagcaggtgctgtgattcagcctttctttatatcaccagacaaggtgaagccttcctgggtttatcatggtctcccaaaggactgttgacacctttgtacctacgcagctttctgctgcttgatgctaatatcatacacgttcttctgaaatattaacaggaaaatatctgtttgaataaatagctttgtacaagtgtatgtctccatcccaggcatccttccactccctgggtgtgtatggaattagaaacatgtaccacttcatcagctttcaaacacattttttaaaatctggaagtgtatagcctggggcctcagtgtttctatttctgtttatttgtcatacagagtgttgcttctcacctgaaccccttgcagacattccagcaaaatgaaaacatgaccttgagccttagtttcacagtccatgaaaagctcaacttttattatrgaaattcagggttasagcccttcttttttttctcccacttaaaaagggataaagaaactaacccacccagattgctgctaagcctaacatgagctttgcatagccattgaaaaaggttcccacactctagaatttttattccaccttttaaaatgctcttgtccatctcttctgaagactttggagacaggagatttttcagtcttaatgcattgaaatgaagataatacaaaaagaaagctttttcaaaatttttagtctcaaaaagtcttctcttgggaaaaggcagacctttatcttagtcaaaagggaatgagactgttggcaatgacaaattaaagtttgaggggataattgaaataaggaaatggaaaagtatggctgattatccccaaagcctggatcagacaaggaaataagccagaggcagcatagatttgagtgaagatgtgcaccctcaggtcaagagctgaggctggttgggagcaaagaaaaataatagaaagaaagaaatgggaggaaatgttttaatacatttaagatagtggaatataaataagcaggcaggggtttctatttctatttattgtgtttcctttgcctgcacagagtgttgattgacttcacctttctccgtatccagaaatccatctatgtgattaaacttttgttcttaaacaaggcttctaatattagatggaagatttaatgaataatagtagttaacattaagtgagtacttatagagttctaggcactgttctaaatgtttgacttatgtcatttaataatctcatcaacctcatgatgatggtagtatcatgattatccctacacagctagtaataacaccagcgtctctgtctatataaatttaatcattcctatttccatcaataccaattcagtctaggttcttgcttttgcccttctctctgtctagaataaccactgacaccttgtaagcctgaaaaaaatgcaacctcacatgtagctgtgatcacattttcctccatattccagctaaaccggtgcgcacttttagttttgtatttgccgtttactataattatttgttggtgttggtctctctgactccatgagtagtgttgattttctttgtatttctaaaacctagaatctagcaaacatttgactgaataaagaataatgattgactgtgaaacaaatgactacatgagcgcacagatggatccagtgtttttttcttttaaataaatgatcatgtaccagtaattacagaactggttctaaacatggattcttatgtagttagagatccatgaatagaaaatctttatttaatttaatacgaggcctctagcctagtattcagttagttctaggttccccagcactgatctggaagggaaaagaaaattgaatctgaaatgaggctgggatgtgtgtgtggggtatgtatgtgtgtgtgtgtgtgtgtgtgtgtgtgttttcctgtagttgtgacttaatatcaaagacaattgcagataatatgagaacttttcattatttatgcttgttttctctaattgagattagattatattttgcagataaacaatttgaattcgttaataacgtgatttttgaaaatcactgacgcttgttaatgttaactaggataaatattattctctatttaaattgtgtgttttgatctttccctttaaaaataatttactacaaattttaaaatattaaatattaatatgataatgcaatccgaggtttataatttagcttgatcccatgacagagtaagctaatgttaactatataatcaacaacttgtaaaaaatgttcagagattacctcttaaggcccacagtaataaaactatctacacttttctctaaaagtcataaaaatgtttgtgaaataaaatcaagtttcatatytttgtgtactgaaattagtttcttattcctacccaattatctaacatacaattgtcattttgttatgagatacatacacttctcattacacatggagaagcattatgtcattatttttataaaaggctgataaatacagttgttccttcatgtatggctcccatacagattcctggtaagatgattctataaaattatataactcaaatctcctgttgactttcatctgaggacaggcagtgggttcaccgtgagtcactgtagttcaaagatgtaaagaaatctgttgtaatcacacttaaccttcgcagagcacaaatttaaagggagactcatgatttaaaagtggacaattaacaaatgacctttctccttcacattaggtgagatcatcagggcagtgtggtaagtagtctgactgtagaatattttaaaggaatgaaagtttttttgggtataccttctggccttctgggcctgtttttggccttctggccctgttttaaatcccatttttaaaaaccctattgcttaaaacagctaaaagaacaaattttgtaagcattccattagactggctaaacatctccccccacccagtttacaatgtatacaatctcttatattcatgtggcttagtgatttgtacaggatgacctaaagccaccaggattcctggagatatkcttagatgtttactaggttgctttggagagtgagaagaaatctgggcttgttgagctttacctaccctacctactgctttctctgggcaaattcacttacatatgttttatttagcatggatctgttaatactttcatttggaatgaaatgtttctgccggtttctttctgttcttgtgcaaatgtgaaaactattgctttagcgaaagcaaacaccgttacttcctgaatcacagctccctccaaaccactcctctccagataaacatttatgttttatgccccartaactacacttccttttattttccctgctctgagccttgaagtgttcacctraaagcattttaaaatagtctgtaattccaaaggaaatgaagtaattgtccatggaagggaggtgaggactcaggatacagattgacctggggttgctcatgaattgagaccaaaagaaaaacagaggtagaataaaatgaaagggagaagwgctcagtgaacatctgtgctttctctttgccgagtcctgacacagcgctcactacccctctgcattttatccctgtcaccatttggagaatcaggcaggaaggcccagcatcagggatttcctctcccttcaaattctggtccctgcaaccagctggagccacccacagattccctttgttgatgagtgcttccggaaggtgaaggagaacctccccatcagggggctgcaatgttccaaactgcagcatcattcatgacgtggctaacatttaccttcatttttgtagggggtggagaaaggtatttttttatagtaataaaatacaatctgtgaattctgccatataccaaattaaaagaggttttgcggtacagctttccatggagacaaggaacaggtaattattcagagataatgcttctgaaacagaacattgtcagtatataatggttccctgccggtagataaatgcagaggcaaagacagcatatttattttttaaagcaagagacattcagtgatgcaattgcaactcttgaaattacctttcctgttttaccagatgaaaggttgtagatttaatcatcatgcctgatggagcactggtgtcacaaagtgacagaaataagcccagtgacagcagccctgctgtgtacagattgacttagtaaacactcttggcacagactttagccgttgaggaacttcttagttataaatgggtggattctccatatagctgctcaaattctaaattcattatattcctgccagttaagccttcgtatgtctttgctttgccartgaaaactcagccggccaggaacaaatcatatacagacttaatttgaattcaagggatgatattgcttcttctgtaggttaagggttgcagtggtagctcgatagttgtgtaactacactgcactgcaagggctcatcaggtcccactcagtattttatttctaataatagtaatggctaattttttttttttgagatgaagtttcactcttgttgcccaggctggagtacaattgcacgatctaggctcaccgcaacctctgtctcctgggttcaagcgattctcctgctttagcctcctgagtagctgggaatacaggagcctgccatcatgcccagctaattttttgtatttttagtagagacggggtttcatcacgttggccaggcttgtctttaactcctgacctcaggtgatccacccacctcggcctcccaaagttctgggattacaggcgtgagccaccgcacccggccagtaatggctaattttattgagcatttaatgatgcgttagacactgttctaaagactgcacatgtatttttcatcaaccctataatgtatttttaaaatgcggtagatttctcttttacccagggagaaaggagaacttaagggaatggcttggatctgatcacatggctaataaatggtagaacttcgactcattgagttgatgggcctcttaaccattgtacctttgctattcaaagtgtggtttgtagactaacggtatcagcatcaaattgtatttcagatacaacttcagacccagttaatcagaatttgcattctaaagagatcccaggtgatttgtagtcttcatagacagtgtctacaaacttttctggaatgcttttgctattttaaaatgaagatcactaccacccatggatttttatagcctttctcatcatctttgatctattaagcactttgaaaattacactacaatttaatggcacagaaaagaatgagttttgtggacattttaattttagaaaaatgtcattgtaagtgaataacaattttctccgaaataagcagcttaccttagaagttagcttgggactgattgatgtgagtccccgagagatagcccttttgctgaatcagacagatctttcatctatctctaaaaagtaccatctactccaggaaacctggcagtttctactacctttatctgcattgctttgcttgtgacagtcctttgcatatatgatggcctttttcagtgctttctaaagctatttttaatacaaatgaaggatttgaatttaaattaaaatccagctgcacacattattattaaagataatttcgttgtggagaaaatctaatcagtagatatttttattgatgttaatgtgccaattctcagacaataggagtacatctttttttataaagaaatcattttaaaattgatcctaatttcagaaaccttaaaatatgaaaacaacattttagagttaagggtttagctaattaaatgttttccaaatttaatcttagtgtttcttcaatagggagacactggtatatcttaaaaagagccctggactaggaggcagaagatctgagtgaaatcctgattcagacacttataggctgtatgactttgcgtaggtcatttaaccttttggagactccttcatcttgtctgcaaataaagataaaacacgagaattaaataaggattgaaacttgcggttttctgtttcactcatttctgtaacaggtttcatgttttactttcattttcactgcttctcaaagtgtagtctgagttataagattcctctttcatgtaatttttttttatatttcttacaagtttttttggaattatgaccacagaccatagcttgtagaaaacatgtgatatttcaatgctttttgtaatacactttattttttagtgcacttttaagttcacagtaatactgaacagaaagtacagggagatcccatatactccctgccctcacccatgcatggcctcccctgtcatcatcccccaccccaccacagtaggtctattggttacaagtcaggaacctacatttacacagcactatcccccaaagtaattattataatttaccttaggattaactcttggtattgtattttctatgtgtttggtaaattttataatgacacgtacccaccatgacagtaacatatagagtagtttcactgccctacaaatcccctgtgctccacctgttcacccctctctccctacaacccctggcaagcacggatctttttactgtcaccatagttttgcattttccagagtgtcatacagtgtgtaggcttttcagattggtttctttcacttacgaatatgcacttaagttttttaagtgtgttttgatggcttgagagctcacttctttttattgctgagtaatactgccttgtctgaatgtaccactgtttatttaaccattcacctactgaaggacgtcttggttgcttccaagtttcggcaattataatgtagctgctgtaaacgttggtttgcaggttttcatgtggacattaagttttcagttcctttgggtaaataacaaggagtgtgattgctggatcatatagtatgtttagttcagtaagaaactgctgaactgtcttccaaagaggctgtagcattttgcattcccaccagcaatgaatgaaagtctgtgttttctccacatccttgccagtgttgggtgttttcagtgttctggatttragccattctaacaagcgtatagtggtatttcatcgttttaatttgcatttgcctgatgacaatatataatatgaaacatctttttatgtacttgtttgccatctgtatgtyttctttaataaggcatctgttaagatctttgggccatttttaaattgtttttctcttattgttgagttttaggagttatttgtatattttaagtaacagaactttatcagatatgtcttttgcaaatattttctccttgtctatgacttatctttttgttctcttgatatttcttttcttttctttttctttttctttttttttttttaagacaaagtctcgctctgtcacccaggctggagtgcagtggcatgatctcagctcactgcaacctctgcctcctgggttcaagcaattctcctgcctcagcctcccgagtagctgggactacaggcgtgcaccaccatacccagctaattttttttttttttgtatttttagtagagactgtgtttcaccatgttgtccaggatggtcttgatctcttgacctcgtgatccacccaccttggcctcccaaagtgctgggattacaggcgtgagccaccacacccagccctctcttgatatttcaatgctttttacatgatctagtatatgatggatatctctatttttcataaatgttctgtggatagtttagagaaggttgattagagtaagaggcaaagttgacatattaaataaattatccttattaattattttgttctgagttatataatactgcttagactttctcataatagtaatcaacttctcatctgtttctaacagtttttatgtcatatatattgataatgagtgatattgaccaaaaattcatgacttcacatattccttaacattcaaattatagaaaaagaaaatcatatgacctttttgttttgtttagttgttttgtgttaaattctgctgagtctgaaatttaggctaccatgccgtttttctatatgcttgakaaatctttgacaaccctttacattttattcttcttcattcctttgagtcagatttgtcactttggggcagcatacactttgatttatgattttgttaattttttacctaatctacaaatctttgctgtaagagagtagggattaaaatatttgagtttactatcataattgacatatttgattttattcctgccaacttattttatcctttcttcataccatttttaattttgtgtcttctttcaattattttataaaatacactgcatacagtttaatgcccaatcctttgaaaataaatatatatttttatttatcctaatggttaccttatattattttaaaaacatygtcagtattcattttatatcaaggtctcaaatttaatggtgtcatttgttcttcatctatttaaaatgaaagatatagcattttttcaattttcctcccatctttactcactggaaattattagtataaactttgctttttataactaggtaaataaaattttaactattttatagtgcttctgttttaatcattaattttgatatttccattgagttgtataaccgtatttatagtggtccttaaatccgactactataggaattgattaacgtaatatagacagccccattttccaattctcccatattttgagcccatttatttatttattcatttattttttgaaatagagtcttgttctgtcacccaggctggagtgcagtgacacaacctcggctcactgcaacctctgcatccaaggttcaagcaattctcctgcctcagcctcctgagtagctgggattacaggtgcctgccaccacgcccggctcattttttgtatttttagtagagacggggtttcatcatgttggccaggctggtcttgaactcctgaccttgtgatccacccacattggcctcccaaagtgctgggattacaagcttgagccaccgcgcctggccttatttatttttttgttaaaatttcaaagtaaattttgaaagaattttatttggacaatttgttttctaaaaccttgaatacctaagattactttttctattgccctaaccatgaacacagtttacctttgttatttaaaataagtattgtcattcaatatttattttgaaaataaaataaatgacaaatcattcaatattttgaatgacaatattttctttctctctaaatgctccatttttgctgttttaattgtaagaaatctgatcctttgtaggtggtctacatgtatttctcacttgtatatttaaattctttcatgatgtgaatctcttaattgatctacccacagagcatggtaagttgtttctaacttcacattgagacctggttttaggtacaaaatgtatacttcaatggtttcttcaacgtcacatctggtactgttgcacttgatttttcttagagaagacccrtaactcctagattggatagttctacatctatcatcatcttccagtgattttcccttattcatttcctatgcatttttgaaatacttttcagtttgtattccaaatcattgttagatctcccctggtaagtgctgatctgcattgttttcaatggcaaatttaattttacaagtgtacttttattttctttgttgttatctctttcttacctgctcccttgtaatcttagttgcctctctgtctctgtatggcatttttgttattgtttaattggagctatatcttttactgcaatcagtaaagataaagacttcttttagtgtttctgctaaaataattttgaagcatgtgttctgaattcgacttgtcgctttgctggttctgtagctctatcttatgctccaactgatcagacatatgttgatcactctgtcctcttcttggagatgttcagcacttgttggttagttaaagactctgatatatcctgcagtaagaaaagtctttaactctgtccaaccaatatttcctgaaattaattgatcctggaacttttctccccatgaaacaccttacagagctactgtttcatgaaatcatatttgatcgcaaatggttaaaaatatgtygtcttatagttagtaaatatcttggggaattctttcactgctatgattatacactaatattcatcttcaccttaaggataatttatttgattttctatttaattgcagtttctttacaaatgaaaagaaattgtgatgcagtttcccagtgatttttttttttgcaatgtaaaaatgatttgtagatgttaagtctatatctcatagttctttaaatgaggaggaaaggcatttaatgagtttgtatagacacattttcagatacccacacagagaaactgcagaagagaagtgcaaacacatttacactgtcctactaccatagatgatgttgaaattttgcaagggattactaaaagatgtcaaatgagctaactataggatgtgaagtcatgtttttgcctacatttgctaattgaagaactgtgtgtgagagaggttattgtaaagtgtcaatgactcattttttgtgtatcatgaaaattttgctccattattttatagctacatagaatatgaaaagatatttacacaaaagtatctgaaaaatgaaagtcaagagggtctccacagctacagctagttgccaaggcaagttaatgagtaaaggaaacattttaaacaaatggtactagaacaataatataaatgtttgaaaaagaatgaatggacctcttccacacagtatatacaaccgaatgtaaaagtctaaactagaatctagaagaaaataggaaacaatttgttttgaccttgggttgatgaagatttatatacggtacacaaaaaaaagcaaaaactataaaaattgattgaatttcttataattaaaacaataaacttggcttatcaaaacacactcttaggagaatgaaaaagaaagtcacacatggataaaatattctctctctctctctctctctatatatatatatatctgacaataagctatacctaaaatatataaaccacttttattactaaataatacaaaggtaaacaacccaactacataggaaaaggactttatcagatgttacaaaagaaggtatatgcttggctagtaatcacttggaaaggtgctcaatatcatcatcagggaaatataaattaaaaccccaatgagttatccctgcacaaccactagaatggagaaaattaaagagcctgaaaagcaccaatatgttggttaggctgtaaagcccagaactctcatacattgctgttgggagtataaaatggaacacctgctttggagaaagtgcacacctactctgtgacctagcaatgtcacataggtgttaacccaagagaaatgtctgcaaacaatatgtattggtaagtgaaccaccacttaccaattattccattcataaaatggaatattactcaataataaagaggaataaattactgataaagacaacaatatggatttatttatatagcttgtattttatctccattcatcaaaaatctctacttaatttgggtgaaagatacacattttctttctttacctgagtttttcttgaaagagactatcaggtttacaagtttagaagtaagaatgttagtcttctaaaacatcacttcagtagaggagaacttttgagtcacagactaagtctagccttcagtttaatttcacctgatgatattgctttgatcagataatgattgtgaatggcaaagcagaggttctcaaaccttaatgtgcatggggatccgctggagtttcagatttagctggactggaatgaagcctgagatttctcatttctcccaagttcccaggtgatgctggcactgctggtccaggatagatgagtgctctggataatgaactttctgttggaattggaagggctgaaaagaatgtattttcacaatttgtatttcaaagagtacatggatatcagagcgtggtgaagcctgccctttcaggcatatcacagttgggaccaccgtctgagttcattttaagccattttaggcacctccataatgaatgtatctacttttgccccaaattgaccgttttcctttctacttgacctgttgacctgaggagaagcaatagtgaaatgatgaactagattaagaagggtatgcatattgttttgtatcttctaattgacctggcgttgacaatttcaaaaartgtatgagttcttaagccatctcgttgatttactgaaataggttgaatgctgtggtggcttcatgactgtgcccagttcttccatccatgcatgttgccctgtgacttctattgctgtgaaactcatgtgagttgtcagccaaaaaaaccaagtggaatgtgagtctgacagttctgagcagaagctttgagagcctcccgtggcttctcagcctttttgctttttcccttctgcagtaagaatggcacgtcacagatagtgactgatctttcggccaaagtaagaaaaatacgtgaagagttgcagctgacatgtaacctgagcaagaaataaataattgttgtatctcagtgagactttggggttattattgtggcaaaatctagaaaaaatccacaaatagtctatatctcatacctggtgtcaggtattgggataggctgattatgtattttatttgtattagtcatcacaataatggttacataatttttctcaaatcataggggagaaaataaggtttacagagagttgacatcactaattctgggaaaagatttatttcaaatgtactgtggtgtgatgatgcataaaattatgaaatatgactaagattttgtacaaatataatgagaaaagttatcaatagtactagtttaaccttttaattataatattctaatcaatgggcagaattaatgcaattatagacaatagcagaaactccttttcactagaattggctttctcattcaaattcaatcgaatatatttttaagaactgaaagcaaaatgttccagttaaaaatttctactctgcaaaacttggagtacaatttaattagctttcttggagtaaatgaactgagattttgatctttgaaagtggaagatgatagactccaatggggagatgaccttagcctagttaagaaatgtttagtcaagtaagtcaacatgataatgtaacagatcattggtattttggttgctaatgaggcagaaaatgaaagcttcataggagacataataaaggccttgatatccaagttttgtgcttaggaggctggttttaatgacgagattaagtttagggatatgcaaagtaagatacttttccagtgagatgggaaagatttcaataaagatgttatataaagaaagttttgagaatccactgggctagtcatttgggactagctttcttaaacatttcattcatttattccttaattacgtttttacagtggacctactcagctaagagtgccaggtgtgtgtcatatgcactgaataggaaattatcctgttctcacagatgtcttacatttcagtgggggatataaacaagaaacaaaggaattcctttttaaaatcakaagtgcaatgaagaaaatgataaaagaagagtgtggctatttgcaaggggcagggatagtatttgcaagaggaaggggtgaatgaaaagggagctgataaggaaccaatgttttatctaagacccgaatgaactaaagaagcatagatatactttcaatataagcaaaaggtgtgtgtgtgtgtgtgtgtgtgtgtgtgtatttctagttttataggcaattatgctcaatttcaattcgaatttcctttttttttagctttatgtgcatatcttaactgtagcagctatgctgggaacatgttaaattgtatattatatagtcaaaagaaaatgagaatgtacaattatctgggaaggtttygtatcattcatacagacttttagaaaaaaaaattggttccctaaattatctgtgttgcctcagcaaataagagtctctcaagcttttgtggcacaaaatatcctatggagcaaaagatttagtcactgagttatttccacccctggcctaccttcaaaaaagaatgtcataccgaaggaaataaaacacatgttaaatatctgcataataaacgaaataaaagaaccgaaaataacatctatttcaatagaatgaataagaatataatctctttgaaataaactccaatttagtcataaacaaataactcatgctagtcatagatattattacatgccatgtagttgtgtgaggtttaaaaaatcagtctcaaagcttattaaaggaagtacaattgtattatttgctcgtagagtcaagaaatatatgaaatgtggccatatttcaatgagtgctattgttcaaatacttgctgattcccatggtaaagacagaagatacattcttaatctgtatgcactcaggtactatagattaaatgtgcagctctttgtgtattagaattcactccagtaactaatgtagacccaaaccatataggaggtagtaattatatatgcataaagaagggcagattaagtcatttcaaacactttaaagaatatctgggctaattttctactctcatatggaactgaataaaatccagatcaaaattgcatccaccatttatatttaccataacttaattgtggcataattcaatcagtatctaaagaaaactgagaggaaacaattactgtttacctaaccaagttatgtctgttttaaatgacttaatttccaattaactattaaaaattaaagaacataaaaattatacaaattaattatttactcagtgatgagaacttttttatcccaacaggctgagaccatatttaawacttttccttgtattttattcttccatgcaatacacttttgagttttcagaatatgttcctcttttcagtttgtccctatatgttggtcaacagattcctaatggcaattcagaatagaagagtgtttaactctagaaatttgattttgggtaccaacagcctactgcagacactttcaggaagaaaaactactttctaattggccagtgtcaaggatccaagagtcacctattcctttaatactcaaacatatatccacttagtgggaaagttaccttaatttatcatttaatcataatcattttcaatctgaacaaatcagaaacttatgacatgtttaatcaagggctaacaggaggaattggcactctggatcaatataaaatctccatatttgtttagaagcctattcaaacatgtatagactataggcttgttaatatgttacttatatttcttcagtattttttaatgaacagaactattgaaaaattaattggaaccttcttattgactttcgttggagacaccaagttctactcctaggttagcagaggattaatagcattgaactacttaaaaatagctgcatcttgtgctttgcagaagtgggaaggagaagctaaagaaaataattattcctcacactgtgtaatacwctggtcctggtgattttcaatattgaaatacgttctatcatctstaaagtttctaatattgatcctgctgtatcttattctgaatatattatttcatattatttatttggatgccaaagactcagtctactgctttgataaattttgttctagctcatcacatcaaattttttgtgaaggaatttaattaaattaattttacatgttatatcaaaatatcacatccacttaattctgaaagcaactctttactggggctgaagtttaaaattgactacatctagaaaattctatgggtattcattagactatttttatagttataaagtgttcatgtgcgtatcaccaaaaataacaaaatgggaagatacatcaaagttatgtagaacaagtttgctaatgttccatatgtgtaggcactttcaatgacttggaggtgatgatattttcaaataaaataatttaaaagcatacctcaattcaatgtttgttatatacccaaagaaatttgtgtatgtatgtaaccatacttgaaatgtcaagtatggtttgaagttaaatcggtgctggggacaacaaagtcaaaatgattggaacagtattttttttttttttttttttragacagagtctcactctgtcacccaggctagagtgcagtggtgcgatctgggctcactgcaaccaccgcctcctgggttcaagccattctcctgcctcagcctcccgagtagctgggactacaggcacgtgccaccacacctggctgaatttttgtatttttagtagagatggggtttcattgtgttagtcagaawggtctcgatctcctgatctccygattcacccgccttggcctcccaaagtgctgggattacaggcgtgagccaccatgcaccatggaacaataattttaagaacattaattgttgacatcttggctgccatcacaccaacagaaatactaccatcactctaagccaactctctcttttacctttggtttacatgggcataccatatctggctacagagaaattctccaggagtctgcagtacactttcacattgtccagcaatgctaacattcaatcttagaggtcatttagcagctcatgactgagttgattttgtgcagtaaggcatagatctataatgaaaaacaaatcttcatttacttctgttgccccatttaatgattatgaagagtaaactcttataaagtaaagtaatactctacttgaaaggaatattcctgttacactataaaatatattaccagatattaatttgatggtagaacaaaggaaggatctgytataaaatatatcaagtaaggttttacatgtcattatacacaaytgcagagttttttgagaggctctaatgaaagggtacttctcatgctttggaagctcaagtcttcctcctcaaagagagtcaatgacattattttacagaggattttgtagaaatgaaaggtaattaatgccatataaaagcaaaaacattacatctgtaattgctacatagcatgtgcatgacaagttgctggtgcccataagggacagcacttgaaggtcaaaggaaagagcatacccttccacctctcagtttgatttgagtattaaatgagctagcacacagcttggcacatgttaggctttcagtatttaccttctttcttaaaaaataaaaaaaaaaaactatttgtattagcccgttttcatgctgctgataaggatatacctgcaactgggcaatgtacaaaagaaagaggtttaatggagtcacagttccacatggctggagaggcctcacaatcatggtggaaggtgaaaggcacatctcacatggcgggagacaagagagaatgagaatcaagcraaagggatttccctttataaaaccatcagatctcataagatttattcactaccatgagagcaatatgggggaaaccacccccatgattcaattatctcccactgggtccctcccacaacacatgggaattatgggagctacaattcaagatgagatttgggtgggaacacagccaaaccatatcactattattcagagtaattatgatcaaatgcaacagtgagattgaaaatattatttaatattgcattttgagtacaaataaattttggcttttaatcgtgaacagtcataatgttgaatgttttacttaactgtayttattattaattttttgaaatggtaaaaagtaacaactaacaaactaagaaaaaagagaaaggaaatgaacagtgttataggcaagtagatgctgtggcttacaagcatatggttttctctcagaaacgccccagycctgtctcctatctcatctctaggagcccacatctacacatcaacctttcctacctgaagtcaagacctaaaatagctgtttacatttggaagatagtattcagagtattcgctttaaatatcttatctagaaattacaaaaaaattcagacttctcatagattttctataccatattttctactcgtggccaatatttccctgagacaaagttttcttttgttctgaaattcatgggataaaataattgcttgaataatcaatttttggaaagactgataatgttgctcaagaattgaagatacacatatctaatcatcatttggaattgggtgagtcatctccaagttatttcatatgaaataaaatcaaatccattatttaaattacagctcacagatatttctgaaattacaattccttcaaatatatataagaagaagttaaatatttacttttaagatttattctaaaacaaaatagtttactacattgaatagactcagatttcaatttgggtctttaggtataagtaggacctgtcttccttacttttaatttattttagcatggctttattattctgcattacacaccgtcttgtgtgtttccaattacaaaccatgtttcattgggttctctcagcattttagttttgtttttgaaatatttggtggttgcttctcctctaaaatgctttaatgcaatttcggttaaacttcagatcatccaattatcagaatagcactatatagacaacacatgaagaagtgagtcattcacccatttcctgtcttttgtttctttactgattgaagggttcaataaattccttcagctcataatgaccatgaaagttaaatactatttttatccattcagctgggttttaaatacagcatgtggacccatcattctgtcatgggcagaagctctggaaattcttgayaacttataatcttccctgcccatattcacaagtgaaaatgattatacttacaagaaagaactttacacactaatttttgaatcaactttcagaaagacaagaagtccatgaaaatcagtgtacactattgcttttgagaaaaaaattatctgagtataaagcattcaggatttaagggttcaacttattacttgtttatcacaagttaaagttcttgtttatcacaagtggaataaaatcaattattcatgataacactttggcttactcaatgtaaattttcttggattaaagttaaattttaaaataaggcagtctgtttgacagaaaatgaaacttttactttaggagaagaatacaatgtcccagaccactcaatttagattacaccaggcactctcttgatttatcccatacccttgtatattctacctgggtacattttttactacctgaaatctcaccgtatatttttttacttctagaagtctattttaccttttaggataaaattacagaagaacgcacacttttcttatttagctttgtggtctttaaatttttttaatttgcatttattttattttaaaaccttcaacttccattttggattcagggggtacatgtgcaggtttgttacatgggtacactgtgtgatgtcaaggtttggggtaggaattatcccatcacccaggcaaagagcatggtacctaataggtagtttttcagcttttgtccccctccctctctccctttctagtagtccccactgtctattgttcccatttttatgcccatgagtacccgatgtttagctcccacttataaatgaaaacctgagagcagtacattagcatgtcaagtactccagtgtcctaataaatagctgatgactaacgttgaaggaatgaaaaatatccatcattacttatttagtattagtgtacattttactaccatggcacttatgactaaaggttttgaaatctgcactgcagaacttcatgggtctttttttatgcctatgttctgagtgtaattattccttagttgtttcatgtgtatatatgagttatttttctcaattaggatgcaaacatgctgatggcaggaacttacaatagcttcatcttttgagttctatcatggctgacatagattagcagcagagtgtcaatgtgtgcagtgagggaatgatgagtcaatgtctgagtgcaacagtaggtgtcaagtaatggttgttaaataaatgcattactttaataatctgccagtcagtttatgaataaggtgaagaaataaacatatatttctttttatttttttgcatattttaaattatttcctcttggtctatatagaaaaggagttaaaatgtgtgctttctaaagtctctctgattttttgattgtctatttatgtcattgtggtttttattctcaattttggggtgtactccttcataacttgtgtttatgtgtctttcttttttattttattttattttatttatttttattttttcttttttttctttttttattatgctttaagttttagggtacatgtgcacaatgtgcaggtttgttacatatgtatacatgtgccatgttggtgtgctgcacccattaactcctcatttaacattcggtatatctcctaatgctatcccttccccctcccccgaccccacagcagtccccagagtgtgatgttccccttcctgtgtccatgtgttctcattgttcaattcccacctatgagtgagaatatgcggtggttggttttttgttcttgcgatagtttactgagaatgatgatttccaatttcatccatgtccctacaaaggacatgaactcatccttttttatggctacatagtattccatggagtatatgtgccacattttcttaatccagtctgtcattgttggacatttgggttggttccaagtctttgctattgtgaagagtgccgcaataaacatacgtgtgcatgtgtctttatagcagcatgatttatagtcctttgggtatatacccagtaatgggatggctgggtcaaatggtatttctarttctagatccctgaggaatcgccacactgacttccacaatggttgaactagtttacagtcccaccaacagtgtaaaagtgttcctatttctccacatcctctccagcacttgttgtttcctgactttttaatgatygccattctaactggtgtgagatggtatctcattgtggttttgatttacatttctctgatggccagtgatggtgagcattttttcatgtgctttttggctgcataaatgtcttcttttgagaagtgtctgctcatgtccttcgcccacttgttgatggggttgtttktttttttcttgtaaatttgtttgagttcattgtagattctggatattagccctttgtcaggtgagtaggttgcaaaaattttctcccattttgtaggttgcctgttcactctgatgttagtgtcttttgctgtgcagaagctctgtagtttaattagatgccatttgtcarttttggcttttgttgccattgcttttggtgttttagacatgaagtccttgcccatgcctatgtcctgaatggtaatgcctaggttttcttccagggtttttatggttttaggtctaacgtttaagtctttaatccatcttgaattaatttttgtataaggtgtaaggaagggatccagtttcagctttctacatatggctggccagttttcccagcaccatttattaaatatggaatcctttccccattgcttatttttctcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggygatgtgggctcttttttggttccatatgaactttaaagtagttttttccaattctgtgaagaaagtcattggtagcttgatggggatggcattggatctataaattaccttgggcagtatggccattttcatgatattgattcttcctacccatgagcatgraatgttcttccatttgtttgtatcctcttttatttccttgagcagtggtttgtagttctccttgaagaggtccttcacgtcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcctatcagcttaaggagattttgggctgagacaatggggttttctagatatacagtcatgtcatctgcaaacagggacaaagaggaaggctttatgtgtctktctccattgcattagtatgttggaataaagtccactgtgatcacagaacacagtttgtggaaaataaagtctaggacttcattttctcatatgtaatctttagtcaccagtgagaatgagctgctttcattccctcaaatttctaatacagggtacaggggagcaatttgagaaccagctggatccactgtaggggctgggagagtagcttgatctcttcacttctctatcccctcacctgagttcttataaataagtcttagaaataagttcttataaataagtgacttatttataagttttgtgttcagcagttctggttttgcaatgagaagtgctacaacttctcaatgaataccaagctctttctcttctttctggggttgtaaactggcggtcctccagagtggcccacacaacgttagctccatttcaaacttagagccaacatccagatttctggaaactctttgaaaagtggaagatccggcaactttggcccagatccctggctggccgtgtcacctcggggcatagtagctgctgtctttgaaggatgcatgcttggccctccctgttgctcccttacctgaaccttagtggaagcttccagttaccctcatacttgtcgagtacagtctaatggagaataaaacactgactctgcaccttcaataaaaactactttggtcactagatatgtgagtttgttctttctccaccagaatataaaacagtggagttttatgtataaagtagagggagatggtcaggctcaattttatccttttcattgcatttggaatctgagtgatattcatggaaaggacaacaaggagttcaaatattagaagtggtgtctaatgtccacttcagataatggtgagatcaaatgattgcgatgcctatggacactgatgtcgccttggagatattaagtaggatatcctcagatttataactactctatactcacagtgagattacagcaggaaaatgaagttcatcaaattttcattgaaaaaagtaaacaaaagctgccaaataaagatttaaattcctctttagggattcagcaaatacttgaaaagcaaagtcatccttatatttacatttatattttgttcaaaatgcgctgtaaccattttgaacaaaatgtaactacgcctctgaatttgtctaagaaaaatccagtaactcttttttagatgagtaatatttactcatttatgtgaataagcaattgacaaataaaggaataaattagatattgtggagtacctaatgaaaatattagaatgtataaggcatggatttctaattcatgtaataccttaagaactagattcttggagagaaaatattgtcagtttcagataaaaggattttagatagaagatgaatgtcatcaaaataagcagcaatggaaaatagagaccagataagtaaattggagaattgcattactcaggaataatttttgactcaataacagacacaccccctcccaatcaaatggcagtttaaacaaattttgagggaggtcttattttgaggaagtgtaaaggtaggcaggttagggctggtgtgaccactgtgtaacatgaccaagtctctcatcagagaccaaggcttgctttggcttgtggtctgtaagatggaaccacacttgcactcatgctctaagatatctgcagggaccctagagtcatccctgcgtctcaggaaggaagaaagtaaaatgccaagggaaaacaaaacgacattgcttrttctttaagtaaagaacttgacacctttaaagccaccttttcaggagcccactcagtggcttctgtttctttttcatacaattatatttcattgactttgattgcattcgacaggatatagctatgcctatctgtgaatgagcctgggaatagagcttcgtatttgggcacattataaacctgaaaaaaaaaatttgtctctaagaaacaagggggtcattatattgtataggcaactagcattctcattgctttttctctcattcggggaaattaagtataatcaataccttgaggcatagtttgcaggttctatgcaaaagccttctctggggtgagccaggtaagcagccagggagtgagacagggaatctgaatacgggctctaagaagtgaagatgaaaagctcagggatgggcatagcatgaggttcatgccccgcaactgcctcacgcaggagggacacgtgggtaaggagactgagtttaggtaagtgtgttttataaattctcatttctcatattttgtgttctgggataatttattttttgttttttggaaattaagtggggaaaaatcctagtatttagcttttgatatttgaattttttgttttctccaactgaacttctcttgcatctgacttcagaaacagtctccagttttgctggaggagcaatataatgctgttctctgcctaatgaaagcagttaataatgattaatgccaaagagtgagtgctcagagggaggaacagagctgctggacagtatccacctttgattgatgtgtttccattggcttttacccttcattgtttctttgcatctgcaatggcgtgaactgcaagcaccattttgaggacagtatgcttcttgttgtagtctctcacatattccaccactccactgagtttccctaagaataaaactcttttacagtaatgggtgtttccttttgagagccaccaggtgtaattattttaccttgttgtatttcagttaaaaaaaaatcattcttaatgtgaaaaagcctaaaaaatatatgaagattgcaaattacataaacgaatggtcaaagaaccttaagaaataacttacccaaaggttaaaaaaaagtaattaaaatgtatatataaaagttccattaatttggaaatatgaaacttttttacttataaattggaaggatgtttttagtgacattcagggttgataagaattcaccgtggagtaactggccagtgtgaataaagagccttaaacatctatacccctttcccaagtagttttattttacagagtcyacctcagtaaatgctacaaaatgcaaaggtttatatatatgtattaatacaatctttgaaatttaatttctaatattggaaaaaagaaagcaacctaaaaatctaataagagaattaaatggttaaatagaatgctgaaccacactaaaacaaaacaaaacaaaaaggaaaaaacttttcaaaggacaktgaaagacatgagatgttactgatgtcatatgtaaaataagtaagattcaaagatgcaagagaggttcagttggagaaagaaattcaaatatcaaaagctaaatcctggagttttataacatatattgtatataatccgttaacaagaaataatagaaattaaatgggccaaaaatctaaaagtaatrgaccctgagtggtacaattatgtattactcttgttttcwtctctttttttattttcccattttagacagtgaatctatatttgttcagtcattaaaatgtgttaaatatcttagttagcatgatgtttgttattcactgaaatatatgaagtcaatttctaggacagatgagaacaaaaatgccacataatcatgagaataaatttttagacttctgtttaccacaattatagaaattaattaacctcaagcaagtaattcagtagtaatagaaatagttatccaaattaatatttttcattttcaaaaccatctatgatgagaaaatatttgtctataattcatttataatacaagatttttattgaaaaattttattgttaacacattttaaaaattaatatgtggttcagtttctttttatgatgaaatagttttagcagaccaatgctactgacaaagtcaacaagaaaagctgtataaaataccaacaaaaaaaaatatatttgaaggaatgggaatgccgttaaggcagccagtgcttgagaaacccagatctcatagggaaaagaagctgatttgggtgtgcaattcttccctctcaggccatttgctgaattttaccctgtgcagggaaagagggtgagaagttcagcagataacttggatakaagaagagaagatgtcagaactttctgggttcttacagggttggaagaaaatatagaaggttgagacttttaaagccaccagcccttttgggtcaygaccttggagacaaaggaggtgcgaaaaagggagccagctattccaccctggtttttttctccaaagcatttgccaattcaagaacagtgaaagattagagaataagaagccaagaagaaagtgactaacaaattgattagaactggtgggagcgctggtgtgcttggaaaacaaatactgaatttcaacatccatgaagaagcatggacctcatgttcttacagaagcgtatggaagtattggtgaatcagagagatcaaacctagcaaagactgccacctccctggcatcagctcagtcgctgattggacttgtgagatctacccctaattttgatgactgccagacaataggataaattatttcaggagaattattacaccgttcagagcttctacagtgtcctacattcaataaaaatatrtccaaacaaacaaaacaaataagcagacaacaacaaactaggactgttaggaaatacagatgatagaaagagaaaggtgagacagatattggaattatcaaatatgtgtgatatatgtttaagagaggacaagatatagaattcaaaagatatttagaatcagtaaaagaatgcagtaactaagatcgagaactcaagtagtgcgtttaacacagattgggcataacagaagagagaattagtcaaaacaaataagagatagacatttaatgatgaaatatttaaagctttctcccagtgatcgaggacaaggcaaggatgcctgatagcaccacttgtattcatcattgttttggtgaacttagtccatatataaaggcaagaaaattataaaaagacataacaaatggaagggaagaaataaactgttattgttcaccaatgacataaagtaatttctggaaaaccattaaaattattaaataaagttcatagaaaataagaatataagaaaaaattagttgtacaactatcctagcaacaatgttagacatgaaagagtatattctgcataattccaattacaaaaatttcaaaaattgatctacagtaatagaagctaggttagtggtggagttggtgggggacagaagaggaaatctgggggtgttagtaatattattttctttcacttgagtgttaaattgatctgttcactttatgacaattcattgagtcatgaattcatgatttgtgcatttctctgtatatgcatgataagtgatactaagattgacatactaggaatatgagacatctacataagattttaaagagtgataagagccataattaaaattatgattaacacacttttattcttaataaagaggagtatgcatatgaatcaagaaattggtaattttagttttagagtcttgttggcttttaaacatctgttcacttttgtggttcacagatattcaatttttattgaaatttaaatgtgaaaacacatctgtttctctgattcatatttttatggtcaactctgaaatgagacagttgtgaactgagaaattattcaaaacacaagggatgtgtcttcctattayttgtgaggaggaagtacaataaagtcctgaaatcagcaacttgcattggtggcttgtttacataaggaatatattaaatatttccttttctactgtggatttctgtctttctcaattagactataaggtcaatgtaagaagggttcctaaataaatgattaaaraaattaaagtgtgaatagcagagctacattttgaattagagatttttaaaaatattgtcaaggtaagggacctgcggatgatatttctcatggaaatctatacttgtttagatattttttttccagtccaatgaggtaatgtctgatcgcctagatgcttctgtcacaaccttagcaaggwtcatgatttctcaattgtattgctcaagagcctttggctgctcttactgaccagcctattactcatcttgtacactttgatttatgtattcaccacactaccttcaaggtaatctggccaaaattttattttctaatttttcagcttaaagtttattaagactttaggacacgtctagattcctttcctctaccataccctcttagtttcacttcaaacctcagtgaaagtgtgacctttttcaagaagctctcagggctggaaccagatatctgtgatctagttacatttcccacattcttaccaccttgagttataacatgtaggattatttgtctgctctgcccaataaagtgtaagacacctgagaaggatttagagtaagaataaaagcaagagagagagagactgagagagataattagcgtttttttctgaaaatgcattgtcctcttaatgctcatggtactgttgggtctcagctttctcatcagattctaaaatgctcaaaaactttttgattaaagtaaatgtaattgttgccctgcaccgtggtcttatattttctcagatatatactaacagcattagaagctgtactttactttctttcttttaggaagaatattaagttagtttgtgtttaaatgaactaattgttttgcaaatgtgtttataaggagatgatatacatttttttttcttgtaccttatggtaaatacttgaatgtttgtattatatattttcccagtatcttcctttgacagtaatttttatatcatgacccttatttcatgttgaaaagcataaatacattcatggtaattgaaaatattaattacttttctttagcatttgtccaaaataaaaagtaagtatcaccagtgatttaaaatgcaaattttgagaaatacaaaaattggatcaagttctggctccccatctgctggccaggtgacttcttttttttctttttttttttttttagtcaacttttaatttctagggtacatgtgcgggatatgcaggtttgttacataggtaaacatgtgccatggtggtttgctgtacagatccgcccatcacctaggtattaagccaagcacccattagcttttcttcctgatgatattcctcctcccatgtcccccttttgacagaccccagtgtgtgttctgctcccccacagcccactgatatgtccatgtgttctcattgttaagctcctacttataagtgagaacgtgcagtgtttggttttctgttcctgtggtagtttgctgaggattatggattccagctccatccatgtccctgcaaaggacatgatctttttcctttttatggctgcatagtatttcatggtgtatgtgtaccacattttctttagtctatcattgatgggcatttgggttgattgcacgtctttgctattgtgaatagtgctacagtgaacatatccatgcatttatctttatagtagaaggaattatattcctttaggtatatacccagtaatgaaattgctgggtcaaagggtatttatgcttctagatctttgaggaatctccacactgtcttccacaatggttgaactaatttacactcccaccaacagcgtaaaagcattcctttttgtctgcaacctctccagcatctgttgtttcttgactttttaataaaggctattctgactggtacgagatggtatctcattgtagttttgatttacgtttctctaatgatcagkgatgttgacctctaatgatcagtgatgttgaccttttttcgtatatttgttggtcgcatgaatgtcttattttgagaagtttctgttcatgtcctttgcccactttttaatggggttgtttgtttttttcttataaatttgtttaagttccttgtagactctggatattagacctttgtcagatggatagaaggcaaaaattttttcccattctgtaggttgtgtgttcactctgataatagtttcttttgctgtccagatgctctttagtgtaattagatcttattagtcaatttttgcttttgttgcaattgcttttgacgttttcatcatgaaatttttgcccgggtctatgtcctaaatggtattacctagattttcttctagggtttttatagttttgggttttacattgaagtctttaatccatcctgagttaatttttatataagatgtaaggaaggggtccagtttccattttctgcgtatggctagccaattctcccagcaccactcattaagtaaggagttctttccccattgcttgttttcgtcaggtttgttgaagatcagatggttatagatgtgcagtcttatttctgagttctctattctgttscattggtctatgtgtctgttttgtaccagtaccatgctgttttggttaccatgtgactttttaaaaaaaattatttatttatttatttatttttagagacaggatctcactctgtagttcaggctacactttatcttagccaaaagaccaagaagtcatgtcrcccaggctagagtgcagtggtgcattcatggctcactgcagcctcaaactcatggactcaagagatcctcctgcckcagcctccagaggatctgggcctgcaggtgcatgccaccacacctagttaattttttttacattttttcagcaacagggtggccatgtgaccttatgtaagttacctaaaccctgtaagtctatgtgcctcatctgaaaaactgataaaaacagaaccctctttatagggtcatggtggagaagaatcaaacagtggacaaggaatatttagtataatgccaggaaactagttgactggtcatagtcacacagatgcttcagggcaggcctatttcttgcatacctrtgatttcaggacattttcagaagtcccagacctagaacccataggtggaraatccaaattttttgtctgaggacaatgaaggtgtcagtgaatatctactcccttacaagagctttgttacaattgttcaaacctatcaacttctagatggggaagactggaagaaggttcaagaagtgtttcctcagaaacacccaaaatgcacgagaaggaaatagacgcaccaaagttacctcaatatagtgatcatcacagaataagaaacttgagcggccgggtgtggtggctcgtgcctgtaatcccagcactttgggaggccgaggcgggcagatcactggaggtcgagagtttgagaccakcctgaccaacatggagaaaccctgtctctactaaaaatacaaaattagccaggcatggtggtacatgcctgtaatccagctactcgggaggctgaagcaggagaattgctcgaacccgggaggyggaggttgcagtgagccgagatcacgccaccrcactccagcctgggcaacaagagtgaaactgagaaagaaayaaagaaagaaaaagaaggaaggaaggaaggaaacaagggggagggggaggaggaggaggagaaacaaagaagagaagaagaggaggaggaggaggaggggaggaaaggagaaaggaaggaaggaaggagaaatttgtgccattgactaactgaggccagtatcatggtggaaaagcctgttactagtgttgaggtgaagaagcttgaccatataagagatacttctgaatttattcaggtgaatattgggatatcactgattttatcagattcattatatttaagagtaagaaggaagaaaagtggaattctgggatcatgaagagttcagaataaatgggaaaaggaaatgcagcactaaaaacatgaccaaaatcaatcaacaaaagtcagtcaacaaatatatgttaggtacatatgtgaattacattggtgttcaaaatagaatctttgactttaagtgcatacattttaattagtaagaagagggctccaaaaacatgtaaataggcagcaagacaatacatgcttttggcaagtgctattatgaactatgaccacacagtaagaratgaatatgggtggtagagaaggcttctttttttttgagacagagtctcactctgtcgccaggctggagtgcagtggcacaatctcggctcactgcaacctctgcctcctgggtttaagtgattctcctgyctcagactcccgagtagctgggactacaggtgcgcaccaccatgcccagctactttttttkttttttgtttttttttttttgkatttttagtagagacagggtttcaccatgttggccaggatggtctcgatctcttgacttcgtgatctgcccacctccgcctcctaaagtgctgggattacaggcatgagccactgtgcctggcctgagaaggcttcttagatgacttatgtgttgagaaataaatgacaagacagtgaacaaaatttggggggaattctttacaagcggaagtaacaacaaataaaaaatgccaagtttgccgatttcaggaacgaaaaggatcactgtgttcagatgatcataactgaggccgaggaacagagaaagatgagttcagatcttgttctgaaaacagaccatgcagggccctgaagtccaagtttggattttattccaaattaatgaaggcccttggaagatttttagaaggggaaggtgacatacttttctttcctttgagagatcactgtggctgctatgtggtggatgcctccagggacccgaaggtggggacaaaggccaactaagaaacacaacaggagttcaggtagaagatgatggtggcttagactgggagcggtggaaatggtatcataatttccatttgacatccattttaccaaaggtttgagatttggaatatgagtgaaagggaggaatcaaggtcatttttggtctgagttactgtctgaagagtcatgccattaacagagaaacagaaggcattgaggagctgactcgayggtggcatgggcaaatcagtggttctccttcggtcatgttacatttgaggtgcttatgatataaagtgagaagttcaatacasacgtctgaaagtaaaaagagaagtctgtgttagacatgtagatgtcatgtcttcagaatgcagatcggtgtaaagctctgggcctggatgcaaccacccagggagaaagtctacttatgggaaaggctggggacaaagcaacatttccaggtctgggaggagagacctggaaaccaagaagaaagggtcaaagcagtgctgaggaacaggcagatttcagttagagcaaaaagataaaagcaatgttcagagaagaaggtgtatgggtatagatgaccttggtgatgacagattaaatttcacagacattaggaarggagtgcagaggagaaggggccacgaggaatagatcagaatagtgacgcatttccttttggtggcgtgcaatctggagacagatttctgaagatgactgaggtgaaagtgatgcaaggaatgatgcacttgcttaaaagcaaagtgtgccatgaaggcggggatcttggcaaagaggagaattaattcatcaaagcaccctgcccttgaaatctcaccacactgctagattgaaactagattgatggcacagaatggrtgttttgttttatcttatctctctattttcttatgtgggaggagtggacatattgcaaaaagcagttgccagacatgcacatttaaatgtactgaaacgcaaggtgatagacaagaaaaatttagtcaaatttatgcattaataatttatcttcagaaaatgcaaatccctgttgtagttattttcctatttctacaaatgtaattaaagcattgataacacaggggaaccacarcatyggaattgagaacaacctggtgtgaaagaaaagaagtgttgaaaattttaagtttccctctcctatgctttctattatttctgtgtgtaaacccaattttcacttcccctttctatgaagctaatgctagatcttatctcttgacatttaaaacatccactcttcctgccaacattcatttgcttctccattgttaaatcggatagtcacaactctgatgtgctgtgttgtagtacctgagctgatcgtatggaggcagatcttatgacgctggccattgccacaagtgataattggcaatgcccaaagagatgctatgaaagccttaatattgttgacgaaaagagtcaaactctgtgaaatatttgaagagatttattctgagccaaatatgagtcgccatggcccatgacacagcctcaggagaccctgagaacatgtgtcgaaggtacagcttggttttatctattttaggatggcgtgagacatcaatcaaatacatttaagaaatacattgatttggttcagaaaggtggcacaactcaaaacgaggtgggggaggggggcttcctcgctaaaggtaaatttaaacgttttctgattgacaattggttgagtttgtctgaagacctgggatatatagaaaggaaatgttcagattaagataagagactgtggagaccaaggttcttttgaagttttatagtggctgcccttagagacaaaagatgtcaaaggtttcccattcagatctttaaaaggtgctagacttttagttaatctcttcaggattgggagaacctggaagaaaaagatctagctgttagtagagattctttactgatgcagttttccccccacaaaggacagctttgcaggtccatttcaacatatggcagggaaacatgttttgggctaaaatattttgattttcttccttgttttgtaatgttatgcctgagtcagagtggaaagtaagccacaatatatagggttaaataaaatccatctgatgagaatttatggtttgtagggcatgactttctagacaacttaggaacttgggcaagataaaaaaaatcagagcttagtccttaatatccagagaatatgatgcattttcataaaaaagtaaggatcacccacttaacactctaccctttcaaaatccactcatattgtaatttgtttgtaataggtgacaatatttttctttcatttatagataactaatcttcacctttatcaaacatgtctttcaagagtatgtaatacatcgattgcagctccaagtctacatcatctgtttttgcatccttcttatttacttatttttctttttgtcaataaaatacatcttaaatatatagtcaggctcctctttagctcaaatagtgttgttttgtttaattagactgtgttcccagtattgcttctatttttttttctttttttctttttttttttaattatactttaagttttagggtacatgtgcacattgtgcaggttagttacatatgtatacatgtgccatgctggtgcgctgcacccactaactcgtcagtattgcttctatagaaggctagcccaaatgcagagaggaaaatggcttgacttggccttaaatataatgaagcttgtacagtgtgcattgtgttttaagtttgaatatgaatgtaactgctacatgtattgtattaaattaatgaacttttattatgcttagcccagtgtatcctcagtttttaattcaagttgcacaaaaatttattattttgcttcttgataaaatgatttattaatattttattcaacctcattgttttaagcttttctgaaacatattccctctttaatcaatgatgatatgctagctttaggtaarcggtctgatgttaacmcatatacagagagtataaaattccacttgactcctcaagtgcccatcaaacattttytttaaaactcytttgatacatcttagtcccattctgcattttatatgggtcccattctttgattttcatttgttttattacatttgagtctctttacaaattagctaaatatgccyaaactctaatggtgttgttgtagattttttaaagttacaaaatattttgagattggttttctacttgttgaaactggacttcatattgcagggtaatattcccccatggggccatcagtattcataaatctatttgatttacatgttgaacactacatgttccgtaaaatacctagaatgctgcacatgtggatgaatattaatgattgtctctacaaataataaagcaaagaacaaatgacctctctttaataatctagtgttacagcagtcctgaaagaagtgggcagagcaagggtccccagccctcacagctcttcttatcctttgggtagcacacaagagaaagaagtgcatttgagagagttcatgagcaattttaaaagacttctgtaggaagatagatgcttttatccaaaaaatggtctacttactgatttaagtgattacatctgcattctctcttcactaggaaagaatggccaattaatcaaacttaaagtaaattcatctacatttgaaattctgtcaggtataattcaaatgtgtactttggctggtaccaaatatgtatgctccttttaagaaacaatgccatattttgggataaagttcaactgcaatttaagtcatgaaaaaggctactgggagaatgaccttaattaaaataaatcattttcaaattgttcctaactaaaatatttgttataattttagatgaaattatattgcattgtttactcatatctggaaaaataggtgtagttaaaatactagaagaaaatcagttgaaacattaacagtatttgttcctaaagctatgtttaataaggaattttctgccttctacttatgtgttttaaaaaaattaaagtgatcgtgtattgctttaatattatgtgtgttgctttgataatactttttaaatcagttaaattataatctaaaataaaaggtgattttagtgcatatacatgcatgtgtatgcatgtatatgcatatgtgtcttatatacttatattaaaattttgaactggcaattagggaagtggttttttaaactgggataatacattttaaaaatatgtagtggatgggaatctcaggtaatggcataaaagtgctaatgacctgcacaagcattgaatgaaagatgcaaatgagcagcttaatggaaaaaatatgaggaacttggtgctaaatcattcacagtcaacctgttyctgggctggggtttcctaagcagcrgagcacctccctcactaccgtctattgaaagtcagcttttaaacaataatagtaataaataataaaaaataataaaaatatacatatatmaaactttgacaccatggtgtacattttagataaatcaatatttgttagactacagcactaacaagtttctatcttaaacattatagtgacccctaatcaggccttagagtggtgattgaattttttttttttttttttttttgaggcggaatctcgctctgttgcccaggctggagagctggagtgcagtggggcgatctcagctcctcagctcactgcaacctctgcctcccatgttcaagggattcccctgcctcagcctccagagtctacttaaaacacataaatagaaggcagaaaattccttattaaacatagctttaagaacaaatactgttaatatttcaattgattttcttctagtattttaactacacctatttttccagatatgagtaaacaatgagatataatttcatctataattataacaaatattttagttaggaacaatttgaaaatgatttattttaattaagatcgttctcccagtagcctttctcaagacttaaattgtggttgaacttcatcccaaaatatagtattatttcttaaaaggagcaagtatatttggtaccagccgaagtatacatttgaattattcctgctgacagaatttcaaatgtagattaatttactttaagcttgattaattggccattctttcctgtagctgggactacaggcatgtgccaccgcacctggctaattttttgtattttgagtagaggtggggtttcaccgtgttagccaagatggtcttgatctcctgacctcgtgatccacccacctcagcctcccaaagtgctgggattacaggtgtgagccaccgcacaggtcctggtgaggtaatttttaagtractatgtatctgttcatatgtaagtatatgtgtgtaggagtgcagatgccagtgtgtttggacctctggggaaggagagggtaagcaagagatatgatgcaactcagcctcagatgagctcaatcactcacagaattaattaaggtaattgaccctcattcacttctgggttcctcaataacagcactactaacattttggaccaaataattatttgctgtggagactgttcttctgtgcattgtagggtgtttaggagcctccttgacctccaccctatagatgccagtagcactgtaaccaccagacaggttcttcctgcccgctgaacaaagttaattcatggagaccatagcattgcagtaaagaaatagtttaataaagttgaggccggccacaccacgtgggagacagttgtaactcaaatcaattttcttgaaggctcagaggttaggggttttttcaaagatagtttggtggataggggcccagggagtggggagtgctgattggttgggtcagagatgaaatcatrgggagttgaagctgttctcttgctctaagccagttcctgggtgggagccacaggactcaggactggttggcaaatgctggtggggccatccagttttcagaaatgcaaaatcctgaaaagacatctcaaaaggctagtctcaggttctacaatagcaatgatatctgcaggagaaattggagaagttgcaaatcttacgacctctggaataatgggtgttaattatgtaactatgtttgcatcttagcagaattcaggtccctctcatcttcctaacctggtggccttttattagttttacaagggcagtttacttttggggaagggctattatcatttaaactataaactaaatttctccctaagttaaccttgcccatgcccaaaaatgtgcgaagacagccacccttgaggctagaagcaagatggactcaaccatgtcagatttctcttactttcataattttgcaaagacagtttcaagacctctctattgttatatctaaaaatgcctccaaacattgtcaaatgtctggcattttgtgagcaggtggttgggatgggtaggaggttgtctgggattgagaaacacaaaacactgctctaaatttgttaccaaggggtgaatcattttgcggggaatatttcatccagatgctctatagtcttttccatacaactgttgacattcaattaaagaaatatgaaacaggactaaggaaacaacaacagacagtagtagcagatgcataaatgaccagttattaggaattaacggatatacatatttaaataactataacaaacatagtaaaaaaaaaaaatggcaaggtgggtaattggacaatatccagtctaaagtacagataactcaaagaatattgtttttcctgactttggttcatggtggtttgcttccttgtgtgtgtattttttggtcttcagtttcgagcttatcctaaactccggaatatcttgaaacctaagttcaggacacgtttttcaataagttttgtccatttttgagatgaatattactgwtcttgcacctcttcagtcctcatttcatgacacctactccccggcttactcaggtagtcttgggtctatcttttccacctttatggcctgaagtaccaatgtaggaatttacccacagagctcctttcatgtgagcttatggtttattcctcttgcttcagcttatagctcttgttttcgggtttcctgaaggatattacttcctataagtccagtaataaaacaaacaattgatatttggtataatagattatttggtctttgcattgctggaagctaaagcccatatactgtgtgcttcattgtaatatatctttcatcatgctatttcagaatgtgacaattactaaaagctgacatttgagatcatatcaccacctaatattttttttcaaaagtaaaartaaagtggaagataaacgagaaacttagaaaagactaggtttagaaagtttattaattatacttctgaaaaagcaattgtcattttctaaacggataaaaatgaactgcaaattaraattcccagtggaattaatgcagtgactcattacataatacatcatgggcaagtaatccatcctttgtactctcaggcaatcggatgtatttaagccaaagataattcaagacaaaagtaatcagggttcctccaacatcgctttttatgtgacatagagcttatcattgtttaaagcatcgaactgcttaggcattctttgttctcttttattgccttcatttcattgtctgaatagcttttgtagtatgatgttaactatcactgtttggactgattgaatagtttatttattttgataaccatcaggtgaaagcaaaagtcatttcatggcaatttcctgttacttcaatgagacactgctttccaaaaatggcaagaatgttcttgacaattagcatttacacgtgattttaaaattttactttgtttttattcttccatatgagctcttttgattttattgaagctttgaatgagtgagacataagcacagtttaagttgtatgatgggagctaaagtaagtttaatttcaatttcaagcaaatactatttattctacattttctatagtcagggagacatgagggcttgcatgaaggacctgcatgtcaaattcctctattttctgacttttttccattaccaatatagacataatcacatacatttggttgttcttacttttccaacagcctccctccctttctctttactgtaattggaagcatatttccatctcttcctctgtctccatccctcccactttgatattcttattaaagtggaatatttcctcttatctggtagaatgtgaggaaaayagggcaccctaatttatttgatcaccgttcagtttttctcggtaactaagtttgtccctgaaagtttctggtctcacttatggttacattgttaattatcttggaatagtgaaaaagatagtcaatatttttttttcatatgtcttcccacagtgtctgaactatttccatgattttttgactattcgcttttgtctttgtagaaaatattcattaggatataatttacaaatctaattttcatagttctggatcacttattgccccagtaaattccattatttggaactgtacctctatacttaactactagtgaatggcagaaggtgtttctctatcctagcttctttagggaaagaaagattatttgaagggaaccacaagcagctttgtttctatctgtgatggaagataacaattttaatatttaaatagatgttgaataaatgagtatgatttttatatgtacattacatagtaataatagtaaatgtctttgggaaaaaatgcaaataataccatgatagatgctatcagagtctaatagattatataacttgactgcacatatttgaaacatttaagtagaaaacaggactggtagttacaactggtgtagctttatgaatctctaattctattacatctgagacactttagagatcgcttgatctagtctctttgtgcagaaaacaaggaactgaatctttgagaagcaaaagtggcttatccaggctacataattaaaactgtcatcaaaatgggcctcccagctgccatcacagtgcttggcccataccaaccattgattcttactttcctatcaggcctgggcatattccagtctgtccaccatttcttgtgcatatccttacaataaacatgaaayttatattttataatccaaattsaggtaatgttccatttgactgtcatacaaggtttcccaatcaaaagcagatgagatagtggttgaggccaaggcatcctgggtattagttatgtatttaaattctctaattaattgtctccaggaaggaaacaaatgtgtacactttggaatttgtctgtattactactaatgtaaaataaacattgcactaaaacttggatgatgattgaaaaaacaatttaaaaaccatgaaagaacaccacaaaatatttttcttacttgaactacattaatgttcaaggtggcctaagggaaagagagagaggaagtgctgttttaaaatgttctctctctctcttgagaaacagcagatttattgtcataataatctcaaaatgcttttgaggaggtcagcagatataaagtacatgcagattgagtgtaatcattatatgaaaaattaaccacatgaacaatgaaatggtactgtggtagcagccctttgtcaaattaatgttctgaagagtgttatttgtgaaatacaaaggctctgaaaataagtggactggactaacttcgcagttttatgtgctacatttgtaactggattccagaaaaaattattaggagaaggagaatttagagcttaacattctgttcacctaatataaagttacagagtgtcagatcagatagcatcatccaattagtcaatttacattgacataatatatatgggacttccataatgaacaatagtcaaaatgtattattttgggaaatcttgaatcaaattatttacaggtatcctgagagatctctattataataattgtaaaaggcagcaatarctttctgaaaaatatttatatattgtttcttttttaaatattgtttaattatacttattttttatttatgtctataatgtaaggtaagggttaaaaatactgtttaaatgcagttgggatatataattgatccaggatcaatttattgaaaaataaacttttttcactgcactgtaacattagcccaccataaatcaagtgaccttatgtgtatgaacctgtttgtggtgtttctattctgtttcatttgcctatttgtctgatcttgtactagcaatccattcttgtttgtttggttggtttttgtgagatgaaatctcactctgttgcccaggctggagtgcaatggcatcatctcagctcactgcaacctctgctttccaggttaaagtgattctcctgcttcagcctccccagtagctgggattacaggcacccaccaccacactcagctgatttttgtatttttagtagagatgatgtttcgccatattggtcagrctgattttgaactcctgacttcaggtgatctgcctgccttggcctcccaaagtgctgagattacaggcatgagccacctcacccagccaatacattcttaaatactatagctttacagtatgttttaaaatctgatattgacatctgtccaccaattttttttttctcagcaaggctttggctatttgtatgcctttgcatttgtgtataaattttagaataaacttgtgaattttcttaacatgaaaactgttgggattttgatgtggatgcattaaatctataaatcaattgacagaattgacagcattgatgttctaatctatagccttcctttttatttgtatattttttaattcacttaataatttgtagttttctataaagaggtcttgacatatttcatgaatattcctattttctgttttttatatgttattataaatgacataattttaaaaatttatattttaaatgtttgtttctactatataaaaatataactatttttaaaattattaaccacttgtatctagggaccttgctaaattaatttattaattgtatgtagcttcttttatattttctacctatataatcatgtcatatgtgaataatgactgtagcatttcttcctttctgtactgtttgtatttctttttcttgctttggggcaattagctatggcttctgtgtaatgttggttaggtgtagtgatagtgagcattcttgtcgtgctcccaatcttggagaaaatgctttgtgaaagctatcagaatcaaaatggaatcacttttgtcaaacccttacaaaaaaaagtggggaatatgaagggagggttcttatgcacaattgcctaataacaagaactatcataagagactgccaaaaccrcagcgttgcacaaagaccaccacagtcttacacacacaaaaatatatatacttatgtgaggatctgcccagcaactgcctgcctaaccttggacggacactggctttgttattgatccttgtagccagggataattatctcaaaataacttatataacctcctcattttaccttcaaaaacccttgtcttttgttttcctcccctgaaggtgtctgtagtttactatgctatgttattccatgctgtastgcccactgccagataaacttattatctttggagaatgtctgtctttctgcccattattaagactgacataatctggtatcaagaaatgggacagaagtaagctcacctggaacagccgggcagcccctggaatcaagtgcagtaccaactgaatgaaccctttgtactctctgcttccaggagtcaccttttctgccctggtgattctcctcttaaattcttggactgcctccttttagtgagttcttttgacttgacttgggaccgcactggtttatccggttgcctcaagtagaagatattgcatccctcttggaactgtgagcctgtcttctctggcaagttctttttaatagaaggacaagtatctttccagagagttcttggatttctgcagaacttacattatttgtgaggcatgtttttttttttctcgtgaattcacttttgattttttcttcatgtttgatttaatgttttgtttgatctgtaccactggcttaaaatttttgtgagtacagaattttgttttatttttgtttggttacatgtgtctaatgatttagcaattttatgtttttctccctcttgtttatgaacatcttttgaaagcaaaaataggcattttaaacagtggatgtgggatggcaaattgaaagtcactagagcagtcaccaccatctttgtggcaccttaataataagagcctcagagaaaaagtctcccatgtcaagatcaactgttacggacaggcaaggtcaccttcaggaacccagtcggttccaagaaaaattctatacaatgaaggaaacttkgtcacaggtcaaagaattagggcacaagccatctgccaagtatgaaataaaggaatcttgtgccacrtacacttgtgaaagcaaaacgatttgtccaaatccttaaaattccttgacagggcttataggattatctgtcgctctccagagattaataagaaactgaatgacattccaaaattctaagacatgccaaacccttagactgctatacattcaaaatttatggtccattctcatgaacatttttttaaactgatgggaaaattacaccaagaataatgtatggccattatggagattgttttggccttccaagcttgtttttctcagaaatgaattagaaaagtgcaactagagggctaacatatagtcttttaagtttcctatttttctattttatctctgcctatttgaatatactgacgtttttgcttgcattggaagagaaactctctgctgcaattgttcttgaaactaaaataggtcaaagtctgcttggagattatttttctcatggcatttcaatgaaacataaacagcaaggaattaatccttaatctaatttaacactgagaaaaaaaaaaaggaaaagaaagtaaaagggacttattaaaacaaagttgctagagaaactgctttacccaaaatttgatgcacagccttcataatattacccatcaggacaaatgaaaatcttaagtttagccatgtgaacatttcccattgtgtcagaaactgaatttagattcaattgtccttttataaaccattgagtttatattactattttactgtctcatgactaaaatttttaaatgaaagctataagatctttgtgtgtatatgtgtttatgtgtgtttagacacatatgcatgtgttatgttgtatgttgtatatacataatacaatctggcatagttggccagaaatcctttaaggaattcttttcaagttggcttagagataagatatgcaaatgacacttaaaagtgtaaaaaaaaaaaaamcccaaatgccttttagctcatgggattcatatgaatctttgataaataaattggttttaaatttgttggtaaaataaaaatttgtttcagaattgttagcttacattttgttgcctgggtttgctggttagacaggattacattgatctctgttagatgttttacagtcataaaactataaattcagcttaggccaggtgcagttgctcatgcctgtaatcctagcactttgggaggccaaggtgggtggatcacctgaggtcaagagttcgagaccagcctgaccaacatggtgaaaacctgtctctactaaaaatacaaaaattagccaagcatggtggtggcctcctataatcccagctacttgggaggctgtgtcaggagaatcactggaagccagggggcagaggttgcagtgagctgagatcatgccacttcactctagcctgggtgaaagagtgaaactccatctcaaaaaataggtaaaataaaataaaatatattcagcttaatagcaaaatagattttgtttgtgtagctctttaaaaaagatgactaatattgttggtttaagaaaaacagctgtattttctgagttactggcaaaatacccatatatttcaggttcctacttgggtgatgaacacctgatattcacaggcttcaaaaatagttaacagagaatcaacttgaaatgagaactagcttgtctaatatctcagttttcatgaataatctggtataattgtttaaaataaataggtgaatataaatggtataaatgtgtataaatgaacttttcatgtaatttcagatgttaaaattatgttattttgaattaagtaatattcataaactggattatttccaaataagataaaataataaacattaatttctgatcagaggttcatgtttatttaattttggcttcttaaattttacaggaaaacacaatatatttggatctattaaaaattatatcatgtttcacattaaaaatttgttctatgaggaagcacacattcctagaagttgtaagatgtatattcataagctgttgctatatgacaaatagttcaaaatgcttacctcctaggctttaactagaaattaaagctacaaagagttaaaccttttaattaatatatgtaattctatatgtaagttgtacaaggaagtaagatacctttttcgttaaaaaaaaaagtataagcatgggaaatatttaaattttggtaggaaggaagaataattttgtctaagggttatttcaaagtattaaaagaaataacaacaaagcaaaaagaagccaataattaggggagtgagagggatgcaaagaaggttatgaggaagtgtttttaggtaaagaagttaaaagcagaaagtgaataatatgaaaaataatattgtgtggtcagaatgataaagggaaataagaaaaataaatgtttgtgctaaggtagaatttaaaaagaagaaaatataggagaaaactgaaagcttaatcaagtcgtaaaaggtctgaggagaatgcaaaggtttgtaaagtataatcttatgaaaggaatttgtgtgcaatcaagttggcttaagttagaagagaattgtttacaattctttctaaaattgaacattactatactgatacaaaaccagaatctagtcctctgtgtttaaagcaacacagttttcttggattattgatctgctctcagtgaaatttgcagaaagtttttatttttaattgtaaaacttgtttcttttaattttcaatcattttctgaactgcatcttttgcccaatttacagttttcatttattttttcccaattccagattaaaattgctatgttcttcttttaaaataccaatttaatttcacaaattggagtttcctcttgaagcttttcagattcatgtctcagaagttcaacttttcattgcatctcactgcacataatttgcaggtcatacatcattgcctctagctcttcctccttctcttcctgcagaggtacatcttttcatattgttaaagttgtgactctctccattgactttttagtcagctcctactgcctttttttccccctccagttgttactctgccactgtggtctgatgctggaaaatgtcttgaaggcccagaagagcaatgtcttcctccaggataacttgatctgttctcttggcttttcttgatgtgtctgaattgttccatgtaatgaggcaattttgcatgcttttactttttttaagagccacatattaccctgctcaaggtactagttttcttgtttacttctatgatatgaagtgcactcataacctcgggcagacaattccagtgtcttagagaattctggtatcttttcattgggttcaacttccaggttatttaaatggacttccataagcagacaacaatcacactgcaggaggttcgtgtttgtgtgtttcttaaaccttttgatgatgggcctaagaaacaaaaattttgtgttttatcaagataattccctatgctttatgttgtcttactaggtttttcattagtgagggaaactgagctttgaaagagttaaagttttcttacatccttgtaattttctgtatttatttttgacattttctgtcactctagttaagtgaataattattatttcatgatgacatgtgattctgttttaattaaatgttttaaaccttttgacatctttggcaggcttccccagtatcaaagttctaaattaagtctttttgacttcaaattaactttgggaatttctagtcaggaaattctgaaggatgtgtctctcatcttatgaaagagttattaaacgaattaggcttatttaatatgttgggttgtctggtaagcattgtctaataatagagtgatgccaaatctttttcaagttatatttatatgaatatgttattgatrtgaatgttccaaagattatgtaaaatttatagaagtctgatggctctggttggatgctgtcaaccataattctggttgttatcttaaaatgttacatgcgatagaaataaccgaatttcttcatcaattttgtcattattataatgaaccctgcagagttcaaattcatcagatttttaaaccatagttattctaaatctttgtcatctactgttacagttttgtttcttctctaaacacatgtgcattcagatgcctagaaaagactccagtaattactcttgcttacaggtttctgataacactaaactcagtaggccaagcgaaaatttccagaactctgataaagaaactgatacattcatgaaactgctaacaaaaatcaagcagaacaaaaattaattacatgaagtgaaataactaacaaagatgatgttttatgacttttatttgaaacattgttgtttctttacttaaaacgtttcagttgcagatttaaggaaactttccctcttaagctaattataatttacagctatttgacaaaagtatacctttgttttttttttktttttttttktttttttttgagacggagtctcgctctgtcgcccgggctggagtgcagtggcgygatctcggctcactgcaagctccgccyccygggttcacgccattctcctgcctcagcctcccgagtagctgggactacaggcgcccgccaccaygccyggctaattttttgtatttttagtagaggcggggtttcacygtgttagccaggatggtctcgatctcctgacctcatgatccgcccacctctgcctcccaaagtgctgggattacaggcgtgagccaccgcgcccggccaaaagtatacctttgtaaactaaagtggaaaaatttactttttatccctatttgatcctatcaaaattcagaaactacatgagtattcttatgttttttaatggcagtatatatgtttgtgtaagttcaataagaatctgctttctttataacagaatagaactggaaatattggctatattacaaaggttttgactgagatgtgatatttaagttatttataggtactacagacaaaacctgaagcctgccttggtttgactttttagtctcaagagatatttaagggtccaatctgagattactatatgtttaatcactattcttgctacatttatgtaaataattcagtcacatttgacaaaattaaacttattttacaaacaaattaatcttattctcattatctttagtaaagattgggatgactgtagagagaaaaattatgtttctaaagaaaaactctaatatacttgttagatgttggccctgtgcatagtttcttagtttttattatctatctgtagwctagactggatcttgaattcttctgatataggagttaagaagaaattacttaggcagatagtgagaatatgggagtcctcagtaaggttttccttttaatgaaaagcagcccccaaatcattttcttttcttacgaagagcagcctattgctggcagttgtgccaataggaagaaactacctgggaataggcaggctcaaaatggcagctccaycctctctttgccagccacacgtacagtaaggagcagacaagatggttctggccaagtggaaagyccatttgcataataagattagggtggggcgaccagccttcccacacacaatgtaaatgtcacacctgatccaatcaatctgtgggccctacataaatcagacagtgccttctcaagcttgcctgtagaatccagtgcactctgccaccagcaggtctttccttttcagatacctctctctggcaagagacagacagagacggctgctctcctctcccctttcttctgcttattaaactttccgctccttaacccattccatgtgtgcgtgtccatgttgttaatcttctcagcacaaaatgaccaaccccaggtatttaccccagacaatgatgccacttcacttgtaggttcctccaatccacttttctctcatgaaattagtgagaacaaaaccacccttttctaaacccgcgtagaatgaagctagacaatttgatgtaaatttcaagggacaagacttgtgcctgatgtttgagccacacggcaagttcaccaaactgtcgaatgctgtaaccagagaccttcaaaccacaaaccagggtgagaagttgacaatttcatgctgggaaaaattcttcccaagacattgaaataagattccttatcataatgagactcttgcccctcttaatttttccttgcttgtgcctacctttttcacttggcaggataatggtatagttaaaatttcacaatcaatagcttctgcaggaagctgtaaaaaatgttgcatctgtcatgcccatcctaaatatttacatgccctgacagataagcccttagcctgcccaatgggtaacttcaacagcatctctagtacaactgttgctcattctgtgttttaattcaacccagctataagatacgaaatgatagaattgctctagattctctattggttaaataaggagatatttgtgctattgccaataatacatgctgtacctggataaacccctttgggcaagttgtgatgcaaatactcaagaaaataggccacatagttacaacaggacttacctaattccccatggtcatttggctgattcagtcagttgctttcaagcctaggttcttggctcaatattattacataaactagaattttcctattactattaattttactttgtatttttctttataaacttygtacttattgcttgtcaaatttcagcagaagtacaactcctgagagaataatgctggctcagagttttgagatgataacccttgtctatgaaactgatgaagttggacttaacaacgaacactccccacagaactcctgatgctcaaatgtggctaaagggtttcatactgactcctaatcagcaatcacttccctctgacatgggatcagagttacccagaacaagttcatcctggcactgatggatgatgaaaatctaaccacagaatgattagtcagcaatggttttagagacgtattttgatcaaaaggggcaaatgtgaaagttgtctgaatcaaaatgaagtcacttgtgtcagacactgacataatgaagccaggaaaggccatgaagaaagcattttcatacacaattgcctgataataagactttgacaaaactacaatcatatacaaagccattgcaacctaatacacacacacatacacacactcgcgtgcatgcacacgcttctgtgaggatatctgcttgtctaaccttggactaatgtcagacttgtttttgatccttgcaactaagaatagctgtttcaaaataactcatgtaaccctcctcactttacctttaaaaacccttgtcttcttttgccaccctgagtacttccatagtttactatgacatgttctgcattgctgtgcgtgttcctgagtaaacttactatctttggagaacctctctctgttctgttatttaagatgaaacctttcaatattatacttctaaatatgatgtttgatataaatttagtttagattaccttcatcaaaataaggaagttactttctatttctttcttatgaatgattttaaatattgtctaatatagagtatatatgttgagataatttttttttctgtcaaaggtactatttattttgattttaaaatgataaagcaaccctctattccttgactaaatctacttatataaatttttttgtatatttctgggttcaaagttcatgagattgatttgtaacctccttttcctaatgtctttatgttatttctgtatccatgctattctagtatcataatatttacattctagatttagtttaacttcatcttatttttatggaattttttcacttagatttaccctatatttgctttttgtttttctttatttgcttcttgacttcagtgtttctctttctctttttgatcttttatctaatatgtgaagaaattttttctttaacatttcttctgataggctcctctggtcacaacttctgttagtatctgtttgtctggaaaagttctgatttttgccttcaaatgaaaggatatttttgctatgcacagaattctaatttgacaatttttttcagaatttttaaaatgccatttcatcatcatctggtttggccatttgttttggtaattcagttatcagtcttgttgctttttcctttgaaagtaatgcatctttttatcttttactactgtaaaaatttttccctttttctttgtcttgactttgtcatgactgtgttatgtctctgtggatttctttttatttattctctttatgttccatgtctcagatctgtagtttgaattagtttggcatttgtgttagtttgcaaagactgtcaaaaaaattattaaagactgaatggcttaaacgacagaattttaattctcacagtcctggaagctagaaatccaagacaaagatttaagtaaggttgatttcttccaagggcgtctttccttgtcttgtacatagccttccctttgtgtcttcacatgatctcttctctttaatgtgtgtgttcaaatctcctcttctagtaaggtcaccaagattagggtcaccttaatgatctcctttaacattaattaccactttaaagaatctatcttcaaatataatcatactctgaggtactggtaattaggacttcaacatataaatttaggggtgggatatttcatccaataatagccgtgtaaatgtcttatccattatttcttcaaatgtcctttctgcctcattctatcttttctccttctgagaacccaattagatgcatgagatacaatttcaagtccaatgtatctcttatgctcctttccccaattctttttcttccctatctaatctgggtattttctactatcctatcttccagtttgctaatctttccttctgtgtctagtctaccatcgaatatccttattcaatttttaattttactgtatttttaaattcagaatttccactttatttgttttttacagataattgtctagtgagtttctccacacagtaatattttttgaacattttaaaagtaatagatattttagtcaatgactgatgatttaagtttgttacctgcatcattttttaatctctttctattgtctgtttttttctcttttatttttagtgaatctgtcctgtctcttgacatacctgtttttgttttgttttgcatttttgttgttgttgttggttttggtgtgtttaaacattgtttatcaaaatcggtagaattttgtaaatgatatgatcttccttgagggacagtttactttttttctggcagatatatagatatagatataaatatagatatagatatatatccaattaggaattgagataatatctaaagtgaaaatctgtggtgtttatggaatgtttatcaatacctccttcttgaaggttgctgtgttccaattactgtatttgcagcaagatcaaaaagccaaaagttctgcctagtttattcatattttagatattgttttctgcttggcatttcaacctcttgccccaaatagtttcggaagtgacaaatacatcaaagagattatttggatagaaggtagaagtcactttccaatggtcctcttttctctagtatcttggccacttaaatcctggttgcctttgggtttacttaatactgtttattggatttttggtaatctaaaaattatttcttacaacagagacaaaaattccaataggactttaaagtggaaaaggagtcggttgaagaataatgtcagtataagatattcgtataagatattatttaaattaccattaaattaaataagcatagtagcattactggctgggcacactgtctcacacctgtaatcccagcactttgggatgctgaggtgggtggatcagtcgaggccaggagttgggtggcgaaactccatctctgctaaaaatataaaaattagctgggcgtggtggcacatgcctgtaatcctagctacttgggatgctgaggcacgagaattgcttraacctgggaggtggaggttgcaatgggctgagatcacaccactgcactccagcctgggcgacagagcgagactctctttctaaatatataaatacataaataattagcactacttaatagagaaaccataagttatctgaaacatattgtcggcagagggggaaaaagaagaaagcagaaattcattttagaatgagaaacatattaggtgtgaaaaaactatataccactgtcatatacaaaaatataatatgtgtaggtctatttgtgaaaggcttttactctttaggttatatagttcttgaatttttaaagctgttcagacactgtaccacaacctcatatcacagtggtacccagaaaatccaaatagtagtacttgtgwaaatagatttctrtttcagcctctttaaaggcagttatgtagatactcttaattttgaatttttggaaatagggaggatcattatttcctaaaattatagcacttataagtggtagatagggaattctctcgtaggtctcagactccagagcacaaacgaccaacctttatgaaatatgaacttcctggcttcacttccatctgggaggagaaatgtattcccccttatgctaatccattccattcaggacaatgctcatgggtagaatcctatttattatagtatgttaaactctacttctctgtaactcttacttattaatcctgcctatgatgaatgtgctgtaaaatggcaaagtcaaagcaaatttactacatccttaaactttaagcttattatgtttctggcatttggggctatacagttcccaggttctgcatatgtttgacacggcttcatagataaaaatggcttacatcccgaatatgatgctaaaaactgttttccaaaattggatataaaatgtgtgagtaggtgtatacatgattattgatacgaccttatttttgaaaataccatttaactacataaattatatatagttttacttatgtatttttaaattataaactatttttatttgaaataatttcaaacttagaagacttaagaatagtacaaagagcttttttgcataaactatttgaggataagttgctcacatgaatttgcatcatcccaaattcgcatgtacatacattctcacatatgtgtaaactcgtatgtatgcaatattctttctaatgtctgcgacttggggaagtttattttggtagagtcaaaaacaaagactaataaaaagataagctagaagaaactgttgttttatggtgaatttttcttaattttaaaagataagcctatttgtgaaggaaagtatattatgtatttttctattgattttgttgttcaatttgtaaaatatatttgctaattatcccagatttgggaagaaaacagtttaattagcacttctgaaatgtgtattaaggaagtgacagattcactgagacttttttttttttttttgagatggagtctcattctgtcacctaggctggagtgcagtggcacgatctcggctcactgcaacctctgcctcctgggttcatgcagttctcctgcctcagcctcctcagtagctgggactacaggtgctcaccaccacacccagctaattttttgtatttttagtagagactgggtttcaccatgttggccaggctagtcttgaactcctgacctcaggtgatccactgctttggcctcccaaagtgctgggattagaggcatgagccactgtgcccggcccactttttaatgttttaaagcgttagtaccaagaagttcaaagtgactagagcctgattctaccctactcctttctcctccccaaataaactcatcttcaagaaacactttttttaatttttttttttatttttttgagttggagtctcactgttgcccaggctagagtgcagtggtgtgatctgcaacctccgactccctggatcaagcgattctcctgcctcagcctcccaagtagctaggattacagacatgtgccaccacgcccaggtaattttttgtatttttagtagacatgcggtttcaccatgttggccaggatggtctccatctcctgacctcgtgatctgccctcctcagcctcccaaagtgctgggattacaggcgtgagccaccgcgcctggccgagaaacactttctatagaaacatttatctgattatatcaacgacaacactttctttcactggtgcatgacgttgattgcctgtgtgtgtccttcagcatttatctcataaagtaattttatggtgaattacagttgagtgtgtttgtttacaatctggaatgaaatcattaaagtcaatgtcaaagatcagccagtatttcataggacttatgtattcagaaatccataactgtgtttcgaaagcagggcactgcctgatgaccaatcaatgggttttgccagctagaaaaaaggagatttttactctaatttacatgggctgcttcatggtggactacactggttaagaacttcagctctacatttcctacctcagtcattcactgactttttaaacttggacctgtcactcagtttcagaattacttttgtatatgagtatgatattactacctaatttatagcgtttttgttagaaaaaggtgaatcttgaatagtttttggtgttgttgtrgaagccatctcaaggttcaaataatgagataatctgttagaatcctaaatgacctcctctgtgatgttttgctctatggtttggaaaacctttagagatgagtgtggcctggcgcttctcttcccattttcaattttagacactctaagacagagaagagaaaattatattagtacagaatttgcttaaatgtcttagttcctcacatagtccatgactgattactttaatccttgtgtactaagaaaacacaaatagaagaatcgacatttatctgtattttaaagttatgagcaactttttcttggctaacgattgatctgtaatgtcaacgtggcttgcattatatgaagttttactggctgttttgaaatggaaggtgagggtgcctcttcactttcaaatgtctgaaggaagattactgtattcgcacaaaaatatttgtacttagctgaaatggcacagaatattatagttctcaagtgtttaattccttctcatagaaattgcaagggaacttaggatgcatttggcaggcgctttctctagtgcaatcaggttgctatggcaaacctattattttaggcgaagaaggactatgttagtaaagtgctaatctattttctgttttatgtgagcctctaattactccccaactattgagcacatactgcaagtgtggtttttatcattttaaaaagtgaaaaaaaaaataaggtcatggagagtgtgcctactgttaccacaccagcaggtgcatttgatgatacagtgctctcctgaaatcatctcattctgggtcgggaatacactttttttttttttcatagaaaagtacaatgaaaaaggaagtgaacaaattgtatgtgagtaattgaactccaagcctcccagctgtgttttacttattaaaatatgataataatatctaatatttgttgaacacatactatgtgccaagccctgtactgtgtagtttgtacacattataacattcagcccttacaatcatcctgtgctatgggtattatttttactcccattatgcagccacaataaatgaggtttaacttattcttccaaggaatcacatttagttgtgtatgcaccaagattaaaatccagacctattaaaagttagagcccacatttttaattgtacctgtgccacaaagtgtatttcccttttagacacttaaacaaacacattaagactcaaccccacattatctttgccagaacctttctctaaccctgcaggccctgtgtgcacgtgcattttaccttaatttcccctgctagtaaaagtgttaaaacatccttctttcttttgtatctcaatatctagcatgatacttaccccacagttgatagtcaaaatgtgtctggggaatgatcaaagtaatgcagacatttaagattgtgagccctgctaaacctattcttcagcaagaacatgtgtgttctctatgtggggtagttagaaggaagttagtattcttcagcggaacactttaaatgtgaccatatagggaagaaacgtatgtgtatgtgtgtgtgtgtgcctgtgtgcatatgtgtgtgcgtgtwgcatattcagtcatggtttctgaaggtgattacaatttttaacactagcagttcaagtccaggcatctaccctgtggcttctgagtttacagattttcaccctttcacaaatgtgcaaaaatgttactggtggtcatgcagaagagatgtacttggtcctgaataaataatgactttcctgaattagttatctgaggactctcttgattgtcaatccatgaggttagtgggcgactgtgtctgtcttgttcgtcttcttgtctccccatccaagatctagaaacttagtccctgctggtttgaaacctgtgtcatgtggaagtgagaccttaaagcgagaaaatcaaagaaagtgagggaaggagatgtcaaagtctaaggcttgagatattggttgtggttgagattatgaaaaaagaggaatccaagaagaaaagaaaaacctggaagaaagagggaaggagtgaaggtggtgtgtgtctgtgtgtgtgtgggtgtgcgcatgtgcgcatgtgtgtatatgtgtgtgtgtgttgggagagaatagtcagaggggaaagggagggagtagaggatcaagaagaggcagagaaggagagaaaagaggaagaggaatatagcttgaaaaacaaatgtcaaacttcacaatttcacaatctttaccttataccagttttagaaaattaacctctaccagaagttgacaactttccataaggcagtgcttccagatatgagtcatccatgaatgtttaactattaaaaaataagacagacaatagttaaataaaagattgtggaacaagagatgacctttccatttcttctcttaccctctgattatttctactgtaactacactccagcaattaatcaggatgtgaaccaatgaaactactaaagttttaatctatttgtaataatgcaaatgaggcaatctgtattttataaaggtcacaagctactctttttcattttgtcttatactttagatatactgacttaccctataagtaaaagaaaagttcgactttgtctttctagtattaaaataatagtattttgtttatataaatcttgcagtatcttatggataacattccaaaaaaactgtgaatgagagtttcttccaggctatatcaagtaaaatttagtaacaaagatttcagaaatgtcaagtatttcaatgaacacggtaactttcctaaaagtgtaattatttcaagtttgcagttaatttccatcatatttactaaaagacaaaagtaatttcatgttcacaatgatcaatatatattacttctattgtgaataacccatttttgccctcagttcatttttcttttgctcatttattattagttatttttattttaacttatacacatagtaatgttttcttagtgtctatattgtttgtacaaatattttgtccttgtttattgtttatattttagtcttaggttattcattgctctatagaaattgaatattgaatattttatggtcaaatttattaatattgtcctttatatttctgatttggtgtcatatttagaatagttttctcacccaagtgttatgaaaactctcacctatattcttgtctagttttatgacttaaacttttacatttgaatgttgaaacccctggaaacgtatttagttgtaaggagtgaagtaaaggaaatgaatatttttgaaacatggctcaccaattttatcaaacatattttttgaataatccattatgcccagaaaagtatataacataaatttatagcattatgaatcatataaagtaatcacatgcccagattcagaaatagaagaatgccagaatcctaaaagctccattctcacttctctgaaatcagcataccctctccctaaaaagataacctttattctcatgttcatgtaatcacctctatacctgtctttaaagttttccgcctagatatatattcccaaacagtgtgatagttagacgtgacttttttggaattaatccaacagcatgcattgttttatgactgagttctcgcactctacattatgttcttgagactcaggcattacgttgaatgtatttgcgattctttcttttaattgctatagtgtttcatttaagaatatagctgatatgtaagtattccgtaattgatgaacatttggggcatttctcctttgaagttgctaagaataatgttgctatgattattctggaacatttcctggttcacatgtgtatgcttttttctctagggaacttacccaagaattaaattgctgattcttagattatgcatgccaacttcactagataatgccaaacggtccccagaatattctaccaatttatattctcaccctctgcaaaagacttatctgtatttccaaaccattgccaatgcttattagggtcagtttttaaatctttgctaatctgattgggttggggcagaatctttttgtggttttagtctgcatttcccatgtgaataagaggaggagtatcttttcatatatttactggccatacaatcccatttgctgaagtgcccattcagatctcctgcccatgtctttaatggattgtatgtatttgttgttgttgttgttagagttctttaaatagtttggatatgagacagttgtcagatatgtgtgtcactgatatcatctctcattctgtggctcaccttttcactctcttattttctaatgtactagagctcctaattataattcaaatggttaatattttcttttttagttacttactccagcaccatttatgtgaaaagtcatctttcctttgttgcttttcagtgtcaccttgtcctaatccagtatttgtatatgcaaggaattgtttttggattctctattctattctacttggtctccacttccaccaaaatccaacttttatgattactgtgcctttaaaataagccctgatatctatttcaaaaggtatttctacctccttcttgttcataagtattttcgttattggtgctttccatttctgtataaatgtcataattggcttttaagctttaaaaaatcctgataagattttsgttgtarttacatcgaatctatagatcaattaggggatatttggtattttaacaatattgaataataagcatacagtatttcttcacatttaaatctcaaagctttcatttgtctatgctgcatatacatatgtgatttatttttgtatatatgtttgctatagggcaactaatatactctcttaataatccatattatttgttagtagtttttgcattgtctacatgcacagttttcggttaagtaatttttgtttccttctttcaattctttatgtcatctttttatccttaccatattctaccgacaaagacatctagtgcaatgttggatagaactaaaagataaatttatctttctcttattcctaatccaaatagaaggttttaaaatgtttaccattagcaccaaccaattattattattaagtgcatgcatatcctttaacattttttctctcttcctctttcttcctttttcactagtaaaacactttatttactatagttagaggacattttatttggttgaataatataaaattgatgacgtctgactatttttgacttataaaaagagtcattttacattgttcagcttacctgttatgacatttctccacttattttccatagatacacacagactctgtttttaaagtatttctgaatattaccatacttgttatttcagacaaatttgagaatcatttcatcaacttgaaaacattcagtgagtttgattggtacaatattgatttattaattcaggaaaaatcagacacttcttaataagaaagtatgtccttttaaaaattataagtcttctcctatggccttcactatgactttatatgcaaagttgtataagttcatttattttacgttgctgatatttttgtacatgaaacaattttccattatattaggttgggttagtgttggcacataaaaattttttcatttctgtatgttaattttgtcacaagataccttgccaaaatgttttaktcctttaaatgcatttgtaatttttaaaatcttgggcataaagacagaccatctgctaataatgatcttggctctttattatattgtttgtctaatttttattaaattgcacttaaactataacaatggttgttataaacatctcccatctctaacttagatcactccctgttaaccataatgttggatttcttttgaaaagattattatatatacctgttggcattagtatttaagcaattttctagaatagtgtcttctcaggggatgactctaggccagtgatatatttgagagtgttcatcatgtaagacagttgtttaatccatgggatagcaggaaattttggaaaatatagaggaaagaaggttcagggctgagccatggggcaatccaagatttagatatttgtataaagatgagaatccagtaatatagcctaagaagaattcgtaatccaataatagctaatagaagaaagtatttcccaaaagggcagggtcaactctcaaaagcttctgagaggttatataagatggtacagagaattggccactgggttggggtcattggagacattgctgaaraagtacttgtcacatagcagtatcttgaggtaattggattgggttgagatgagactggagttaagagaacagcagcaaacttctttttgggaagtttactttaaattgtactttgctgctatgcttttgcaacacaaggtgttttctatcttttactcatctatgttttgcccggttcctatgttactcctcccggcaaccaccaccaccactgctttcccctattagaatgaagcagttctaactaagcctccttttcctcctccttattctcctgcttctccttttagctgcctttgaggtttagtctctcatatatggcaaccatataaagagaaaaaaataatgtgatgtatttttcatggattatgctgagataatttttgaaggcagttcactgttagtgggagaaggtgctgtggtctataggtgaggtctggaaggacttcagacaaatattcaagtgctgactaatttataaacccagagcagaggttttacttccagaattatttttacatataatatattcaatctaatagcattaaaatgctatycaagaatacacatagcattctaaaattttaagcttccgttttaatgaatactttaaagattttgagctagtcatatagaagattgggtttaaggttagaatgagataatgtggattatgttgagataatttttggaggcagttcattactagtgggcgagggtgctgtggtctgtaggtgaagtctggaagggcttcagacgaatattcaagtggcaactattttataaacccagagcagagttttatttccagaattagttttacatataaaatattcaatacacaaaatgctattcaaaaatgcatataacattctaaaattttaagcttcctttttaatgaatactttaaatattttgagatagttatatagaaaattgggcttaaggttagaatgagataatgttctagtaaattttagctgtctatatattcyattaaacaattattacatatattgtgaccttttagttttatactagtagcayttttttattatgaagttagtaatgctggtcaaaatgtttagggtttaattttggtgatataatcattcctccacattttttggtagtcaatatgcagtaaaatgaggtaaatgctatagaatagcagactttagagacatatatatcttttatttaacagtgtactcccatatctaatcgtgtatttcatacgaaacagattcttaaatatttgttgaattttatataaaatattttggagtaagtgaatcaaggttttcacattttcatgtagttcttatgagaaaaaaatgtactctaaggtgaaaatagacactttatctgaatcttatatcttaatgattgtgggaaaatataaatttaaagagatttaaattaagagtttttattaaaatgattacctgcacatagttgggctttttgcttatatcttgacttataatttgtctatattttacacaagttcagagtctgaacttgtttgaatttttaagtaaaatctattttgatcggaacttctaaaaatctgccttagttcattattcttctttgatagcttataatgagctttaaaatataattcataaaaaatgcagttctttatgaaatgatatcattggaatgattttatatgtgcctaaagattatctactttattaaaacttaataagagtaggcagactcaatgtagagtaaatttcagataagttttggttggatgatattgatgatgttggctgaattaatttcttctcacacagttatttctatgctcctttctgtctgtttctgaattgtcttcttgcaaattacttgctttatttttatttctttgggtatctctttttttagattttcttttaaatatgtcgtataaagtagcacagtgctagaaaggcagatttccattttccttctttctcatgtatgagaatattaatttggtattgatttcagaagccacagttgtatctccataacagtaaaacaatcactgaaataataataataatattatttagtaaacaaaagaaaaagattggactcaatttcttatctgaaatcaagtcaataaacctgtatgtcagcatccttctactacattaagggagaacttagttggctgctaccaagatacaaatctcaccgttagtctggaccgtagtgattttatcatttaacaattgggttgaggcacttgcttatctagtttaaactttgcattcagtattctactaggtatagacaaagggctgtgggatcagaaaggtgacaattcttccaggtaaccaacctgggatggcaaggaaggtttcagaggagattagatttgggctggctatagaacaccgagtaggactttacagagaaaatggtggtgtgcaccacggagggaagaaatagggaacataaagtctctgaacatgagtgctctataattgctggatatatacttgaaaaggttaagttggaccatgtgtggaaaactctgttgaagaatctagtctttgctttgaaggttacatggggccatcagagggatttgtgcaaaggaattacacaatcatatgtatgtttttaaaaagcagattatgtggattttcacagaagacccaagaagaagagtaggtttgtgaatacagatgatgaatttgtcgtgggacatatttaattgatctgaccatggaaaacacaaatgaaggtattcaggcaattggaaatgaatatctattctgggagagatataccatttcaaattcaagttctaccattaatgctcatgtattgtgtgaatatttctatagtatttatatatgattactgtttaatgcacgtgttcaataaatattgattcaaaacattatgattgccgggcatagtggctcacacctgtgatcccagcactttgggaggccaaggcgggtggattgcttgaggccaggagttcaaaaccagcctggccgacaggtgtaatcctgtctctactaaaaatagaaaaaaaaaatcatctgggtgtggtggcgcatgcttgcaatccgagctactctggaggctgaggcaagagaattgcttgaacccaggagacagaggttgcagtgacccaagattgcaacactgcactgccagcactcaagcctggggacagagcaagactctgcctaaaaaaaaaaaaaaaaaaaaaaaaaaaaaaaaaaaaaaaaattatgaggacacataagaagcatasttaattttattgtatttgtgaaattgtgtgagtaggaggatgccaatgtcacagatttggtgaagttttccttggaccttgaagaatgattggaaatttacctgataggtatatgataatgactgaaacaaaattggtagtgatttgtggtagtggctaaayagaagttgtgaastgaggcagcaaaataataaacttacaaaaattagccaggcacgtgcctgtagtcccaactgctcaggaggctgaggcaggagaattgcttgaacccaggaggcggaggttgcagtgagccgagatcatgccactgcactccaacctgagtgacagagcaagactctgtctctaaaaaaaaacccaaaaaaatatggaatgcatgaagaatttactcttttttacctctctgtctgcaataaattagcctttcctaatgcattatattttaattgttaactttttaaaaaatgttgtggatatatagtaggtgtatatgtttgtgggagacatgagatgttttgatataggacacaatgtgaaataagcacaccatggaaaatgggttattcatcctctcaagaatttatccttttgagttacaaataattcagttacactttttcacttattttaaaatatacaattaagttattattgactgtagtcatcctattgtgctaccaaacagtacgtcttattctatttttggtgcccatcctaatacgttatttttgatttttatcagaagccactgtatcttataaactgtattagggttacatgcaaaaggttaattcatctcatagttgccttagtattagtcattttaaaactccaatagatacatggtgaaaaaagaattggaaattggttactatattctctgatattttaaaaagatatgtgaattgttatttatcaggaaagaaaatgtgccgacgccagaatattaacactttattgtctaactttacacaaaaatatgggacagaaattatccacaatgaaaacaacggaatgttgaaatctgaacacatatgccagtgtttagttcatcttttctgaagaggcacagaagccaatgaggcacattcaggaaaattacttaaaatgtgaattacttaaaattacttaaratgtgaataaatttgtcaccatgaatacatataccctgaaacgtagaaactggttctatgtaactggaatgcattgcccctcaggaataatgcaactgatgrtcatggcttcccacatctgtgtgtgaaggaacagttcaccatatccagaccacactgctgatggtactacagtttgcctctttctccccacagcctgcattattggaatcatttgcacatccacccatgaaaaagattagagcatttatgcacattgaaaggtgactggagttcagaaaatctaggttctaaaaccaacactactaatagatagagagctggccttgggcaaatcatttagccccagcatgcttgagtttcctcatctattaaataaattgaaggaagtcatggatccttctgacattttaccaaaaaaaatgtgtattggtatatttttccagggatagatctgtgttctgccarttatggttcttgattacaaacaacaaaaccaacttcattaaaagggataaaaaaatattttattagaaggctttaggctcagaatgcaactttgaacaattagctcctgcagcaacctggggaagcaaggcactgccaagaaccagttcctgctgccatcacttctgaatgtcagccactgcaggctgagcttcaaggctcccagaattgctatgctgttgcatttgccacactgcccacagacgttgtgcctttgctttcaccctcaagaataaaagccctgaccaagggtgtctgatgtgtgcctgttctagctgccagggtataggaagagggaatatcgttgaaggagggacccctgcctcctgctgaacctgggactacctccaagtagagattagttgaaggtcagccagcacaacactgtattgccatgtctttcaccagattctcaaagggatcgtgaccccatcatgtcagctagaaaatattatgaatcattgcattagattatctttaattacagctctgaaattatatgatcctaaatactaatttttctttcccccatcatccaccaactcagaatttctttaacaagatacaagttcagcaacagagtgactaacaacattgcaaggtcagccctgaagcatcttgtgattatttcagtgggtgtgtaattatgatggttgggctaatgacagggagtaacagatgtctcggagcactgtcacccaagcaaatttctggcaaaccagtagtgattcctcaaacaaaagaaatttactttctcatatagccttccggtgctgcattagatgtacattaagatacaatgtggtttaatggttagttgtgcaaactttgaggttaatgagaatggatgtaaattttgaatctatttcttcctagctggttcaccattggaaagttacttggcctcaatatgtctcggcttcctgtttagtaaaatgattgtaatgattctagtcaatgtgtggtgttggaaaatgaaatgatgtcatgcagggaatgatagtgtttgacacatagttaccactcaataaatcatgatgaaagtcagcataatgggactagttaaggggttcccaaacgatgaaccaaattcattgcaaaaatatttataattttaaattttaagacgaggataataaagatatttaggttatgctctttgacataggttctatgctaaaatgagttctatgaactataaaattgactacaaatagtcactaaaatagcacattgaaatattacctatgaccactttttttttctcatggagcagatagacccaagattaaaacattttaaaatggccacatcatactaaattatgtcagtatatataatgtattatgttatgttcaaggaatcatcaggataagttgtatatgaaatagccagagagttttataatggatttattcaaaaatgaatgaaacaaaaattagagaatagcaaatgtgaatgacttctgagacagcaactgccacttccactccagaccaccacggaatttcttcttgaacttcagcttaccttagggaggttggaaatgtgtatttgtgtaactattatcaggcacagactggaactattctaggagatttgggtttaatagtgtgctcrcctccttgaaagccttagtgattccgggactctcctcataagtgtgcactttctttatactttccaggtaaatgtgaatgtggcaaatgcacctgctatcctccaggagatcgccgggtgtatggcaagacttgtgagtgtgatgatcgccgctgtgaagacctcgatggtgtggtctgtggaggtagtaacctttctcatagctgtatgctacctgcatgcaacttgctttacctgcctttgttattctactgactcttgctttttcaattgctgttaaaaataagataaacagaaagcaatataccattgaacctaaaagcaatatacaattaggtttgtaatgacttttatttccctgaactctttatttagcaggtatgtgaaagtacgcagtacactatcaataaaagatcattgaatctaagtactaagatactttatgatcgtgaaaggttttggggcaagtcagcattttaacatgattttcattactttatttataaacactggtaggagaaagtataatatcacccacaaacttgaaaaaatggagtaagattactcttagaaatcacaagaggtatacgctcagattctatgatgcctctcatacccaaacaagagctcactggcattaataaactgtccagagaatgagtgaggcagatagaaggtagtgagcagaggtaacccacaaaaatgagagtcccaggagtagagtgctgatccgagcacctccatggctgggaatgtgggtcaacattattcttgcattgcattcttgaaaaagttcatatcgctgaggctgatgcatgtgaattacagatctttccacgtttccagtataaatgaagtgatgtggacatggaattacattacaagaaaataattatatccctttattgggggaaagaaacagaatgtgtgtcttttctaacttttattttaagttcagggatgcataggtaggcttgttacatatgtcttattggaggrtggagggtgggttgagggagaggatcaggaaaaataactaatgggtagtagagtgtgtgtcttaatggaaggctgaggcaccatccatccatcctabctgtctgtctrtctrtctatctatctatctatctatctatctatctatctatctatcatctattatctgtgtatctattatctatctatatcaatcatctatatgcctgttctctctctaaccaacgataagacatttgaaacctgacaaaaaaatactttcttctttcctttctctgtgagttgaggggaaaagcccttttaacctgttaatgactgaggttagacttttttgaatttttgcagtcagaccttggtgatgacctggagcagtaggatataaaaaactcccacatgcttagcgtcccaataatggaacaccaggcataaattcgtaaaacatctgctgtgctgggcagtttatcttatgccattgtcatggcagccaccctaagagattgtttctactattttttctttcataaatggaaaatagagtgaggttggagaagttaacatcccataactaaaatgtggcagacccagaatttcagctctgatatttagttcacagatcgttccttatgtcagtcacagttttccctagagtgacaccaacgtgttttaacaatatgtcaatattattcttaggttaaatcctctgttcactggtattagttaaccagaaatacctatgtaggttttactctttttgtttgttaaggacatgacatatattaactcatttatttatcatagcaatatgtatgtatgtatatatacgtattcatgtataaaaagcttgcctggccccttgaaagtgccatctacatgtctctgctcttgttaccattgttacttttcttttcttttcttttcttttttttctttttgagacagagtctcactctgtcacccaggctggagtgcagtggtagaagcagagctcactgaaacctcaaactcctaggctcaagcaatcctctggccttaacttactgagtatctgggactacaggcacataccaccacagctggctatttattttttgtggagatttgggggtctcactaagtggcccagattgatcttgaactcctgggctcaagggattctcctgccttggcctcccaaagagctggaattacaggtgtgagccactgagcctggccagaaatggcttttgtatgttttttctgtctatttgttgctttggagtaatctcagtctcttccactttcatatttaggtcaatgtctcttgaaatgattgatcagcaatcagtcatccttggctttagattcttttcaatttctaataaaagattttcatatgggaattcctccaaattacgcatggtttaaactgaagtaattattttttcattaactaaacaaatattcattgagtgtctactatttgccagcactagacattcagtggtgaacatagagcatttgctctcctggagcttatggttgagcgtgaagggaggacattgagaaaggaatgaaaaggagctgagtgatctgaaaagagatttgattcaatgggaatatacataacggggatttaacataggctgaaggctaagaaagacttctctaatgccttcatatctggataacaactatgtaatgcagactatgtgctttacaggtattaactacacctcacaacaatacttggtagtaataggatacatggaacttggccaagtaggggaagtggggtacagtcagagagcagcttgtgctcagttgtgtgggagaaaagagagtgtgtgacgtgtgccaggaacatttgaggaccagagaaaaaccctgtgtgattgcagattagaaaaccaaagggaaaagagtgtgacgtgttttgtaaacatgttaataacttgaggctttactctaaaggtgacaggaaaccaaaggaagggcttaaacagagcttaaacatgatcacagtgttttaaaaagtacttctggttgtcagatggagtatggattgctccaaggactatgtgtgtttgtgggttggtaggtgaatctggatgttaggagatgagccctggtgagagatgaaggtgccttagctggatggaagacagtaaaggtggaggatcttgaatgtgttggagaacatgttagaagcagtggggtcaagagactaacaaaacccttcaccctgctgcaagagactccagcactctgttaaactcctagctctggttccctggcaacagatgaagatggtgcattgcagtgttaacaagcaacattgctcatggtcataatgatttatgattgataagtttcaactacattggaagagatgatgaattgaactataagcagctgatgggaacctcatgcttttggatttcataagtgtcataactctgccaacagtcttgtcccttgtgggctccttgaaagctgtttacggaatcatcgggaaagattttggctcctgttgggcgtgcgacttcttctaagccagaaaagcctcaacatctgtgcagtgtggatctcatctctgtgcatatgggctgtgttatcccaagagaaaatagyccccaattatatgagttcatcctcatgaactcctgcaagaactcccrtgggtatatcctggtgcctgacagtgcctgctggtaagatgtggctcctgtcccacagccttcaaaggagaytggtggcaagtgtcagcctgagagcttagttgaaacttagagctccctccccagagtacaagcatatttaaggaaattcatgattgcacaatatgaggggcagggtaggatcaaggwtgacaccaggtttctgttttgagcaactgaatggtggaggagactatgcttgtcttgaccagttgtctccatttcttgaaaaattggtttcttcacagagagcaacagagatggagaaacttggatatgttgctccctttggaacatatcccttgggtatgttagttccctctcctagtccttattgtcacttctccttgtgaataacttattgtctttccattcttccatgatttttccaaattacctcctataggaagcctctctgaaatgatgtcctacttcctctataccgcaccacctgcatcgtagtgtgatgaagttgtatygagagtgtccctgtgtcccttttctttaagtctacaattctcatggatataatcaatctctctctctcattatcatatgctcaaagctaggataaaggttagtgctcaatatttttatttgaataaatgatcaagtaaaggattcacaattaaggagaatgagaaaggaagaactattccagttttggatacaggattcttcaagttgaggtgaggatgtgatttggaccttgaacaactagtatttagatgtgcagaaataggatgtgaagaatattttaggcctgggaaagctgggcaaaagcacacaggtgaaaagttatttattagatattgaaggaaaatatcgatttcattttttttttttacatcaagagctctttctcagctgcttctgtacccatcattagaaaggatttttttcacatattacttactcatgtattatttataatatatattatgtcaccttcatttcttatacttggctcatctttagatatcaggtctttaaaaatattgttaaattggtgtttttgctttcaaaattaaaaaaatatatagagagaaatggaaaccacaaaataaaaatcacccattaattgatcatcctagaataatatctgatgacactatgttgtatttcttcctaggtwttgtttctgaggagtaaaattattttcaaaatataaattcataaatcttctttgggtattttgatattttgtctagagaaagtccacattgtatggtatcctcagttgctttaatgtacatggtgtgcactttgttgcattttttcatgtaagatttaagtgagaagaagtaaccattttctttggaattaagtgaggcagtgccatatagcaagacgaatgggaaccctgtattcagacagaccaggattttaattctgggtctatttcctgcttattgtagtaacttggacaggttgtttgtcttctctgctttggtttacctatgtatttgtttgacctgtctaccttggtttactcctatatacaataaggataataatccatttggctttatggaaagaaagagacataaagacggaaatgtgcctggtactatgtgccagtgaatatttgatgaatgccctgtatctgtaataaaaataaaagattgtagtggccatctgcattacagaacaaaataatacatctgtctcaggtatctggaagcactagctgcagagcgttttgcaaggaagttggactcacacaaatcagcagctctgtacctcggggaggaaattgcagctggtttttccaaagcaattagtcccccccatcatctctccagtggagaacaaatcttactaatatgagaatgtgaaacacacagacatcatccctctgttatggcttcagagaataacaaaataagagagtcactcattttggtaatttttttagttctccaccagacactaaaccataagatctgtggcctttcatatggagaatataaaacctatatatccaacatgtggccagagagtaaaatatggtacttgactscaaaatcagggactgtcttagcattttagcaaacaagcaaataagtaagataaaaaacatgtataaacttaactgatcagcagatgcatgagcactaagagccaatagtgtttatcccctttcctaccaataacactaaagatgattaaaccaattctgataggttggataaattagcaattgtacctgaaggtgaatgtaactaatttcataatttttacagttcagttttgattacaccaaaattacaacctggaaaagagtcatgaaaatgactagcagaaagaaaatcagcatgaagtgagatcgttcttcatttaattaacttgtgagtcatgttcaatcatcatagactgtctgtggatgttctcaaaacatctttattaaaagaagatgttatgcaacctatgcatgcatggatttattatcagataagtcactatttataaaaagcatgacttgtccagtgatagttcgtaagatttatttattttattggtatatcattttaagattacacaagtgaaayatattcacatactggcacatgtgtgtttaattgtttagcctaatataagttaaatcagagacttccctcctgtgtgccatatacctagggtgagaataagaactaggctgcttattgcttttcttctttcctctatactcctggaatagctacccatgagtccaatttaaaaaacaagaagggataatgaagagccacctcttaattacacaatcagttcacatttcttcagggagttctctagttcatcgctgcaatttgaaggagatcrtgccgcctgagagtatgaattcagtgactcccaggcactgatggatttcttgtatgaggaagagatcagatcacacactcagactaaccctttcttaactgaacaatacagtcagaatgtgattgtctccaaattacatcttaaaattgcacacctgtttcgtgaatttgtaagaggatcagttagtcctgtgtttggctgaaggtgatagacacaaatactgagtcttcaggttgtcattccagggttggatggtgaggcgactgcctgagcaccacagtgtccctgaaccccatctctctcttctgctctgcccttccagtatgacgtttatcattgttatggtttggctgtgtccccacgcaaatttcatcttgrattgtagtttctataatccccaagtgtcgtgggagggaccaagtgggaggtaattgaatcacgggggtggttttctccatgttattctcatgatagtaagttctcacgagatctgaaggttttataaggggcttcccccttcactcgactctcatacttcttcttcctgccatcatgtgacgaaggacatatttgcttccccttccaccataattgtaagtttcctgaggcctccccagtcatgcagaactgtgagtcaattaaacctctttccttccaaattaccgagtcttgggcagttctttaaacacagatgttgttatcaatgaatggtccatgtagatgattctccaacagttccaccactcctgggtgttcctcttacaggtctaagtggcaacacagtcgtgttggtgagacaaaagatgaataaaactacttctatggtcttattttttaaactcaaatttccaggaacattccacttagtagacctccagtatgggacacgctcctttgtcatttcatgagacaacacaatcttagttttctccttccttactgaatgttcttgtctggcttctctagttacctaactctaaatattggggtccccaagactaatttctccctggatagctgcttcacttctagggctttaagtgccatccacatttgtaagctctaacatgtgtatgcctagagccagcactaacatgttctctgagcagcagcttgtgcctagctgcttacttgacctcactatctcattgtcttaagagtgtctcaaatacaacaggctcaaaacagagctgtttttctgccctcaacctctttctcctgaagtgcccctacccaataaacagcatcattattcacactatttcttctagctagaaaacttgtcttgtcttttcctcacttgccacatccagtccaacattgtgtcccacatatacaggctccatcaccaaaatagatttccatgtacttctctgtgtttccactgccaccactgtcctttaagcttctatcacttttcacttggaaaacagcaagaaccctctaacttccccatattcattcctcccaacataccttaatctgtcccacctagttgccaaatgagtttgcaaagtgtaaactatatcgtcacatcattcacttccttaatatccttctgtcatttctcaatcctcttaaaataaatttagattttttttaccaagagtaaatcatttgctatgttctcatttctgagaagggaatatttctccaccttcattattcagtgtttttgacttactattcttcaaacacgttggccttcttttactgcctgtaacatgccaagctatttcttgtcccaagaacttttcatttgtttttctaggctctgttcctagaacattggctgtctggctccttctcatcccttggctgtcactgaacccttccctgactaccctagttaacagtgttcttgctattgaatatactagcattttctttttgtcttctattactcaaatgttgcttatcgttattttcttccctagaagaccgtaattaccatgaagacagggccaatgcctattttacttactgttatattctaagctgttaatacaattcctgatacatagaaaatatttcttgaagagataactaaattattagagtttattaaaaagagggtattgaaagttgttttgttcttaagtaaagtcatataaatgacaactcaaagcatttgaatattaatgtattttgatgattggctgagctagataccaacttaacttcgtggaaggatataatagattagctaataataaaaaatcatcgccaggcacagtggctcacacctgtaatcccagcactttgggaggccgaggcgggcagatcatgaggtcaggagatcaagaccatcctggccaacacagtaaaaccctgtctctactaaaaatacaaaaattagctgggcgtggtggcacatgcctgtaatcccagctattcgggaggctgaggcaggagratggcttgaacccgggagtcggagggtgcagtgagtcaaaattgccactgcgctccagcctggtgacagagcaagactccatctcaaaaaaataaaataaaataataataaataaataaaaaatcatctattttcttgcataacattttatattatttgcaatgagatgccataaaattattcttaataatattgtaaatcaaaggcagaatatcaacttctaaaaggggaaaaattgtctcatactacaacatggaaggatctttaagatatgttaaataaaataagccagtcatgaaaagaaaaacactgtatgatttcacttatataggtacctagagtagtcagatatatagacagaagctggaatggtgatttccaggagctgagaagagaagggaatgggacttactgttttatgggtgcttagtttcaatttgggaagatgaaaatattctagagatgaatggtggtgatggttgtacgacaatgagaatatacttaatgctactgaaccatacacttaaaatggttaagatggtaaattttatgttatatctattttaccataataaaaaatattgtagaaaaaagtagccataggtctactttaattatctgtttctttttatgtgggttttaatagattgtgtcttcacggaattggtccaaatgatccaggttatcagattcttggacaaatcattgtttgtaatattctattattatccttttaatgtccataaggtaagatataatcatctctctcttaattttcatattgaacatttgtgtcttctctctttttacttgtttagcctggcctaatatttatcaattttattgatcttttcaaatagccaacttttgttttattgattttctctgttggttttctatttccagttgtattgatttgtcatggaattgattgtatttcttttcttatgaccaatttagttttatattgctcttctttagtgttttaaagtgaaagattacatcactgattttatatttttcattgcttctgattgcattcatgctgtaaatttctttccaagtattactcttgctgtatcctacacattttcataatatgtattttcattttccatatagtactaattaaatttgaaaaaaaaaggcagaaaacaaaaaaaagacagaatatttttctatgcaatacagattaaatgatttcagttgtgtcaaattgtgataattcttaccaacctagggtcagtaagaaacatgagcatttgagaagttcatagcccaattgagctggtactagaagctctctttctcttcatttttggtttcttgtacaacagattctctgccttcaaagatggacaactttttatttaactctttaaggacatctggactttaagtggactttggttttcatggagaagtaaagatgtactcaatttaacaattattcattgagtagataggggcgtaggggtgccagttttctaacttggctctactctacagtttgatttgtgggtaaaaatgagaaagatgttttgaaaaagacaatttcaatctcctccaagtttttgaagatccactgtgtctcaggcattgtgttaggcactctgaagactacagtgctgacagaagtaatactcagaaaattcatagtagagtagtggattcatttgacacataactatataccatgagatggaagtcaaaaaagttccacaggaggtaaaaaaaaaaaaataaggtattacagaaattcagaggagagacaatgagtctcacttagggatattaggtaaatcttcacagaagggtagtcgctttttgctgagctttgaaaattactcagaacctgaatgtgtatagtaagggaaaggtacttctacctctgcaaaaacatgaggtcagaaaagcatgacaaatgtgcaggaaacaatgaatgggccagtttggttaaagggagaagagaaggaatacaattggaaatgtagcttctgtttttcaagaagctaaaacataacaaaggctagagtaggtaaactctatgccatgagtattaggaagttatacgggactaaatatcaaggcaagttgtgctgtaggaatctacgagccagagtattggagagacatgacaggaagttttttccaacgttgtgatggtgatgtaagtgggaatgttggaggtggtttcaacaagacttgacaacaagctggatgagggcagtaagggaaattcaaatgagactcaaaacatcatgaactggttgattgaaaggatagctgttacattaaaagaaatgagaaagacaagcagcttttggaaagaaaatcatatatggatgtaggagatcggtcagggtggtgggaaaaattgtagaagatgcaaaccttcttggaaggctggaagattttacaaaagctttggaaaaggatttggctgaaggcagccagattctcttatctggtgaaactaatctaaataagtaagttaacataggccttggaacctggcctttgatcatctgagtgcaggactactctctctggggaggggaggggacgggagagaccatgtaaattgcccacaagtgtgttgactcagagcctttgtgattaaatctatactgaataaatgcctgcagtgccagcttgtcagggccacggctgctgactctttacagcaccctccttggtgtctggtgtctgtgagcagcctggtcccctagcccactctttcactggatacctgtgtctgggtgcatttgttcatccgttgttccaccagggtctatgggtcggaccctgcctatgtagctctggaggtattaagtggggatgctaatagaacacaaagtgtggaatcatgaaaggggaatgtaggagaaaatcaggggctggagatacagccctgtggtcttggcagttatctgaaagcccaaaatttaatggatttttcaagaaagaaattatggagagattaaaaaagatgattaaagataaacattgggtgaatacctgcacttattcattcagtaaaaaaaaaaaaaaaaaaaaaaaagtagaagaataaatagagacaaaggaggagtgttgaatgaggccaagagaattttgtggcatgccaatagagaagagacttgcaaggagagaaagtgcctgtgaatatcaaatatataccttcaaatgatgtggtggttgaaagagacaagaattaagaaatcctgctgtgtctcactttctaaagtgaaatatagaagcaaagcaacacattgggaagagtgtagacattggaatcagaggaactagagtcagttccgatctggctgagccaattatcggtcacatgtttacatgcatgctacttttaaactttaatggtttcagtttttgggttttttgtttgtttctttgtttgtttttactttgcatgtaaatcaagctaggtgaaaaagaccacaattacctcatttatttgtttatttatttacttttttccttttttgctaacctgtgtgacaagaacagtcattagccttagaaagtgccagagcacttgctgattgagtgcatgttaaaggtatggcagcgacatttttcttgcagatttagtagtcccccattcgtatccgatgtttttcccagaatattttttaaaagaatgtcagacattcctagtatcctgtctttctttcaggatcccaattttctccaggggagcaacatatgctggattaaaaaaccgctctcccagaccttctctggctgttaggaggcacttgttgcatggcctgtgaggtagggatgtggtataacccagggaaaatctctcttatttaatttaaaaagcaaaaaaaaaaaaaaaaacaacaacaacaaaaaaaaatagttttccaagaaaccctctccaggagacttctgcttacctctcagtgatcaaaaaccktttcaccacagttacttaccacgtcctaccgatccgcattctcgcaagtgtccttcactccatttactctactgcatttttcactgtatttctcatgccaaaacttgggcttctccaccagtctgcacacgttcatgctctcaattctcacagccatctatttcattctccactaaactgttagagggatttctgtagaaattaaagaaattcctatcactcctaaaaaaaaaagaaaaaataattataataattaattgcaaaccattaagcattggttactcatcctccctgtggagagctgaatggagggggagcagatggagcaaggttcactcctgagggtcctgccagagcaaatggtcaggagagaacggtgtcaacagcttcagagaggctaatcagtgtgaatgatgagcgtatctgtccctgggagaagagcagggaccactttgtccatggtgcttgattttgtatcccctagtgcatagcaaaatgctctgttgataacagatactcagtaactcttcgctaggcaaatagttgattcagagagaccctgctgtaaggtaatgcacatatcaggaaaaggaataaagggtcgagcggaaactgaaatggaagaaattgaaatggaatatcatgcaatctaatggtgtgttggtggcaggcaataaacaggtgtacatcctggtatatagctgtcacaaatacaatgttacatatataccaaaagataaacatctgaaaaaccaggaaccaatgtcaggaaccaaaccaaaaaaaatgtgccaaacatgaatccaagctaatgttaatttttatgcaataatagagagacaccattacttccacttgtatctgttgttatttgtaagcagagaggtatacagataaactaatatagtrccaaatgccatttgtatgaaagttacccttttgttttattagtaagcaataggagaacaatcaataaatactgccaccagtggtaatgtgactagccttgcaaattggtctggatggcatggtgtgtgcaatgaagaatagcgctaagactccatactgataaaaatgcaaatgaagaagtattttctatcaagaaaggtggtataattccatttaaaattattgcaagatttctttctctcaagtcatctcctatgctacattcaaatttattatgttaagctagaactctgttgtaagttctttcaaacaattacatgccaaattgactatgcataaagaagaatgtgttggatgggaaatgagatcctatggtttacacatttctttcttaaaactctctgcttcagctggttatttcctcatcctctcactcctttcctgtgrttgcttcacaggccacggcacatgttcctgtggtcgctgtgtttgtgagagaggatggtttggaaagctctgccaacatcyrcggaagtgtaacatgacggaagaacaaagcaagaatctgtgtgaatcagcagatggcatattgtgctcggggaagggtgagtatctctgctggtgcctggactccattcctgttctgacacatgatttgtagaacagcatgtagcaactgtctttcccagactgaactttgcatgaaagcaaaccactatgtcctctgctgtccccaacttgaagcttgaagattaaccaaatgaagttttggatctaagaaaatgaaatgcgtgtgagaggattcatgcaaaaatatccttgtatgcaaagttattgctgaatgaaatagaattaatacttttatcaagaaattaggacaacaaaatataccagatactaaatggacccaaaaatggggaaaaaaggcaaaagaatgattattgggctcacctctgaaacaacacagctcagaactacagaaaagtaatcacaagcatctgagctgcccaaagatatgactttgggaacttctggggctaaattatttagctgtatgtggagcaggggaagattgaaggtgtgagaagacataaaaggagacaaaatatttaatttagtttaatttttytaaaaaggaaagaaaagctatgggggaggggtagtatcccacaagtctgatggaattttctttgccctaaaaatcaccaattgttccaagtaaacatgtgcagcctgatataagaaaataggtaattgttcggttgggcaccgtggcccatgcctgtaattctagcactttgggaggccaaggcgggtggatcacttgaggtcaggagttctagaccagcctggccaacgtggtgaaaaatacaaaaatctactctattaaaaaaaacacaaaaaaattagccaggcattgtggctcacacctgtaattacagttacttgagaggctggggcaggggaggagcttaaacccaggacgtggaggtcgcagtaaactgagatcacaccactgcactccagcctgggcaacagagcaagactccatctcccagaaaaaaaaaaaaaaaaggtaataattaaacaaagaaaacaaaagcctgccaaatggttataacctacaagttggttgaatagaagccaccaacccaataaaacatttgccatggaaacatattaaaggaaaaagcaagccttctccatctcccatcctacacacatgcaaacacacacacacacacacacacacacacayacacacatacacacaaattggaagaggattcccctgagtaaagaatgctaatagattaaattttgaacaccttgattttgatgtttctgtatactattcttgaagggactttaaaatcctgccattgtaatgcatatggcatcatctagaaagctgttgtgttcttctttgctagtgactaggaagacacagggagcctgaaagattctcacctcatgtctggggagcagcgcttcaaagaaactgaagttaggggcttcccagctctcctcttcagctcagtatcctctttacaccacagacacacttttttttttctgacaaggcacagctctggctgaagcttcatttaccctcaaaacctctgctggtcaggatgaccaggtaaataattttctgaagaagacagcaaagcaaaagtgtgctagagacactgaatcctgttgccaaagaaccacaccagtgaggctgccacacacgaaggaaggaggtctctgaagcaagatgtgccgtgtgtcccctaaacagtagcttttgttttgcctcgtatgcaagaccaatgctatcaagttgaaagagactttttggcagaacttcagacatcaaagaggatggatgctgtgactatctgtggtgccaagaagggggatgaaaatgaatgcagatgtattcacttcaatagatgacagtgtccttggtttccaggagttctgtgttcaacacttgtatttacaatgctcaggcaaggaggccatgccatcaacctaatgtcattacagcaggcaggtggaaaatgagtttaaagcaatcgctttgtgccttgtttgttctctcactaattcaatctaatctcaagccccaaacagatcttccaccagttctgttctcagggggcttcagcccctagaaacacctaccttgaattcaagctgtgttgggacaaccaaaaagaaggaaaggttaaaaggaagaaaacaagggaaagaattggggagaaggagattaaggaagaaaagcaggaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcrggagaatggcgtgaacccgggaagcggagcttgcagtgagccgagattgcgccactgcagtccgcagtccggcctgggtgacagagcgagactccgtctcaaaaaaaaaaaaaaaaaaaaaaaaaaagaaaagcaggaaaggaggcagggatggaattaaactgcaagagagaagtaggagagaataaaagagatgttatcagaggggaatgatctgtgtataaaaagatactgagaatgaatcgtttttgaattagatttttttttcctctgagcatggcttcagacatagagcacttaagtttagatacttttttacttggttttctgtaatggcattgtcactgggataagaatagaagcttttcacagaagctctactgaaaaagatacccatacatattaaaacactagtgtgcttatttatatttgtttattttaagagtcaactattgtttgtgtttgtgtgtttactacgctcactattgaatcattaacactttccataagcgggtcttccctaagacctgtccaactgcgagtacaggaagaacacacaaagccataccctccagggtaacaaatagcagtcttccatttcctaaactgaaggtcatgtaacaagagttgtttcttctcagaaaataaatatgcttatgaaagtcattacagccctaggaaagattctcatctttcagcatcataaatgtagaaaatacaaagaaaaaaataggttgactaaatattgactcaaaggcatttcctgaaaacaaaacaaaacaaagccaaagagtccctctagctaatgcctttgcaaattgtttgctttgggaggtggcgatatattcagagatcaatgaagggttgaaagcatatttgtstaaactatttgtttatccttcaatgggtagggagtttgggagtccttaaacttaaaagggaatatgaaagctgcctcaaggctgcacattttgacattcatgttagtggaccggcctccggactgttggcagcagctgatcgtgatctcccttcttttccccttttatggagacatcaatgctggattatcgatgacgaaaggggataaaaccaggatcatggaactgtgatctatgataggcgcagaggataatggggatgccacagttactcctggttccagtggggagcactaccccacaacccaccctgagaaccacaggaaaagtaatgcatgaaatagactaagggactttaacatggtgatggaaaagaaaaacctgtttccgattttttgactggggccatgtatttctagatcaatttcatggacttgtccaaattttctatcatttttctcaaatttgtcaatgaaagtccctcaccctgatggtcacaaaagatrttcaagttctttctttatttgattatgggacagatcttagcagtgggcatgagatcgccatggcacacagcttggtggcctgtacccaccaaaaggctgaaacgtgcacttcccatgagctgtgaataaagctgtcacctcaggagacgatgaagaaatagcgttttatttctttacaaatttatagccaagacaataaatcactccatagaaaaatttaaaacaagatacattcttgtgaccttcataacagatggagtagttagtacaatagtgaaaactgcctgctgggatgtcaggttgcagcattttgtcaggcttgaatgaaaaagaaagtccaacattagtaatggaatgggcaactgacaaaggtgccttgcccttagactcaaattgtttttgtgaataaccaagagagatgaggttagtgcagtgccgggtcttccctaagcttagctacctttgcaaagtacatgatataattcattgtgggttgttttgttcatttggggatttatttggcttcaagactacacaattatatctttgccttgactacttcaagctagatccagataatcacgtccaatcttcttacagatgctgttgtgtgacaatggctgtaaacacatgtcattaactgtctccttaaactctcacagtgatacttcttgggtcccacatcttccaaagaagtccagcatacacacacactcacccacccacaacctgtcmcacatccccagaaaagagaaagagtgaaakatgcttcacaaaatcggcctcagcctkktgttcaagttgcctcgctcaatatgcctgtgcagtcagacctgcaggaagaaacagctcatttttaaactactgtatatgaaagtttttgcctggagatacatcacagataggcagatcactaaaaagaagagtggattgaatcagagtgaagtcttcagttaactgtttgtttattgcctgtgaggtccaggacagtttcctttattctctcttccattctcatctttgaaggtaaaatttcatttctttccccttcctatgtcctaagatgccctgaagacacatgagaaaatgtggctgattccccagggatggaagccagcaaaaatgcacagaagggagatgggaacattctcaagggtccttatattgagaaagaaaatgaatggattagtggtgctgtggtgatgaactatctgccctaaaactcctgccaagatcagccagctgttctctggctaggctgggtctcaggggtgtgagtgggtcttggccagctgagttgaaccatttctcacctcttgatagtcatgcagcctacatctgtctgatggaaccctctccctgtgtgcttcccatttaagagaggcacaatttgacccatgttatggaagaaaacagctagagcgttctacaggaaaagtgctataataggtcctaataactattcacactgtgttattactatgtgctatctagttctagtttcacaagcagtagaataatttcctacctctaagatgcactgagcattgacaaacaggaaagaataacacagctgggaaaatgctgacctagaaatgctactgtttcatgacacatacaaaatcaatcctcattttttattctaagtatttcagcgactagtagactttcagaactggaatttactcatcaaatgttctatccatatatgccatattagctttagctgagcttaccagttttctgaaaatgctctactatggcatgaagctaagcattccagaagcaagagcagtgattagaatagttccagggccagaggataagtttgaagatgaaatataagatatttcatgaattgtgacatatataaaatgatatcctgggtgtatatatgaatattatgggcatataaaatcagcactactttagaaacaactaaagacagccaaatacttcaaataactaattttccttcactcatggaaataaaacactaagtatggtgcctttcgaggaaacttctctgatagtcaatgaaatactccatgtggtctttgttggcagatatatcactatccatttgttaaacaagcagtagrgtgctgtacatttttttatgcctagaaatgtgaaagaaagtcttcaaaattmggataaagaaatctctaaaatcaggaaattcctcaccttgatgagaccacaagggaaccagcatccyttgcagactgacctgggagcagcagctcactgggtcctgagaaaccacagggctgtcagtcaattattaaaactgagaagacgtgtatatttcctcaagagcatgcaaatcaacctggaccctcaggaaaacaagtcaagactaaatacaattatgccatagctacgcaagaagttaaaaaacacarttgtcacaatctaaataattctgactgcactcttactttgagaagtgtgtcaagaaatggcaaacatttaatttggactttggggatttttgcagctgaaatgcatataccagtttccctgatatgaaatatcacatagttgagacacatgaacctgaatcctttcatgatatctgtgatgaccacaactcctttttcctgatcactttaatcacccaggctgttaactcatttttaatcactgtgttttaaaagaagcactaatgattgatycttgccccttttcaatatattttgaacttaccaattctgcagttttgttaaatatgtcaaaatactcttttcaactgcacattttttcaacgtgattttgactcaaaaaraatacagccatcttttagtaaatggaagtcatgtttggaaagaacaaccaacccaaggaaacagaaggaaaagaaagtcctttttatttgtttctttttcattgtaaagtctttcctgctgtcgttgaggcagtttttccatgtaagggtttttagtctgtcatggaaagctgtttagactgagagaacttctgtcttggataccattcatcatctcatttattttcttttattttaaatatatcattaataaaatttttactcagtaagtaaagatattttaaataaccaaagaggaagttttttagttaggtaggagaaatgggtgaagtggagggaaaaagagttgaatccagagcctcataaaatatgaactttgggagtaatttgagctatcccagtttatgacagagggtcctgaggatgagtctcacaaggcaaatatactgagtgactgtatgcatttttagcactttaattagccacccaatatgcaggtgtgctcctactccaagaaaatcatgtaaacgaaaatccaaaattataagcacaataatttagtagttgttttaattagaaatgcaacctaatttaatacaattccctattcatttcctttaaagagcaggcactttaaaaacatgattcaatttaggaggaaaaaatctatttttgaatacttttttggaagaccatctataagaatcaaccccatcctgctctcattgacatttcaaccagactgggccatgggacatttgttcaaggctaattgcaactgtctagatccataatgaaggctttcctgggtgacctttatgaattacagtaagtaaagctcccctctgagaaaccagccattcaatacacttttacctttggatgatgggttattagaagcctgttgtcagtgtgtcaacgatattctattcgagatggaaayctttagttataaggtgatggtgagtaatagcctttgtaatttcaggttcttgtcattgtgggaagtgcatttgttctgctgargagtggtatatttctggggagttctgtgactgtgatgacagagactgcgacaaacatgatggtctcatttgtacaggtgcagtattaaccttttctaattgctctatgccacagtttgttatagagccaagagacactcgtcatgcaatgctttaggtggctggaccaacagggccaaccgtgaatatgaaatatctaccaaaggcgaagtgggcatttgggaaaaagccctcacaaaagcctcacattattcctaggcatagaagaatacaagagaatgaagctaaattttgtgattatttgggatccttccacaaagtaacctccccaccctcaaactcacatgtatgcagttgtatattgaacacagaaaagaattttgttggcaaccattttactttgaacatggtatagggaatgaaatattcttttaaacagaatctgggtaccactagttgatgtgttggttgcttttagggaactggatgtgtgtatgggggagaggtataaagagggctcagccgtgtcatagccactgctatcctaatttattgagtcctcataattggttataaatycatttgtttagccaagttacgaggaaacagagacatgtrtacttctcctcagctctagctgaaggtaaaagatgactctttgtgygtcattaagttagacctttgctttctgcccatccttactacgtaagactctcttcacggattacttggcctgcctcatgttatgtcaaagagccttatgtttttctgtatttattcataagtcagatataacttgctctttaagggaaaacaaaattgtcacctaaaagcctagctggagtgatacaggatggtgactatctgatcggtaaagggtggcaccaaataaatgccactaattgtttgaaagattagatgtctcgcagctgcttaataagatgtaataataacatcattgcacaataagaaaatctaccaaggatgaatgaaatgatttcattgtggacacttgtgatttataatagcatgtttaaatttggcacattttgatcataatcatratacctatatgtattttattgcagggaatggaatatgtagctgtggaaactgtgaatgctgggatggatggaatggaaatgcatgtgaaatctggcttggctcagaatatccttaacaattacatgagagaggtctggattcttattttttctgggccattagaacakataaatgcgaaggaaaccatgtatattcaccactaggacaggttaaaaagaccattgtatgtttttctatttctgaattacgaatgaaatccgagtacctattagaaatgagttatgcaaatttagatgcaaataacrttagaaaaaaaagattcttccataattaacataagtggttcctaacgagagcaatttttccacccaaaagtcatttggcaacatctacagacaattttgattgtcacactgggtcgggtaggaaggtatgctgcagacatttggtgggtagaggccagggatgctgctgagcatcccgcagtgtacaggacagcccccaaacaaggaattatccagccccaaatgccaatagggctcaaactgagaaacattgagttatatggctattagaaatccacattcttacacaagaaagaccatattagaatctaaggaaaacatgcatattcacattaattaatcgatcagatttttccagaattccgtatcagtcaccattttaatatggggacaatgaagacaagcacacaggaggtagaatatcagagtggggctggatcaagggcaaaaactggtcattaagtcatctgacattaaatcatttagccactaagttatttgtctactctcactttaaactcaccaaagaagattctcttaaagaaattatgaaaaatgtacaatttaacattttaaataaatagtgacagaagttgtttatactctgtgtcagtatatatatctactgataattaaaaatgaattgttattcagggatatctattttaggtttctagaaataagggatcacatttttaaaactgggcaggggttatgcgtacaagaaatctgattttttattttaatttattccatggtagtgtggccttttaaaaagacaatattgagttacatataaaatgggcctgaagtatgcatccatttcccttaaaatacttttttttctaaggataccttacttactggaaacctggggtcatgcaaagaagtcaagacgagaaatactgtgataaaatggcaccaatctcagaagctcacaaaagaccaaaaaaaaaaaaaaaatctagaaatggcttaaatagaaattacaaatattcactcagtgataggaacaaaatgtttattttcttaatggtgaaactttgctttgtatgaaattcacattgaaytatgaaagtgtacaataattgggacttcccttacatatttacaggtaaatctacttatacacattagtttaggcaacctttaattatttagagctaaaaaaaaaaccactttttttctaaaggtgaattactttgtaaaatcctagaataatgtagcaaaatcatttccgtattactttaagatgaaaatttttacttggaaattttattttaatgatgtaaatattctagtcatggcttaaactttataagtcaaatttccaaaaataaggaaaatatgcatccactgagttacttaaaaatttaatattgaaaattattttaagagaacatttaactgatcctgatttttatagtactaacaatgttctcataatgtaatagatttataaaaattgttatctctatcctgagattaaggagtgcaaccatgttgtagttctattattgagtacgtaaattgatagatctcttccgtaaaatgagggaaatataagtagtcaataaataatgtaggttatattctttcctcttcactacctaaacattttaagctgtgaacaacctattattattgttttgtagcaattttgatgacgtattcgctgatgcacagacattggaattcattacattatctagccatcgtaatacaaatgacctttggatttctctatcacggcgcttatcctcctattaaggatcagaaagttaaactttacggaccacgtacgtccctgtctcatattcttctttgttggtttctgtttaatactttaaagctgtaaaaaaaawttaaaaaattccttctgagctcccaggccatacaaaagcaacttaagggtggatttggctggcagctgggcagtactttgtcagcctcagctccactggaactgcccttgattctctatagctcatcacaaaacctcaggtatgtcttatttttcttataatcctctgtatgttattatcctttttattaacaacaacaactacaacaaaagtgctgctctttttcatagtctcatgtaagaagagtgtcaaaaatgtcctcggcatttgttttctcagaaaaagaatttagatattggagaaattatcataccataaaaagttcaaaatgtgattcatctaaaattttggacaaagatgaaaatatagtcagctctgttctagtgttcatttagttagaaaccatagtaccggaactgtattatagtagaagttaatggtacctaaactctaaggaatgctttttctttgaaaacagaaatatttttacttatttctgtccactatgtttgtgtgtatgtgtgtgtttgtgtgtgtatgtgtggttttgatgccagcaatgcaaacaccaatatatctattaagaagtgattgaatttagattggaaaaaataaaatagttacatgtaaagacataaactctttccttcttaaatgtgattttcaactctatgatagaaactccctctaaaaaacaagcagggcaagaacaaacttacttgtaatgggtgagagaaaataagcaaatctcattggctcattcctgtttttaggaagttgcagtgggattaatgtcaattggaagggatgcagcaagtttagagaaggtgttggcactaacgctgcttgtttggcaaatcatcatcactgaggtattccacccagagactttttcaaaaaagtcaactaaagtgctaagtcataagaggagagccattatacccgttgtctttctgggctccttgagtttatctggattccaacagcacttggaaagtaccgccctccactacctcaaatgcaaacacaatctctgccagtagacattggaattagacttagtgaaaaccaggaaaaaaaaaaaaaactaaaatataactcagccttagtttgcagactcaactgtcaacactttgaaaccctactccatattcaagagagtcaacaggccctatgtcacattgtaggctaagaaacctcagctatgactactatttcactcaaagtaagaccatgtacatcctggattttgatatgcctgcattttggaaaaaaaaattgaggatttagcccagtcgctttcccttgatatagccttgttctgaattaaaatggaaaaaatatttcaattattttcatcttgttctcaactggatgttagtcaatgtggtctctttttgaatatgtatcaaatattaatgatccataatattagggagataattttaaatgaagtgatacgtgtctaacttacttaaagaataagtttttggtttttgcttttaaagacaaccaaatctgatattgttcatcctgataaaaataacaacttttagtgcttaaagcattaattaagcaagtggctaggtatgataaagaacttctgcttgctccccaagaggcaaactattagaagaactggagcgggagtcctttggacccatcgtggatctctttaagccactgctacccaaaaacattcaggacaagcaaacatttagagcaagaatctccaaattcttcaggatttgtaatgaaatgatgttcagttccattttgctctttacatagggtggagaattgtcatgtcttctctaatttttccaagtaaagtggtagcaaaatgttttaaaaagcaatcttatattagaaaacaaaaatgttgtcacttgaaataccaaaacaacatttctgagcgttgttgagggactggcaaagcaatcagctactataacaaatcagtagaaataaccctccyacaccagatatgcatgcagaaggaatggagtattatagagacttgatacaatggacatatgcacatggaggtacaaaacacacagtctaaatacaaatgaattccatcagatttactatacggaacatcagtagtgacagattgcacttcttacttaataacagcaaacttaatttctgaggggaaaaaaatggcgaagtcttatcccaaacaaatagcaagagaggtatcatcaaagagctaaaattttctttggcatggtaaagggggaaattgagtttaccaacttatttacatgacatttctctatattggtgagtaatgcaatgccattttgttacataaagttgtttgatgttttttaatatgccttcatataaatattttattcaatatgttgtatttgtgaatttaacaaatgatattaaacacaaactacaatgcagacagacaaactmtttgtatgcraattagcaatacataccaacagttcttgatacacaggtacctactacatgcagctcatcattgctgtcctcttcccatgctacaggtgagaccagacacaaagtaaatgacctaactcaattacaaataacaaggacccctctgcaatatgtctaaacatatattagaakaaagtatttgacatccttcatagggataaatgcccttatagacaccccatatataaaacacaacagagatacacatttacataaatctcagtcatttacaaaaataaatcttgtcttaatttaaaccaataaacagacttgcaggggaaaaagaaaccagcaagtagggctaattatcagtaacaaatagatgggggtgtttgctctgtgtgtgtgtgtgtgtgtgtgtgtgtgtgtgtgtatatgtgtgtgtttgtgtgaagtgaagtgttgctgctgtaagtagtgtccataagcccatttgactgtattacaagttagttaattactcatatagttggccacatattatgggatctatgttttctgaaaataattggttaatggaagttatctaatatattttaactgttcctgttaaaaacaataggcttcaagatgacataacaccaaatcaaaaatgaccaaaggaatcattttgtttgttagatttgtaatttagcatcattggcaataaatctactcaaacgttctgctaactttttatttattcaagtagaatccaatatgaaaatgaaataagcataaacaaacagttaaatttctactaaacctttaatcagctaagcaggccagaattttttaatgctgggcaagggctgtcatgaagaagatttatgaaagcagtgacaaaataatttcccaataaatacagtgcagatggggaaaatgatgactgggtcatcctcccacatagaaagaataacaagaggccagtacattgatcccacatataattttcaataaatgaggttcagtttggtctcaatgaactcttctragaagaaaacattgaattttattaggtgtacacagagttaacaaatawattccmaaacagtttagtatgaaacattttgaacccctttagatccaatattgaacattttgcatggaatcttcattgtgtagtcaactgttcctggcctttcttggtagttgtcttccctaagctcaaacaaacagtgttaaactaaaaaggaaattaagaatgcaaaataaaagaaaataaatggaatggaccaaaatcctcatggatgaatgtgttggtttgcctttattttcatctaggataattcaacagactgtattctgagatcatggcaaggcacctctaacccagccactgggcaacatgagccccagatgctgagctagaggcatgtactggtgaaatacacagtaccggactcagcatgctgagctaaaaaaaatatttttcctaatatgtccagtttaaaaacttgtcattaaacaccaaaaatattaaagtctaattaatttataactaacgtttgcattgctgctgcaggaaagaacacaacagccgtcttgcccatgctctgctgagtatgaggggaacgcagccagaaacggggatggcgttaagtttggttcattaaaaacaggacggagtatatctgaaatggatttaggtagcgcaattcttgtaggttataattactgattttcctttttttttttttccaaataatgagaattaatagatgaaaaatgaaccttaatcaggcctacaaggcctacagaaatctttggacccactttctcaaaaaccagtgggtcttgctcgctgggcaaggcaaatgttaccattaccagtaagcttgtgatatgtataaaacacacacacacaaagaaactagagggggatgtcaaacacatatcatagagagcttccctggattgtgtttgagccatttcccacccaggcaatgccgaccttgggagcacagtatctgctactggacagagcgtatatgtgtgtttaatcgatagtgtgagccagagacaacaatctttcttaatctttctttatagatgcaatttgtaataataggtttagaaggcttcctgattccctgattgctctccgacctaagccaactgcaacatttaagatttagaggaacaaaatccctgcaaaaggtcacagacagtggagcgagcagccctgtaaaaatgggaagaagagaaatccgtaatagcacaggtttacagcgtctaactagaaattactcaatattatttgtgtgctacaaaattgaacttaaacacatagatttcgctgaaacaggactcaaaaaggattatgggtagctgtcagcaggcaaggtatcgagtgtacttgtgaagtatgtcattcacatgaagtgtcacagtcacagaaaagatattaaaaaggcattccatatctggtagggcattccatggtctgagtttagctggttatccaggtgtcttcttgttgtggggggtgcaacaggttgagatttatccacttgcaacagagaagttcggagacagcaaagaataagcattagcttacttcctgctgctcttcagccacggagcaggaatgtctggtgaggataaatcactcaactgtgctcaggacgaataagtcacaacacctgtgaggatctggctatgttgtcttactcttgttgactggtttgcctccattcattattgcagaygcacttgtgcttttacttggcgtcaccccaggcttcgggaccgtttccccaacatcatgcaaagatggttctcggtacatggcaactagtgatgggaagaaaggaggaggaaaagcaaacattgcttggttaggtgtgagaatggtccatccatacctgcatagaccactgcagtttgcccatttctgttttccctgaagtaaagcaattccattgagacagaattcctgttgtaaagcaatcatttccagcccacagaggacattactcccttcacattctctggtctgtatacctaaaatatgtatatgagtgtgcatggatttttgtctaggacagcaggtttaaatgggagctatggcctctttgtgggtccatgatgtaaaacacacacacacacacacactataggagaatgacaggcatttaacttaattctcaaaaaaagaaaactcagacatcccttccactgcacattaatatcaacacatgaacttctcattcacttcaatcaatctttgtgagctgcggtatttacatcctagaacattaaattactttctttcatgtggttcaaaagcaacatagtcatactagtgtcaacttcaaagctacacaaaataataacaaataactctcttcccataagccagagccttcaggagattatcatttcaatgttcatttcctacaatcatggaaaaagacccttgggcagcagaaggcaactcattttctgctatgttattaaaaatctaataattgacatgatacaggggcagaaaacagaatggcaagacagcaactgaaactacctgaataaactctgaggatttatctaaatagtgtctggtggcataatcatagtagttcacgtggctttttagaaaatgatttctggaagtcctgagaaaggacatataagagtgactgatggttggggaaaactagggattaaagtcatctgccatcagaaatacaagtgcattagagctgcccaaactgctttttaggtttttgaaagtttaa

SEQ ID NO: 12364 - DNA, 26796 bp, Homo sapiens
  misc_feature (1)...(26796): n = A,T,C or G, or insertion/deletion polymorphism (see Tables 1-2)
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcccctaaatgcaaagcatcctgtgatgcttttttctcccactgtgcagatggaaaccatcctggactagaatttctttcagggagagatggagcccttctgtctttactttgagctgctcagggggttctgaggtgaggagctgaaagtggtcaggccctgatgggactctgtggccttgacatataaggagaccaaggagacagatcctccttacacctgggagccaaatgccttgacactgctctgtgtcctgtaagccagcctctccatctttcgggtgctggccaacaacacttggctctccagatattttattcatcagggatccccagccctgcccgcccatggctagggaaggcaggatggggcttgaggacaagcctaggggagctggtgaaaatacagaatagtggccgggcgcggtggctcatgcctataatcccagcactttggaaggccgaggtgggtggatcacctgaggtcaggagttcgagaccagcctggccaacatggtgaaaccccatctatactgaaaatgcaacaattattcgggtgtggtgtcgcgcatctgcaatcccagctactcgggaggctgaggcaggagaatcgcttgaacccggggggcggagtttgcagtgagccaagattggcactccagcctgaacaacaagagcgaaactcaatctcaaaaaaaaaagaaagaaaaagaaaaaaaaatacagaaaagctccaacacatgctcccgtgcatcagcaggggctcaggaagaggtgggttgctgggaggatcacctgacagaagagagttctctgggtttgggctggaggctggcagtggcctccttgcccagacagggctgatgggtagggggattggcagtggaggggtgggggcagtgagggctgacaccttgaagctggatgctgagtttgacacacttagagctgaacactgatgtctgttcagccagagtctggggaggtcttggactccaaagctgatttgggaatttgggaagaaacattaaagctttttagagaataaggaaagagtatgggagctttactctgttcagaaaggagaatttatggaagtatagctcacaatctatgatctgcacccccaaacatccaacctcccatatgagagataaaacacagcatccctaggaagcattattcctgcgcctccaccaggcagtcatgccccagcccagcctgtcttcatccctaaccattaccattccacctccttttgttcagggcaggtctgggaatatgttcatgtgagggatcacttcttgcaaatgctccagttatcctgcacccttcaagtaggctccaaatcctacaacattctccttgccctcccaactcgcagggtgccagcttcttcccattctggccagagtttgtgacttccatgaacgcccataatctacttttctctgttttctctgaccccatgctgagggggaaatcaacaataataaaaaggaggccaggcacagtggatcacacctgtaatcccagcaatttgggaggccaaggtgggtgtatcacttgaggccaggagttcgagaccagcctggccaatgtggtgaaactttgcctctactaaaaacacaaaaaatagcccggtgtggtggtgcgcacctgtagtcccaggtactcgggaggctgaggcaggagaatcacttgaacctgggaggcggaggttgcagtgaaccgagattgtgccactgcactccagccagcaatagtgtgaggctcggtctcaaaaaacaacaacaaaaacaataacaaaagggaaaatgagtaaggaaataatgccctgtcccaatgactgtgtctgtctgcagtgcactctatgggtcagagagacagcaatggtcccacggggcaggtgcctggggcttcctctcctaaatcaattctctctcctgatccctgtctcctaacaaccctacatagtcacaagcttggtctctaaatcagaggtgatcattgtccatcactaccttaattgaccaccagagggaggtagagagcaaagtttaccgcctgcctgagcagcactcaccgcatgaccaggtcctgcttccttattgtctcttttaattgacctgaagcgtccttacaaggcagtctaacttaaatatccgccagtacaatttaaattctgccccaggccgggcgcagtggctcacgcctgtaaccccagcactttgggagaccgaggcaggaggactgcttgagcctaggagttcaagatcagcctgagcaacatagggagactcccttctctacaaaaaattaaaaagtgagccaggcatggccgggcgcagtggctcaagcctgtaatcctagcactttgggaggccgaggcgggcagatcacgaggtcaggagatcgagaccatcctggctaacatggtgaaaccccgtctttactaaaaatacaaaaaattagccaagcgtggtggtgcgtgcctgtaatcccagctattttggaggctgaggtaggagaatcgcttgaacccgggaggcggaggttgcagtgagccaatattgtgccattgcactccagcctgggcgataagagcaagactccatctcaaaaaaaaaaaaaaaaaagccaggtgtggtgacacatgcctatagttccaggtactgggagcagggagcgggcactgagatgagagaatccctttagcccaggaagtcaaggctgcagtgagccatgactgcaccactgcactccagcctgggcaacagagtgagaacctgtctcaaaaaaaaaaaaaaacagaaagaaagaaagaaaagaaaaagacgcagctgggcacggtagctcacgcttgtaatcccagcaccttcagaggccgaggtgggtggatcacctgaggtcaggagttcgagaccagcctggcgaacagggttgaaaccccgtctttactaaaaatacaaaaattagttgggagcggtggcatgtgcttgtaacccagctactcgggaggctgaggtaggagaattgcttgaacccaggaggcggaggttgcagtgagccgagattacaccactgccctccagcctgggagacagagtgaggctccatctcaaaaaaaaaaaaaagaaaagaaagaaaaagaggcagggcaccctggatgggaggaaggagcaccaccaagacaagcctaaatgtggatattttcattccaaaagcacaagaacttcaacctggctgaccccacaagcccatatatctcctccctgccttgaactcaccaagccccctgcttggaataccagtaggcagtctgagggaatgggacaatgtggtgcaggcagggtcgggacgacaccaggagtgtgaggacaggcccggcagagtgctctgagatcagactgaaggcgggagaaatgagagaagcaagacttcccggtcagaggagagaaagctgactagatgggctttgcaggtccttggggagagcagagccacgtgtggcttttagatgccactgttctccagatctttgcagaatccactaaactaggaaccttggcctgcagccagtgggagaagggtagtcactgggaagaaactcccaaaagtctgaccgaggcaatgctaggctggtgagagggtgggagtgggactatcttccctggagctgattaaggcataaggagactgcacagcctcaggactatatgctgaaatgcaggcatcacgtcagtgtagtggctgagagatacaaggaggaagaggtggaaatccaggaaaacagacagagatgaaaggactataacacacacagcaggtttctatgtaaatatgtgcttgtgatagggaccagatgactaacgacaaccttttttttctttttcttttttttttttttgaatcggagtcttgctctgtcgcccagcctggcatgcagtggcacgatctcggctcactgcaacctccacctcccgggttcaagtgattctcctgcctcagcctcccaagtagctgggattacaggcacctgccaccacgcccagctaatttttgcagttttggtagagatggtgtttccctcatgttggccaggctggtctcgaactcctgacctcaggtgatccacccacttctgcctcccaaagtgctggaattacagccgtgaaccaccgcacccagcctaacgacaaccttcccacacactcaagcccccacctctgcctctcctaaggagaagggacatttgattgctggaatggctggagctgtggaaggaggatgaagtattgggtggctgcagtgagccatgatcaagccactgcgctccagcctgggtgacagagcgaggccccgtctcaaaaaggtgtagggtggatgggaaagtatgtaaagaaaaagagagtgagcagggaccagagaggcagaggcaaggcttggctttgttctgtttcaagacatagagaagagatatttgggagcatctgtcatattgaatgagactttggggacacaagtggagtaatgactattttagggagttttcctaagtgtggaatggtctagtctcattcaccatcagcccctcaaggaaacgttcagtaaagatggaattggccgggcgcagtggctcatcctgtaatcccagcactttgggaggccgaggcgggcggatcatgaggtcaggagatcaagaccctcctggccaacatggcgaaaccccgtctctaataaaaatacaaaactagccaggcatggtggtgcatgcctgtaatcccagctactcgggaggctgaggcagagaactgtttgaacccgggaggtggaagttgcagtgagctgagattgcaccgctgcactccagcctggaggacagagcgagactccttctcaaaaaaaaaaaagatggaatttactcttcacagcattcagggttgcgtttctttttccatgagtggtactaagaagagcctcaaggtgggagcaggaaggctctgctgtgtcaggttatacctgcacatatgcatggccacatggcccaacactgtaagggccttgcttgtaagtcccttattctgtcctctagcaatgtgaccatgtaggcaacatttgaaattcctttaaaattccttctaggcagagatttaagctaagaggaggacctgagtgacctctggtgcaacatctgaaagcccacgacaagcctcctgggcttttccatgaatatcgccgtgcccctgcctacggatatgctgatgtgtgtatacaatattctgtgagaagcagagacgctgaacactaaacaacacaaacccatttggtctaactccatctctgcctactcagacatctgcttctagcggtatcagagttatgtctatgtagctaaaacaaatggagtaaggcagcaatacacacaggctgacaagcccaggatggagggcggcactgcagatgctctgctctctactggaatgtgtggacatacaggaatccctatcccaggacacccgcagacccccaccatgaatccgagatgctccccaatgacggtgatgatgacagaacagagatgccatccctggtcacacacacacacacacacacacacacactcccactgcctccctctgcacccctcccaaaggcacctgccttcctctcctctcaatccacaagccaacctccagctgccacctctctatcagccttggctacccccacccacgctggcacctgcctggcagctccctatccaccccctcagccctcaggaggccagggcacacgtggaacaggttgatgttgttctccaggaagtggagtgggaggggggtggggtcactagggcaggcggggtccccggaagcctctgtccctgcataaagcagcctgtcctggcaagggatggtcatcctctcaacctacagacccagtgagccctaggccctcaccccagacccagctgctggataggacccagccccgctcccaggtaagaacttgatgacagcagggaaggcaggggtgctctgaggacacaggaagatgggtggaccaagaagggaatggaactcccctagagtccagtgggataagtatcccgataggccttggggagggaagggagaggcaggcctgtggacatctctctggtgaagaggaggctgctgttgcccaagcccttcccaggtgcacccaggtagcaccaggaggttgtcctgccccatcctggccctcccaggaatgagggtgaaaaaaaaaaaagcaccttgaagctggcagaacagccccacgcatctgtgccgtgcttcctgccccccctgctgctgtgaagtgcctgtggtggatgtgggatgcttccaagccagctggtgtggcctcttccacccacggggataactggggtgtgccgatcggccacccagccagagcacctggactcaaacttcaaagacagagacttaagatgttgaccctcaggtcaggtgcggtggctcacacctgtaatcccagcactttgggagggtgagatgggcggatcacctgaggtcaggagttcaagaccagcctggccaacatggtgaaacaccgtctctactaaaaacacaaaaattagctgggcatggtggcaggcgcctgtaatcccagctacctgggagactgaggcaggagaatcacttgaacccaggagatggaggttgcagtgagccgagatcatgccattgcactccagcctgggcaacaagaatgaaactccatctcaaaaagaaaaaaaaaatgttgcctctcaggttcccatgggccccacattctccagggccctctcatcctagcgcacatctctcagggccacattcattggttctttccacacacatttgccaagctcgaactctgtgccaggtgtggtacttgctgctgcagaggtgactaagacccatttcctgccctctgggaagtcacagacgagttgctgatagggtcaggtgaacagatcataacaaaggaaggtgcatcagaagagcgctttggaaacacagatacagtcaccagctgcctggaggactgagggaagaggttccaggaggtgacctgaattgagcattagcggaggactagggagtcttcagatccggaagcgggtattgtaagcagagggggcaaaggtgaagagcatcaaaatgcctggatcctggctgggcacagaggctcacacctgtaatcacagtactttgggaggtcaaggagggcggatcatttgaggtcaggagttcgagaccagcctgaccaacatggtgaaaccctgtctccattaaaaatacaaaaattagccaggcgtggtggcacacacctgcagtcccagctactcgggaggctgaggcaggagaatcgcttgaatctgagaggtggagactgcagggagccgagatggcaccactgcactccaccctgggcaacagagtaagactccatctcaaaaagaaaaaaaaaagtctggatccaggcatcccccaggggctgtgagaggggagtgggtgtactcatacctgtggcacgcatgagggaaggacagggtgcagggaagtgtaacccacacatggaaagggcaactggggcaggtgaacagcttggccacccaggctcttgttgccagcagcatctccttccctcccctggtgtcctccgactctggctattgctagtctctggtgtgagagaaagctttacttccattgctaaataaatgctctagaccaggcgcagtggctcacacctgtaatcccagcacttcgggaggctgaggtgggaggatcacttgagccaggagtttgagaccagcctgggaaacatagtgagactctgtctctacaaaaaaaatttaaaaattagccaagtgcatgactgcagtcccagctactcaggaggctgaagtgggaggatcaattaagccttggcggtcaaggctgcagtgagctgtgatcacgccactgcactccaacctgggcaacagagtaagaccctgtctcggaagaaaagagaagaaagcaaagcaaggaaaggcgaggtggagggaaggaaggaagggaaggaaggaaggaagggagagggggaagaaagaaagaggaaagaaagaaagaaggaaggaaggaagaaagggagggagggagagaaagaaagaaggaaggaaggaaggaaagaaagaaagaaagagaaataaataaagaaagaaagaaagaaagaaaaagaaaagaaagaaaagaagtgctccagctgggctccgtggcagtgaagaaaatgagcgtggagtgagaaaaatgcccttgacaaagaaaagggaggtgtggctttgctggccatctrtgggactttggggcaactctttcaactctccagccctaggttcctcatcataaaatgcagactcccttgattctttccagctgtgacatgagacaatccaggcatctctaagagctcctcctgcctcagagccgggtaaactctctctgcaggggcccagcctatatcccgggctccttggcagccttggcagccaccttgacactctcctgtctccccacctccacagagacaatgaccatgtttgaaaatgtcacccgggccctggccagacagctaaaccctcraggggacctgacaccacttgacagcctcatcgacttcaagcgcttccatcccttctgcctggtgctgaggaagaggaagagcacgctcttctggggggcccggtaygtccgcaccgactacacrctgctggatgtgcttgagcccggcagctcaccttcaggtcagcctcaagyggggctgggaactgagggatactgagggacagrggctgggcacctggcctgcaaggaggacctcaaagctccctctggccagaggtgattagatgtcatctagcccaaagtcatcatcaggagctgaggaggctggtggtcggggggatacctctcagctcagcctcttttatttatttacttgtttgtttttgtagagatgggttcttgctttgttgcccaggctggtttcaaactcctgggctcaagcaatccttccaccttggcctcccaaaatgctgggattacaggcatgagttactgcacccagccagcccagccccttttgtcttttccctcctgcagacccaacagacactgggaattttggctttaagaatatgctggacacccgagtggagggagatgtggatgtaccaaagacggtgaaggtgaagggaacrgcagggctctcgcagaacagcactctggaggtccagacactcagtgtggctcccaaggccctggagaccktgcagragaggtgagagtgggcgggacygagggtctcccgggatgtgggtggggcagtgcatggaaatggtgcttggggccttgagctgaaaggtaggacccttgcactgacctttgccaatgtggtcatgacaggggagctcttggaggcaacccttctggcccatggctgcatccaggccatttcctagtcacacctcccgctgctgccaccgtctccaggaccacctccccactgtcacgcatgcacagggaagatgatgtccacactagcttgctgtgtgatcttggaaaagtcacttctcttgggacctcagttttcttttctgcaaaatgacaggattgaatgatcatctctaaggctccttctaactctaagactatgcaatacactagaaaaaggagggatgtgtcttaactgcccccagctgagacctgagcactgtgttctgctcccataaatgaagcctcctgcctgaccccaatacacactaagcacgccctcgggaatgctgccccacagcacaaagggtgtggcaggtgccacattgatgctgggcaccaccggatgtttggcttgacacgggaactgacttttaagtagttaagtagtggttgaaagaaggaggtaaggactgtgaaggccagaaggaaaggctggggtagtcatccagcaagcatgtatatagtaaagcactctactacgggctggggtgcgcctagaacatctttgtccaagaaccttgcagtctaggaaggtgaaaattttaaaaacctgtgcaacagtaattataatcaaagccaagaagtgctaagtgctgtagggatggtttgactgagtcttgtggcaggtcaaagggacttctggctggggaaataagggaagatctcacagacatggcagcctctgttttgggccttgaaagatgagcagaaattgggcatgcagggctgggagaagggtattatgaaggcacacaggtgagcaatctcaaaaccaccaagggccaggaacagccagcatagcaggggcggaagaggtgcgagtagaacgagcaggaaatgcaggtgaacccaaaccatggaagaggcaagtggcagctccaggagactgaattgtaggcaccaggaagatcctgaaaatgttctgatgtgtcccatgactaatccagccagatggaggaagtgtgtcagataggggaagaggaacaggggtttgaagcagtcagacaaggcaagacacttttcttctttttttgtttgaaacagtttttcgctcttgttgcccaggctggagtgcagtggtgcaatcttggctcaccgcaacctccgcctcccaggttcaagcaattctcctgcctcagcctcacgagtagctgggtttacaggtgcccgccactacgcccggataattttttatttatttattttatttatttatttattttgagatggagtctcgctctgtcgcccaggctggagtgcagtggcacgatctcagctcactgcaaactccgcctcctgggttcaagcaattatccagcctcagcctctcaagtagctgggactacaggtgtctgtcaccacacccagctaattttttatatttttagtagagacggagtttcaccatattggctaggctgatctcgaactcctgactttgtgatctgtccgcctcggcctcccaaagttctgggattacagggaagtaatcccagttaagtagtggttgaaagaaggaggtaaggtggctcgtgagccaccacacccggctaatttttgtattattagtagagatggggtttcaccatgttagtcaggctggtcttgtactcctgacctgaggtgatccgcctgcctcagcccccaaaagtgctgggattacaggcgtgagccactgagcccggtcttttttttttttttttttttttttttgagacggagtctctctctgttgcacaggctggagtgcagtgacacgataccaggtcactgcaacctccgcttcccaggttcaagcagtcctcctgcctcagcctcctgagtagctgggattgcaggcgcacgccactacatccagctaatttttgtatttttggaagagatggggttttaccatgttggccaggctggtctcgaactcctgacctcaggtgatccgcctacctcggcctcccaaagtgctgggattacaggcgtgagccaccacccccagccaagacactgttcttctatcccatgagcaacgaaaactgaggacccgagctggggaagggcaagaggagtgaagagggaggaatggatgcaatgcccattgccaacggtgatagaatggcctgggcttggtagctgattgcaggatgagggaaagggttttgtcaaaggtgactgcgagattttacccaggttgtgacattataggacattaaagctaccattacaggtgacaaacaggaagacacaggttagaggtagatttggagattgtgagttccttttggatgttttgagtttctggttctgctgagacatcagctgagcatgttgaacaggtgattggaaataagggcctggagctcaggaaagaggtcaaagtgaagatacacacaaggtaatcagcactataaagattaaaactgtaggagccaggggaggagtctcastcccgtaagcccagcactttgggaagccaaggcaggattgcttgagcccaggagttcaaaccagcctgggcaagagagtgaaacccccatctccacaaaaaacgcaatattagccgggcatggtggtgcgcctagagtcccagctactcaggaggttgaggcaaggggatcacttaagcccaagagctcaagtctgcagtgagttatgatcgagccactgcacttcagcctgggcaacagagtgggaccttaaaaaaaaaaaaaaagaaaaaactataggagtgagttgggtgtggggagcttttagagggagttgagaaaacaggactgagaacagaatcttacagaacataaaattttagagaaccaaagaaactggaaaatgaggtgcagacagaatggataagatttaggaactagaagtactggagttgagccagggtggtacattgtgactggaagccaagagaagccagcgttgcacggagggtttccacagcaggatcgagwattgcacagagttaggcgaggtcrttgagactgayaggtaagagatcattgtaatttcagctgagtagtggaaatacaaggcaaattataaagaatttaggtggaccgggcatggtggctcacatctgtaatcccagctattcaggaggctgagggagaagaatcgcttgaacccgggaggcagaggttgtagtgagccaagatcgtgccactgcactccagcctgggtgacagagtgagtgagactccgtctcaaaaaaaaaaagaatttttttgatatatttgccaatgaaatgaaggaaaaaaatagggtagtaatttgagggagtggcatgatcaaagcaaacaaatttgttaggattagggacacgtttatatatggaagcagacagaaggagcaagtggagaggaggaactggtgttaacagcaagagagagcataagatgtggagagaaaggatcccagagagatgaatggggaggaaagagsgggggagcatctacccccrggatcccagagagatgaatggggaggaaagagrgggggagcatctacccccgaactggaggaaaagggggtaagaagcacccaagaggccctgttccyggccaggtgctggcccarttaccgagtttatctctgagcaacccaggaggtcagcatcattatactcatttcatagatgaggcaattaagactcagagaagctgccctgccagtaagcatgagatctgggtttcaacctcagccctagtccagagtcctcactccttccctgccaccacaatgtctagttcctgggaatgacagaaggaaagaggagggtgtgktacaggcaggaaggagctctgaacggttcccttatgtttctcctgcaacaggaagctggcagcagaccacccattcctgaaggagatgcaagatcaaggggagaacctgtatgtggtgatggaggtggtggagacggtgcaggaggtcacactggagcgagccggcaaggcagaggcctgcttctccctccccttcttcgccccattggggctacaggtttgattcaaacacacacacacacacacacwctcacactcacactcacacatacacatttacattcagcccctccttggaggcttcattagctttgcctgatcagcgcccaccgaggatgctgaaaagggccactccttcccccggctcttaaagatccaaaccccagacatatgccccctccctggtcagtggcacccagtgagggcagatccctgcgccagatgccacagggaactactggggaaggggaaagtcacattcctgggttttccctcgtggtgctcccattccaaagaggagacatctttactctcggaaagtcatcaggttcatagaggagacacagaggctaaagcccagagaacacaggcttggaaaagccaatggaaataaggaatggtctccatacctctatctattgcatctaaatattcaagggatgatttgggatttggagccaggagtaggggttagtcatggaaggcgtcctgaaagaggtaagcatgggacagatggtgaagaggaagaaggagccagggcttggatggaagctctagggtgatgtacaggcaggagatggagcaggtctgcccagttcccttcatgcatctgaaccaggaactagaactgacctgactagactctactgacctgaaccaggtcactagagggaaaatcagcagaaatgagcacaaggactttgaagtccttcctcagagtccagaccagggacaccactgaaggcttccagcttcttatctccctgaaggctctcagccctgaccctgcacctcccccaactcrcgctcccaatatctcatacttaagatgtccagagattcacaaattctcattgtctaattctagggatccataaatcacaaggaggctgtaaccatccccaaggrctgcgtcctggcctttcgagtgagacagctgatggtcaaaggcaaagatgagtggggtgagcagagacccgcatgttctccccacaagatgagaattacctgcaccagtactgaggcaccctggtcccctcttgcggaaatgtcagagaatgagtaggggggtgtattgtactgtgatccgactgcagccatggagcctgctctggagagaagggtgaagaggctcctggattctgagcatcttctgggtgctgggcactgtggttattgggggagggggtacaaatatgaacatgcactgcctctgctctcaagaagtctgtggccaaaggaggaaacagacagagactggaatggatgatagaaagtagtgttctcatagtagagaatttatcaaggaagaaaagattgcttccagcaatggaggttgaagctgggaattaaatgaagcatttggggtgcaaggtcctagcccttagcagagccctttggcttgagactgaagaagggaatgtggggcagctgctaagtgtcctcccaccctccctcccttgcccttcacagatattccacatatctgcaatgataacatgcaaaccttccctcctggaggtaagtgaaattgcttacgggcttcccacatcttccgccctacccctgacattatctgccaaaatcctccaccctctcctagcttatactataatcccccaaggagcctctgcttttgtttcccaagtccctaagaatacctagcctcaactttaggaaagacagatagaggcatataaatactgtcccagagagatatagaaactgacagacagagacyggaaggcacagtcagaagcagaagtaagacttggagactgagtgtgttcccgaatcatgggggtgratgagctagcataatctccctgtgtttttataatgatcactgatgaaactsccttgaagactgttttagatgaaaaggcaaaaatgggttttgtgctgacagatgtgcattttttctgtcttcagaaaagtcaggagaggagaaggtcatccgtaagtgtttcctttcattccactgaaactttcttgactccaaattttaaaactccagtctttttctttccttctgacaggactgacagggaaatagcagagcgaatctcagcaaataattgtccccgaaacatggcagaaattccaatagcttgggaaaaagcagtggaaaggggggagtctttgcccaggtggtctgacgcctgagacctttgtcctcaacagccttastagcagccaggcacagtgattcacacctataatcccagcactttgggaggctgaggcaggaggatcccttgagctcaggagttcaagaccagcctgggcaacatagtgagacaatgtctctatttaaaaaaaaaawtttttttttggatggagtttcactcttgttgcccaggctggagtgtagtggcgcaatctcagtccactgcaacctccacctccccggttcaagtgattctcctgcctcagcctccggagtagctgggattacaggcacccgccaccatgccctgctaattttttgtatttttagtagagatggggtttcaccatgttggtcaggcaggtcttgaactcctgacctcaggtgatccacccacctcagcctcccaaagtattgggattacaggcrtgagccacggcgcctggccttttttttttttcttgagacagagtctcattctgttgcccagactggagtgcaaaggtgagatctccactcactgcaaactctgcctcccaggttcaagcaattcttgtgcctcagcctcctgagtagctaggataacaggcgcgggccaccacactcggcgaatttttagtatagatggggtttcaccatgttggccaggctggtctcaaactcctgacctcaggtgatcctcccaccttggcctcccaaagtgctgggatcacaggtgtgagccactgagcctggcctagaaaaaaaaaaaaaaaattaagagwcttagtagctataacctgctacacacacatctgcaactcggccgcccagcaactggggccagagccactgagtcacagtaatgccaggaacaaggtagctgggctctcccaggagacaggcaggatgtatttcctcatcttccttagtgtctcaacccctgggtatggctgccattctgaaggattgcattcttatcttttttttttcctttttttctcagttatccaggcatctgatgttggtaaggaactttgtgagtttctcccaagactttggcatggaggtagcattaggggcagagagaggagaaggcgaagtcattctttgtcagctaactcatgggaagggaaaacagactttctttctccactttttgctggagtctcaaagaaaagtcaagtgtgtactgatatgggataaggcctgggatctcaggaagattaactgttgggttagatgatacatgcatcctggcccaccttctcgccccaaccctcaggttagggttggtggatagttctgtcacygcattccttggtaaagaaaaatggggccaggctcaaactggggggtagagcatgggtacctaaagggggctgagtgtaggagccctgcagggggaatgctgactggagaggaaggtgcccgayggagggctgtgtgtcccattattgtccccmyaggggacgtacacgaaggcttcaggacactaaaagaagaagttcagagagagacccaacaagtggagaagctgagccgagtagggcaaagctccctgctcagctccctcagcaaacttctagggaagaaaaaggagctacaagaccttgagctygcagtgaggacctagtggaagtggggaagggtgggagaaggcatgttttggtgaagatttggtgggggcgggtattgcagcaggtagggagatctgacgggggcaggaggtgggtggccaggggagtccaccttagataccttccccaaggctggccacgtgccccaaggctgccaggccactgctcctccctttgtcccctggaaaagggyaaacagtgggttcccccaaggcacatgctccctctgatggccagaagggacttctgctggaggggctggaaccttctctttccagagtccaaaactcaggaaacaaggaacccaggagtccagtactcttcaggacatgaggcctcgaaaaagaaatcaggaartggagagagtttccgcatgtcaaggggttattatgtgctgggccctgggttgggccctttcctatgttatcttcaatagtcgcccaccttcccccacagcttgaaggggctctagacaagggacatgaagtgamcctggaggcactcccaaaagatgtcctgctatcaaaggaggccgtgggcgccatcctctatttcgttggagccctaacaggtaagtggggaataaggtcttcatttatagaccttttcagtaataggaatgaatcacttgaatcaattcccaaatggatgaataaatgaatgaatgacaaattataccacagttaagtagtttatatctacatttttataaattggtttcatggctggctgcagtggctcatgcctgtaatcccagcactttgggaggccaaggtggatggatcacccgtgatcaagagttcgagatcagcctggccaacatggtgaaaccccgcctcttccaaaaatagaaaaattagccgggcgtggtggcaggtgcctgtaatcccagctactctgaaggctaaggcaggagaatcgcttgaacccaggagggggagggtgcagtgagccgagatcactccattgcactccagcctgggcaacagagcgagactccatcaaaaaaaaaaaaaattggtttcattcctaaggatttgcttggtcacattgggtagtctgagaagacagcctagtcttgctaatagaggttgaataaccctagttttatcagcaacatatttaaaatttctgcatatagctaagctcatcacttctatcctgatacctgttagctttaacttcagggagtaacattttcttatcttgcccctaagagctcttcttccctccacattttctagttttccacttagaaaaactctgtggtccttcaggtgtaagccaaaacgtttgttcccttaggaagcctgccctccgactccaagaccaaagtggacccctcagctatggctcccttaacacctgcgttgtaattacatccaatgaatgaaggctgaaattctggaagtgcgctatttggaggctgtagtcccctctgcaccagcaacacacatctttctctgctttttytctccagagctaagtgaagcccaacagaagctgctggtgaaatccatggagaaaaagatcctacccgtgcagctaaagctggtgagggaaaaacagcagatgctggggagagtctgggagtagctgcagccagtggagatgcagatttcgcctaaggatggagccattctggaggatccctgtcttatcccaggggcttatgcccactcctcctttctctctctatttctcattttttgttatttcacaagaggtagaagactgaatttctgggcaataatctgggtttattagcctgatcttgggagaagagacagaaactgtggctttgcttattcctagccaaatattgtaagcaaatttttttttttttttttttgagatagagtttcactctttttgcccaggctggagtgcaatggtgcgatcttggctcaccacaacctccgcctcccgggttcaagcgattctcctgcctcagcctcccgagtagctgggattacaggcgcccaccaccacaccctgctaattttgtatttttagtagagacagggtttcaccatgttggccaggctggtctcaaactcctgacctcaggtgatctgcccacctcagcctcccaaagtgctgggattacaggtgtgagccacctcgcctggcctgtgagcaaattttttactgtgtctgagtctgtctcaatttattcctctgtaaaatggggctaaaaatcaatgtgctgcccactgtatagggctgttcaaagacccagatggggttgtaatgtaaggtaaagtaaggaattctaataaggggaatgtaaccttcttgtgatttttgtgagttaggagaggagagaggtttccagttctttcttttcatgctgttttgattccctccaggtggagagcacgatggaacagaacttcctgctggataaagagggtgttttccccctgcaacctgagctgctctcctcccttggggacgaggagctgaccctcacggaggctctagtcgggctgagtggcctggaagtgcagagatcgggcccccaatatatgtgggacccagacaccctccctcgcctctgtgctctttatgcaggcctctctctccttcagcagcttaccaaggcctcctaatttgccttttacgtctgcttcatgactccctaatgccttcccaacctcgtggtgctgtgtccttaccacctaagggcatttcagagccatcagctgaagacatctgaaatctcagctggtcacccatgataaccaacttccacctgcccaaccatatatcaccccctacccctccagctccgcaacccactaagcccatctgctgatgcttaaattttctttacttttcttttctttttttttttttttttgagatggaggctcactctgtcacccaggctggagtgcagtggcttgatcttggctcactgcaacctccgcctcccaggttcaagcaattctcctgcctcagcctctcgagcagctggaattacaggcacgtgccacgacacccagctaatttttgtatttttagtagagacggggtttcaccatgttgcccaggttggtctcgaactcctggcctcaagtgatctgcccgcctcggcctcccaaagtgctgggattacaggcgtgagccaccgtgcccggcctgtgcttaaatattctaggagtagaagcactcagacttttaaaactatgagccgtttcagcaaaactgagaaaaaaagaagattaattaatttcctatcctaatccctcctacttatacttccccaaaaaacaagctttactggaattaatggaaaatattatgtcaatcttaggaatgatatgtcttttggtgtttttctttaaagaatttatcatacagaaattcttaatttgtgccagaaaaagaaattgttatcatactgcatataaatcatatgtacatgaatatgatgctgtactgtcctcaggcaaactggaaaatgctcagagggtatagaatgtggaatccagatttttttttctgttcaattagttttctttaatggaatctagagtctcaagtgagaagatatcaaagcagtttgtcttcaaagaagagcatttgggagtcccctagctctgggttgagggaaagaccgagagatatatagtagaagcccgaaacaaaaataagacagatttcaaatttattgaacagaaaatgcagatgggcctttaaaaaaaagggggacccaagaataagactaacccaaaactttaaaaactaaattgtgatattatttcacctttctctgttctgccctgaaatttagggttcttgtaggaggaagtagtgtgggtaggcttggcatattactactaatatggatattacaatctcatcaaaccgctgggtttatatcatcctcctctgcctaaaagctgggtttgaacatctttcaccaacctcttttaaagcagtatcaggaccggacaccgtagctcacgcctgtaatcccagcactttgggaggctaatgtgggcagatcgcttgaatccaggagttcaagaccagcctgggcaacagggcgaaaccctatctctacaaaatataccaaaaattagccaggcatggtggcatgtgtctgtggtcccagctactcgggaggctgaggttagaggatcacttgagcctgggaggctgaggctgcagttagccaagatagcaccactgcactccagcttgggtgatggagcgagatcctgtctcaaaaaataaaaataatttttaaaaaagtagttctatgagtgcagtacatgtctgtaatcccagcactttgcaaggccgaggcaggaggatcacctgaggtcaggagttcaagaccagcctaatcaacatagtgaagccctgtctctactaaaaattaaaaaaaaaaaaattaaaaattagctggacatggtggctcgcacctgtagtcccagctactcaggagaaggaggcaggagaatcgcttgaaccccagagggggaggttgcagtgagccaagatcacgacactgtactccctagcctggccaacagaacgagattccgtttaaaaaaaaaaaaaagttttatgagtggaagaatttctctaaggattttggtccgtggagtcagactctcccccagtgtcttagtcaccccctgcccagcctggttccctcatccaccaagaattcatgaccaactgccagaagctttgtgttatgccgccagcctccctgatcctgagcaccttccaaagcctcactctattgctcatggatatactgggttgttatctgctgacttggttgttttctccttgtgatgtaaacttaatagagagatgagctaacaccctaactatctagaagagtaactcctttgattgttaaggatgaacataactcatctgttttcttccttaccattctcgcccaccttcagttgcagatatggtgttatgaagaggttctaatgagtttattccaatgatgattcaaaagtcctgttatccaccccccagccctggagggtgagaggacagttgaggaggaactggtcaaggcatgttccctaaaactagagcacatatctttccagttagcgagtggctgtttaacgcaaggaacatcctgcaatcctatgaaagaggatgcaaaagatatgcaggataccctttatatatgcaaaggaggaggtcaaaacatatttcctgccttctaggtccttacaacagggctagattgtcttgtagggtccgtgaaaggtctaaaactcaggacttccacttatgggagagagaaaagtttcaaggtagggagagagtttttgttttgtgttctaagaaattgggagctatatccttcaccttgtttcaccttccctgcagaaccagtggggcagtcctttgaaaaataagtgggtagggtttcttgtccaatttgcttccccttaggtacaccactaagtaaaccatcattctctccttaggcacaccattattctgttccccatttcacaatgtctgtctggatgtataaaagccctctcaatgggctccctaaagcgtctgccagtaggggctcccaccctctttcctcaacactcccaatccaccgcagcccagagcacagtgtctgcttatctaaccatctgactcccccgtatactacattcttgagctgtttttcacccccctatttgctaaccgtgggccgtacatagggtggacccctatattttgttaaactggagtgattctacgcaaatgcacgctcctacctatcggcactcccagcctgcagaaattgtatgccttatgttcagcactaaactcaaatctaaccaaggaagtccggatcccatagggktcttcctactctccagttcggtttattttaaggccaacagccctagcttcacgtccctccttcacagccttctttccttccctcctgccggatgcgcccggcagccgttgagcacaagcccagcggatctggaaggagaccccgccgcgaccggggaaaattgagcgaacttgggcgcaaaacccgcccggcaactcgtgacgtcatctcgtcccgcgctcggataggctgtacccactccacgctggttgaggcgctcttaaagtcctttgtaacccagattggagcctgaggggacctctcgtggacgcccacagaaatgcactcgagaggaacataaaagcatcacacttaagcgctcgaaagaaagccccacgaacccataaaggctcctccccgctccttcctcgaagctcctccttcatcctgcacctcggctgtggatttatttcccctttgttgactcggccrtcggcctgccgggcctggcgtttcccagaaggcccagcgccgggaaggggtttgcagctgctccgtcatcgtgcggcccgacgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccggcggaggagaacaagaacccccaccgccgccggccccccaggatgtggagatgaaagaggaggcagcgacgggtggcgggtcracgggggaggcagacggcaagacggcggcggcagcggytgagcactcccagcgagagctggacacagtcaccttggagggtacggcagcccaggccgggaacgtgccgcgatcgcgggtgacagcgacccctgtgatttggcttcttgctgggaagccacagcagcctccaccaccctcagttctttgggatcacccccagatacctgcttccactggccgacactccgattcaggcccaatgactgaaccttctctccaggctgggaaacactcccctcccatcccctccatccccatatctggggttgcatctatatctaggtcccagtgggcctggggactccctcttttaagtcctcccctctgacctattccgtttatatcccacccgactgattttagcgcctccaatatatgactgattgttcccgctggaaaccagtgtttgtgtctgtgtgtaaacagggccaggatgacctagaatattgactcctgagttttaaaactgtacagcagatttttgttgtcctagctgcctttagcacactcccccgaatgaaccatttcgacctagtatcttgtttcctacttctctaactgaagtgtcccaacagtccccttgctgtctcctcccttcaggtccttactgcccctctgtttctaaagggtttaagtacatacacacttaaaacttttcgggtgtcatctttgtttggttttgtaatactcaacctttggcctaaactcctatataccggtgtctcctatttcttttctccgaggttcctgtttcgagtgtctgtagtcctcttgttcctccaagttcatgttttacttttcccacttacagcgtcctgtttccatttgaagtgggcaaagtgagagcttcccactgtgatcctggtgccattttcctggttctggatcaagtgggaccagactacttactaggttttcttttcactaaaatgcgtgagaaactagctcaaaaacattgagataagcaaagttatcctcctaggtggtgcttttgaggatgtgatggtgttgactacatcagctcttactgtaaagttgagcaacaggatcgatatttaatagagatccttttacctaaagtagtggcagcaatgtcaaaggtgccactcagcattgcctactgggtgtgtttattacaggcacttcattttcttcttgtaaagtaattcatattcattgcagaaattgtggaatgtatgagaagttaaaagcaggggataaaaaacatggttaacattttttcttgtgaatttttgagctgttctcctataattgagagcaagttatgtatacagtttgtatcaaggcataactaaatataaattttgaattttatgtgttttcattaacattcgtaaacataatcagcattcaatttattccagaaacatttattgaatacccaatataatggttaagagtacaagttctggaattagttccctcatctgtataaatacaagtaatagtacagtactttattgggttgttgtgaacattaaaatgcttaaaactgtgcctagcacataaatatcagctgttattatttatatcattagtgtggcccagataccctgtgctaatcgctgaatatacagaagtgcctaagaaactactcattgattgcattcccttattgctttgcatttaaactgtttctagtttcttgctatcataaatagctttgaagcaatcatctttgtgcccaacttaaaaaatctacttttctaattatttcttcagtacagattcccaccaaaacctatatgcctgagtttaaaaggctgaacattttaaaggtttttgatagttattgtccagaaaaactgtgctgatttacattataccaggagaaatgtagttttcactgtactctataatttttttttttttttgagacggagtctcgctctgttgcccaggctggagtgcaatggcgcgatctcggctcactgcaacctctgcctcccaagttcaagcgattctcctgcctcagcttcccgagtagctgggattacggtcacccaccaccacgcccggctaatttttttatttttagtagagactgggtttcaccatgttggccaggctggtctccaactgctacccttaatgatccgccctcctcagcctcccaaagtactgggattacaggcgtgagccactgtgccccacctataatttttttaatgttacaaatttggtagtttaaaaatgtttccatttgcaattactcaaatactaatggaatataatttttgtctgttagctatttttcctctttgtatgttagttcgtctccatttttgttttgaaattgtggcaatataatcattataccattatatctcttaaccatttatacaagctctttatagaataaaaatatgaatctttgatcacatttgttgaaaatatttttcttttgtatacacagttatctaaaagggtttttttaaatgaagtcaagcccattaatcttttgtgcgtatgtgatttctcccattgttcacatttagaaagtcttttccattaagatctgataaatctggactccaggtttctgtagttaattggtttttcttttcttcctctgtcatcctctaccccatcct

SEQ ID NO: 12365 - DNA, 20892 bp, Homo sapiens
tggtggatctcttgagcccaggaagtcaaggctgcagtgagctatgatcacaccactgcactccagcctggatgacagagcgagaccgtgtctcaataaagaaattaaattaataaataaatgttagcatcttgagctcttggagagcaagtggaggcggctgataagagaaaggaaggtgaggccgggcacggtggctcacgcctgtaatcccagcactttgggaggccgaggtgggtggatcacaaggtcaggagtttgagaccagcctggccaacatggtgaaaccccatctctactaaaaatacaaaaattagccaggcgtggtggcggcgcctataatcccagctactcgggaggtgaggcaggagatttacttgaacctgggaggcggaggttgtggtgagctgaggtcacaccacttcactccagcctgggtaacagagggagactccgtctaaaaaaaaagaaaaaaaaaaaaaagagagagagagaaagagaggtggccaggtgtggtggctcatgtctgtaatcccagcactttgggaggccgaggcgggcggatcacctgaggtcaggggttcaagaccagtttggccaacatggcaaaaccctgtctctactaaaaatacaaaaatcagccgggtgcagtggcacacgcctccagctactctggaggccaagcaggagaatcgcttgaacccaggaggcgaggctgtggtgagctgagatcacaccactgcactccagcctgggtgacagagcaagactctgtcttaaaaaaaaaaaaaaaaaaaaaaaaaagggagtgactgctgatggtggtcttctcagcaaaagcaggtaaaaaaaaccaaagaagttaggggcagaagtgatcagtccatctttggtcaaagtgggtttgaggtgcctgtgggacattcaagaagagaagcagaggctgggcgtgctggcttgtgcctgtaatcccagcactttgggaggaccaagtgggcagatcaattgaggtcaggaattcgagaccagactgggcaacatggtgaaacctcatctctactgaaaatacaaaaattacctgggtgtggtcgtgggcgcctgtaatcccagctactcaaaggctgaggcaggagaattgcttgaactcgggaggtggaagttgcagtaactgagaacacgccactgcactccagcctgggtgacagagcgagactctatctcaaaaaaaaaaaaaaaaaaaagagagagaagaggaaaagacagctgggtacatggtctggagctccacagagaggtctggagtagagtctgatgttttgaatcaatgtcaggtattattaactccagtttacaaagttcagagaggttaaactatttgaccacagttatacagccatgaggcaaggatttgaactcagatatatagatgtcaagttctgtggtgcctttgacccccaagttcagtgctaattcccttgtcccaggatgcatcagcttctgcaagsgggggctgggggtttgagaaggaggaagcaggtgtctgagtgtatttgtgccccatgtgccttctgcctgaaattgcatttgcagcccggacacggtggctcatacctgtaatcccagcactttgggaggtcgaggtgggtggatcacttgcggtcaggagttygcaaccagcctggccaacatggtgaaaccccatctctactaaaaatacaaaaattagccaggcgtggtggtgggtgcctgtaataccagctacttgggaggctgaggcaggagaatcgcttgaacccaggagggggaggttgcagtgagctgagatggagccactacactacagcctgggcgatggagggagactctgtctaaaaaaaaaaaaaaaaaagagagaaaagaaattgcatttgcctggaacttgcaggaaaggcatttctagctggcttggagatagcgagagatgggggcagattcttgtttcttggtaatcagaagctctcaattaactctggctacaccatcagcaagttagtggttgtccatgtgtgaggatttcgacaaccatgaagtcagctgagaccaggcaggaactgagggactggggacttctgctacctgggaccctttgtttccttccctgactagctgctcctgtttttgcagtgggttctgtcccagaatgaggtgatgtgggagaggcccaggtcctacatgtggcttaaggtttccactgttctacactaaagagaactaggctgaggccaccatggtccagggacaaggggctgtcccagttcagtatcttagagaaaaattttgtcttagctccaataatctttttgtgtccggagttggttcctgctggtggggttcgtggtctcgctgacttcaagaatggagccgcggaccttcgcggtgagtgttacagctcttaaagatggcacggacacaaagattaagcaacagcaagatttattgtaaagagcaaaagaatgcaatagaactaaagcttccacagcgtggaacgggacccgagcacattgctgctactggctgggaggtggccagcttttattcccttattggccccgcccatgttctgtttctgtcctatcggagtgcgcttttttctttttctttttttttcctttcttttcttttctttctttttttttttttttttttttttgagatggagtcccactgtgttgcccaggctggagtgcaatggcgcgatctcggctcactgcaacctccgcctcccgggttcaagcaattctcctgcctcagcctcctgagtagctgggattacaggtgggcactaccacgcccagctaatttttgcatttttagtagagatggggtttcaccatgttggtcaggctggtctcgaactcctgacctcgtgatctgcccccctcggcckcccaaagtgctgggattacaggcccgagccactgcaccctgccagagtgccctttttttcaatcctccctgtgattggctacttttaggatcctgctgattggtgcgttttacagagtgctgattggtgcattttccagagcactgattggtgcattttacaatcctcttgctagctacagagcactgattggtgcgtttttacagagcactgattggtgcattttacaatcctcttgctagctacagagcgctgattggtgcgttttacaatcctcttgtaagacagaaaagttctccaagtccccgctcgacccaggaagtccagctaggttcacctctcattttcttcagagaagggtgccttgctttctttctaaatcaggccttcctactgtctctcagaggggtgtgtgtgtgtgtatctgtctctctctctagaccacaagctccataaagacccagactgggaatgggagcagtggctcatacctgtaatcccagcactttgggaggctgaggcgggagattgtttgagtccaggagttggagaccaatggcgaagcccatctctacaaaaaaaaaaaaaaaaaaaaatagctgggagtggtggctttcacctctactcccagctactcaggaagctgaggtgggaggatcacttgagcctgggaggttgaggctgcagtgagccgcgatcctgccactggactccagcctgggtgacagagcaaggttctgtctcaaaaaaacaaaacaaaacaaaacaaaacaaaaacataaacacctggactaggtctgttttgtctacttcatgtatttcctggctcatatttgtcaaatgaatgaatgaacgaatgaatgcttcttaagatccaggtcctgggcctcaaagtggaggcagatcttctcgtctgtttttctattttcttttcttttttttttcttcttttctcttttaattattattttttttaatcaggcagcttccagagccagagtatgctcagagagatgccctctccttgtctgtttactgaatgtgtttccagcttgcagagtgttactttcaattctgcaaagaggaggtggggagggcagcatgcactaagatgttcctccccgcatcccactaaccccaggaaacagatggtaaaatgcttaagacactgctgcttccctcagcacccttggtgccccaccccccagccccagacttggctccttctctcctaaggctgaaatgcaatcagcccagatgggctctggcagtcaactctatccttctaactctgggcaccaagcagggtgggatgaaagtctgtatttagtcagctattttcctrcttcttcccgcaaacttcccagccttcctcaatcctcttaaacttgtgttcacattccttttttaatactccaagtgccatttctcaggctgtagcttaactcattctacatcagtctgacagcaacacattcctcctgtgtgcagggttctggaccaggcagggagtgattgggctggcgggggaggtcatatgctggttaacaatatatgaatcccaccctggtactcacagttgatgggaggaaacagacttgcccgtctataagcccagtgtagggagaagccccatgtggctggagaaccaagtcagggctggggaagcaggtggcttttatggcagggcagctaatgggtctcaggcattctcctttctgagaaggtgaaaggcactcaaggaggaaatgcagaagcaaaggcaccatcagaaagagccaggcatgtataggcaggaaccagtagatacagagcctgggagataaacctgtgaaggcagstgggggctgttcgtggaagctcttgaatgtcaagtggagactgatctgaatccagtgagcaatagggagccattgaagatctatgagctgggggagttacagaccctgagctgtgctttaggaaggttaataggggccatggagaggatgccttgggaaaggagaggaagatgcagggagaccagttagaaagttgttaccttaatggagggttgttaccttagtggaggctgcaggaaggcagtacagtcgggtggaaggagctggctccctggtgtgttggctggatctcctgctaaccattcctgcagcctgagggcacgttgccttttggacttctccttttgttatctgattttttgtttttctccgcckagcttaagcaaagaaagaaattcacaagcaacagcaggaaactccaccttccattccctcctcaggcctggcctcctggttctctgttggcccatgtactcctctgccaggtatctggggcctctctgcagggtctccagccggaggatctctcttcatgctccatccttgtcttcaggcgcccacttttggggatcaggaagctgtgcctgggcagtaggtttgtccgtgaattgtaggagtactgatttatcctagaagttgccaagcatcaaggggagaccctgcccttccccaggggaatgcaatttgagtgggcccacaagacccacgctagtgaaccaactgcacatctgtggagggttggaatattctcccagctcagagaggatcggtgagccctgtctgtactacacagctggtaggtacagaaagtgggtcgcctggggttttgcttcagtctagtgccctagacatggcactcagaggagggagagctgggatccggttccgcgcgcagtgctgagtctcccctgatttgcggtagtggagcagtccacccggagaactcaggagttttcgcagggcgagggggagggctggagcctggaacccccatattccttgcacctcttgggcccgggacaggcagcccttagtcactggggtgtccatagtgcccacgaagggccagcgtcccagagggttcccaggtcaggttggtgacgtgtggggcttccctaacttcgtaggcaaaatctgccagaccctcccgggggagcggagctccgartaccagggccgactccgctcctgaggccgctgagccctcctgcacctgtccggcccgggaagtgccatgggacagctgatcgccaagttaatgagcatcttcgggaaccagggtaaggrgcgcacagggcatccaagckagcgctttgatctcgccctcttctgggactcctctgatctgtggtcggacgcacggggggacctcgggctccgagggtcgtatatgggcgctcctcgactgccccgcggcctcccctgcccccgtccctgcctgctcctcttgggtcccggcgcttcggtgcgccccaggacgcaaagctgggcgaccctcctttctccccgctaaacggagccagcggcggggatggggggctgctgcgagtttcctgcgattgtgacttcgcgttakgctctttctctaaacaccgtctcttggcaagccccgaagcgccccgggcctttcagacacttttctrgaatgtgaagggaggtgggggctcagctgtcttttccaccgtcccggagtggggcaggtgtcggagytgggtgggaagcagacgcggtacggtgggcagaggtccccagcctgcggggagcgctatctccttcctgggaggtctggtgggggcacacagtcccttggtcttcgggtttggccctgacgctgcccttcctccgacgcttccagagcacacggtcatcatcgtgggactggacaatgaaggaaagaccaycattctctaccggttgtaagtgactctcgggcggggagggtagagagctgggcctcccaccagactgacaggcagggggaccaatcactggagctcttccctgggttcccgggctcctctgtagtccggaggagcgattgggcacgctgcttggaccttcctagtactgcggctcctcggtctggcattcaaatcctgcacsgtacaggcaaccctagctcccactgctttcctccatcttcccgggggccctgccaaacccagctccaggcctgccaagtgtcccaaactgcctccctgctcttcgctccctctagcggcaggtccctcctttctcacccctgtcccctctgccagttaactttcttccccttcttcaaacccaaaggctcactgaggctctgtagctcctggtctagcaagcctggcacatatgggtggtgctgagtaaataccgatcgcagctttccccgatattcgctctctggatggcacctctcccattttacagcctccaaagtactttacttaggagaagcttttccatgaaaaagtaatacatgtaatgattttaaaaaattataaaggaaaatttcaaacaatggaggaatacacggtgaaaagtaagtttccttcttgcctctggctcctagttttcctcctattgtaactttgcgtaacttttcagaagcattatttacatataaaagcatgtgtatattttctatgtcactttaaacaaagcacctctctgatgtccctcactgtgtctgtctcatttttctaaactcttgctcctcaaagtgtggtctacagaccagtcacacaggcatcacctgaaagcttattaggaatgcaaaaccatggccgggcgctgttgctctcaaagtgcctgtaatcgcagcactttgggaggccgaggcgggcggatcacctgagatcaggagttcaagagcagcctggccaacatggtgaaacctcgtctctactaaaaatacaacaacaacaacaacaacaacaacaaagggctgagcaaggtggctcacgcctgtaatcccagcactttgagaggctgaagtgggtggatctacctgaggacaggagttcgagaccagcctggccaacatggcgaaacccyatctctactaaaaaaatataaaaattarctgggcgtggtggcacatgcctgtaatcccasctactctggaggctgaggaaggagaatcacttgaacccgggaggcagaggttgcagtgagctgagactgcgccactgtactccagcctgggcgacaaagggaggcggaggttgcagtgagctgagattgtgccactgcactccaacctgggcgacagagagagactacatctcaaggaaaaaaaaaaaaaaagcaaaactgtggccggatgcggtggctcatgcctgtaatcccagcactttgggagtccaaggtggatggatcacttgaggtcaggagttcgagactcgcccagccaacatggcgaaaccccgtttctacaaaaatacaaaaataagcctggcgtgggggtgtgctcctgtaatcccagctactcaggaggccgaggcgggagaattgcttgaacctgggagacatgatcgtacctacactccagactgggcgacagagtgagactctgtgaaagaaagaaagagagagagagaaggaaagaaagagagaaagaaagaaagaaagaaagaaagaaagaaagaaagaaagaaagaaaaagaaagaaagaaagaaagaaagaaagaaagaaagaaaggcaaaagcctggacccctgcccagactcactgggtcagaatctgcattttgacaaaactctcaggtcattcaactgcatattaaagtttgaggaggctgggctctgtggctcatgcctgtaatcccagcactttgggaggccaaggcaggaggatctcttgacaggagcccaaggtcaggagttcaaggtaagcctgggcaacacagtgagaccctgtttctataaaaagaaaaaaagagataaagtttgaggagcctcctctaagatgtttcccttctctggggtccaagccagggcagggcttrgtctcactcctgtcttcattccccagggcccagcacrgggcctggctccgarcaggtgtttggtgaacctgggtggacttgttctgagttagattcagactgctttgggagtagagcatttgggggccagagttgggagtaggctggactgagctcttggtgcccactcctacctccccagcttgaccartgaggtggtccatatgtgtcccaccattggcagcaacrtggaggagatcattctgcygaagacccacttcttcmtgtgggacatagtgagacctgaggctctgagctttatctggaacacatactactccaacactgaggtgrggagggcaccagggctgaagggtctccaaggcaggcgtgtgatatcagactgtcatgtaacctttctgagccttggttccccaacttgtgaaatagagattataatggtcggttcctgtggctcacacctgtaatcccagcactttgggagtccaaggcgggtggatcacctgaggtcaagagttcgaaaccagcctggccaacatggcaaaaccccacctctactgaaaatacaaaaattagctgggcatggtgtcaggcacctgtaatcccagctactcgggaggctgagacaggagaactgcttgaacctgggaggcagaggttgcagtgagccgagatcacgccattgcaactccagcctgggcaacagagcaagactctgtctcaaaaaaaaagttttatatatacatatatataatgatctccctaagttgttgtgaaaattaaataacaaaccaatatgtaatgcatatatgtcagatactcaacacagtgcagtgcctgcctgttaacgtgtttgaatacttcctggcagctgctggcagctttctgtttgatgcactggatgggtaggccccttctctctaggggccttactttcttactccagcaggagtagaattcagtggtataattyctggaccgagacagagctgggttccatttccagcactgctactcaccagctgtgtggtcaagagcaagatacatagcctcactgagcctcagtctcttcatttgtaaaatggggatactaacagtaccaagtccacagsgttgtggtaaggcctaaatggagtcatgaacacccaatgcttatgtagcacagcctctgccacacagtcagaggtgtgctattcccatgtctggatagaaaagacaattacaggccaggtgtggcagcacacctggtggtaatcccagcactttgggaggctgaggcaggcagatgacctgagatcaggagtttgagaccatcctggccaacatggcgaaaccccgtctctactaaaaatacaaaaattagccgggtgtggtggcacgcgcctgtaatcccagctacttgggaggctgaggtgggagaatcgcttgaactaaggaggcagaagttggagtgaaccaagattgcgccactgcactccagcctggatgacagagcgagactccgcctcaaaaaaaaaaaaaaagacaattataatggaagcagggtggtgaaatcttgaggctgcatgctttcatttctctggggctgacatctgggcagtgcagagaccagtggggaaasaaagagggcaggaaacacatttaccaaagagaaagsctgtctctcacggctcccctctgctgcccagtttatcatccttgtgattgacagcacggaccgggatcgkctgctgaccacycgggaggagctatataaaatgctggcccatgaggtaagccccctgcagttgggagagggcccagtggtactagctgtgtgccctcaggctggtcacttagcttctctgagattcgttyctgctgtcccagtttctsagagcctctataccagcagcatgaggagggctggtttgtgcctgatgaagggcatcagtaccctcagtgcaattgactatagaagccagrgttgctggttcaagttctaactccatctttcattcactgtaggactttggacaagtgacttcacctctctaatcctcagtttccccaagtataaaatgaggaggatcatcaattccyacctatgggaytgtcataaagaggctttccttgagctgctgatgttatttgatayggttgctaccattgtggcagggcccccatctctgccccatccaggcatgggcctctcttcctgggacagctggagagggagccagagagcgcctgtgaggcagtaggaaggaaggctgggcactagcaggctgactggggctgggctcctctgtccacaggctctacrggatgcttcagtcctgatatttgccaataagcaggacgtgaaggactccatgaggatggtggagatctcccatttccttactctcagcaccatcaaagaccactcgtggcatatacaaggctgctgtgccctcaccagggaagggttagtggctgccctacctggatctytagggcctggctgaaccaatggatgactgaccatcagaacccttctcctgcctctctcctgtgagaatctggttcacagttggctcctgggccaagccaatttggcatctccccacaggtgagatgtggtgggtaagccacaagcagacagcatccctgctctcaggggcttgttctagtggagaaagaggtagcactccgcctaaatgcaataatctctctctctttttttttttttttgagacagagttttgctctttgttgcccaggctggagtgcaatggcatgacctcagctcactgtaacctccgcctcccaggttcaagcaattctcctgcctcagcctccggagtagctgggattacaggtacccgccaccacgcctggctaatttttatatttttagtaaagatggggttggccaggctggtcttgaactcctgaccacaggtggtccaccggcctcggccttccaaagtgttgggattacaggcatgagccactgcacctggccgcaataatcttaggtgctgagaagtgatgtgaagaatcccactggttaccagaaatggaagggagaaggataggtctgatttagttctggtggtcagggctggcctctcttaagagatgacttttgagctgagacctgagtgaagagtaggagacagccatggggagacctggggaacaagccttccaggcagaaatcattgactcactctgacttcagtttcttawctgtaaggaagaggatcattatacctcctagagtttctgtagagtaaatgacaccattcagtacacawatctttcttgagcacctcctttgtgccaggtactgttctaggcactggagaaacagcagcgagcaaaacagacaaaaatccctgccctcacggagcttactttccggtaggggaggcagatgataaacaagaaaaatatatagtcagttagaaaatgatggcggggcgcggtggctcatgcctgtaatcccagcactttgggaggccaaggcgggcagatcacccaaggtcgggagttcgagaccagcctgaccaacatggaggaaccccgtctctactaaaaatacaaaaattagccgggtgtggtggcagatgcctgtaatcccaggtacttgggagggtgaggcaggagaagcgcttgaacccaggaggcggaggttgcggtgagtcaagatcataccattgcactccagcctgggcaacaagagcgaagcaccatctcaaaaaaaaaaaaaagaaagaaagaaaatggtaaacggcttgaggccaggagtttgagaaaagccttggcaacagagcgagactctgtctttacaaaaaaaaaaaaaaaaaaaaaccgctggatgtggtggcacacacctgtattcctaactgctcatgaggttgaggcaggaaaatcacttgagcccaggagttccaggctgcactgagctctgaccatgttgctgcactccagtctgggtgacatagcaagatcctgtctcaaaaaaaaaaaaaaaaaaaaaaaaaaaagtgataaatgataaggtgaataaagagtaagaaacagagattgggccagcatggtggttcatgcctgtagttctagctactggagagtctgaggcaggaggatggcttggggccaggagttggagtccagcctgggcaacatatccagacccccatttccaaaagcaaaaacaaagaaaagaaaagggagagtggaagtgtgtggagggaatgttgcaattttaggtaagttatctgacaagggacactaagcaggtagatattgagtaatcacctggaggattttaaggagctgggccacgtagaaagggccttacatcaggcctggaaaacttccctttcgtcttacctgtcaagtggaatcatggcaggctgggcacacaggtatctttttttttttttttgaggcagggtctccctctgtcaccccccaggctggagtacagttgtgcaaacatggcttactgcagcttcaacctcttgggctcaagcgatcctcccacctcagcctccctagtagctgggactacaggcgcacaccaccatgccctggtaatttttgtatttttgtagagacaaggttttgccacgttgcccatggctggtgtcaaacacctgagctcaaatgatcttcctgccttggcctccccaagtgttgggattacatgagtgagctaccacgcctggcgcagatgtgttttttgaagaaggggagactktaggcaagtcagtccaagggaccacacgtttctagcagtgtccttgccacccgctgggtcaggagaaccctcttccacaacccacagtcagttcaatcagcattttccctcccttctttccctccctccctccctcacttcctccctctcttccttccttccttccttccttcctccctccctccctccttccctttcttcgacggccacttgctctgttgcccaggctggagcgcagtggcgcgatctcggctcactgcaagctctgcctcccaggttcacgccattctcctgcctcagcctcccgagtagccgggattacaggcgtgagccaccacgcccggttaatttttttttttgtatttttagtagagacggtgtttcatggtgttagccaggatggtctcgatytcctgacctcatgatccgcccgcctcggcctcccaaagtgctgggattacaggcgtgagccactgygcccggccacttttttctttttttttttttgagtggagtttcactcttgttgcccaggctggagtgcaatagcatgatctcagctcactgcaacctccgtctcccgggttyaagggattctcctkcctcagcctcccaagtagctgagattacaggcatgcgccaacatgcccagttgatttttgtatttctagtagagacgggctttctccatgttggtcaggctggtctcgaattcccgacctcaggtgatccacccgcctccgcctccctaagtgctgggattamaggcgtgagccactgcgcctggcccaatcagcattttctaagtaccccccatgttccctgtgcggtgccagaccaaggctgaggatgatacagagatgaccaagactccacccatgcgccggagttgcttacaatctaatgggggaacttgcgtagggaacctctttctggcacagatcaccgtgaagaatccttgcccagagacacagctaaggggcccagcaaggtgagtctccaggctccttcctcagagaagcmctccctgactctcaggcatccagaggcctctgtatatttcctttatcacagtatgtaattacagaattatgtgtctgaccatttatttagtatccatctcttctactagacagtaagcctcaggggcatgtctgcattttcaccagtaactccagagccttgcacagtacctgatgcacagcagatactcaagccagttcatctctgttaattgaattattggatgtaactttggttcctgcacccagtccgatctgggcaagggctggagacttgaaggccatcattctcttgggttaggctgacccctcctgttccttcctccctgcaggctgcctgccagacttcagtggatggaatctcaggccgctgctaactgatgttccagtctgaggtcaaccagaaactttggggttttgcatggtcaacatgggtggaaaatcaagtggctatttattacttttctatggttctctagtgggagcagtggctgctatggacagtgagattgacaccattctcccaacccgttgctgasaagctggactgcataccttggattcctgcagacagcacagcagaagaagctgctcctcactccatggccgcaggcatccttcttggagacgtyygggaaatgttggatatgttgcagatttagtgagtggaactctctccctctcctcagccctcagtctctccgtaggaataatgtgtgtgtgtgttgggggggcagattaagagacccctgaggctgggcgcggtggtttacgcctataatccagcactttgggaggctgaggcaggaggatcacttgaggtcaggagttggagaccagcatggctaacacggtgaaaccctgtctctactaaaaatataaaaattagcttggtggtggtgcacgcctgtagtcccagctactcgggtggctgaggcagaagaattgcttgaacccgggaggtggaggttgcagtgagccgagattgtgccattgcactccagcttgggtgacagagcgagacaccgtctcaaacaaaacaaagcaaaatacaaaaattagccggacgtggtggcgggcgtctgtaatcctagctactcgggaggctgagacaggagaatcctttgaacctgggaggcggaggttgcagtgagttgagatcgggtcactgtactccagcctgggcgacagagagagactccgactcaaaacaaaaacaaaaacaaaaaaaaaaacccctggaattgctcttcatttcctcaaacctccttccaccctcaggctttttagcccctcagccatttttgtcccattccctttgggcaaaggagattctagcaaggtgaagaaggtgggctcaaggggaggagggcagaggcaaaaactggaaggggaaatggaggaggacaggacgtcccagatagggacagccctttgcactgcagggattccacttctcctcgtcttcccattccctctgagatgctgactctgaccacagctcttggactttaagccaccccacagcatcccctttacttctagtgtccttccaatttgaatcccactcctcccaaatataccagattcctaaaggggctgcttgtttgtctttgtgtaatgatttttgttgttgttgttattgttggagtctcgctctaccgcccaggctggagagcagtagtggcgcgatctcggctcactgcaacctccgcttcccgggttcaagcgattgtcctgccccagcctctcgagtagctgggactataagcgcgcaccaccacgccctgctaatttttttgtatttttagtagagatggggtttcaccatgttggccaggatggtctcgatctcctgacctcgtgatccgcccgcctcggcctcccaaagtgctgggattacaggcgcgagccaccgcgcccggccaggattttaaaaaaaatactgtattaggatttttataaggctgtagtaaatgctattgaaaaatgcttacctcttatttcagccttctcctctgtctgttcctcaaactggcttttggtttgagagaaggggaggagcgaccctggggttggaaaagcccaggagacaagatggagatccagtctgttcatctgtacatccctggacctggggcggtcctggggacagtccttttctcaagccagtcagtggacatttgggggagagtctaggcacggatatagaggacccaatattcctttttttttgagacagagtctcgctctgttgcccaggctggagtgcagtggcgcgatctcggctcactgcaagctccgcctccagggttcacgccattctcctgcctcagcctcccgagtagctgggactacaggcgcccgccaccacacccggctaatttttgtatttttagtagagacggggtttcactgtgttagccaggaggtctcgatgtcctgaccttgtgatccacccgcctcggcctcccaaagtgctgggattacaggcgtgagccaccgctctcggcccaagattccttaatctagttggttttccgaaagcgtggctatgaaggaagaactcaggagttctagccattcccattgtattttgtgtttttttcagtaggtatcccgacgcaaccctcagattaaaactttaagggaaaatgaagaccacacccctattccatagaaattaactctaatgacaacgtagtggcgtggcgggggtatagctcagtggtagagcatttgactgcagatcaagaggtccccggttcaaatccgggtgccccctctgtgctccggagttacctcgttttgttggtctccggaggtcctctaaagagttcccgcacagatggaatgggagggagtctcgagccctgccaccctttttgctttcgcaggcgagtgaggatggagtcctggcccctgccagtggctcagcctgtgtgtgtacccagggtagaatgcaatgcgagtgagggcgaggagctccgggctgacccttggaacacggtacgggtggctcaacctcgcaatggcagggcggaggcgagcgcacccccaggtcagcctggctctttcttggcgggaaggaggctgagtttctaagggctgggctggggaagacaggtcgggagaagccgcgtgagcatgtgggagggagaaagaagctccgagacgtggcaaggggtcttctgcagggcaggagagtgggacgcccccgaagtgaaatatttcgagagacttctccttccacaccccaggaatatattttcttatactgccagtggggatcttcagctcagagcttcagggaacaacccctgcttccaagtgagtaattcttctgggagttgtattttttccatctcttgtaaacgtcttaccccacttccacttcccttcgggaacgccacacagcgcctgcgcagcaataccactaagcgactacgtgcggtcggtttgccggcagagggggtatagctcagtggtagagcatttgactgcagatcaagaggtccccggttcaaatccgggtgccccctctttggccttttcgagatactgtttttgtcctgggtgtcgatttttcctaagctgtttgcttttactcctactggcagacgaggagcagtgagggactgaaaggaactggggattcaacagcagtggctctcaaaatgtggtcctgggaccagcagcattacctgggtacgctcgggcctcatcccagacctaatgaattagaaacttgagggtggagtccagaaatctgtgttttcatatacgctccccatcgcttgagtccaggagttggaagctgcagtgagctatgatcgcagcactgcactccagcctaggcaacgtgcgagaacctgtttcaaaaaacaaacaaaatacacacacacacacacacacacacacacacacacacacacacacacaccctgcaggtgattacgatctcaagttctagaggcttacgttaaaatttacacatttgcttctactatttacaagtttatgtttcagcctgagctcttcttgtaagacagaccacgaggtaccccagatggaggaatgtgcaaagacgccggggctggagctggaatccgtcccgagacttctcaccttgacctcgaggaaggcaggaggtcggagacagggggtgggcaggccggggaaagaggaaacccgcaggacaagagggttgtggctcgtcacgtggccacttgagggcagcaagtagctgcagctggaggtagctgcctatctgattctgtttgagagtccgccaagttgggatttaaattagacatcaagaagaatttacagaccggccttgccttgttccacggtaaggggacattgggtttagggctggaggaggtagtctctgggactctgggcccggcggaaggaggaaccggcgttctaagagattagagagcctttagttgtttcctttcttaggtgtttttttttcttttcttttcttttttttttttttaacctcagtgccacggaatccgtctcttccagcccacagtgtaccttctcctgtccccgcccatatccctcctcctggaaaatttctccaatggcgctcagcgttcgcacccttcctctccgcggttttctagtccctaggccccagcccactagaagccaggatgccccctcaccccgtctcccactctccagcgccccagctccttgccgtcacaagaacgaagtaggtyaggggagggaagaggcatcttcgtgtcctgacctgattccttgccgtctattaaatatcctacattgcgggtatttttattctgtcctggaagaaaaaataaaaagattatctatccccagagcctgtcagaaggtggtgacaggtgrggtgagccatttcctcgtctggggctggctctgaagattgattgggtctggccctgagtaggcctggaggccccagagaggcaggaggcctgggttacctactcgtggggaggggtccagactgttgcagagtaaggggtagccaggccccctccaccctcacgtctgctaggcttggggggcaaatcggtgctggaaatggggggtggagggataaggtggagtcatggaaggggggtgggattcaggcccctcttggggagaaaagctgggggtctttgctgcagggggagatttctgggggtgggggctggaggacaaagcatcagagacgcacagaattccgaagaacagctcaggaagtcgcagagcttggaggagctgggggcgggggacagtcaggggcccgtgacccagggatggggcgcctgtcccttccaggggtccagtcctcgggccttctctctgcagctttcccggcggaacggaggagggaaagggagccaggagctcagtgaggagcgcggggcggctgatgcttctaggggttctctcagcccgaggggctcccgccctgtcccctactctgcaccccttgccttgggagcggctgcagagctctaggggagcgctccgktagggctgagggcaggcgccgggagagcccccaacgacgccgcgccccccgccccgccccctgccccagctcccccccacccccaccgacccagcggcccccccagctccccgcctgctcccggaggccgcagcctccagctccgctcgcgctctcgccgctcctgccggctcgcccggccccgcgctccgccgtctcctcgccgcccgcccctccgccagccccggggaccgcgcggccgcagcctgagccagggccccctccctcgtcaggaccggggcagcaagcaggccgggggcaggtccgggcacccaccatgcgaggcgagctctggctcctggtgctggtgctcagggaggctgcccgggcgctgagcccccagcccggagcaggtaggactggcgggagccggcccgggtgggccgggggcggggagggacgggcagtcaggtgtgggcatgggcaggtgtggacggcctggcgatgtccgcgaggggggcattgtccgcaggaggccaggagagctgtgggctgtgggcaggtggatagggaccccactttcccaaacacatagggtgtgtgagtgacggtggagacaccgatgcccggacctcttcttctctcctggaaggatactggagggaccttaggagaggcggctctatgtggccatgggctctgaaaggggacagcgggagagtcatcaggacccctgatcaccccaggcaaggctgaattctgatgagatgggagcctggggaggcccctgccccagccatgccttcttttcctcttctctgccacacccccgaccccaaagctgatccaggctagggataggtgggagcagcca

SEQ ID NO: 12366 - DNA, 85934 bp, Homo sapiens
  misc_feature (1)...(85934): n = A,T,C or G, or insertion/deletion polymorphism (see Tables 1-2)
caagagccttccattctcctgctgcaaactgtgtcactttgacaacaattaaattttaaaataaaataccacgcaaactgtgtcagagactactagttgtccaccaaaattattctttctttcctgaacaacaaaacctgggtgttagctagactcattgctgcctacataaaggttacatttgtatgtacattgggattaagttttaataaacatgagacaagcagaaatgtacagtattttcaataattatccttaaaggaagaaggttcgcccttcttcttctcttcttccatcctgatgcctgaatttggatatgacagctggagttctggcagccttattgtacaatgaagatgagatccacaacacaaaagggaggaagctatgggctgaaaggagcctgggttcctgatgactttacagagctgcctcaccagctttgaagagcttacctctagccttttttttttcgagacggagtctcgccctcctgcctgtcgcccaggctggagtgcagtagcatgatctcggctcactgcagcctctgcctcctgggttcaaggaattctcctgcctcagcctcccgagtagctgagaatacaggggtacacaccagcaggcccggctaatttttgcatttttagtacagacaaagttttgccatgtgggccaggctggtctcaaattcctaacctccagtgattttcccacctgggccttccaaagtgctgggattacaggcgtgagccaccgggcccagcatcctctacacttttatgtgagagaaaatatgtgagagtggctcttatttaagccacttttgtcgtgtgtgtgtgtgttcctgccatctgcagctgaggtgatgctaacaaatacagcaaatcagcttgaagtccccctttcctggtcctttctcttcagctatactgccaacccaaagcgctcatttatggaaactctggagctcacaattttaacaagctgccgagaccacctcggtaggagagaacttaacccagcggtactagaggaattaaagacacacacacagaaatatagacgtgtggagtgggaaatcagaggtctcacagccttccgagctgagagccccgaacagagatttacccacatatttattaacagcaaatcagtcattagcattgtttctatagatattaaattaactaaagtatcccttaagggaaacgaagggatgggccgaattaattgaataggttgggctagttaactgcagcaggaagacgcccttaagacacagatcgctcaggcttttgtttatggcttaagaatgcccttaagcggttttccgccctgggcgggccaggtgttccctgccctcattcccgtaaacctgcaaccttccagcttgggcgttatggccattatggacatgttacattgctgcaaagattttatttatggccagttttggggccagtttatggccagatgttgggaggcttgcttccaacaacaagcagctaaatttatttgcaagagtaaatgatttcgtttttaaattggggccaaacaacattttaaaagatctactctaagaaaaaaggaaagatcaccaccaaaaaaagcctctcgcgtgtcctcctgtcatgcattcaaagcattccatacattgtttttgactaatttattatatcaattattaggaatttttaaaggacttttcctatgcaaactctaagagctcaagttttgttttgaatagaaatacaactatatttaccactatttatgtacatctcaatacattttctaataaatatttattgtatactgactaatcctcatttcattcttaggttctgccttttttttgttttctaatttgggctgaaacaattacgctctgattttgctcactgaattcactcttatatcccctcttcacaaagtaagaaactttctggaaactttggcctctgccatgcactgggaacctcctcttcatctaatttgtctgactaccatcttgaacccagcaaggacaactagatgtgaccccttcttttttaaaaaaactattattaaaagtctatcatgtgctaagtgctagaatagatgcttcaaatgctttctttttttcttctaatcttcatgccaaatttgcaagtgaggtcttgttctctccattttatgggtgatcaatcgtgattcagagtgattaaaacgaatccaaggtttgtttgcctctaaagtctgttttctatctcactttaagaaaatctctctctgattttccatacctctgtatcattacattcaagtcttccacttctccaacttcaactctatttcttttccctgcttcccttttgcttctcactggctgtatctggatatttcaaaagtacagaataagttgttcaatttagaagggattctgaaaacacaaatccaaattttacaaagtaaaattatgacatgataataatggtgcactctgaaataaagtgcacagaaaatgccaaagaatataaaaaccaaatataaggcagccccatccatttcagatccacaaggtcacaggattaggacctaattataaataataacccaaataactcttttcctttcagaaagcatacatacatacacacaaccctggagaaagtcttttccaactacagtcctcctcccactccccaaatgcattaacttcaatgttttagaaagcactagagtcactgccaaatagttgaggttatccatcagatgttccccaaggtgagccttctcctgacaactacagcatgagattattgtgtatatatagatcactgtcatgcacaggacaggcacatgacaaatgtgcattaaaatgaaggctgcacatggcaccactgtagccctagactgcaaactcattggcattccaagaacttcacaaatagcacaataatgtgacttttcttttttaaaaaggacactatgtagcttgtaaaattaatcttagaggcacatcatattaatcatggttccattacttagcagtcttcattttcattcaaaatatgaaatttccaagattaagatgatttggatttacaaatcttgtaaaattcaagcatttgtatgagaataaatcactactaaaggaattgatgtcatcaatatcttttactccttatatctaattgcaacactgggcattaaagtgagagttttactggaggaaggacagcaagaaaggctaattttggagccctggagaacagtgatcaacaggagggcagtgtaatgagatagtcataggagagactgaaagtgggagggggcatggaaagggagaacttgaagacaaacataaatgtgatctgttttcacaacatggtcagggcctcactctgctaacatttgtatgtacgctagtacttagtctctatcaggcacagttctaagccctcatttacttaacaatagatactactttcatccccattttatagttgcaaaaaccaaggcccaaagaggttgagtaccatgcaaagcttcacagctagttagtggcagagctgggattcaacaccaggcaccacttcataatcatgaattatcattttacacagcatgcaatctagaacaatcactttcaatcttgtttttaaccataatccttccagtaagaatacatgactcagtacaccaaaacataagtaacagaaatagaagttttgtgaaataatacttttaccaaatgtaatgcatttggtagtcccagctactgggaatggatgaggaaggctgagggaggaggttgaggctgcagtgagccatgattgcaccactgcacttcagcctgggtgacaatgagaccctgtctcaaaaagtaaaataaaataaagtaactttttctattggttatatgttgaaatgatgccttggatatattaagtaaattatattgctaaaattaatattacctttttcaaaactttcttttcttttctttttttttttttttttgagacagtctcgctctgtcacccaggctgaagtgcagtgacatgatctgggttcactgcaacttccacctcccaggttgaagcgattctcctgcctcagcctccacagtagttgggactacaggcatgtgccaccatgcctggctaatttttgtatttaaaaaagtttttttaatgtggctacttgaaaattttaaatgacctatgtggcacttaatatttctattggacagtgctttctgctcattcaggccaaaaaccttggagtcatccttgactcctttctccaccaatcctgtaggttctatcttcaaaatagtccagaattcagcaactacaccacctgctataccacctcccccccatcacccccaaccccccgacacagagaaaacacacacaagtcactttctcttgcttgaataactaaaatagctttctaactggtctccttgcttccttccttgctacactctacagtttattcaactatttcccataaagttgcggagcgatccttttaaaaggtcaatcagattatgtcactcctctgttcaaaatctccatggctttttttccaaagtttaaaagcccaagtccttgcaatggcctacaaagccttaaaagatctggtcacccgtctgtgctcctgatcccttctcctgccccatctgtctgtcctaatctcttaccactctcttcttcactcagctatggtgatcttcttcggttcaccaagtatgctcctgcctcatggcctttgtacttcctatacctctacatgtaaccctctaccttagacttcttctttctcgcagtttggcatcactttactgaacgttatatttagaaatgcaaacctctctctgcttactcttccacacttcccccttcctattatatataggatataacatatccttcttattatataggatatattatatcctgtataatttatttaatttatctgtctcccaccaataaaatgtaggagttccttgagggcagtgactgttttattgctgcattcccagcaccttatgtgcctggcaaatagtaggggccagaaaatgagctgtgggttcccaaagtcagttacggaccatttgcaactagccattctcagaaatctacagaaataaacaaatacttcagtatggggtttttttttttaacttatatcctctttggacctacagtcattccacaataaagaatgcaagaatcttctccacacgccacaagtcttagttaaccaaatcttctgtccattttctcataaccattaggagccctccaaaagccctggaagatgggttttcctttaccctcaggcattaaatctccttaagcatctgcaaaaagttctgagttactggcctaacataagtgcagcttaatctcagacgatctccgggtctatctagtgtacatgaggtacacccggacaccgttaagtatcagtggtgtttgcactctcgatggtttgcagactggccacaccttacctactgggtctgcattcaggaacatgtgtcctgtctgttagcactagaagtgatggacacgtgttggctggaatgtcaaggctgtagccaggccccttattttagacacttagaaatcaggactctgagaacttaggccaagtaaaaattatcaaaacaaagaaacaaaacacgtggtggcacaaaagacaccagaagccaggtcgtttgcccctcaccattcagcccttcccagcaaaagatcctactgtgcagctcaacctagctcgcagccggtaccgcgggattttaatgtgcaactgtgagctcgcaggctgttaaaggaaggccgcgccttggccggtgcaccttccccagggcaaggagaaagcgccgctcccggcctcagccgcagcaggctccaggtcccccggcccggagccgactgagacggtgcggtgcccacgctctcgcgagactagcggtcggggcgggcgggtcgagcctcccggaagtgggccagaggtacggtccgctcccacctggggcgagtgcgcgcacggccaggttgggtaccgggtgcgcccaggaacccgcgcgaggcgaagtcgctgagactctgcctgcttctcacccagctgcctcggcgctgccccggtcgctcgccgcccctccctttgcccttcacggcgcccggccctccttgggctgcggcttctgtgcgaggctgggcagccagcccttccccttctgtttctccccgtcccctccccscgaccgtagcaccagagtcgcgggtcctgcagtgccccagaagccgcacgtataactccctcggcgtaagtgctaggaatgccgctggcctcgcggggaaacgcattctttctatctatagctcgctctgtacatcttctgtctacggcagctattccagaggcaacaactgcttccctctgttctcatctccccattggtggctggcgacccgaatttgggaatggggagattgcccacctgttatctttgagcagactaatctcttgtaagcagaagtgccattcggagtctccagagccctgtggcttggggctgggaatgtccccctgacttcaggctttcctaagtgtattgcttttctctgagaatggtctaggtttttaattttttaattgtaagaatctgtaatacagcatttttatttcggtcttattcgttgtgctcaaaggcaggaaacaactattaatttgccttctcgaatcttaatagttataagattcattctctttcattgctctgctaggcataaaacacacttcgaacatgtaagtgccgctgtcagctctggagagtttaaggcaatagttattttcgatattttaactcctttttgtttcataggggtaactcattcgactgtggagttcttttaattcttatgaaagatttcaaatcctctrgaagccaaaatgggacacagtaaayagattcgaattttacttctgaacgaaatggagaaactggaaaagaccctcttcagacttgaacaaggtcagtagcaagttgttttgatttgctcatttgcgtcttttaaacttttaattcattggcagtcctgttaaatgttttaaagctytaagataaatattatttccaagggtctaaaacttgatttgtgcaaagatggtgctgtgttctccatatatcactaattaatgttgatttgaattaaaaatattttatatccctcgtgttaggataaggataaaatagttctcttttctctgcgtactaattcccacttaagattgaagttaaatatatgatcagaagattgcccatattatttctaataacatttactattaaaacttggtaaattacttcatatgtaattttgctttgggtatgcatgtagttttgcctttgtataactgtctcttttcctttgttgaacctttgaattgacaaaatagattgcagcaaaaagtatagtaaactattgtttatgtatatcaaaaacttctcaaatgtggagtaggtaaaagctgaaaatattttcttagcaaataaaaagtgcaataactcatctggttatgttgaactatatatagttgatctgtatttaaaagatcaaattacttttctacaaggctagttaatagatgttttattttcttagcctttgtaatttttcaacattgaagaagtgtaatatatgaaaaatccagtcccccttattaatgtaccaaatggatgttgctrgtcataaacatttcaaaggaatttttaaatttcgctaatgttttaagaattaaatttttgaaaaaaatttcacacatacaatgtgatatcttcatgccaaatccgcgcctttttccaactttggcatttaaaatcactgagtacctactccatttttggctttcctgactctgcacttttctggttttgatttttttttccccctcccctgttgcatattcttgtcaacttggtgtctcttactaggctctcttcctttcactttttaattaattatgggtatctgctaggaattctttttctgttctccttcaaagaattagttacacagtctcatggcctcaactgttgcctctgtgctaatgactacttttggaggaaaagccttgagctttcttcttcttggaagctttcagcatttgatgacgggtagatctagagccagaattctcctggctctgctgctaacaagctgacttggggcaagttacattaattctgagcattcatttctttttttttttttttttttttccttttctctttttctgagacagggtcttactctgttgcccaagctgagtgttgtggcatgatcatggctcagtgctgcctcaacttcctgggctcaagcagttctcctgcctcagcctcccaagtagctgggactgcaggcatacatcactatgccccgctaattttttttttttttttttttgtagaaactgggtctcactatgttgcccaggttgatattgaactcctggactcaagcaaccctccctctttggcctctgaaagtactgggattacaagcataagccaccgggcatggccccaattctgagcattaatttatttattggtgagatgaaagtggtaatttctgttcttctacctttctaggttttgagactcaaaattaataatacatgaattttttgtgataaagccctaaataaatataaggcattgatatgaatcactccatgtattcccaccctggaccttggcttcaacctgatattatgcaatagaatagtattaggatagctcaacttggatatgcttaaatctagcatgtccaaaaatatcccctgcccattctcgatcctttatttctcagcttccctgtttatttcgtggcatctccatttttatagttcccagggtagaaaccttatattctttgatgatttcttctcttttcctgcagtctctttttaagcttgcagtttctttccaaatatctctgattgcctgtctattctgtatggctgaatatagatgccagaataatcttatgcagtctcttccctttgttattaagtggtatgtataaaatcaaatttaaatacctctgtctgacttctaagacattctgtaatgagactacaccttccttagccaagattgtatctcattctccatcattaatgtcatagatctttacagttgcccaagtcattcctgttaattcccttctcagcaggytttctcatgcctgtccttatacccgtactcccatcagattcctttatatctgttaaatctcatttactgtcagtctatgtgttgcctaagtttcaactttcagctagaatatcacctcctttgtgaagtctttccctaatttttcactgtctgcttcctttgatttccaattacacaatgagcacagaactattaagtgctgaataatgaagyagtgtctaaaggcttgttagtcttacagtgtcagactagggtttaaaatctgtgagaattgatgagggcaggtgactcacacttgtaatctcagtgctttgggaggctgaggctggaggaccacttgaggccaggagttcatggtcagcctggacaacatagtaagactttatctccacaaaaaagaaacaaaattagctgggcatgatggtgcttgcctgtggtccccagctacctaggaggttgaggctggaggatctcttgagcccaggagttaaaggctgtagtgagctatgatcccaccattgcactccagcctgggtgacagagtgagaccctgtctttaaaaaacaaaaataaagggccgggcgcagtggctcacacctataatcccagcactttgggaggccgaggcatgtgggtcaccccaggtcaggattttgagaccatccagcctgatcaacatggtgaaaccccttctctactaaaaatacaaaaattagccaggcgtggtggcgcatgcctataatcccagctacctgggaggctgaggcaggagaatcgcttgaacctgggatgcagaggttgcagtgagctgagatcacaccattgcactccagcctgggcaacaagagcaaaactctatcttaaaaaaaaataaaaaataaaataaaatctgtgaggatagggacagccttacaaacttagtgcagtgtactgctgattgattactagaactctagttaaaactagcaaaaattgtaaaagctaacctatttgaagagggaaattgaaggatttatgaaaaaagaatgatgtggttgactttataactctggttaaaaccggtaaatgtatccaaatgttataaatgagaatgtgccacctttttttgcagtaatggtgtgatcattttgttttagaagataatttgaagccgggtgyggtggctcacgcctgtaatcctagcactttgggaggccgaggcgggcggatcacgaggtcaggagatcgagactatcctggctaacatagtgaaaccccgtctctactaaaaatacaaaaaaaattagccgggcctggtggcgggcgcctctagtcccagctactcgggaggctgaggcaggagaaaggcgtgaacccaggaggcggagcttgcagtgagctgagattgcgccactgcactccagcctgggtgacagagcaagatgccgtctcaaaaaaaaaaaaaaagataatttgaaatgtgaaagatgagtggaagagtggtagagaagggacattggagacaagaagcattgagaaggctattttaaaaacacatctgattaaagaaaaggattgaacagcctgagttgaaaaagagaggacaaggccaggcgcggtggctcacacctgtaatcttggcactttgggaggccaaggcaggcggatcacctgagttcaggagtttgagacctgcctggccaacatggtgaaaccctgtctctcctaaaaatataaaaattagccaggcgtgctggcgggtgcctgtaatcccagctacttgggaggctgaggcaggagaattgcttgaatccaggatgcggaggtttcagtaagccaagatcgtgccaatgcactccagcccgggcaacagagcgagactccgactcaaaaaaaaagaaaaaagaaaaagagaggacaaagtatgagttattttcaagttcagaggacttggtaaccaatcaaatgtgaggaaaaactctggcagtttttggctgtttcatatttaattggtcatcaaagccctcatatttctttccttctctcttttctacaagaaggaattcctcctcgtttttaagactgatatttctatagattcttccagttcaacaagtacaagaataaataatgatcttttctagacaaatcatagctttttcgcttatttcctatctcatttagtggtagaataatgaataaaatcaggccgagcacggtggcttactcctgtaatcccggcactttgggaggccgaggcgggtagttgacctgagatcaggagttcaagaccagcctggccaacatggtgaaaccccatctctaccaaaaatacaaaaattagccagatgtggtgacatgcacctgtagtcccagctattcaggaggctaaggcaggagaatcgcttgaacccaggaggcagaggttgcagtgagccaagatcacaccactgtactccagcctgggcaacagagcgagactcggtctcaaaaaaaaaaaagaataatgaacaaaataagtacttcccaaatctgaaattcttccatcttttaagtaggttgatgaaatttataatttttactattttttaaagaaaatatttagacataaaggttctttgattagaagactgagtttctataaattgagtggaggggaaaagatagaacatatttatttacaataatagtttaatcactcattatgctagttgcctacaagagagacatggctaatgcaagttaagtatcctagcattagtatgaggaataagatagccacaccatgtactgctatgacctcagctaattttagcaaactgagtcatggaatctgacctactgtaggctctctgatgtttcatttactgtatataaaaattttagtttcagtgatttgcattagaggtcwacagagtggctatgtrtcccttggggtatgcgctgatatatctattgggctacagaaagaaaatataacatcccttccttccttcctccctccctccctccctccctccctccctccctcccttccttcctcccttcctccctccctccctccttccttctttccttccttcttccctttcttttcttttcttgtatttatttatttatttatttatttttattgatcattcttgggtgtttctcgcaragggggatttggcagggtcataagacaatagtggagggaaggtcagcagataaacaagtgaacagaggtctctggttttcctaggcaaaggaccctgcggccttccacagtgtttgtgtccctgggtacttgagattagggagtggtgatgactcttagggagcatgctgcctccaagcatctgtttaacaaagcacatcttgcaccacccttaatccatttaaccctgagtgaacacagcacatgtttcagagagcacagggttgggggtaaggtcatagatcaacagcatcccaaggcagaatttttcttagtacagaacaaaatagagtctcccatgtctacttctttctacacagacacagcaacaatctgatttctctatcttttccccacctctcccccttttctattccacaaaaccgccgtcgtcatcatggcccgttctcaatgagctgttgggtacacctcccagacggggtggtggctaggcagaggggctcctcacttcccagtaggggcggccaggcagaggtgcccctcacctcccggatggggcggctggccggacagggggctgacccccccacctccctcccggacggggcggctggccgggcagaggggctcttcacttcccagtaggggcggccgggcagaggcgcccctcacctcccggacggggtcgcagccgggcagaggcgctcctcacatcccagacggggcggygggacaaaggcgctccccacatctcagacgatgggcggccgggcagagacgctcctcacttcctagatgggatggcggccgggaagaggtgctcctcacttcccagactgggcagccgggcagaggggctcctcacatcccagacgaagggtggccgggcagagacgcttctcacttcccagacggggtggcggccgggcagaggctgcagtctcggcactttgggaggccaaggcaggcggctgggaggtggaggttgtagtgagccgagatcacgccactgcactccagcctgggcaacattgagcactgagtgaatgagactccgtctgcaatcccggcacctcaggaggccgaggctggtggatcactcgcggttaggagctggagaccagcccggccaacacagcgaaaccccgtctccaccaaaaaaatacgaaaaccagtcaggcgtggcggcgcgcgcctgcaatcgcaggcactcggcaggctgaggcaggagaatcaggcagggaggttgcagtgagccgagatggcggcagtacagtccagccttggctcggcatcagagggagaccgtggggagggggaggggggagagggagaccgtggggaggtgggaggggggatagggagaccgtggggagggggagggggaggggggaagagggagagggctcttttcttttctctctacctgttttagttttttaagtctgttatatgttagcaacattgaattacgttaatatatgaattatgctctcagtttgtatgtcagataagttacaaacaaaaaaggcatactcagaagaaaacgtagaggttgtaggtctggaaggggttgacaatcacaccctcatttgtttgcagtatgttgccatgcattgcacttttacttaagctaggttaagtagctttacgggttatattatcttaaataacagtctctatattactttgtaaggagaggtagagtaaccaagaatagttcttttacctcacaggagtgatcgaacttaaaagatgagttagaaagtgtttgagattcgtccttttcagaaataacaagtagcattagatagtatgatacttagaaaatattttcagaaaaaataaaaacttaagtctttgatgtaaacatgagtgagaaagttaagtgcttttttgaaggaaattgatgcttggagcagagtttggcacatattttcctgcaaaagttcagatcgcaaatctttgcagcttttcaggcaatgcactccctattggagcgactcaactcccattgtagcaggaaagcagccataggcaaacatacatgaatggatgtggctgtgttccagtaaaacttcatttacagaaatggggattaggctggatatactttgccaacccttgctatagtgaaagcattttgaatatatatttttagaaatgcttctttcatcattatatgattttacccaaaataagtagaacttgaaatctttgaatcactttattacaaaatattaaaaccaagactttttaaaataatgaaatttatttagttacattttcactgagagatattatcaatattaatttttagtgagagccaaaaggttttttctacccactaataaataaaatgtattatttaaatattatttatttcatttatatcttatcccattaagttaacttttatattttataatttacataatctatgagaacatcatacatatatattatataaataaatgacttagcttgggaattattggggttttttcctgaaggtagagcactgatccaaatactgttttggagattttagatgagttttaacctttgctctgcaagttctctgaatacttgtgtaattataaaaacagtatttgtataaacttaacaggggacaggttgtacacatatacccagacagctaatctctgctgtttgtacttgttcaaaatgacactatttctcctaaagataaatttagtcattcttgtgagatgtaaatgtttatgcttctcagtcactaagtattttacttcatgttttaattctttctgtaattatttcttagtctatcccttcataattgtagstctaattttaaaatgttttccctaattataaaattatgcaaatgtataaaaagcattttttctgtgttttttttttaattaggattatactatctaaacaattttgtaacctgcctttttccygtttgtagtagtattatggtgtatgtactctacctccctgcctactgccatgtttcagccatacttttttccagaagatattttaaaagctctacataaatgtgtacaatgtaacaaaatagaataaattaaaagtggttattacatttttttttaatggagtcttgctctgtcacccatgctggagtgcagtggtgcgatcctagctcactgcaacctctgcctcctgggttgaagcaattctgccccagcctcctgagtagttgggattacaggtgcacaccaccacacccagctatttttgcgtttagtagagatggggtttcaccatgttggtcaggctggtctcaaacttctgacctcaggtgatcctctcgcctcggcctcccagagtgttgagattacaggcgtgagctactgtgcctggccaaatgtcttttgataacatgatttataatggctttacaatatgccagcttgtagatttaccataatttatttaatcactgccaatcattagatatttaggttgttgtcagtttatttcatttcaataaatgaggctgtgataaatatccttatacataatctctgtttacatcactgatacttttctcaaaaaatctatrtaaaattcctagatcaaaaaatataaacattcttaatatattaatgccaaattgtattatagaaaaagtacatttagttgcttagagaagaaattcttagtttcactatagagcattctcttagtgtcttttactgaaawcttttgttcacagaaaatatccctgttagtatatcctcttttattactttgttggatgtttaataagtcaaggattataaattataaataatatatattaaataggtaaatattagtttttttcctctcaaagaaattccttagatattaaagattttactcagtggaactaaactttcctgcctcatcagttattattgcccattattaattgaaagttatattcgtgtttaaaatttatatgtattatatttctaatagacttgaccatagtcagtattttygtattctaataattataaagaaggtttaaagtctgctttaaaccaaccaaaatgtttctttcacagtacagttttaactgtaatgtgcttatttgttttcgcttatggcaaaatatttgtaacacattgcacaagtctaaggtatgtttttttaaaaataacctaacttgggcaaaagtagaaatgcattggctctcaggattacaagacagctttagtaactaaaccatgaagcayagggatataggcagtagtgtgttggaggtgcttttgctggctyacaagagctgattgtgcacatcccttcccacttccacgttcaatgttgtcgtgttggtagcttaagattgcccatgtcgggattatttccaccagaaagtcagcaaacactccaagtcagaggttcccaccaccctagtcagttgctaaatctttattagcacatcactggacttgagcagatatcagtcgggttcagttgccttcagaactcctgttagaatcctgaattctgcctctatagaggttgacttctgtcagtgaagactagctttctcagtatggtgagataatagtcccatggtagctcccaagttttacagactatcacatactttctgacaccatagagaaactagctttctctgttgcagttagaaaaatactagagaaggtctctcctcagatgcctgccattgggtacttaattcaggggtgaggatgggggatcatggtaaatggggttgtataagaatttgcacatcccaagttgctatgtgaataggaatgcgtttccaggggaaggagaaagagacattacagagcagacagctctatgatgtttactatacttgctaaaatgtgaaattcagctaaattggaatacaaagtagtgccaaaacagcattaggtttgcggagttattttaaacataattgaaaaatcaaggttttttaatactttaaataaaacatctgtttttcaatgtggtaatttaagtcctaygatgagtttattaacatgtgctttttatttagggtatgagctacagttccgattaggcccarctttacagggaaaagcagttaccgtgtatacaaattacccatttcctggagaaacatttaatagagaaaaattccgttctctggattgggaaaayccaacagaaagagaagatgattctgataaatactgtaaacttaatctgcaacaatctggttcatttcagtattatttccttcaagggtaagtcaggtgttttgtttgtgagaaaaaaagttaatttgttctgtaatttgaagtcacctaacttgtaaatgttactgtatgaaccatggcagtgcaatttttatagtgcttccttgagatgcaaatagaatattctttgatttctaggaggtaattttatggtccattgcagagctaaagtatcaagtaaatgtattttaagtaacatmttaaaatgtagtaatttcatgcaacctgattataggttgctgtttatttgcgtgcccttgttattactgataggttttagtatacttatatttcattaaaccaacattcttggatattttgtgtattatacatgtaattatgtagattgtgaaagggtaaaagtagcttttccattaagttttgttgcaacttttaaaatgattttatgygcttagaaataaatacattttatttgggacaattaaccttttagttagagtcagactatattatatgaggattttttttctatcactgactgaaaagtttttgttttgttttttcccttagaaatgagaaaagtggtggaggttacatagttgtggaccccattttacgtgttggtgctgataatcatgtgctaccctwggactgtgttactcttcagacatttttagctaagtgtttgggaccttttgatgaatgggaaagcagacttagggttgcaaaagaatcaggtaatgtcagcttgctttctttttcttatttaaaaaaataaatgtaattatcctctgtgatatagatttcaaaagttttgtgtattagtccattctctcattgcagtaaagaactacctgagactgggtaatttataaagaaaagaggtttgactcacagttccgcaggctatacaggaagcatggctggggaggcctcaagaaacttacagtcatggcagaaggcaaaggggaagcaggcatgtcttacatggccagagaaggaggaagagaacaaagtgggaggtgctacrtgcttttaaacaaccagatcttgtgaaaactcactcactatcatgagaacaagggggaaatccacctctgtgatcaaacacctctcaccaggcccctcctccaacatcggggattacaattcgaatgagatttgggcagggacacaaatccaaaccatatctttttgcctstatgtttaattttgtttcttattatttagtaatataagtagatagaaccatattaaaaaaaaattttttttttttgagacggagtatcaccctgtcacrtaggctgcartggtgcgatctcagctcactacaacctccacctcccgggttcaaacgattttcctgcctcagcctcctgagtagctgggattataggcaccygccaccatgcctcactaatttttgtatttttagtagagacggggtttcaccatgttggccaggctggtctcaaacttctgacctcgtgatctgcccaccttggcctcccaaagtgctgggattataggcatgagctgctgtgcttggcccatattacatttttgatacttaaccatttttaacctataaaaatggcaaattttgtggttcagcttaagaaatgaaggaactccataatgaaacacttatcatttctaagactttaccatataaaaatcagaaataagctattgaaaagtgaaggaaaatgtattatcattatgtatcattttaattcaacaaacattggttaaccatcttttgtgtagaagacatgtgctaccataaataccaagagcaaaatgaaacttgtgtttcattttggcgcaatctcggctcactgcaagctccgcctcctgggttcacaccattcttctgcctcagcctcccgagtagcttgggactgcaggcgcctgccaccacgcctggctaatattttgtatttttagtagagacagggtttcacggtgttaggatggtctcgatctcctgacctcatgatccacctgcctcagcctcccaaagtgctgggattacaggcatgagccactgcgcctggccttttttttttttttttttttaagacagtgtctctgtcacccagactggagtgcagtggcctgatctattttttgtagagacaaaagtctcactgtgttgcccaagctggtcttgaactcctgggctcaagyagtcctcttgccttggcctcccaaagtgctgggattacaggtgcaaaccactgcayctgatctcaatattaattttctgcttttaagttggataatacatgaagaaaggaatgagaagttcactgacataactaaaacagaatacaagtactatggaacattaaaagtagtagaaacacgtgttgatatactcgtagaagataaatttactacatgttaagtatataaattttctaataggcagtgtgtgtgaattttttcaaatattatctcattatctctgtcttgtatatgaggacacatatcttgaaagatttaaataaacttgcttaaagtctcttgtggtacagttaggatttgaacccaagtgtttgacctcttttccagtakcatgcttgccttgctatttataattacttaagaaagtttaaatttatattttcttcattttagsctggttttgtttgtttgtttttacagtggtctttcctttatttgctttgcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactggtatgagcttcattgactgccttcattaattttgatgagaatttatgcacayacacatatacacacaaataagagaaaggaagaaagaaagrgaaaggaaaggggctaacataaattttaaaaacacaaatgatgattaggtgtccttcygtttaaaaaattaatatttttcctttcaaagaaaacattcttaattgaggattaagtcaatatataagtatcttgcatctgttgcttataaatacaggagagtgatcatagaaggaacataatgatcacatatttcaacttacagtacagtagtccccccttattcgcagttttgctttctgaggtttcagttacctgcagtcaatcacatttcaaaaatattgaatattccagaaatcagcaattcataagttttaattttcatgctgttttaagtaacatgacaaactctcatgccatcctgctctatcccacctggaatgtgactcatccttttgtccagtgcatccatgctgtaaatactacctgtmcaccagttacttaatagcctgctcagttatcagataaaaaaacacaaaatatcaaaatatatatatatatagggtttcatactatctatagttttacacatccacttgaggtcttggaaggtacccctaaggataagaggggactactctattaatcctttcccaagtaactcatggatcctatattagcaggagctctggtactatagtactatagcatatatgaaaaaactgaatgacttctattatttggagagaaacttattagtaaactctcagaagttgtatttggaaattatgtcttctacatgttaaaagagcttattaaatttagtctgttttggttcctaagattccttagtggtatataattctattaaaatagatcagatttttccagctagtgatccttgaggaaatggttgctcccctcacctgtcagaggagctgagcctggcctggcctagcctgacaaagcgtggccatcagcagctttgggtttaacccagtttaccttacaaatgttatcttgtgtgtatgctacaatgtagaaaagtttggaaaccactgatttgcatatgtaaagaacaagaattctrgttggtacaaacatttaaaagatacaatctgctgtttcataaaacagttctccaagtaaccatagaaactatgaagatatttaaaagctcatagatctggttcatcaatataaataaaaatctctaatcataatggcaaagttaggtaaagaaataggtacattctaaaatttggtgtttctgcatgtacctagaaaccaagcctccagttctacrgtgaaaacttcataatacctaagaactcagtattcttcatttgaaaatttgacattattaagccaggtgctgtggcttgcacctgtaatcccagctgcttgagaggctgaagtgggaggatgacttgaggccaggagtttgaaaccagccttggcaacataatgagacccccatctcttacaaaataatgtaaaaaaattgtaaaggaaaatttgacagtcttgataatcactttgagatctataatattattgaaatcagatttatcaaaccacataagggcattttatgagttataaattgtatgagttaggatatggcataagcagctataacagaaaaacatagggactaaaggctaaaattgtatttatttcttacaaaagattagataggcattcctggactaggatggtagttcagtggtgatagggaactagtttctctcatgttgctctgcagtctccaacacttwgcttcaaattcttagtcagatatggctattccagctcctgctaccacattctccccagtggaaatgaggaaagggcaggcatgtctttttgggtatgatatgatatatattactgtgttcatattgcatcacaggaatttgtctcttgccatacctaccttaaaggagacctgcagcgtagtcttgagwttgtcagctatgtgtaaagttgaaccttgggaattttattactaaagaaagaaagggaggataaaactgagtacagcagcagtctctaccacagactgtatttctgagacatttgrgagattctgtgcaatgtaaaagaagtaaaccttgccacagccttacttgaaaagtgttgcaaatcgtaatatcctttctgtgaaacaagttttcttttatttatttattttatttattttatttttttttgagatggagtttcactcttgttgcccaggctggagtgcaatggcgcgatctcggctcaccgcaacctccaccttccaggttcaagtgattctcccgcctcagcctcccaagtagctgggattacaggcatgcaccaacacacccagctaatttttgtatttttagtagagatggggtttcttcatgttggtcaggctgttcttgaactcccgacctcaagtgatccgcccaccttggcctcccaaagtgctgggattacaggcgtgagccactgtgcccagccagttttcttttaaaaaagtattatctagcagaattcaacctccagaatggttatgtgaaggcttcacacactctttacgtagtgaaacaaccctaactggtgaaaattattttaagacaatcacttaaatccccttgaaattgtcctacggatatttagcatatggagaaacatatgaagatctactacatcttagtaagaacaggagtccttggtgattgaaccaagacctgctccattatcttacacaaatgcctctgttatggaagctgtatcacaggtgctccactcctggtaggtgtggccaagarggagacattctctcctcccaactcccagcctggggttatagtttcatgctaagaggcacagtctatgagtgtttttaattctccctgccggccctgtcttgcagaagttctttttttttaatttttttttctctttttttttttgagacggagtctccttctgtcgcccaggctggagtgcagtggcgcagtcttggctcactgcagcctccacctcccgggttcaagcgattcttgtgcctcagcctcccgagtagttggaattacaggtatgagccaccatgcctggctaatttttatatttttagtagagttggagtcccgccatattggccaggttcgtctcaatccaccctgccttggcctcccaaagcgtgagccaccgcacccggccgtgttgcagaagttctattccaagcaggcaggtggagaaaaatctccttttctccacccagcccctacttgcagagctgacatcctttcccacaagtagcaggccaagaacactgggaacccatttgccctggaaaaggtcttggttcaaatgccaagactcttgctgttcttatcttaaataaatgtttcttcttatgctgaatgccctaggataatttccagggactaaatgattgtttttaaaattattttcaccagttaaattgttttgctagggacagtgtttgttgagtttcttactgtatcactccagaagtccatatttattttttaatgttgatgtgtgttaaaacatagtttggagtttgactcttctttcatgtagaattagaaaaaaatattttcactacctattgtttagaattctttcattttacagttgatttttgtttcaaaatattgaaaaaagaaacagttttaggattttgctattttaaaaattggggacgggtggagtggctcacacctgtaatcccagcactttgggaggccgtggcggatgggtcacctgaggtcaggagtttgagaccagcctgggcatcatggtgaaaccccatctctactaaaaatacaaaaattagccgggcatggtggtgggcgcctgtaatcccagctactccagaggctgaggcaggagaatcacttgaacccaggaggtggaggttrcagtgagccgagaytgtgccactgtactccagcctgggtgacaaagcaagactctgtctcaaaaaaagggaaaaatttaaattagctgtgtgtgttggcatacacttgtcgtcctgactacttgggaggctgaggcaggaggatcacttcagctctagagttcaaggctgcagtgagctatgattgcaccactgcactcctgcactcctgggtgatggagaaagacctttctcaaaaataaatggatgaatgagagcagcattggtatttactctttttttttttkttttttgagacagggtctcattctgtcacccaggctgtagtgcagtggcacaatctcagttcattgcaacctccacttattggggtcaagcagccctcccaccttagcctcctgagtagctggsactttaggcacatgccaccatgctcagctaattttttaaaaattttgtagagatgaggtctcactatgttgcccaggctgtctccagctcctggactcaggtgatactccctcctcagcctcccaaagtgctgagattacaggcgtgagccactgcacctagccccaatatttattytttatacgtgaaaatcctatttggacataagttattactacattttgtcattttgaaaaataccttgaatttcagtgattgtgttgatgaatctcggaggaactacttaatgcaagttttgagaattaccaatttaacttttattacaacttctytgctccttacatagcctttcttcatctgagtgcttattatgggtatgaataaatactaagtaaataaatgacttactaaataaatgactgaaactggaaataataatgattctaaaattatataagggtgctcagctgagtaaatgaagcacaaacaattcatttcagcagcagagcaatgtggttaagattgcatattctgaagagrgacttggccaagttaattcctgactgtatgacttgggctgagttacttaactctctgtgcttcagtttctcttttgttaagggaacataacagtatgtcctaatttgtgtggtaggaagtgaggaataataaattagtgtatttaactgcttagaacaatttctggtatgtggtaaatattcagtaattgttactactttttattttatacacattaatcactcatgctcttcaatatgaattcagggataattattagtccattttaaagatcaaacaaattccatgtaactttcattcgtttattttaaattaaaacaaattatctgtttttaaataggtagatataaggtttcactgtgttgcccaagctggtcttgaactcctgcaggctatccwacctccactcccacaaagtgctggggttgagctaccgtgcctggccaaaacaaattatcttcaatgttgtaaatatttggaatactgtgccaaactcctgattctgattctgaactataagctacattcgtattccttgagcgtatttattttagcaytttctcaacctcgcttttatccaacttatcaaaacaacgtatttcattaacactttaggatgagccatacaaaagtgttacctatgagagagttgctttttgtttcatcggattttctaagcagaattaaagttagaaaaaaaaaaagtatgctgaagcgaatgataggataccataaccaaagaaaaaacttttcctgtaacagtatcatcgtaaaattgatgtccaatatagaaaaaaatgagtggtagatctttatattttatttcrcctctaaacttaacatagatacagtttcaatttaattatgagatactcctttgtgtctcctttttccttcagctgctaatagtaaatggatccrggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaatgtcagtatgtacagaggagtatcacactaaaacagaaaaaatttctaaagcacacattaaatatatggttgaaaattacttagaacctgtattttaatatgataaacagtatttgcttaactgattttaaataagtatatgtatatatgtattttttaactattgacatttttcagtccatccgaaaaataatttgggaggatatttttccaaagcttaaactytgggaatttttccaagtagatgtcaacaaagcggttgagcaatttagaagacttcttacacaaggtaaaggatacatactagaatgttcctatcgattttaagaaatgtaatattataaagggaaaactctcttttgggtaacgtcattattaaatatgtcattgtattatatttgtgttattgttgatattataaaactgtgattctgtaagctgagagttagcagaaacatctaaagggcacgtcataataatacataacacaattatttcccctgggtactgtatcttactgttagttccatagaatgctcagaatattgtggaacccagtatatagttgttaaatgtatgaatgggaagtaggttgaacaggttatttcagctgagaaaggcttgaaacaagttttgaaattgagagatgtgatagtctcctgttgtctatagtaagaaccttaactgacgtagaggggctcccagctgattttgcgcactattaaggccacctaaccactagtgatattgaagccagatattgacgagataacaaaaggtaacgaagtgagtcttctattaaggacataactaatcaagcagttaatgtgccccccccccaacaaaatagggtaggaaaaaataggtgaaatgagaaagtagggtttgtaggagacaaattagaaaggattattaagagtctatctgcatttcatataggacaacctagcagtgaggatttggggaagatcttaaaatactttttttctcttgcagaaaacagaactagagtaggactcagaaatagtgcctttgaagtagacgtcaatatggcttgagctctaggatactcagtcagcttcatgcatcaacttttgcaattgtgtaacaccttaatacaggaatttttaatattaacttttctccctgtttcattttactaaagggcctctatcttcccttcccccaataacctgtattatttacatgaaataatatgtgctcattgtaaagagaaaaagcccaatagtttaaatgtgtaagaaaatagaatgtatgacctcttctttcccaaaacccacatctcagctactacatattgtttcttgtacttaagactctttgtgaaaaaaaattcaattttatatataattttatataattctatatatggtaagtacataaattttatatttatttttattttttacacatgcaaataagaacataaattgtcaacaacttgttcttttagttgacaatatgaatttattatagctaattatttcttttaacctctgtatagcaatatgctatttttaaagtacttgaatttatttagcctttttgataggttgtttccagttttttcatttttcattcattcattcaatgcatattcattgaaccacctactactgtgtgctagacatgaggattcagtggtaaacagaacaaagtcctttccctggataaacttccagtctcataagctgtactgcagaaaatacatccccgtacaccttatgtttacttgcttatgtgagtcaatctgaaggatacattgttaaacatggaattattgagtcaaagggtatacagatttcaaatataataaatttattttcacagcaagttataccaacttaatattatcactaacattagatatcattaacctttatcatgtttgtcagttaggcaaaacataccttattttaatttacatttcttttttttttttgagactgagtctcactctgtcaccaggctagagtgcagtggtgtgatcttggctcactgcaacctctgcctcccaggttcaagtgattctcctgcctcagcctcccaagtagctgaaactacatgcatgcaccaccacacccagctaatttttgtatttttagtagagacggggtttcaccatgttggccaggatggtctcgatctcttgacctcgtgatctgcctgcctcrgcctcccaaagtactgggattacaggcgtgagccaccgcgcccagccttttaagttacatttctttgcttattaatgaagtatatttttacaccttgattagctatttatatttcttccattaattgcctgttaatgtttcttctcatttttctattgagttgtctctttktttatatcgacattattgattattacacaggcctcaaatatatcccctagtatgctcttgatcttttaactcttgtttatggtgacattttttttcaatgtagtcaaacttttcaatctctgatggcttccaatttcatatcatgcttagaaaagaccttccatcaacattctcttttcttctaatttgtatttttacatttgaatatttaatatacctgaaatttatttttgtgtattatataaagaagatatttaacttgatttgtattyttaaaattatattgagttgaaaatccatccttttatactgatttgaagtaccaccataatacttcatagtgtatggtaatatacaaaatatacakctgttatctgtgctcttccactgatccgtctcttttattctatcaatactaaagattattagtttatactgatggcatagctttttctctttttcaaacatttcttggcagtgttcttttttttttttttttttgagacagagtttcactcttgtcgcctaggctaaagtgcagtggtgtaatctccrctcaccacaacctccgcttcctgggttcaagcgattctcctgcctcagcctcccgagtagctgggattacaggcatgtgccaccacacccagctaattctgtatttttagtagagatggagtttctcaatgttggtcaggctggtctcgatctcttgacctcaggtgatccacccacctcagcctcccaaaatgctgggattacaggtgcaagccaccatgcccggcggcagttttcatatatttactcttccagatgaaccttagaaactggattttaagaattgatttgtattttatgctgttttgtgaggctaacgtgaataaccactacactatgaaacccattattttgtttttttgttcgtgtttttataagtcatttcaaagtctctttagaataagccagacacaaattaattagttaatataaaatcaagttcaatggargcaatcctgtaccagttcttaattttattacaaacaagttccagaaaaagagtgaaaatttccccaaaaaccatttatttcctttttaatttttaagttattatctaaggaatatggttgatgaaaagggaraaaaagtattaaacctktgtgcttcttttagagaattcaaagaaagtcaggttgttaataagacttyaggaagcaaactttgaaagcaatcttgaaaaagaactcctgaggttagaatatttggtagcaccggggaggaaaacgggttccactaaagtccttamagtgtttaaaaaaaaaaaaggtacatgtatacatgtataacaaacctgcaagttgtgcacatgtaccctagaacttaaagtataataaaatatatatataaaaaaataaaaaaagaatagaataagtgaatgctgatgtaggcagaaaagtgggggctgagattgaattgataggaatccttgtgtctttcttttatgttatttttgtctctgtttctttctcccccacacccctcgtgtgtgtttgcgcgtgcacgcacgtgcacacacgtgcacacagcaggatgagaaggggaggaggtaggaggatacctgtgaaataaatatttgttttattttcagtgaaaaaattataggccaaaaattagaaaatagtgacagttataatctctttgtagatatttgcatttaaggtatcrtcttttctttcttttagaaaataggcgagtaaccaagtctgatccaaaccaacaccttacgattattcaagatcctgaatacagacggtttggctgtactgtagatatgaacattgcactaacgactttcataccacatgagtatgtaatgtgtttttttctgtgaaataataatattacttacaaacctttatggctagtatgattttcatactacttattaaaaacgcttaatagaaaatgaaataaagtaattcactgtaattctactatttcagcacatgacattttcccactttttctgtgtgtgggccatgtttctatatgtgtatataaacatttttacaattggaaaacatcatcagccataattgaaatcccgatgaatatatttaaggtttctgtgacctttgttagaaagtttttaaatgtagaatctgtaaagccattaaatattatatctgcatttctccatctgctctagcaaggggccagcagcaattgaagaatgctgtaattggtttcataaaagaatggaggaattaaattcagagaakcatcractcattaactatcatcaggaacaggttttacttatttttgaactgctgcttttccttgcatcttactactatttttttgttgtcttgaggatggtgatgatctaacacaatttaatgtttttcaggcagttaattgccttttgggaaatgtgttttatgaacgactggctggccatggtccaaaactaggacctgtcactagaaagcatcctttagttaccaggtgttgcatttttgttttttttcttattgatggttgaaaactgaaaattgtatttaacttttgaaattaacctaaatgttttctttaacatgtgagttcagtacatttcttaaattgaaatagaagttttgatttggacataggcttaatattaactaattttgttaggcaaatattttgttagagaaactgtcatcagtataaaccaattcatagttattatttaatgtttctggaggactgcatacttagtaataaattcaatattaatcaaattaagcaagcatctggctccttactttgtaagtgacataaagcataggttgggcaactagagtgcagtaaaagcctttgcatatctttacttagagtcttttttaaaaatatctttgcaaagtaacatcaatgcctcaattatgtatttattttttttctttgagatggagtcttgttctgtcacccaggctggagtgcagtggcacgatctcagctcaytgcaacctccgcctccagggttcaagcgattctcctgcctcagcctcccaagtagccaggactacagaggtgcaccaccatgcccagctaatttttgtagttttagtagagacggggtttccccatgttggccaggctggtctcaaactcctgacctcaggtaatccccctgcctcggcctccgaaagttctaggattacaggcatgagccaccatgcccagctgcctcaatgattttttaaaataattttatgaagttttaaaaattgtttaaactgttagccagatatgctgtcatgttaactccctatttctcacatcctgctagatttactcaaaaagcctaatgaagatttttgacctatattgaagtttttttcctataaatagcatcaaacttattttattctattcattagaaaagaagtttagttttaatattgcaaatttatattctctccaaggagtttctttgtatggatttaatatttaattatattttcataggtattttactttcccatttgaagagatagacttctccatggaagaatctatgattcatctgccaaataaagcttgttttctgatggcacacaatggatgggtaatgggagatgatcctcttcgaaactttgctgaaccgggtatgtaatttttaacttctctgtggatggggaaagaatagttcatggcaaggtcaaaataaaatctgctttaytgattttcttccccattagtctattggtttttaaatatttcaccataaakgtaccagagatacatacaatttgagaaagaaaacatggagccaacaaaaaaagaagttcatcttctgtcctctcctttgccttcctaccttttatcttctcaaacagaataacttttatgtactgttttctatattgtgggtctacataagcttttatttggacaaaatattattgcatttttacagacaagtttgaaaccactgctattacaattacattgacataagagatattttcactcattggccagaggtattaagaatttcagtggcaattaaaccagaacctaatggttttaggtcccccctcactctyagtgtcttgtgtttctatagctatttcattaccaggaagaatgttgcaggagyccattgatatatttattttttaacatttcraaactaggagtctatattagtgacattaaaatttattcagaaatcttaatgcttttttttaagagtataaatttgggtgtaagtatctctgccctcttttttctagycattctaaacgaaatcaagccattctgctgtatgccatggatctaatacaacctgttgccraaaataagtaggagggtggagatggagttttaaatgtttttggtagaactatggttttaaaaggcctatgatattaacatttctgttttcccttatgatgcgacttgggtttttgaaattgaggacaaatttttagaagagactgtaagctagagttttttcagaatagctatgagaaataaataattattaattttttaaaacattatctcataccactttagatawaatttaaccaatatatcatttatggcagaaatgatcaaagcaatttaaaaaccagtgtttccttgaagtaattgttttcrttttatttcttgaaccattgaaagcaatctcttttctgaacaggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactsaacacctcttcacgtagctgaggtacagaaaaacaatttatctacattaagaaaagaaattcagtgttccttcctagctttccttaagtaaactatgcaggtaaatgtttccttttgctagttggacacaagcattgatttggtggtagtatttatcactattgcataattagcataattctaacaatcttttgcagttgttatggaatactgggctataaaatatttaactagctaattttaaaattttaatttagggaagttgatcacgtttctgataatatggagtgcaatcatattggctactgtgaatacataaaatgttaatttttgttatttttaggttgctttcaatatattttagaagtgactgtgaaggtgaatagcttattacacattatagtggtgtgtgcctatagtcccagctactcgggcggctgaggcaggagaatcacttgaacccaggaggtggaggttgcagtgagccgagatcacaccactgcactccagcctggcgacagagtgagactctgtctaaaaaataaattaattaattaaattaaataaaaaataaacattaacattatagcatattgaagccagtctagcctcatcgatttaatttttattatttataaaaattataagtgtaaacataaacattgtctatttctctttgagctctttacaataacttctgaacaatgccaatacttatagtattaacttctatctaatacaatctttgtaattaaactcataattttcatcctgcttataagttttttttgttatttttagaaaccctacagtggcactgcttataagatttttgataccttactagtgaccagtgtcacttaggtgttctttggaaatgtgtgcttacctaaaaaatgtctatttctataatattaaagcagtattataatatatatttcaagtcctakgatgaaaaattgatttgatttggagggatttagtgaatattagttaagctggtagaacattgtttagttccaaaaaatgacrgctttattttattgtgcttttagcaatagcaaaaagaaatatgcttctaagattgttacatggcagaaaagaatgttcaaacttaatttacttaattttaarttacaaaatctaggattctacttgttagctaatagagtttcragtattttattaatctttgtgcaaatgttgtgtttaacagtttggaaccaatctgattttttattataaaccagtgtttataataaacagctagatagatagcamcagtgttaaacgtaaatcacacaagtggaaattgtaaggtgtaagagtttttaagagttatttatcatcatctgtaggagaaactggcttcagtctggtcagacaaatctaatctttccaacagctaagtaattcaccagcagggaatttatgaataattatttagtcaaccacctggaaattaagtctgattaaagttttaaaaataagcaagcaggcccaggcacggtggctcaygcctgtaatcccaacacttttaggctcaggcaggcagatcagctgaggttgggagtttgcaaccagcctgaccaacatggagaaaccccatctctactaaaaatacaaaattagctgggtgtggtggtgcgtgcctgtaatcccagctactcgggaggctgaggctggagaatttcttgaacctgggaggcggaggttgtggtgagctcacatcatgtcattgcactccagcctgggcaacaagagcgaaacttggtctcaataaataaataaataaataaataagcaaacaaaaaacagggagaaaacctaacagaattgtagtgttatgatttacatttagtaatatgaaactaacatttttcttcttcttttcctctctcatgtctcaatatctttgcaaaatctaatcttcctttttaaccgttttcttctcttgataaattctcttgtttctatgtgttttggtatgtttgatatcttgctgcatatttttctatgtcaaatcatgcctccttttgtctctttscttcctcctatcttgcttttctctttctgttacatttatttgttacatttgtcactgtgctttttacagtacatgttggatgctgctaggaatttgcaacccaatttatatgtagtagctgaactgttcacaggaagtgaagatctggacaatgtctttgttactagactgggcattagttccttaataagaggtaggcttgttggagtgtatttccctctaaaactttagcttttgtttaagtagattaaaggatttaatagcttcatatgcaatgcttaataattttttaacacagttaatgttcttctaaatactttgtatgacatattctaatataactcagtctatttttatcagtataaatttctactttggggtaagatacctcatttcaaattgaaagaccagtaggatgaactgaagactcactaacaaaaccattttttgttgttgaaaatatgcaaacctgtttttcatcttctactgggagatatgatgtaatgtttagatgttttataatcaattttgtatagcttacatcccagtaaacaacatatgttcccttttccttacatgagccatttctccagttaagttatggggaaaacttttttgtcacttaaactagtagacatttgtttaaatccttaaagcagttttattttttataatattgatgtggtctttattttgaaaatcatttatgagaagaaatctaacctcttcctggacataaataatgaagattgttaaaatattctgtaatgctctgcagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtggtaagcacctaatctttttcatgtacttattttgctaaatgctttgatatttaactctctgacacttggtcacaatcatacccatatacttcaaaatagtgtcttagatttataactgatttataatacatagttttcagaatgttttacttgtttaaaagcaaattaatttaccttatgaatttatttatgtaattatccttttacttcattatgctatagaatagcactttgcatttgaaagaaagcaaacttttgctttgttgttgttgtcttctagcatagatcagcgtatgatgctcttccaagtactacaattgtttctatggcatgttgtgctagtggaagtacaagaggctatgatgaattagtgcctcatcaggtttgttyatatgttgtttcttaaaacctacatggccaacaactttgggcatttttattaaaaaaaattcattgtaattaagatgtatccatgctaaattttacctttgtccagatttcagtggtttctgaagaacggttttacactaagtggaatcctgaagcattgccttcaaacacaggtgaagttaatttccaaagcggcattattgcakccaggtgtgctatcagtaaacttcatcaggagcttggagccaagggttttattcaggcaagaaataattaaatttgtttcttcaggttcaatttcagagtaagtctttccagtttgagagctaatctagttgttctttctgcttctcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggtaatgcaatctaaaaattgttactgtatttgtattatattattatattaaattatactgtaatgttatggttatatatcatgtatatatcatatatattataacacagtgctactgtggacgtacttgagaaaaagaatttaaactttttggtaacttggccaggtatgatggctcacaccagtaatcccaacacctcaggaggctgaggcaggmagatcacttgagctcaggagttcaagaccagtctcagcattatggtaacaccctgtctctatcaaaaaaaaagtacaaaaaattagatgggcatggtggcacatgcctgtagtcttggctactcctgaagctgaggtgggaggatcgcttgagcccagcasgcagtggttacactgagtccagatcccaccactgcactctactgggtgatagagtgagaccctatctcaaaaaaaaagaaatttttggcaacttatatttttactgcatggaacaaaacctagacagaaatactttcaaatgttaacattttttgagttgtgaaatatttttgtttatattttatttcctaatttgtgtaaaatgaacatttatttctcttctagcagaacaatatgtatatttgtgttagtgtatatgtatatatgtgtataaatgtctttgtgtgtatatatgcacaaacatacatacaaacatgcgaactaaaatggaaaataatataaccttatgtttaaggcttttcataatccattctcatccaccatcctagccctatgtcagtccactatttcagccaaatagatatttttacttctccccaaatactatgcgaattgtctggatctttcaaggtctaaagttgcacctcctttgttcagtgattcttctgaacatgtagcaattatagtctctatgtattcctctagcatagagagtcaaaaattataaaatacatccctgagatatgtccttaatattacttgatttttttctggataggtgtattttattgtcttacttactattatatgtggcatattacagcatagcatgctcctgttcatgcagcagctggcaaagtttgttgattgattgaccaaatgaaaattcctataaaaatcatcatattctatattggttgctagttgctgaatatgcatagttccggtttttaaaaattatcaacctgaatacctaaaagtttctttaattgttcacaaatgtatattcactatccttatctgatctttgctaatatacgtattcagttttataggacaacaatcactgtgtacaatattatctcaggttttgttttggtcacrgatcattcttaaaacatttccacttcagtccgcaaaattgtgatttttattttgttaaatgttcgtacgttctgttattatgcccttttaaatattctatagtatgtttagtagtgttactaagtgttaaatatacagtaaggataattgttttttcttttaaacaattttcttagtgtatatttacagaggtagaatttctagatcaaaaggttctgttacctgttgccagattaatgacttaaagcttaagttatttaaagtaaggttgaaattttatataatccattgaccctgcagttctatccctaggtatatatctgggaaactttcatatatttccatttgaagatatgcacaagaatatttattacaacattatttataatagagaaaaattagagacaaccttaatagaacagatatattttggtatattcatacagtagaatattatttggcatttgaagtaaatgtgctgtagctgatgcagcagtgtgaatgaatctaaaaaatacattgttgaccactaaaaagcaagttgcaaatatatataacttcaattcattttaataaaacttggaaatagggaaaataatatatgttgtttaaggaaacaggcatgtgtagtgaaaatgccaggggtagtgagcaccaaactgaattgaggttacctctgaaagtgaagaatgggtacacagaggctttattgtatttgtaaagtttaagtgaggaagtagaacttgggtttttaatttttttttgtatccgaaatattccaagttttaaaaaaatgtmagcctttcaagtgatttgcttttctctgctcaaaattaggaagttgttccctagagctaagctattattttgatacgtttctacttcaaaaaaagctttgttaactaagctgtaattttttttacaaatgtgaaaatacaccttgggtagaatcatctactttcagacttctaaaaaaaagtaactgataatttgttttcaactttaagttaaatgatttgaaaccactttagccttcctaattttggatgattccatatgaaattttgttaaaatgtttttatgtattcctaggcaaaattgaagaagtagttcttgaagctagaactattgagagaaacacgaaaccttataggaaggatgagaattcaatcaatggaacaccagatatcacagtagaaattagagaacatattcaggtatttgggactctcatcttactactgtgtttagcattttaagaacattagaactatttgttgaatggatttttttaatgtactttttttcaagcttaatgaaagtaaaattgttaaacaagctggagttgccacaaaagggcccaatgaatatattcaagaaatagaatttgaaaacttgtctccaggaagtgttattatattcaggtatgttaattgagctcaaactgttgactttacttatatttaaaatagtttgcatatcctgttaaatttgaataaattactcctaaaaattaaccactttttaattaacattttcagagttagtcttgatccacatgcacaagtcgctgttggaattcttygaaatcatctgacacaattcagtcctcactttaaatctggcagcctagctgttgacaatgcagatcctatattaaaaattccttttgcttcgtaagtatgccttgtttggtagagatttgccaccttaataagtaagttaccactagaytgaattaagcagttttaagggtcctctatatccttgctactcaaagtacggtccaaggaccagcartgtcagcatcacctgttgttaacattttaccctattgttttataatttgtgtgtgtacctgcatgtgtattctctctatagatatagatacacacatgcctacatgcatacataacacatgcatgcatctctgtatacacacacacacaatttctctgaagtatttgagactaagttgcatacctcataccctttaccacatcattttttaaaaatgtcaacatattattctactttatggctttaccataatttatttaaacaatttccatttttggacatctagattgcttctaattrttccctattatttatgtctttgtacattcatctttacatgaatccttagttattccctttctagatgtttctgcatactacagaagaatataggttttgaggtttagacctaggtttaactttagcttcattactgtcagtatgatcttggatctattgtttagaactttcatcatctcagtctcccatctggaaaattttgtaagaattaaataggataacacttataaaacacttaatacaatgcctggcacatagtaaatgctcatagtttgccatcattagtactagtataaatattttcagaaatggaagttttgggttagacgaggggtccccaacctctgggccacagactggtactggtccatggcctgttaggaaccaggccgcacagcaggaggtgagtggcaggtgagctttatctgtatttacagctgcaccccatcactcgcattaccacctgaactctgcctcctgtcagatcagtggctgcattagattctcatagggacgtgaaccctattgtgaactgtccctgcgagggatttagattgcatgctgcctatgagaatctaatgcctgatgatctgccactgtttgccatcacccccatatgggactgtctagttgcaggaaaacaagcttaggggtcccactgattccacattatggtgagttgtataattatttcagtatatattacaatgtaataatagtagaaataaagtacacaataaatgtaatgcacttgaatcatcccaaaaccacgcccctcacccccagtctgtgaaaaaatgtcttctgtgaaaccagtccctggtgccaaaaaggaccattgggttagactatatccatatatttgaggctgttaatacatactgccaaattttctccagaaagattataataattaatactttcagctctatccaagagtttccatcattascaatactgagtatatatyattataacgtagtgtttaagggcatggagtatagaaccagactaactggrtttgaattccawtgcagactcttattagctataagaagtaagacctggctgagtgcagtggctcactcctataatctcagcactttggtaggccaaggtgggaggattgcttgagcccaggagtccaagaccagcctgggcaacatagtgagaccctatctctacaaaacgttttaaaaaaattagctggaagttgtggcatgcacctgtggtcacagctgttcaggaagctgaggtaacagcatcagcatcagttgagcccaggaggtctaggctgcaatgagccatgattgtgccactgctctccagcctgggcaacagagcaagaccctgtctctagaaaaaaaaaaagagatctttgagaatttataatagacataattatagcacctttcttacagattacttgagtaaaacacaatagtttttgacacatagtgattgataagtgttagctgttactaatcaaactggtaaatataaaatagttaaaaataacatctcatgtaatttaaatattaagctaaattattttgttcattggccatttgtatttatttgttgaagtgttgttttatgtattaccccattttgctattgtgttcggctttctttgttgttttgtaagactttttattgttaaggatattaactcctaattcaaactattcttaataaagtagttgcattcttaaccaaaaaatctgtgatgaagcagctttgtgtttggatggactgcttgtaaaatgcatgttcctcctcagacmtgctcagattattttggagcaaggccaagaaatttgcagttttataagatccccaggtaatttttaggcaaggagtccactggctattgaaaaatattgtcctagaatggagttgatactgagacttctgagtgatttgactcaggcttgactcacaaactagctctggggagggaggctgatatggagagaacaaagcacagatgacaatgattttctaaattgagccagaactaaatgggaaaraaagatacacattcaagaggatatgtgttcacataaaatrgcagtcatgtaaaatgaaattacctgagcatctattatagaagcacaagaaaatacagtttcagctgtattcaggtgtggtcagttatacagtcttactgctaaccaaacaaagggaaatcaaggccatgatagtcttccctctgacagttatcaggaggcatcttaatctgagaaaaatcctggtttcttgaataaacaagctgaggggcagtgcaaccttagagaagagaaaggaagggacttggagagaaatatgaaggyagagagcatgtgatttcctaggcaattaactttgactttttattcctttagtcatcctctgataagtatttttagtatacaataactagcataaaaagttcttgatgtctcacttaggggaatataaaggagagaaatcagatgagaacacataaataaatgaaggaaggaaggaaaacactaagtccaaactagaaaggttaaaaaaacagatttataagataaaggatatagaagccaaaatattttcccagcatacttctaatcaatacaatttggtacttgattatttgcttggtttgggagtaatgtcgcttctaattgaattttttttcacaatttgtcctttaataattacttaaaatgtatgagtataatgtttatttgaatgctgagttcctaaaacatacactgctaagacattttatgattgtaattcagattttcttcttttgtttctattgacaacaagcgawacttcaatatatggttatctttattttccaattcttagtcttgcctccagattaactttggctgagctaaatcagatcctttaccgatgtgaatcagaagaaaaggaagatggtggagggtgctatgacataccaaactggtcagcccttaaatatgcmggtcttcaaggtaagcaaatrgaaggatagctgagctttgtgtttttcttttagggtcatctggtgtcttctttacagacatagatataggctcagagtatgcctacttgggttgcaattatggctctgcttctgctcattaattgacctttggcaagtaatataacctctttgtgtgccaatttctgcttctataaaatttgaataatattatctaatttagaaggtttttgtgaggattaatgagatcattcacataaaacactgaaaacaggatgtaacacaaagtaattacccagtaaattttacctagaaatactagttctatctctttccttaaggtctgtatagctctttatgtatacttggaccttgattaatgtttcttgacctggtttattatataataaacagaatattcttgtttgggccccaagtgggattaggttgtaaatataatccattcacctttttttaaatctaattggaaatatattttattgcatatttgttttatcctgtaaagagaacttacagtaaaacatacagtagttgtaagatgagttaaaggaattaagtatttatcagttttattcatctagttggtaatatttacttagatgtttaagaaatttgctttatcacacctgtattcctggttcatatagttttcacttatgccttttgttcaactctttatttctttctccatctaacctatctttaaggactaatttaattcttgcatctttcataaaaccttctttaactattgctttttacagtaatttctttgtcctccagacaccattgcatttattttctatacctcttacttggcccttgaaatatattgccttattttgatagttagtataatgatttttgtgaatctttatcattgtgattaagaaacaggctttaaaaccagatttcctgggttacattgactagttttataacctgaagtaaatgctctatggcttacttttccmctgcaaaatggtrcctaccacagggattatggttaggattaatgaattaatacatgtgaacagctcattagacgacacctaattcatactaagtaattggaaattgttagccttaaaaccacactaagtaggctgcacactttcagaaagaagaattaagttttatcttttttatgcttcttgtcttttagcttttatactttctgcaaaaccaagcacgtaagcggttctcaataaacttttttgagactttttggatttatgatctttttttctaaaatattctcatttttaatacaaaatgttttgtgctatgagtaagaaagaagtgtatgtgagccagacatggtggcttccacctgtaatctcatgctttgggaggccacagcaggaggatcacttgagcccaagagaggtttgaggctgcagtgaactatgatcatgccaatgccctccagcctgggtgacagagtgagactgtctcaaaaaataaataaatttatttatttaattaatttttaaaagatgtatgtatgttatcagatttgagtaattatctacttcattttcactctgagttgttaaactacttctagttcactacaaagaccaaayttgtgtgtgctctttttctagcctttgtctttcttatagttaagtttggttctttgctaattctccttatctttctaatgaaatgattcttcttatcttttctaaatagaattgcctttacctgtttattttttgctgctttataccaatcccttttccctctgattgtttaatattttcagcaggccacatatttccagcaggctgctaataagagcctcagattaaatcagatttaactactttgttgacctgtctttcccttaaacaaaatgtatttccctccttataatacrgtatatctagtcatgttggaatccaggaatccattttggatctgctcctttcatcctcagtatccaatcagtcattatgatttgtggattcttttccatgttctgttgggtacaccatatcctttttattaccacagttttcactctattctaggactaagtcctatatacaaaaccaactaaccaattttccaaatcttgttacctcatctacaaatcattccattccgttggtcatcatcagatctgtttctaaaacactgttttccttatgtccttccattattcaacagtgagaccaacatttaccgagcattatctgctgtccatgaaaatgcyagggcatatgtagaatattattttatagtcttgtttcccaacatctttatgttttaagctttcttccccagagaagattgtgagccccttgagggaaagaactttatcttaaatttatrtagtttttagtttctcaaaacatgctacatacctagtaaaattcatgcaattctaaatagataaataaatttagtctwaatgaagtcagtgatgccaatataatttttaaggtagcatcattgaaataataaaatctgggaaattctaatgcttctaattgaagactagaaggattaagaaaaaaaaaawatatatatatatacctcattttgatacttcacttagttctaagtacctcctgttaaattttaacaattccttccaaagcatgctttattcttattatctccataggtgttcttgctctttctgaaaccagttctatgacttccttaaatctagcctgaatactgatgaacccactacttttcaacatgaaaaaatacaggcttattacttttctttcttgagatgcttttgggcagggaagccatgccagttacccttgaatattataacattaaaatccaaaagaataagaccagtcccagaagttatgaatcctgaaaagctctttatatctcttgtgacagtagtccccttcagtatgcctttgtaacttggctcaagccagtattgtcatacttatctccaactgtattaagcagtgttgtggactgggtagcccttgtgtgtgcctctaataygtattcmccccaaatcactagaatagagactagcagaatagggactagaggatataggaacaaattgatgctaccaataatacagcrtgacatgtctctgaattttcaggtttaatgtctgtattggcagaaataagaccaaagaatgacttggggcatcctttttgtaataatttgagatstggagattggatgattgactatgtcagtaaccggcttatttcacgatcaggaactattgctgaagtaagtagagctatattatcgtcccaaaaaatcaaggacataataataaatattaccatgttatatataatatttacattgttttctaacctgaaccattttcctccttccttcatcatctttcagttrtaataaatggaaatcgggtttatagattactagataaagttgcacatttagatttacctctaaaaacacacctagtctgtacacataccaaattaacttwcaaatttattttaattacaggttggtaaatggttgcaggctatgttcttctacctgaagcagatcccacgttaccttatcccatgttactttgatgctatattaattggtgcatataccactcttctggatacagcatggaagcagatgtcaaggtatatccaacaaagcttgaataaatgggcatatctgtgttgaaactatatrcagagtcacttcatacatgttcttaaaaaaccmaaccataaagaattgtcatagaactgaaaaggcttgtaggtggatagtaaatttattagcatcctttagtctgtgtagcatacaaaaacaaacttgaatattataaaatctgttctaaaagctaataaaacatattgataagaatattgttttatattgtttctatgtattcactgacttattgagttaattgataaagtttctgaaatctacatgtacaawttttctaatttttcatcaattaggagaaaaaattccactattactatgaatgaaatttgcctttaatgatgaatttccctaaaatgaaaccacaaatttaagtgtactcgtgagagccaccaaattgattaggacataatttcacaagaacaaactttcatttctaccatttgttttacaaccatctgtggactgtaagccagctaaaataatgggtgaaatgaaagcagttttgaaatctaaccaaagttttaaaaatgttaagtaatattactattgttatagatttgtatagaaaaatcatttgaaggaaagaaaccaagtaaaataaaactgctaaaaattgtatttctacaagtaataaattcaatcacttttgttacagctttgttcagaatggttcaacctttgtgaaacacctttcattgggttcagttcaactgtgtggagtaggaaaattcccttccctgccaattctttcacctgccctaatggatgtaycttataggttaaatgagatcacaaaagaaaaggagcaatgttgtgtttctctagctgcaggtaaggaattatgtacaaggttaaaatatgtaaatcratagtattcgcggaagaaaagttataggaaaatgattattttttaaaagcttgtaatgctactcaagattttattttaccacttagtacatttcatagatattcactcataaaaataataaccatgcttactgtttaattataactgtgcaccaggcatttatgtgtgttttttatggctagctgattctycatgtttctattttttccaactcttgacattctgtgtttttttaaatcaaatttattttrctattctcttttctatattttcccccaattttaaaaaataaacccaatcttgtaattatcaagaggtcatgtaagggtccctataaattataaaacaaaacagatgttaaataattttcatcatgtgtctaattggaatcaaatgctttcaacatttgaataaatatcctttattccaactagatttaaaacctgaatcaagtaacaaattcaagtaagcaaaataggctaaaggacaggcttttgttttctttttaatacatttcaagcatatttctagaaagtacttagtatttgaggtgactgaagtttagaactttccaaactaaactgaaaaatatcaagttacaggaagaaagaaatagtattatctgtgtaattccctcttttacccttaaatttgcagctacttagaccagataaaaagacttagtgatacccaacaactaaaatgaaaattacctttccattaaaaatgttcatgaaacattcataaaacgttgtttaagttctataattgtgtttttagattttcatttgactgtttgatctcctggtacccgttgttccctcatgaatccatgcagatgctcatgaaactgaccttagccataggggcaaaggaaacattgatgtaaataacttggttttaaagcctactttttagaacccattacaaaaaatagtaatttcaacctttttgattgtgtactgctgttgttaaacatcttcaaaatatacactttaaacgatatactgatataaactgttacatctgacatacttctcaggtacgatataaaacaaataaaaactaaaaaattaagttgataaacaaatacaaatagaagtgtgatatttgctcctagcatcccaagggartgttttgcctattccatacttgtaaaaaataggactgtattcagatttgcagataggttttttggggttcattttaaactgattggggatgtcttcctttggttatagtattgcaacaacagcaattaaaaacaatggttcatacctgtaatcccaacactttggaaggctgaggcaggaggatcgtttggggcagggagttcaagaccagcctgaacaacatagcaagaccccatctttaccaaaaaaaaaaattaaaaattagccaggcatggtggtatgtacctgtagtcctagctactcaggaggctggggcaggaggatcccttgagccaaggagtttgaggctgcagtgagctatgatcacaccactgcactgcagcctgggtgacagaggagaccctgtctcaaaaaaaaaaaaaaatttgtagcctgttctaataattgacaaattagaaatcacttagaagatatggaatctattagttgtgtactcttagaggtcaaaaagttaatacaaacatttccatayatagtgctagagattttatagttttgactttttcacaaagacagaccgcatatatttttggatataccgattcagactcacctttgaatctacctgtattcatgtttcatacaaggaattaaatgggtcagagtaccaggaagtgtgtatggcacagagtgctatatatatgttagctgctgtcatcactatcatcaaaattaatatcatgtatatatcaaccatatataaaccatattaatcataaataaataatacacagtgtatttggggaaattttgtaccgtcattttggagacaacataggtaggaaaaaggtctaattcttatctttcttaatggaagaaactaacatctaattcccaataaacagaaacttaaattgtgaagtacactcaggaattgccaaaactttcttttatcttagtcaaattctttcacttttcgatctacattttaatatttgttttttatttcagtcatcaaatatttataggtatatattatatacagttacaattttcartgaatacatacttgttggtgaacaargtagatgaggtttctactcataggtcttatttcctactgggaagatatatgcattcaacagatagcaaacaagataattttcagatagcgttaagtgcttttaagatagttataagtgaatgctgtgtatattttatttgtcctcagtttcccctaaccaaaatatgtgttatatttatgctttggcataattttttttcttttgagacagagtttcgctctttttgcccaggctggagtacaatagcgtgatctcggctcactgcaacctccgcttcctgggttcaagcaattctcctgcctcagccacccaagcagctgggattacaggcacccactaccacgcctggctaattttttgtatttttagtggagatggggtttcaccatgttggccaggatggtctcgaattcctgaccttactgttttataagaaaccaaactcaatctttaagtaaaattttagattgcaccattaatcatactattttatcttgtatataaaacctccaattacctagaatgaaggatttaatgtgccagataacttgaagtgacaagtaaaattgtacatattgtgtacagaatataacacttttaagttgttttaaattagtgggaaatttgataatgttgactcaagtgctcaaatgttgactccatatacttaattaggtatcattaaggtaataatttcatgtttaggtttatttattgtccttaagttcaaggtagagtctttttaaatatataattaatatttagtgtttatgtgttaaatatttgatctctgattttactctttagatttaatttataaaagaaagtttggccaggtacagtggctcctgcctgtaatcctagcactttgggaaagcaagttgggcagatcacttgagctcaggagttcaagaccagcctaggcaacctggcaaaacctcattctctacaaaaaatacaaaaactagccaggcatggtggtgtctacctgtagtctcagctacttgggaggctgaggtgggaggatggcttgagcctgggaggtggaggttacagtgacgcaagactgtgccactgcactccagcctggacaacagagccagaccctctctcagaaagaagaaaagtttatctgtgtattcacacctcaatttagataagtatctctctatagctctggttcttaatcttctttaggtcataggttcctttaggaatctgacaagataatggaatctcatttgacagaagttaacataagtatagacatacattttgcaaataattttagagggttttagaggatttgcaggtgcctgccttgtaccccaggtttagagtaactgttctatagtaatggagttcataggtttgtgtgtattattatgattaacatattactttrttgtgttttttttgttaggcttacctcatttttcttctggtattttccgctgctggggaagggatacttttattgcacttagaggtatactgctgattactrgacgctatgtagaagccaggtaggagagcctctaaagtgttgtactgcgagtttatgtctgaatgtcttttacatgctcttcaaactttccttcttgtccatcttttcttaacatttgggagctgtattttctttaggtagtttttattttatttttgtatgttcacttaataggatcataaaatttcaaaggggtgaaaatctttgaagtcactaagttctagtccttcatattacaagtcaggttatctttarcattagctaatttatttcaacaaaactaaaaatgttataacctttttatgccttccatagtgaaggcattgctagttctttgtctgagtcttgtagaagtcttgatgtttccctctatttgttgtcaagccttgtaacctccagttttatgttttctagacttaaaatggttttttttgtttttgttttttgttttttgtttttgagacagagtctcgcactgtcgtccgggctggagtgcagcggcacagtctyggctcactgcaacctccgactccgcctcccgggttgaagccattctgctgcctcagcctcctgagtagctgagattacaggcgcccgccaccacgcccagctaatttttgtatttctagtagagacggggtttcaccgtgttggtcaggctggtcttgaactcccgaccttgtgatttgcctgcctcggcctcccgaagtgctgggattacaggcgtgagccaccgtgcccggccgtaaaatggtattttttttaatgtcacaataatatgaatgaacttattggaggtcgaaaggaaagcactacagcagtgccactcaaaatgcattccacacatcagtagtgtcaccctcacctgagagcttgttagaaatgcagattcttggaccctatgccaaacctcccaaatccaaacctggacatagagagagtagggttggtgggcagaaatctgtgttttcacaaggtctctggatgattatcaacagtctaaggctgaagtttgaaagcactgctctaaaagataaaactttcagcaaaagggcatttatacgataccttgttttgatgccatcaggaaaataactgaagtttgcrtctttacatgccaaaattttatttttgatacttttaaaactgaagtttttaggtgggcatctgaaatgaattgcatttttgttaatccgatatatagtaagacctttttgtattaccattatggagctatagaaatttaggaagctgtttgcttcttccctaaatgctcctgaattactgatttagaagaaggaaatggaacatcagcattcagcatagtatagtggttaagaacttcggctttacaccagactgccagcttctaatcctggttccaaactaccaactgacaaattaccttactgggtacttgggaggatcaaatgaacacatacagttaaggtgcctagagtaatatctgccacatgcctagagtaatatctgccacatgctaaacagttcataaatgttagtttttatcattattaatgtttaggctcccaattatcacctctatgcaatatcacaaatttgtgctgcttaattttacatagaactgtctagattattggttagcaaactgtggcctatcacctgttttgtatggcctatgagcaaagaatagcttttacctttttttttttttttgagacggagtcttgctctgtcactcaggctggagtgcagtggcgcaatctccgctcactgcaagctccgcctcccgggttcatgccattcttctgcctcagcctcctgagtagctgggactacaggcgcccgccaccacacccggctaattttttgtatttttagtagagaccgggtttcaccatgttagccaggatggtctcgatatcctgaccttatgatccgcctgcctcatcctcccaaagtgctgggattacaggcgtgagccactgcgccctaccagaatagcttttacctttttctttttaaagggtcatttaaaagaagaaagcatgtgcaacagaattcatatatgtcccacaaagcctaaaatacttagtatatggccctttatagaaaaggtttgcctaccccgatctagaggtgattcccagagaataatatattatcccagagggtatttgttagggtagtgctagctgccataaattataaacacttaaaatcttaatggcttttcacaaataaaatttatttcttgcttgtagtcgtagacgcatgctcagtaagcagccttctayatactgattcagggaagcaggtttcttccagcttgaggatctgtcagtttccatggcttctggggcctctccaggaggcaagcagagagggaaagagagctgggggaacacacctattctccatacacttaacatgcatcagttctggccacaaccaactgtaagattggttgtgaattgtaggaaattcgttttagtggacatatacctctaccacagatggttctacttcctccctctatagaggtaatcatgaatcagaagtcgttttattaaaatgtacaagattgttccagatggttaagattgctagcactatggccaggcatggtggctcacaactgtaatcagcactttgggagcctgaggcgggcagattgcttgagtccacaagttcaagaccagcctgggcaacagggtctcttaaaaaaacaaatatatatgtatatatagagagagctagtattctgaccttttcttaattgaaagtgtcactgtctatactaatatttttatactttgtaaataaaaagtttcccattgcattactgttgaaaagatgggcattaagcttagacatagaattaataaaaatttctgagtggtttagccaaaaagcagtaagacctagacattttaaataacatttccaaggccacacagatggcaaagctaggatttagacttcagccttcttatttcttaatttcatgctgtttctagagtgcctttctgtcttacaaacaaaattttcatttggtatataatagtaaaataatgctttaaaaaattaactgtcttcaaccagtttttaaactggttgaattatgtttttcaaggtcagcttctaccagtttgttttctttctctctctctctctctctttctctctctytttctctctctctctctttccctccctccctccctccctctctccttccttccttcctttctttctttccttctttctttcttttctttcttttttttgagactgagtctcgctctgccatccaggctggagtgccgtggcgcaatctccgctcactgcaagctccgcctccctggttcacgccgttctcctgcctcagcctcctgagtagctgggattacaggtgcctgccactacgcccggctaattttttgtgtttttagtagagacggggtttcaccgtgttagtcaggatggtctcgatctcctgacctcgtgatctacccgcctcagcctcccaaagtgctaggattacaggcctgagccaccacgcccggccttctttcttttctttcttctttttttttttgatagagtcttgctctgttgcccagactggagtacactggcacaatctcagctcactgcaacctctgcctcctgggttcaggcaattctcttgcctaagccttctgagtagctgggactacaggcacgcaccaccattcctggcttatttttgtatttttagtagagacagcgtttcaccatgttgaccaggctggtctcaaactcctgacctcaggtgttccgcccgcctcggcctcccaaaatgctgagattacaggtgtgagccactatgcccagccagtttgttttcytatatgtttgttttactcttggtttctgctatttaaaataattaagttcttrtttaatagttacttcgattttgaaataccatagacttcaaaagtagaatctggagctatgagggaccttaaaaatcacccagtccaatctcaaatgaaaaaactgtatcagagagggagtcacacagattgttagcataaaattctagtctagaatcaaggttcctgactttaattcagtacttactctatcatactatgactactttctacatgaaaatataaagaaatagggcaagagagaaaacgcattcaaaatatagtcaccaaaagtgactggtttttgtcttcartttttaagtgtttgttttcatttctgatccacttaattctgttgttttaggaatattattttagcatttgcgggtaccctgaggcatggtctcattcctaatctactgggtgaaggaawttatgccagatasaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggtaaagatatttcttaaaatgtttttttgttttttkttttttttctgaaaaatgacttttagtttctaatgtaaaaataagggtaattaagaatccaaatcttacgaattattcaaatgtcagtattgatttggcacctgctggtactataagtgattggtctttgcctgaagaactttgcaacatggtagaagagatgatgatgtgtacataaatatggccattgcaatagattgtagaggaagtgttgtgtagtctcttaaaagagagagaaggtccagtaggtaggtctcagggagaacgttagaaagtagctaaagtttcacctaaatgagccataaaaggtgagtaggactttcggagagatggagaaagttgttgggagacattagagttgaaaagaagccaggtgtatggcacacacctgtaatctcagcttctcaggaggctgaggcagaaggatcacttgaggccaggagtatgagtccagcctaggcaacatagcaaaactcagtctctttaaaaaaaaaaaaaaaaaaaaaaagaggaaaggaataatagggttgcatagtggattgaagcacagtttaggggacatagtacttaatagtgtttttgtaagagcctaggctcttataaaatacgttttgtgaaaaagtcaatatggtttggctttttgtgtaggatacctgcagggtagtaagagattatggaaagggtgagccaggttatggagagccttgactaccaatccagggagcttaaagattatcttatgaacagtgaagaatggatagacatttttgagtgtttttttttccctaatcaagaatggacaataatactatacttttgccacttctgatctgcctttatgttaatagtttgttatatatgattgggggggctgggaggggatagtagctttgtaagctactccagggttagcatatatttgtgtyctcatgatatttatttatatcatgaagtactcaacatttgtccaaaatttttttatttgtcctctgttatcaactgacatttctgttacaatgaatataggttcatgctatcaggcaggtaattattttacacataactttgttttctcacagtttatccaaaaatattcacagcattataatttttataattaatagtagaatttttatattatagagttttggttatattcagagtctttaaaatgaaacataataaacatgtaaggactctaaacattttgcttctatttaacattctttaccttatttttaaaaatataattgtatattttcccaaatgtcatcctgagtatcacatttattatttatatgggtaaagaaaatgacttatgaattctttacattcactggggtattttccaaagtcattatggatcctcaaatttgagagtttccctttagctcataatttacccccattacctgtgtatgcagatgagtaaaaatarcaatgccaatttaaaattcagatgctggataacaagctaggttcgtttattagctgaagagatcactctgatagaaactgtagaagctcactagatttgtttttgtgtatcagcagattattttatgtcacagacatgaatagtcaaaactactgatgttaaatatttgtatgctcgtctgtattatttggtatataggagctgcttcttccctggcctcaccccaattcctatttctcacttcaaaggaaagtatatattttcacattacttcagttgtcggatttgggggaaaataagaaaaatgtaatttctaacagaggtaacacccattatgtctcaaacaggatcagccattgtttgaagtcatacaggaarcaatgcaaaaacacatgcagggcatacagttcygagaaaggaatgctggtccccagatagatcgaaacatgaaggacgaaggtacagaactttaactaaaatagtacaaattyatcaaggtgatgaaattaaaccttgcaattgttcacttagtaaatatttgtgtgccaaacctcacgatataatgattaaaaagattaacatagttcctgatctcaccaagtttttagtttctagcagaaaaataaaattttatatcttttgtcagccagtttgaaagataattttggtggtttcatttataactataataatcgccatgaactgcatgcttactattgctaggcattgtggtaactactttacctatrttattaccatttaacactccccaaaacattgagaatgagtgatattgtttccattttttttaattattatactttaaattctagggtacaggtgcacaacgtgcaggtttgttacatatgtatacatgtgccatgttggtgtgctgcacccattaactcatcatttacataggtatatctcctaatgctatccctcccccatccccccactccacaacaggccccagtatgtgatattccccttcccgtgtccaagtattctcattgttcagttcccatctatgagtgagaacatgcggtgtctggatttttgtccttgcgatagtttgctgagaatgatggtttccagcttcatccatgtccctacaaaggacatgaactcatccttttttatggctgcatagtattccatggtgtatatgtgacacattttcttaatccagtctatcattgatggacatttgggttggttccaagtctttgctattgtgaatactgctgcaatgaacatacgtgtgcatgtgtctttatagcagcatgatttataatcctttgggtatatacccagtaatgggattgctgggtcaaatggtatttctagttctagatccctgaggaatcgccacactgacttccacaatggttgaactagttaacagtccccccaacagtgtaaaagtgttcctatttctccacatcctctccagcacctgttgtttcctgactttttaatgatygccattctaactggtgtgagatggtatctcattgtggttttgatttgcatttctctgatggccagtgatgatgagcattttttcatgtgtctgttggctgcatagatgtctttgcccactttttgatggggttgtttgtttttttcttgtaaatttgcttgagttctttgtagattctggataactgaagcagagtagcttgcccagagtcacatagctactaagtggtagaggtagactttactcatggtctatcttgagagcctaggcacttacaaaatactttttgtagaaaggtttatttgtatatggtattaaaataaatgtgcttttctaacttctcttgagttcaccatattcgtcatctcatggcacactatcatcgccgccaatgcaaggctaatagtaatttatttcattttattccccattccccttagtcattccaatgtgtttattatatatttattttgtaaaacatgcattgttttatgttcatgtgggttttttaaactttgtaattttgaaagattagactcacaagaagttgaaaaaatgatacatagtatgccatgaactcttcacccagtacagcatcagagtcaggagattgacattagtatgttttcaacttttaaaagtttttacattcacttgtgtgtatatgtgtatgtgtagatccgtgcaatttgaccccatgtatagcttcatgtagccactgccataatcaagatacagaactggtccatcaccataaagatctttgtgtacccttttatggtcacacctgaccactccacccccaaccctggtctctctggcagctactaatctgttctgcaactctatagttttgtcattttgagaatgttatatgaatgaaaccatgttctatataaccttctgagattgattttttcactgtgcataatgcccttaagatccatccaagttgttgcatttatcaatagtttattcctttttattgctgagtagtattcccttttatgcatataccagtatttatttaaccattcatccaaaccattcatccattgaaggacatttgggttgttttcatgttttggctaatacgagtaaagctactrtgaacattcatgtacaagtttttgtgtgacacataagttttcattttttctgggataaatgtccaagaatgggattggttcatatagtaagtatatgttttgttttagaagaaactgccaaactattttccagagtgttttaccattttaataaattcccgccagcaaactggagagatccagttttgctacatcttgccagcatttggtggtacccctttcttttaagctgttcagatagcttcatagaccactacaaactgtgtgtggtgggggggtgggtctgagatggagtcttgctctgtcccccagctggagtgcagtggcgcaatctcagctcactgcamtctctgcctcctgggttcaaacgattcttgtacctcagcctcccaagtagctggactacaggtgcatgccaccacaactagctaattttttgtatttgttgttgttgttgttgttgttgttgttgttgttgttttagtagagatgaggcttcgccatgttttggccaggctggacattgtggttttaatttgcatttccctaatggctaatggtatggaatatcttttcatgtgctcattkgccatccatcttycctctttgctgaaatgtcggttcacgtattttgcacattgtctctttctttattattttttagagacagggtcccactctgtcactgagactggatggcagtggtgcatcatagctcactcaacttctaattcctgggtttaagcagtcctcctgcctcagactgccaagtagctgagactacacgtgtgcaccactgaaccaggctaatttctttttttaatttttttgtagaggtgggagtctccctatgttccccaggcttgtcttgaattcctgacctcaagcaatcctcttgcctcagcttcctaaagtgctgggattacagggatgagccactgagctcaatctcttttgtccgttttataattgtataattggagtgctgttttttgttttgttttgttttgtttttactattggttttttttattgtggtaaaatagacataatgtatatttaccattttaccataaaagttacaattttagccattttaagtgtacaattcagtggctttaagtacaatcacattgttgtgcaaccatcatcactgtccatctccagaactttgtcatcattcctaattgaagcaggaactcctcattatctccttccccagcccctggaaccactatcctactttctgcctctataaattcarttatcctagggacctcatataagcggaatcatacagtctttgcccttttgtacctggcttatttcacttagcataattattttttatcaatacataagagttgtacatacttagcataattcttttgaagttcagccatgttgtagcagatgtcataattttattcctttttttgtcttttttgtgataaaaagcatgtaacgttaaatttaccttagccattttcaagtgtacagttcagtagtgttaagtatattaacattgttgtggaacagatctctagaacttttttaccttgcaaaacaaactctatactcgtgaaacactagttcttcctcctctatccccactcttcccaggccttagtaaccacctgtctgctttctgtccctgtgattttgactactttagatacttcatatgagtgaaatcatgcagtatttgttcttttgtgactgattttttccacttagcataatgccaaggttcatycatctcatagcatgtgacaggattcccttctttttcaaggctgcataatattccattgtatgcatacattttctttattcattcattgtcagtgggcattttattgcttccatctcttggctcttgagaataatgctgcagttaacatgtgtatgcaaatatctcttcaggatcctgctttcatttttatgtatatatacccaaagtggaatgctagattgtatgttaattctatttctaattttttgagaaacttctataatattctccataatggctgcaacatttacattcccacaactattcaaatttctctgcaactttgctaacacctggtattttctgttcttttgatagttaccatcctaatgggtgtgaggtgatatcccattctggttttgatttgcatttccctaatgattagaagtgttaaccatctttttatatgtttgtttgccaattatgggtcttctttggagaattgtctattgaagccctttgcccattttttaattggtttttgattttttggttattgacttgtagaagtttcttatatattctggatattaaccccttatcatacatatgagaatttcatttctttttaaggctraataatattccattgtatgtatataccacattttgtgtttccattcatttgtcaatggacatttgggttttttccaccttttggctattgggaataatgctgctgtgaacatgggtgtacaaatatcagtttgagtccctgctttcaattcttttgggtatctacctagaagagaacttgctggatcatatgataattgtttgttgacctttttgagtaactaccgtactgtcttccacagtggctgtgccattttacactcttactaatagtaaacaggcttccattcatctatatcctcaccaatacttgtttttttctgtktttgtttttttggattttgtttttgttgttttggtttttgtttttgktcgtttgtttttgttttttkttttttttgctagtagccatcctaaatggctatgaggtggtatctaatggttttgatttgcatttccttaatgatttcttagtgatgttgagcatctcttcatgtgcttgcaggcatacatatatcttctttggagaaatgtctattcacatcctttgaatttagggaatgaattgagttcttttgttattgaggtgcagggtgctttgtatattctggatacgaaacacttattagatatggtttgcaaatattttctcccatattgtgggttgtctattcactatcttaaaagtatcctttgataaacaaaagtttctgattttgattaagtccaatttatctacttttrttacctgtgcctattgtatcatatgcaaaaaagcctcatcaaattcaatgtcatgaagcttttgccatacatttttgtctaagaattttatagttttaactcttgtgtttaggtctttgatccatattgagttaatttttgcatatgatattaagtccaagtccattttttttttttgcatgtgaatatccagtttactcagctccatttgccaaaaaaaatataaactgtcccttccccaatgaatggtcttggcacccttgtcaaaaaaaatttgactgcatatacagggtttatttctgggttctctgttccataggcctctgtgtctgtctttatgacagaaccacactgttttggttagtgtagctttgtagtaagttttgaaatgaggaagcatgagtcttctaactttgttctttttctagattgttttggctattcaaggtccctggagattccatatttattttaagatggaattttctatttctacaaagcatcattctctttggagcatttttatgatacctcccttaagcttttctgtcagatacttccaacatctgagtcacctcagtgttgtcacctgttaattgccttttctcattcaggttgcgattttcctggttcttggcctgacaagtagtttttcgtgttttcctagacctttggatgttataggacactggatcctatgaaatctttcattttaccaagtagccgttatttaagtttagtatgcagcttctggcctactcttgtgggctgtggtttcagtaacaatttaatatttagcaaggttattctggtctacttcattcatgggctatcaggaggccactcaggaaacctgagtggaattccacactgtgtaatttacttctcaaacctttgggtgtgttaatgctcatctgtttcacatgtagattggtcagagcctgcccaggacttcctatacagctttaaagcgtggttttccagcttcctcctcttcagatcttccctgaaatctctagttgggagtgtgaggggcaccccatcactgctgggcagggcatggaaatccggactctccactcagtctctgctgacagcatgctgtcaggagaggggagcactgtccctaacgacctgcttccactgggggtggaagtctatactccccacccagtttgtgctaacatcatgcagcaggggtgggaaacaccctgagctgcctgctgccaccccaaggccacctactactgccaggttgggtgtggaagttcatactccccagattcccctcgtggtgcccgcaggtaccacgctgctgaggaaggggarcactgccttaagccatctgctacccccaggtaggggataggagtccaggcttccactcagtctccactgacattccagggagaaaggacatccatggtgtttactggcacagggcggatgttgtcacaaaagtttctgtctgggtagggtccctctttccttttcctttggctagagtcaattggtttttcttggaactctttgtcattacctgttggaggttgcaggttgcttttccaagtttacatctcacccagactggtatatatggagaattttaaaaaaagaaaaaaaaaaccagggaactcaccactatgacattcctcaagtcttgaggttcctagccaatctgccttcctctttacactttttgagtcctcttatgatagtccactgtattatgctcagggattttcattgtacttaagagaggaagatcagggaaaaatgagtcttctcccctttttcataccagaagtttttgaactttctgtagttatgtgtgtttgagtatgtgtaaattacttatgctatatattacatagcatatattcagtgtactataatatatactataatcaataatttatgttttgagattatacacagatattagatataccagtattatctatgattaaacttttacraaaaagttatcttactatatatgtccttttgcaacttgttttattcaatcattttgttttggagatttatcttttttatataaatttaaggggtacaagggcagttttgttgcatggatatattgggtaagggtgaagtctgggcttttagtgtaaccatcagcaaaataatgtacattgtacccattaagtaatttctcatctgtcactctcatctcacccttctgagtctctggtatctattattccacactctatgtccatgtacatacattatttagctccattttgatacatgtaaatccagttcattaatttcaaatggtatagagggtttcccattgtatgaataaactacagtgtttatccattcctctattgagcagttattttttgtgaatgcaagcaatgtggcagtgaatatccttgtacacatctccatgtgcacataagtaagggtttctctagaatatatatagaaatgaaattcctatgtggtagaatatacacatctccaactttgtgcttgtatattctggatacaaaataataagataccaccaaactgagctttagagtggttgtcctagtttattatatttaaaattttgtaaatgttttaaaatatttgtatatactatatataatacttataaaattttattttatacacattttgttttttaggttttaatataactgcaggagttgatgaagaaacaggatttgtttatggaggaaatcgtttcaattgtggcacatggatggataaaatgggagaaagtgacagagctagaaacagaggaatcccagccacaccaaggtagtgtaaatgttataatgctgtgtaattatacccttctttaaraaagcacwtacttgtggaatcttttattctgttaactatgaactctttacattaagtcaatcaaaatttccctgccttcttcccttcatctccccattatacatttacacaatcctgttgatataagttatcaagtaacactatctgttcttttctgtaagtgctcgtgggttgattctctacaagcacctcaaaggaaagatttatgattcattatcccagtggttaagacattttcgtaacctgaactgcttattgatgtaaacatttcattatgcccatcttttgcaaacatagaaaacaaccagttgttctgtcttttatgcaattctttcactttctgaaccttttttcctaatttttaaatcttttttcctaatgtttgtcatttaagaagtttttatcatttcaaatgctaaatacatcatcataagctattaaaatcacttttaatattactatcacccaaataacgtactttgtacccattaagtaatgtctattaaaatagcttctgatactgtattaagctgagaagttattttcttattctaatttttttttttgaaagagagagcctcactctgttgcccagcctgtagtgcagtagcacaatcatggctcactgcagcctctgtctcccagattcaagcaattctcctgtctcagcctcccaagtacctggggactacaggcgcacactaccagacaggctaatttttgtatttttagtgaagacgaggtttcaccatgttggccaggctgatctcaaatttttggccttaaatgatccacccacctcagcctcccaaagtgctgggattacagaaatgagccactgcactcggccttttattctaaattttatcttcagtaagaattgtccaaaaaatagttgtgtactgggtgtggtagctgacgtctgtaatctcaacactttgggaggttgggaggttgaggtgggaggatagcttgaacccaggagtttgaaaccagcttgggcaacatagtgaggccccatctctacaaaaaataattaataaataagttgccatctttacatgctttaccagttttttaaaaatctatttggtacattagatccttgtacttcccttttatttttcttaaaaatgagctttcaaattaatgtgtctgccttccctcactttctccagccctatttttcatgtttgctatcttttctctagtaccttatcccaatattcagattccttactcctaccttttccaactgccatcttcttttattccacaattcccattctacatcatagaattttttaaaattatgtgaggatgatagacaatggcaaaacygtgagaggaaaaaatctttacatgatatagtacacattcctatagagtaaggattttttaatagttttcataatatgttatatgattcattacaattgtttaccgaatgccctttaaatagtacttaaaggacgccaacttaaagaataaaaatacgttttttaattttagagatgggtctgcygtggaaattgtgggcctgagtaaatctgctgttcgctggttgctggaattatccaaaaaaaatattttcccttatcatgaagtcacagtaaaaagacatggtaagctggttattttatttacaaagaaccttcaaatgtactatgtatattctcaacctatgtaatcatcatttgattctatcagctaatatcggaaaacccttaaaattaagaagaaagaaaattcattaatttactagtgtgaaaattgtaacaattctagttgaaccatatttgtcgcaactttgaactgagataagaaagcagcatagctgttgcctttattgtgcatgtctttttcctcactgtgactgagcaagttgcatttctgtgagcaattttgcaatctttacwtgtctttttctagaatagtgctgtccaaaataatgtgaaccacatacataattttaaattttatagtacccacattttaaaaagtaaaaagaagcaggtgaaattgattacaagatattttattaaatcagccaggtgcagtggctcatgcctgtaatctccacactttggggggccaaggcaggcagatcgcttgagctcaggagtttgagaccatcctgggcaacatgaaaacccatgtctacaagaaatacaaaaattagtagggtgtggttatgtgagcytgtagtcccagctacttgagaggctgaggtgggaggatggcttgagcccaggaagcggaggttgcggtgagccaagttcatactactgcactccagcttgggtggacaataccagacgctgtcttaaaaaaaaaaaaagacattttatttaactcagtgtatgtatataagatattgtttcaacatgtaatcaatataaaattattcatgagctattttacattctttttgggtggtgctacatcttcataatccagcttatattttacatttataacacatctcaattcagactggccacattttccaaaagtggataatttattgccttgtagtagataaaaataaactaaatattactatttgtctgtaactagatgtgtgaattgttttgaatgattaaaactaccatgtcttatgtcatttttcaggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggtaggtgattcgtttgtaaaaacatttcaaaaaatgatgtgctagagtttgcttagttccttattcccatttgttttcaaattcacttcattgctaaaaagtagtatattgcttactagctagttttaaatagtctttcctaattaatcaagtattatgcgtatcacttttaacctgtaacattcagtatccaaaagccgaaagtaatagatgatgactaatgaagtgcttcctagagtttttcacattcagagcacacatagaagatgttatttgtggccagatgcagtggctcacacacttggcggactgaggcaggaggatcacttcagcccaggagtttgagaccagcctggatatcataatgaagccccaccaccatatttgaaaaraaaagaaaagaaaatgatatttgtatagcacaataggttacatggagtaggctgcttgtgctagatccaactacttcagttagccccaggccccacccagctaccctgaaagctgagggtctctgtatcctacacacctgtgctataaccagtgcctcagcacactagttggaaagccctgaactagtgaactaaagtggatagctttagttaacattctgttttcattgttgcattgctgcaatcagtttgtccggcaaagaattttagactctctgctgttttaaatctatactttagtctaaaaataaactacaaggaagtaaaatagagaaggtatgtgttcttctrtgcctggctagctgttttcacgttgtcaaaaagagtaccaaacctactactataaattatagtagaatgaaaagtgtaaaagtacacaaaggtagctttggttcagcgtggaccattaaaattaatgcatattcttggtcaacaatgcttttctcttctttctctgtatctctgataaatttactcatgctattggagtaaaagttctgtgttwatttatggccccagaagcaaacaatgggtatcagatgtacttaaagaaagctattatgaatctgctgaagaatgagttacataaatttaagtgtgtgctgtctgggttcagtggctcacacctgtaattccaacactttgggaggctgaggttggaggatcatttgagctcaggagttcaagatcagcctgggcaacatagtgagacttcatctccacaaaaatttaaaaaaaaattagccatttgtggtggtacacacctgtagtcccagctgctcaagaggctaaggcaggatgatcgcttgagcccaggagattgaggctgcactgagctctgatctcgccactgcaccccagcctggtgacagagygagaccctgtctccaaaggggttaaaataaaagtgtgttctgccttcagtgtagctgtggcaacttccttttggagctgagtaactttcttgaggtgacacagagaaataatcacctctaaaggctttcctaacttctacggccaaaaacagtccttctaagtcagcctcataggattagatctgtttaggcatctacactcaaattctgaccctcatggtattttaagtaatttttttcaagcttatgaatagtttctgtgggtaggaactaattcttctgtgatcttaaaaatttgtatatttgtttttggcattcactaggcccctgagctctttactacagaaaaagcatggaaagctttggagattgcagaaaaaaaattgcttggtccccttggcatgaaaactttagatccagagtaagttggaatataagtattaagaatgttatcatatttaatccaaatacattgacatcaaccataatttttttttttttgccagggcaacaaaaggagatgccatctctacaaaaataaaagttaaaaaaaaaattagttgggagagattgtgtacacctgtagtcctagctactcaggaggctaaggcaggagtatcacttgagcccaggagatcaaggctgtagtgagctatgatggcaccactgcactccagcctgcytgacagaatgagacactgtattaaaacacacacacacacacgcacacacacaccaaaactcacaattaaagctgactcttgtgaccagctctccaaaaaaagaaaagtaacaaatggagtatagataactgtgttataagttccatgtattacaataaagcaatatgtatattcagttgctatttgtaatccgataataggccaattttaattttaaaataattttatggagaagcttaaaaatcacctttccaatctataattaataaaaccatgtctttaatttttattaattcaaattattctatatatatttcaattattagataggcttcaatatattagaggcctaggaaatagttgactttaaaccaagccatatttagtgccaggctaacttctttaaggcaagataccagaatattttacattttttatattaaccagtatttgttaatcatttttaacacatgattaaagtcctgtgaactcagtatgtactaatttaagkttagatggatgatgtactaatgccgagcttattctgtagaagacaaaataattrattatttctcttacctttgttattgaaatttttctaatgctttttacataatatctgatcatcttttatttaacttaaatttcaatcattttgcagtgatatggtttactgtggaatttatgacaatgcattagacaatgacaactacaatcttgctaaaggtttcaattatcaccaasgacctgtaagaatttcatttatcttctgagtttcagtttaaattatttttcaagtaatttttaggtatttatggttttttttgtcttttaaataatcttttttaggagtggctgtggcctattgggtattttcttcgtgcaaaattatatttttccagattgatgggcccggagactactgcaaagactatagttttggttaaaaatgttctttcccgacattatgttcatcttgagaggtaagtcatcaggagcatgtaatttccataactagtgtttagtcagtttattagctattaggtaaattacagtttcttagaattgatttctgtatgccctaggtatcccaatgaaaagtgaagcctttattctttaacatgacaaattctgttatataattttcactttctcttattttgggttgttatttattttaagttgaggtcttgatattgtgcgatttatacatgtggaatagtctttgatttttaaaatttccctgatgtttttggatgtggttagcacaggataaatataaaaactgaaggtactcagcctgggccttttgagttaattgatttaaagatatatcaagaaatagttttcagaaatgctttcattatagttaaaatatcagaactggtcttttgcctgttagttcaaaaaacatttttcacttccttgtcctaattattagcaaatagacagtgtcagagttacgtatctttataagagtataaattcagagtgtatcttaattcctcaaattttagattatacctaagtatatctatattctattcctcagataatgaataaacagcacaaattttatctcctttcttacaagcacataagggacttctgcgtgtttcatattaatagagccactcctggtctgttttgtttggttgtcaccatggtacagattttaccatccttttaagctatttatgtctttgtatttaaagtggctttcttgtacatagtagcatgtaatcgggccttgctctcgtgtagcacaacagtttctgcttttggaatatttagaccatttacacttaaggtctgaaattgtgaaatttaaatgtttgttgtctgtttattctgtctgttctttgttagctttttcctctttttgtgcttcttttgcattgaatatttattatttcattttaatctcctttgttggctaattagatgtaattcttgtttatttaaaatggctgctttaggtttatagtatatgtctttatagtttaccttccagtgatataccacttcaagtaaggtataaagatccttaaaatagtatagttttatttttcccctcccggcctgtgtgctatcatcatcatccattttgcttttacctgttattaccccccacactacatggttactacatttgtttaggcagtcagttatgttttaatgatctttaaataatatattaaaaagtctaattactcttatagttgccattttcagtgctcttcatatgtttgtgatgttctgtatctccatcttgtatcattttccttctacccgaaggactttctccatcatgtcttgtagtgtttgcctcctcatgatgaattctttcaattcttataagtgtaaaacatctgtgttttgcctttattttaaagatattttcactatgtatagaattcaaagttaagcttttttctctttcatactttaaggtggttacattgttttgataagaaatctgcatcatttttatgtctaacctaccatcacatccatgctggtgtttttcatttcaacgttgtagttttcatttctcaaagttttatctgggctgtttttatatcttccatgtctctgcttaatgttttgaacatgtggaatatgattacagtgactcttttaatatccttgtctgctaattcatttctgggttgcttttgcttgtgattgttctctttattttgggtcatatcaccctgcttctttgcttggtagtttttgttttttgatttttggagcgacaggggtcttgctatcttgcccaggctggtctcgaactcctaggctcaagcagtcccccaacctcggcctcctgaagtgctgagattacaggcatgagccaccacacccagccatttgcctggttattttttattagataccagatgtgaattttaccttgttgggtgctagatttttggtgtttctgtaaatgtttttgagctttgttttggaatgcagtgaaattacttggaaacagtttgatcctttctggtcttgattttaagcttgttagacctgaccagaatagcatttggtctaggaataattattctccattagtgaatcaagacccrtctgtgttccctaccctgtatttcgaaaattatgacgttttcaaatctggctggtgggaacaagcaagtgttcctgacgctgtatgagtgccacatactgcttcttctcatccttttggatggttctttccttgttctttggtagtttcctcttgtgaatttgctggttggtacactacagatacttgagtgggaccctctgcatatcttcagagttctctctttgtacagctccttcctctctagtactctatcctgcaaattgtagctgctttgtagtgttcctggattctcagttcaactcaaggaagtctgccaggctccacctgtgttccccctctctgtgccaaatcctggaaactctcaaggcagtaaggtatggtaatcatagggtttgcttcatttgtttctcatccttcaaggatcgctatttgttgcctaatgtctaatgtcttaatgtccagttcttcagttgtatcagacaggagggaaattctgtccatactacttcctgtttgtcacatatggaagtccttccttgctttctggcccagcaaggttttcaacactcatctttcactttcactaccccagcctggaattgggcaattctctaaggatcccttgttctttatagtgaaaaatgttatttagaagccagatctgagcacatggtgtatttattattactatgacccccagtagatagggctagggaatatataataatacataaacataagtaaatacatacacacttatcttcatctcaatgtatcctgtctatgtgtgttgaaaacctgagtttacaccagttccaagctatttctcagtgtttaattctatttttctccctttctatatttgtaattcccttttccaacaatgaataacctacttcccacaytgggccatcaccaccacatagagtctgctcacccagcttgggcctgctaccccacagtaagccacctctatgtgtggagccctcctggcaccacttggattctaactacccactctggaccactctcacccttggtggactccctcttcatacctcttggactctaacatcctgctccatactacctattaccctttcccctccatttctggtcacctaccttgctctgtcccacctaatgacttcaggatgaatttttcaggaaagcaagggaaaggggacttccttatatttgtatggatacattccatgtcctagtgtccaagtgtaattatgggcagcatattcatggttttgtaacctcattttgttttttaattttggtatctgttagtttgctagagctgcagtaacagagcactacaaactgagtgacttaaataatagaaattgttaaacagcagaatattgtctcacagttctggaggccagaaatctgaaaaatcaaggcatgggcagagccatgctccctctgaaggcattagggaaaggtctcttccagccctgtctcctagctgctgataatcctgtggcttgtggcagcaaaactccaatcttcatgtggcattatcttaactaattacatctgcagtgacccgatttccaaacaggttcacattctgaggtactcggggctaggacttcaacatacaaattctgtggagatgtaattcaacacattacagatgcccaggtatccaacttcagtcatttggcattttactctgatgtagcttgaatacttggaaacatacattttctatattttccatgtttctatgacagttttttaaatatggtacctagctgatattagttattatccaaaataccctgttttacctaatgggattattttttcccatttttactatgaagtatttgatgcccactgaagcgtgtatgtaatatagccctgagatacaaaccatagtaatgaaacaaatatgttcccacaacccaacttaaaaatgaaacattacagatgtctgtactttttgaatttgttttcatttttaagggattacattgaaattaacaataaatttgatgtgctaacatcactgtgttctgataaggagggctggaacaagttatttaacctctataaatctctcttacctctctatagataggaatacttatggtaccttccttacagggttactgtgaacattaaatgagataatatacataaaagcagtattagaacataaatgcataataaataccaagtttattattcagtagaaagagaaattaattggcatttttttctttaagtagaaagtattctggaatgccatttttccgcctaatcatagttcttagtgtttcttcattacttttacttttacagttttatcaagatcacacataacacatctgcataattacaatttgagtctcataaacaaaattatgcctgagagagtatttatctctatgtttatatgtagcttgtaatggtagtttcttctatgtttttaatacataaagggattccttgtatttaaaagtctcaaattccaaagatggaatgtcaaagaataatttcagtctaaattcatttgtatgtctttaggatattgttttattttgtagcaaatgactacatatgattattttctacactagaaggcaaaaatcaccaggtcttgcctattttgttaatatgaattaaattatgtctttgtaaaatgtcttttctttcattcagatccccttggaaaggacttccagaactgaccaatgagaatgcccagtactgtcctttcagctgtgaaacacaagcctggtcaattgctactattcttgagacactttatgatttatagtttattacagatattaagtatgcaattacttgtattataggatgcaaggtcatcatatgtaaatgccttatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaakaaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtyggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttayatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctaytttcaaagtagcatttttttagttagtttacaggttacatacccaaaaccttaactatgactaagaaattamagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaayacattggacattggtttccaaatctccctttcttcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtrggcaaatgtcattgttacctctgtgtgttaagaaaataaaaatattttytaaaggtctgtattttgctttcattcatagtcattgcacccagctaattttttattttttacttattttttattttgtagagacaggattctacactatgttccctaggttggtctcagcctcctggcctcaagtgatcctcctgcctcagcctcctagaggcaattaatttgtcagtgctgaccagagtcatttattcagtgcttgcctactttaggtgcttacctttttgcaggaggcagagaggaggaagaattttagactgttttgattatttatttcattaggcatgttgaaattaggagcaaaatcaacttccaatgtataaatctgttagaaactatacacttctggtgacaatgggcctcctggaaaaataaaaataatttttttaaaataaataaaaataagctgcacactttcctggtacttcttgaaaccttttactcaagtgtgaatttttaatttacctttgatcaacttacagtaaacactacaggccagaagacatatatacgttgcctcctaaagtagccaaaatttttttacttttcattgtattactgaataatatacatatttatagaaaagcatctaatgaccaaagttgatcagtttggtctttgccttagtttctgttggtttctttttactgcagatatgcatatcttcatcttcagataaaagatattaacctaaaaatccaaacctgtaactaccacagcaaacttgccaaaattacttacatagaacctcaatgtgccaatataataaactcatggaatttgcttagtagttgttggttccctcccccaacccccccaatttgtatgagccttgaattatagagtagtgctaatactttgtcattctggctgtagttattttggttagagcaggggttttgtttttgtttttttaaagagtcttgctttgctgcccaagcctgatgacagacagctcattacagcctcaacctcctgggctcaaactaccctcccacctcagcatcccaagtagctaggatgacaggcgtacaactactgcacccacctaacttttgcatttctttttttgtagagatgggggtccacactgtgttgtctaggcttggtctcaacctcctgggctcaaactatcctcccacctcagcctcccaagtagtaggatacggcgtacatactgcacccctattgttttagagtctcgctgattatataggcgtgaccatttctggccagcttttttctttaatcagatctttcagcacttgcctccacgtttgtaatctctactgtctcctcaaaatttacatcagtctcaataataaccattgtttctatttccagttttattttttttataagtgcatgtggtatgagatgagacattacttaggcttttttttccaaattgttaaatcccaaacttataagttgaatatgatttatgggaagtccttttttaatcttgcattattctttactagtagggtctannnnnnnnnnnnnnnnnnnnccaacccccccaatttgtatgagccttgaattatagagtagtgctaatactttgtcattctggctgtagttattttggttagagcaggggttttgtttttgtttttttaaagagtcttgctttgctgcccaagcctgatgacagacagctcattacagcctcaacctcctgggctcaaactaccctcccacctcagcatcccaagtagctaggatgacaggcgtacaactactgcacccacctaacttttgcatttctttttttgtagagatgggggtccacactgtgttgtctaggctggtctcaacctcctgggctcaaactaccctcccacctcagcatcccaagtagctaggatgacaggcgtacaactactgcacccacctaacttttgcaattctttttttgtagagatgggggtccacactgtgttgtctaggcttggtctcaacctcatgggctcaagcaatcctcccacctcagcctcccaaagtgctgattatataggcgtgaccatttctggccagcttttttctttaatcagatctttcagcacttgcctccacgtttgtaatctctactgtctcctcaaaatttacatcagtctcaataataaccattgtttctatttccagttttattttttttataagtgcatgtggtatgagatgagacattacttaggcttttttttccaaattgttaaatcccaaacttataagttgaatatgatttatgggaagtccttttttaatcttgcattattctttactagtagggtctacttctagaatatactgttttctgtgcccattcacctatttcactattacagtttttgttttaatatttgttagagcattttgtcaccacgtttttctctcatcggttccctcgtcttctttttcagaatcttatttattcccacctattctttgtatgtatttttccaaatccaaaaagtattctcagcatttttactaaacaagccctcatactattaatttgataacaacagacatattgacattatttaatcttaaaacataagctatttatttaaaaatttttagcttgttggaattcttcctaatttttatgtttatgattgctgtggtccattttggttcaatttggtggtcaattggtcagaatcgaaaattcagattcaagaaacatttatggagcccctactatataagcaattttacattggaggtattatatcccttttgtaaatcagaacattgataatcttaccataaatcacatagtggataaattgttggacccaagactcaaactctgattttcctaccacaaatcctcttacacaaaccctcaagattgctgtcttctgtgcttgccctcctgcttcctgcaaccatcaacccacaggacccactgttgatattatcggtttcccatggaaagcatttaggtctgttctccttgggcctaggtatacttccttattattacctggccaaaattctgtatctgcagccatctgcactaatcagataaccccatgtgttcctggctaaatgtgtagacttggtgccaagcatgggctaggttatacaagtaggataaatttggaaatataagtatcttatcaaggacagtgaaacagaaaagtcagagacaacaggaagtgttaataattaagagaaggccaactggttaaagttggtccaaaggaatttcggccaaaaagtggggcccatgcccatgcatttttaataccaaaggaaacaatctatggaaattcactaaaaaatatggcacttaattctgcaagtgttcaatgttaatatatttattgtaatggatatattttcaaagtacaaaactgagcactaagtcttattagatatcttttttaccacataaaggagcagtactccaaaaatgatttatcttggctcccacatcacattcaatggatcacaaagtcttttcacttttacctgactgcagatttctactcgtactcttatcttgtgcatagattaacacaataatctttaaattgatcacaatttatccctcatggaactatgaggaaaacctttcttgaacactgatgctgtccatcactggtcagaggacattgaggattcgctatgatttggcctcagtctctttccagtcctattgtcttagtgtctccttgctgtttccaaagctgattacttgcctccctgaaactttgtttcttcaattgtaaaaacagtgactgtaacatctgtgggtagtaagaattcacgagggcaacccatagtgtatttaagtttcactgcctataatagaacctaaataacaatggtctacataagataaatgtcgaaggtgtgcaccccagatttgatatgatggttccattgtcatcaagaaccaaagctagcatttaatgacatagaatattcaagaacttctcaaatatttcttttaatatgagcttattgtctcttagatattataagcaggggtagacaataatctgtttactttttgtaatgtttttagcggcagagtctcactctgtcacccagactggaatgcagtggtatgatcatagtttactacagcctccaactcctgggctcaagtgatcctcctgcctcagcctctcagagagctggcactacagccatgtgccaccaagcctggctaatttttaatattttgtagatataaggcttcactgtgttgcccaggctggcctcaaactcctgaactcaagcgaccctctagcctcagcctcccaaagtgttgggattacaggcatgagccactgcacccagcctatttattttaacaataggggaaacaactcaaattttacatcatctaaattgatggcaaattttaaggcttggctaaaataacaaattttctcacctaaaaaaaaaatctgtaattttatacttaaactctaaagaagcagaagagctattactgaagtctttactaataaagcaagatagaattttataggaatttttgttcgttttggtttggttgattttaattctactttggtctttctcatcattggacaacgtggggaaatgtatttcagacaaataaatgaactagcttgcaataaatagagtgtgactgtttgatagacttcccttctttctgaatgtctacaaaagataagcttttttattttctttaagcaacttcaaagcattaactcttagacctagagatcggtttcctttttttttttttttttgagatagagtcccactgtttttcctaggctggtcttgaatgcctgagctcaagcaatcctcctgcctcagcctccctcagccttcagagtagctgggattacaggcatgcaacccacatctggctagagatctatttctattagagattcacttactggaattcagctctgcatactcagaaataagcaaatatatgcttccctgggggggtcttcatttctgtgtgtttctcataatgtcattgttccactgagccaattgtgagtccagtgtttaaaaatataccatttccataagacacagttccctaaaccagtgcttccaaccctttacatgttatagaacacatgtaaaaaggtaagcttggactgagtgtggtggctcacgcctgtaatcccagcactctgggaggccaaggtgggaggattgtttgggcccaggagtttgagaccagcctgtgcaatatagtgagacccccatctccacaaaaaaatttaaaaatcagtcaggcatggttgtgcacacctgtggtcccagctacttgggaggctaaggcaggaggctcactggagcccaggaggtcaaggcttcagtgagctgtaattgcaccactgcactccagtctggaagacagtgccagaccctgtctttaaaaaaaaaaaaaaattatatatatatagcttgggaggctgagacagtgagacaggaacaggaagatcacttgagcccaggagttcaaaaccaccctgggcaataaaaccccatctctactaaaaagtttaaaaatttgtttggtgtggtggcacacacctgtggtcccagctactaaggaggctgaggtgggaggatcacttgagtccgggaggtcaaggctgcggtgagctatgatcatgccactaccttacagcctgggtgacagagcgagaccctgtctcagaaaaacacacaagaaaaagactgggcttagtggctcacatctgtatcctagtactttgggaggctgagactgatggatcacttaaggtcacgagtttgagaccagcctggccaccgtggtgaaaccttgtctctactgaaaatacaaaaactagctgggcatggtggcacacacctgtagtcccagatacttgggaggctgaggcaagagaattgcttgaacccaggaggtgaaggttacagtgagttgagatcctgctattgcactccagcctgggtgacagagtgagactctgtctcaaaaca

SEQ ID NO: 12367 - DNA, 41132 bp, Homo sapiens
  misc_feature (1)...(41132): n = A,T,C or G, or insertion/deletion polymorphism (see Tables 1-2)
accgttgggccggagcaggccagtgccgggcacgtcctgcccatgacagccctgctgccagccgtgggcacttgttcctggagctccgtggctgggtcctgccgtctccgctgctgccctgccctgccatgttcacctccagtttatccagcaatggggagaggggcttcttagatccccctcaggcttttcttttgtgcctttagatatgtgaaatacaacacagccaggcaaagcaggtgccggtgagacacctggctggcccgagctggcccgaagaactgcctgtctgccatgaggaaaacccacactgcgtggtggctgggaggccaggagttttcacaagccggaaacctgttagatttctctacctgacagcaggaaaatctgatgagacccgatcgcatccaggcaggccgtgtgctcgcagcccgcgggttaacacagactccgagtgactccgacgcaggagaacgcggcgaatctgcgtgaggcaggccaccagccttggtgccccggagacagctcccccaacggccatgtgacggcgttgagtgtccgtggtcaggtgtgtgtaagagacgcgcagagaattccacgccgtcccaacctcccagccggaggctctgacgaggcctgcagccacgcggaaagagcaatgaggagcacgtgtgtggggaggaaggcgggttctgaccccgttccttccgcagcggctccggcctggcgggttctgacggaattctgcagcggctccagccagggtcgtcggggcggggtgggtgctcaggggcggcctttgtgttcggattagaagctggtgattgtcacattaagacctctaagctgctgcaatctgagaagatgttacacaaccagggcccctgagctgaggccaaggagggggccaggagagtggcgggaggggccccaggcagggccagagctgcctgtgtacagcaggggagaggggagaaggggtgggcctggtggtctcagccccagggagagtggagtgcccgcccctcccctcccccaggacggctggcccctgggagagcccctgggggagccagtttcctgtaagcagaagggcaagtggttgggacccagaggtgtctgacagttgtggacttagagcccagaggaagggtttggggtttggggctcctgggacgccgcaggcccctgaggacgtccatcaggatcctggcagtgtggaggtgtagggtccagccctacggggcttagcgggtgttttccctgtgtgtggagatgagggattgtaataaataaagacacaagataaagagagaaagagaaagcagctgggctctggggaccactaccatcaagacgcggggaccggtagtggtcccagagggctaggcccactgatatttattgcatacaagacaagggggcagggtaaggagggtgaatcttctcagtgattgacaaggtgaagtaagtcatgtgattacaggatagggggcccttcccttttaggtagccgaagcagagacggaaggcagcaaacgtcagcattttcttctctgcacttataagaaagatcaaagactttaagactttcactatttgttttaccgctatctgctacgaacttcaaagaggaaccaggagtacaggaggagtatgaaatgcaacaaagagtaatattaaaagctaatgattaataatgtttataataatgattgataattgtccatgatcatctctatatctaatttgtattatgactaatcttattccaactattttctttattatactgaaacagtttgtgccttcagtctcttgcctcggcacctaggtactttcgcccacatggaggcagaggtgacaggcgtacagggcagtgtgtctggacccagatggcaggcacgttaacgaccagtgaccagggctctgcccacctggcccggcgcgttggccccccagcgatgtggcttcacgccggctgctttcctgagcgctcggggtttaggtcctgttctgctgcctctgagcacctgtgacctgaaaaggccctaccctcggcctgggtcccttggggtgccactgaccttctgggaccctgaagctgcctgtgtggtaggcgtgtccacccccacacccacccaaacgatgcagaggagtgaaaaatgattcctcgaggagctggtccagggccgggcgcggtggctcacacctggaatcccagcactttgagaggccgaggtgggaggattgcttgagcccaggagtttgagaagagcttgggcacacatggtgagactctgcctctacaaaaaattaaacatagccaggcgtggtggcatgcacctagagttccagctacaggaggctcttacaggggaggagggacaagcctgagctcaggaggtcgaggctgtggggagccccacgtgactacaccactgcactccagcctgggtgacagagcgagaccctctctggaaaaataaaaaggagctggtcagggaggccgagagcaaatagctgctagaatgtggcgctgcctgggacggggagggctgggggcccttggggtggaccaggagcctgagttgagggttaggggcaggtggaggggctgggaagctcggggctgtcttaggagagccctcctgacacctaggccctgggccgggttcctcctggtggaacatcacagacctgagccctcccactcacttttccttggaccccacaggcaaggagctggggcggctgtctgctcccaggctgaggccccgggacgggcccctcctcgctttgttagccggttagacccagggcgggcgcaagcccttggcagtgctccccagcactgccccttggacctcaggggtgtggggaggacagaccagggcaggacccaggaggccacaagggctggtgggggtcatggtcctggcagccccagtcaaaggctctgccctcctgcacccacccccagagggggatcctctcgagggagcatgggccctgtctccccacctgcccttctgggagatcaagagttgctgtgaagtttctagaacagtgcccggcctggcggacgggcacggaggtgcctcctgggtgtgcccgggtgcggcctgacagggctggggtcctgttgggttgtgggcaggtcctcagacggcctcctggctcctgcctcgcccctccccacaggccctgtgccagcggctgtgcaaacagaggccaggaagcgaggtgatgctccctttgtttctggcagagtgtgtggcacctggagctaccttccgggttccatggccctggggccctggggccctggggacagggagggaatgggatgcacagcggccaggggtgttcagcgtcaccggtggaaggggtgaaacctgttcttcctggtggtgagggtttgccccttgactccggaaagcagagaccgtggagcagggcccacttcaaagcacagtgctgggggctgtggcctcggccctctgtggacgtgggcggatgggtggccctggactggtgaaggactggccgggagttctgtagggcccccacctcctgccagcgcccagcccacagtcgaccactgcctgcccggggcaggagacttccttcctgcagccccggacccgggatctgagacctagaagctgactccatcctttgactgctctgttctgagctaggccacccctgcccctgccccgaggtggccctgggcttgcccgcccgcctgcagtgtcggctgaagagggtaacgtgcgtgcgccccggctgctcccggctgctcccggctgctccccggctgctccccgctgctcccggctgctccccggctgctccccggctgctccccgctgctcccggctgctctcggctgctcccggctgctccccagctgctccccaccggccttgggtctggtgggtgtggccctcctagtgggaccaggccacacactggagcacatgggcacggcaatgccaatgccgatggaggcgggttcctgggcatgtggacctgtcccttactcgaagcagctgaggggcctccagccagccccgtccgcaccccaggggttagggctctgccatgggggcgtgggcatctgctctgacaaacaacgtgtgcatttgattggtgttcctgagtcaccgtggaccaggcaggctgccagagcggctgattcttagcggggagctggggccgggcagacaccctgactccctggggctcccagcagggccccactggcaacaggcagcctcctccctctggccgccgggcctccgtccctttcccagcctggggctgggaccaccgctccacaccacactgcactgcccttgtctgccccagcagggggtgaaggtggctggtggctgaggaccccctgcccaggcccacacttcttgctcaggccccataagtcacttgggatctggagagctggggactttgacctgggagggaggcatctggtcgtgaccctcaggcgtgtgtagggaggtgcctggccgtgaccctcaggcgtgtgtccctggcaggttgctctccaccggccccaccgtttgtaacacatggctcggccaaggtgattctggggtaaggacccatgaggcgccatcttctttgttcctaggctgagcctgtggtgccctgggcagggtgggtggaggaagcagcagggaggctccttaatggtggagtgaacacccacacggatgtctctggatagtggaatgcggaggatgcagggcacgccggtggagagctgcccagccgtgccagcaaggccccggcatccctcccacctgccgttagcaccgggagctgctctgctggcccctcccacagactcgggctctggaggtctacagagcagctgggagggtgatgcctaggcgggggcggagatgccaggcccctgggctgcaggtggaggtaaatggggaagggaggctgggggtctctgggcctttcgccagcagccgcccagcccagggtctctgatgccagggaggtccatgtgtgctcggcccctcctctgagcccctcagcccagccttgtttctgcctccatggctatggggcctgcacccatccgagccaggcactggctagggcagggaggctgccttgggctggggccagtcccggaatccaggctcagctggcaccgacagggaggggttgtgggaaggtgaccagccgtgtggagagcttggcgtcggagggcatggtgggcaccagcgctggtgggatgtggcgagggtggtggtgactcatggcgcgtggcccgtagctctgaggagcatttgcgttttcctgtggattcactgtagcgcctggtcacaatgttgcagcatttccctggctgcttgtctcggaattaatatctatttcctgaaaagagaaatgaactttcttgcagtaaaatctaaacaaatatttatatttattttccacctccatgtcctgtttcaaacttattgtccagcccaagattttaaaaagtcagattttcttttggtgtgaagcaggctcaggaggaggaggagggggaggaagaagaggaggacgaggagggggaggaagctgggaattgggctgagctttcctcgctcatccttgcagtggccacagggccctctgccctctcgtctgcgtcaggtcctgagttctgagtccagaagccgtcgctgtgctgttggagcccaccaagcccgtcccttgtggggacagctccctccaagccccccggggggatggacactgagggtggggcaggggagcagggataggccccaggcaggtcctcccagggcctggggaacacaggggcccatcgagggctccccagactccctcagccagttcttcccgagaacagaacagttaaaaccaagccctccgatggaggtgcggggagagggcgtggctcccgtcccaggaggcaggtgagcttctggggattccagttcacctgccccacagccgcaccctgcctgtgcctgcaccctggggagcccagagccggcaggggccgaggcggtgggacctcgggggagctcaagcctcgactgtcccctcgctggaggccagaggccaagatgatgtccwtgctgggcggcttgcagagrtaaggggggcagttggaccccccaggtggacaaagcgcttcatctgtggctattctgagagacggacaggagtgggttttgtttgtctttcgaaggaagtgacttggatttggaggctgttcctactcaggcttccctgaattcacctgtcttggcttcgtttcggaagtagggggcccctcctgcccaggcctggtgctgcttctgggtgtttgggggttctgggatgtggggcccagtgagaaagctgccccccaacactgtggcgtggagacgctcgagtgtccgcgtgacggctggggagggtgagacctgctgggcttgggacctcccagcctcggtctgcggctcaggcccatggctgggccgtgttggtgggagtgccaggcgcttgctggagcgttggtcatgcgtgcgcttcaggatgctcccggggctctgggtggtgacggggaggctgggctctgctgtgctgtctcccttctgtaaacagaggggaggtggatttcttcccagttaggtttggaggggtggtgggtgtggctaaggatgccttgcgttttccttctcctgctcgccatcctgtttggggtgattccagggcagtttgaagccgtccctgcgctggcaggtccctgcctccccggggcgtgtgccgccatgaattcagttaccttcctttaaggggtgacttaagaccagctgccaggacactggctgaggacaccccgtcacagggctgagaggtgtggggccggctgcctggcctggaccatcctagatgccccctcctgtggacattgtgaccatattgtgaagaagaggcccaggggctggggaatcaggctcacttgattagctggtggccaagctagggcccccctggctgccctggggccccccgaggtcggccagggcgggtgtgcctgaccccagctgagactctgtgggtgagacatgggaggcattgcagccgaaggccctcggggagcccagggcacaggctcctcagctgctggtctcactgcctggcaggatgggctcactgcagcagcccatgcaggctgcacgtcccacactaaggccagggagctttggctccgggtgtcccaggcttcattgagcacggcctgcaggagggaagccccgagtcacttccccacagccctggacagcagccttcctgagcctcgcatttattttcctggggttgggcaagtgtgggaggctcacctcgcttgtgtcagcttgcttggcctgtgggtggaacaaatcaacagccctggggacaaaggggacggtagtgtgtggtgccactggcacccacctgggtgattcaaggagctgcccagaacagaggagagactttgcctgcgctagtgaggcctagtcttgaccaccggccacgggaaatccaggccgccgggcaaagtgctcacttggatgcttgctgatcttttgttttgctggtgatgattcaggcacaaaactctgagctatggcacttgggggtgttgcctccctggggtgtggccaggtatctttggggaggaggggactcatgatcagagaagatgtggtacagagcccatgggggtcaccatgccggtgtgaacccccaaaatctgagacaggtctcggttaatttagaaagcttactttgccaagggtgaggacgcgcacccatgacccagcctcaggaggtcctgatgaygtgtgcccaaggtggtcagggcacagtctggctttatacattgtagggagacatgagacatcagtccgcatatgcaggacgaacattggttcggtctggagaggcaggacggctcgaagcaaaggcaggaagactccaagtggggaggggacttccaggtcacaggcaggtaagagacaaatggttgcattcttttgagtttctgatgagcctctccaaaggaggcagtcagatacgcatttatctcagtgagcagaggggagactttgaatacaatggggggcaggtttgccctgagcagttcccagctagactcctccctttagcttatagtgatctgggggctcaagatcttttcctttcacatttccccccgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttctgacctcaggtgatccatgtgtcttggcctcccaaagtgctgggattacaggtgtgtaccaccatgcctgtccccgaggggttgaatagctttaatttctgactctgtgtttcaataatgcagtttattttgattggcatcttctactggggctttaattgctgtcagtgtttaaaatatagcaggacttggtgtcctttttacacccaggagtcaatgtcctgtaattcagtgtcacaagtactttaaaagtgcatacagagagatacgtggatggaataaccttaatttaaaaatgtttaaggctgggtatggtggctcacacctgtaatcccagcattttgggaggctgaggtgggtggatcacctgagttcaggagttcaaggccagcttggtcaacatggtgaaaccctgtctctactaaaaatgtaacaaattagcttcgtatggtggtgggtgcctgtaatcctagctacttcgaggctgaggcagaagaatcgcttgaacccgggaggcagaggttgcagtgagccgagattgtgccactgcactccagcctgggcaacaaaagtgaaactccatctccaaaaaaaaaaacccacacaaaaaaagtttaatctcaattttttttcctaaggaaaccaaaacttaataataatatgacaacttgatcatataaaagtttttgtgtttgtttttttaaatataattcctcttattgtgacttacataaaccattcattacatgtttggattttctcgtttgtcctgaacttccctgcatcttaaacaaccagtcattttactctaggactaaatttaccatacaagattctttctaatatgaaattatttccctttaagctttcttaccaaaaaatcctctgtattgttataactttctatcttgtttcgtacataaactttaagctttgaattagacaaaaattattcacctttttaaaaggataccattttttttagcaagaatgttttccttcaatatatttttattggaaaatatccaaatatgaaatatctattatctaatttaatataactttagattctaaattatgacgtttgtctgcaagtatttattctaatacatttacctaattattttattttaatcatttacttatttatgaaaactgtgatattcatcatttaacgttatgaaactgctcttgcaaaattataactgagacagtaaaaaacatctgccctaactgactccttgttgcttctaacctccaggccatccttgttcattcctggttggaggctgaactaactttgggaggaacgaacttagtttatagtttagttttgaaacaaaaatgataagagccctttcccaaaacaaacctccttactgcctgtggactagactgtctaaagccacaggattagaatttatggtaatcttactaaattcaagctgtagctatggatcattaaacaaatattaatgtcttcttttttttttttttttgagatggagtcttgctctcttgcccaggctggagtgcagtggtgcaatckcagctcactgcaacctccgtctcccgggttcatgccattctccagcctcagcctcccgagtagctgggactacaggtgctcaccaccacgcccggttaattttttgtatttttattagaaacggcatttcaccgtgttagccaggatggtctcgatctcctaacctcgtgatccacctgcctcggcctcccaaagtgctgggattacaggcgtgagccaccatgcccggcctaaagtcttctttattaaagattacacaaataaagaccattctgttttgggctgcctttatagttttgcaacccctatgccaaattttgacaccttatattatttggcagagataagtaggaaattgcttgattaacaaatgcaaacaaaaatggatgctggcaaattcttaagacatttctagtattattttaccaatgatttaaaatccagcgtattaaagatttgacttaagtggtgtgaacttgaagggcatttgactagtcttttttctttagtatctaagtacttttattttttaagccaattaattgagctcctttatatatttttactagtgaaacattgtgtacacaacacataaatacatagacatattaggcacactgatagaagtacatcttactgatttataaagactttttctttctttatctcagactttcagattcttaataacctgtttcagaaccctaggcagttgttagctagtcttaaatttgcatattaaaggaaacaactctggtgaaaatcaaatagcaaaatttacaacatatgatatggagagaacaagtctggtgtgctagagggaggttaaagatggatgccaaatcaaacataaaattataaaaatctaccattggattatataaggagaccaattttatttagacagggactacctatattgtaactggacctgagctctgggcagagcccacactgaatcctgggtttccaaaaagggagaattattatgaggctggatcatgtgatgcttttacagtgcacttaatttttttttaaacaaagacgtttctaagtgtctaaactacactcttctgtaaaaacccaagagtagcctgtttcaaataactattttagtcaataaatcaggtaacacaatacaaaagcaagcagtttaaaagctaagacagcccacgtgtggtggctcacgcctgtaatccctgcattttgggaggccgaggtgggtggatcacctgaggttaggagttcgagaccagcctggccaacatgatgaaaccttgtctctactaaaactacaaaaaattagccaggcgtggtggtgggcacctgtaatcccagctactcaggaggcagaagcaggagactcgcttgaacctgggaggcagaggtttattgagctgagattgcaccactgcactccagcctgggcaacaaagatgaaactccgtctcaaaaaaaaaaaaaaaaaaagctgagacgaacttgtctgtttacacatttggggttccatgggaacccaaagggagtctggcaccttcttggttttctttaaggaaccccagtctcttataaactattttaggtctctcgtgcagcagagggtgcaagataaaggagagacagcagaagtaaataaagaaaaacagacctcagtcaactgagaaaaaacaaaaaacttttgctcaaaaaaaggacaaggtcctaggagagacaaaaaacccaaaaacatgaagaacatgaagaaggccttttaaatacacacacacacacacacacatcccttggatgttagcttttaattaagctgactttaacagttgagctcctttaaaaaaatgtttttaaatctcattaccatatttcacctgcgacaaattgctgctgtttcagaaatacagacattgctctttcaatttggtctggctagcaaaaaggtggtcttgttatgtaaataaagtccctttagtagtcaaaataaaaaatatttcctctttttttttcttttggctggcatctttctcccccaccacacaccttttgtgtgtgtgtgtgtgtgtgtgtgtgtgtgttgggggggatcttaaccatctgagaggtcttgttcccaataatttggaacttttcttcagatttgataaagttggatagagttggtcaaacccaatgggaaaaagactgaaaaaacaacaaaaacagagacaaacaacaacaacaacaaacagttcagtaaaacaagcaatcacacaactatatgattcctgagtgctctaatggtaaggagaaattaagaccagctggttgataactttagccaagacagaaccccaattcggctacttaacctagggatgggtctcaggctgatactctctaccatcttagaagcaggaaaaaaagaaaacctcatcttccctgttggaaacaatctcaaactccataaaggagttacctgccttccatcgtcatggaagcaggagaactggccctccttgttggaagcaagtaaaactccaaaaaaatagggagttgtacagcaaaataaactttagatcttgaccaaattttgggagatcagggattttttggagggggtgctcccagacctcagcaaattgtcctattggtttgagccataaagttagctcatgtcagtaccaagctccgataggaggtttgccaaaggtcagggacatctccacccagaatccctccatggttaccgaaatgcaaaccctgaaaatttgagataggtctacaaaaggaaaatatcttgggcccctgaaatcactaagctaaagcaaaatgtcaaactgggaactgcttagggccaacctgcctcccgttctcttcaaagtctcccctctgctcactgagacaaatgcatatctgattgcatcctttgaagaggctcatcagaaactcagagagggtaatcagaaactcaaaagaatgcaactgtttgtctcttatctacctatgacctggaagcccttccctgcttcaagttgtcccattttgcttctagttgtcacaccttcccagaccaaaccaatgttcatcttgcatatgttgattgatgtctcatgtcgccctacaatgtatacataaaaaaaagctaagctgtgctctgactaccttggacacatgtggtcaggacttcctgaggctggcaaacaaatgcgcatcgtcaaccttggcgcaataagctttctaaattaactgagacgtgtctcaaatttttaggttcacattttggtaaccacagagggattctgacctttgacaaatctattggtgcttggtattggcatgagctaactttatggctcaaatcaataggataatttgctgatgtccgggagcaccccctccagagactccctaatctccccaaattggtcaagatataaagtttattttgctgtacaacttctcctcctttttttttttttttttggagttttacttgcttccaacaaggagggccagttctactgcttccatgacgatggaaggcaggtaactcctttatggagtttgagctcacttccaacagagaagatgagtttcttttcctgctctaggatggtagagagctgttttcaacctgagacccttccctaggtaagtaactgaactggggttctgtcttggctaacgtgacaaccagctggtcttaatttctcctttccgtcagagtgctcagtgatatattgttggggattttgttgtcgttgtttgttcttgtctttctctaattggatttgaccaactcagcctgacttggtcaaatccgagtgagaattccaaattgtgggtaacaaggcctctctaatttggctaaaattccttgcagctgcaaagggggaagaacgatcaaacataaaaccacgtgtttgctttctgtcttaaaaaagcaattgtcccttcatttacttttcttccaccccatacctccttccccctttgccatctccagtaccaaggactctagagaaggcttctaatgacttgaacccctttaaataattcagaacaagggcaccactcaccgcttttggggtgttctgtcttcattgtggagtttcaagagtcatgggcaggttcttcttaggtctaaagctctgttttcctgtattgcattacctgacctctttggctttggggggtaccatagatgaccttgcactgtgagaggatttgacctcggcgtgtataatggcagatgagagctacaaagttatgggtggctgaatacagtttacaggaagtggtcttggctgtattttttttttcttttctctcctaggaggttgttgtttaaggatcctaattctagtttgaagatgcattctaaagggtcttctttattgcttttctcccaacattaatctcagtttggtttgtctgtgtgcatttgtgcgaggaactgaactgaactgttgttttcataggtaaatgagagactgagtttttcagctccaaagagaaaaggtatctgcttctcccagccaaaggtgcccctgggtgaccagggggcctcgtgggagtgtctagggggttgacccctgctgtgacatgcagcagcccttcagggaaatcccctcaaaagttaatttaaaaatagttcatccaggaaacgcatgtaaaggctgatcacccagcgttttgagccctctctgaggtcatagacctctggagagagaaactgagactcataagagggcagaagtgactcagtggtgacacactgtggagtcctgcccacaagcagcacacatcaatccactacacaaaaacctaggccacagctcagttcctccttttaagaaaaaaaaaagtgggaaacaaataatccaagaatgaggagaaaacacagagaatgatccccttttgagcactctgtagggtttaaggcacatctacttgccagagtaaaatggaagtaagacagtctttgtgcacatttacattaaggaaaaaagagccctaacgtcgaccccaaaccaatagagttcttacgtccccttttccccattttcttttctgcctgctttaaatctgctgttacctttctagtgagataaaaaccactgtttcgatctagcaggtctttttttgcaagccagtgaacttatatttatctcatggctaaagtactgaagtaaaagctatagaatctttgtgtgtgtgtatgtgtgatgtatatgtctgtgtgtgtgtatagttgaaggcccttataatagacttatataattttatgttcaattggcaattaaatctgctttagtttccctctagctcaccagactttctcttcgtaccttactatgtaaattttgctatttgattttcacctgagttatttcctttaatatgcaaatttaagactatttagctgacaattgccttagggttgtgaaacagattatcaagaatttgaaagtctaagatagggaaaaaaatatggtctttatggatctataacatgtacttctggctgggtgtggtggctcacgcctataatcccagcactttgggaagccaaggagggtggatcacatgaggttaggagttcaagaccagcctggccaatgtggtgaagccccgtcccggggcatggtggtgggcgcctgtaatctcagctacctgggaggctgaggcaggagaattgttggaacccgggaggcagaggtttcagtgtgccgagattgtgccactgtactccagcctgggctgataacagtgagactccatctcaaaaaaaaaagaaagaaaaaatgtacttctatcagcatgcctaatatgtctatgtatttagatttcataggtaaatgagagactgagttataacatatgttatggaaaactcctataattctgatataacttagtatgctttatcaataacaattataattgttatgttaagttattgtatgccacagaggaaacaaatttccttgtcaattgtgtctttgactatggttgccctaaaactttttgtcatccacggacatttgttgtcttgttttggtcctccttagaaagtggttttgtaatcagctatagaactctaacaggtgttcttacatataggattctgataactttggggattgtggcattagaatagagaaagaaactttccagactctcatggagagcagaaatgttcatgaatatcaagcagaacaggagttaactgtgtaaactgaactgatagaagactaaagaatctttttgacctttgctttaaatgttgctgattctttcttttgtatttttcagagctgagaaaacttttcttttgagctattgacagctttttacaattcagtatactcctatgaacaaaatttggggtatatttgtttctcttaaggactaagctctgattttgtatcttgcccaaattcctatctaagaggtctggggagtcgtgtcctacaaaccataaattctcatcagatggcttttatttgaccctgtatatcatgatttactttccaatctgagtctggcataacaaggaagaaaataacaatgttttaccccaaaatatatttccttgtcataccttgaaattgccctacaacgtctcttgtgggaaaaatccacattctatagagaatcacctttctcctttgttttcctttcttctcagatccaggagataatcaattaagagccaggcacccttttaggtctgatgagaaacattttacaacctgctctctctttgaagtctgctatctgagagctccctctctgcacaataaaacttggtctccacaatcctttaccttaacctgagcattccttactattgatcccaggtcttcagataaactcaaccaattgtcatccagaaaatgtttaaatttccctgtagtctggaagcccctgctttgatttgtcccacctttctcaatcaaaacaatgtatttcttaaatgtatttgattgatgtctcatgtctccctaaaaatgttttaaaccaagctgtacccctaccaacttgggcacatgttctgaggacctcctgagggctgtgtcatgggccatggtcactcattttggctcagaatagatctctgcaattattttacaatttgactctttttgtcgacactctctacctggtttccccagaatttggaaactatttgtgagtatttttaatttatgggagtacagttatttgtataagtgcaataagaatttgttttcattttgcagcaggacacaattggagaaactggttactccaatgtactaaggctttgactggaatggtgagctttcatttaaggaatcaaacttgacttatggagccaatgaaagccccttggaaaaactggcctcatacctttgtctacagagtccctgtacagggttcctgacctgtggcaagaaaagaatatcactttctgacaggtccaggagccccaggtttatcctggaacctcaagcgatgaggatgactcaactcataggtatttgatggcacaaattcgtggctgggctcggctttaaaaaagtcttatctgagattcctcctatggagcaatgttccatcaaagccaatttaaaagcctatgtaaaaagtaattattcttgctgcactgtatacaaataattaggccaagtataataaagcaaaccagtcttaccatgatttgtctttagtgaaaatgggaaactggagagagaaaaattatgtttcaatactatggtacacctatttttagattccagtcttgcctaatgttttcaagttttattattttctacagtttggaccaaattctgattttccttggctacaagtcttcaaaataatgtttgcaatttttttcatttgtttgccccaccccccatttttctgttttcttttcttttctttctttcttttttttttttttctsagatggagttttgctcttgtcgcccaggctggagtgcagtggcatgatctcggctcactgcaacctctgcctcctgggttcaagcaattctcctccctcagcctccctagtagctgggattacaggcacctgctaccctgcccagctaatttttgtattgttattattattattatttagtaaagatggggtttcactatgttggtcaggctggtctcaaactcctgaactcaggtgatccacctgcctcagcctcccaaagtgctgggattacagacatgaaccactgcacccacccgccccccttatttttcctaatttggagtcactaaaatctaagctgtgctttcttaaagccctgcaaactgaagccagacaacttaaacttcagaagaaaataacagcaacctattttcatacataagccactttcatggcctaccaatgtatggactttaaagttatgtggcctatatcgatttttgcaggattattctttggtttgttgttgttttctttcttcctccccctattttctcttctaggacatgagacttcacaacctgctaaaaatgagctttcctaataacttaggacctgcccatctaggaataaaccatcctagccatgagagatcagatgaaacctgggaccagagactcattttcttctaaaatcttggagagctttctccaagattttaaagagaaaacggggggaaatgtgaaaggaaaagatcttgagcccccagatcactataagctaaagggaggagtctagctgggaactgctcagggcaaacctgccccccattgtattcaaagtctcccctctgctcactgagataaatgtgtatctgactgcctcctttggagaggctcatcagaaactcaaaagaatgcaaccatttgtctcttacctgcctgtgacctggaagtcccctccccacttggagtcttcctgcctttgcttcgagccatcctgcctctccagaccgaaccaatgttcgtcctgcatatgcggactgatgtctcatgtctccctacaatgtataaagccagactgtgccctgaccaccttgggcacacgtcatcaggacctcctgaggctgggtcatgggtgcgcgtcctcacccttggcaaagtaagctttctaaattaactgaaacctatgaacctcccaaatctgagacaggtctcagttaatttagaaagtttattttgccataaagttcatccatgtccagcgagctggtcagaaggaaccgcagggggatgtgtgtgtccgtgtgtgtgtatgtgtatgtatctgtatgtatgtgtgtgtattgtgtgtgtatgtatgtattgtgtatgcatgtgtgtgtatatgtatgtatacatgtacgtgtgtatattgtgtacgtgtatgtatgtactgtgtatgcgtgtgtatgtgtatgcatgtgtattatatgtacatattgtgtatgtgtgtgtatatgtatgtgtgtattgtgtttatatgtatgtgtgtatatgtatgtatgtgtatatgtgtgcgtatatgtgtatgtatgtatatgtgtatatgtgtgtgtattgtgtgtgtacatattgtgtttgtgtgtacatattgtgtatgcatatgtgtgtgtatgcacatattgtgtatgtgtgtgtatatgtgtatgtacgtattgtgtatgcatgtgtgtatgtgtgtatatgtatgtgtgtgtgtattgtgtatgtgtagtgtgtattatttgtgtgtgtgtgtattgtgtgtgtatgtctgtgtgtgtgttcaaccccggagtgtaaaaaaccatcgccataagaatttgcatgagtcttcctcatagtcaacaaggtttctaaaaccagaagttccctgagctggagatgggatgtcttaagtcggttttgttgttgttgtttgtttattttttgagacagagactggctctgtgacccgggctagagtgtggtggtgagatcaaggctcactgcagcctcgacctccctggctcaggtgatcctcctgcatcagcctcttaagtagctgggaccacagtccggagccatcacacctggctaatttttgtatttttcgtagagatgggggtctcactataccacctaggctggtcttgaactccttgactcaattgatcttctcacctcagcctcccgaagtgctgggatcacaggtgtgagccaccacacctggccaagacttttattacccctcattttagatattttgtgggttcttactgagaagttgcagaattctccccgaatgccctgggaactgctgtcctgcaggcgctcacagctcaccgggttgtgcttgcagggccgaggcctggtgcctcaagctgtcccctctgtccccactggaactgggccagtgcctcccaggcctctcttctctttcttttggggagcctcagcgacttgctggggccatttgtctggggctggtgcactgtggcccctgatggccctgcctgatcaggaaccatcagccccaccaacctgcccagagctggaaagccagaccttctgggcgctcccagtgaggcagcaggtcagtggcctccaagycccgaggctccaacagcaggaagtttgaggctctttgggaacgactgagctactctggcaacccccagagcaaaggcagcagggcctggccgcagtccccacggttgtgagtcccataaggcagctttagcttgaggggagggtctttggggacttcagggagctcctaaaagctaagggcacttgaaagcaatgtcaaatggtttataatttttggcaatatttcattttccctccacaatcgtcagctttcaaggtttttagcagctgaactcttgaacatttttaattgattttttatttttttaacagccttattgagatgcaattcacacactaaagaatttacccaattagagtgcacaattcgctggtttctagtaaattcccagtagtgcagccacaggctctccttaaagaatgtgtaacaatgtgtaactcctgcgtgtaaggacagaaacaccatctctctgcttggtggaacacatcacccatttactgccccacggtgctctgggtcggtcacgggcacctgtggctgggctcacctcctgggtccccaggtcacccccttcccggttgctccaacactgaccaccctacctgacccctgcaggtgtgggaccagcaggtcttttggcaaaagggaagagcccgccttgagaaggctgtagcatttctctggaaacgtcattgttttaattgggcagttgcaaagaacagagacagattcatgctgccgcaaggccaaggggggtattgtaagtgtgaaagcagcatctcaaacagatggccagtgcgtcccataaaagtgcagaggggctataaaagtgcagagtgaggggccataaaggtgcagggtgtttgaggaaggagttgactatggcggaacgaagtgatggccaagggtggtggctgagaaaccctgctggtgaagtcctgcgtgggccttatcagtgagttaatctctaactgtgcggagccgtaaaactgcccttcccacctcgtgcagccactctcccggggagggtcttgggaagtccgcagaagtggcccaatggcagagcaggagctccgctctcagtgtggggcctcgtttgggtttgggaaaacatgtcctctctcacgaagacgtgggtgtctccagcgggaccctgatcccgcgtggggcgcatggccctctctgctctgcggcccctctcgctctcctctctgtgcctgggaattctagtgtttactgggccttggccgctgggagcctcttcaaggtggttccattttgacgtaaggactggaggggtgcattgaagaattgtagagtgcaggtgaagggagggcctggaagctcctgtcccgtctcctagaagcgtggctgtggtggcactggcattggagtctgaggtgccgcgtgtgccgtgaggatgaagtgtgagaaattttgggaggtcctagttctaccatccccagtgtcttcgagacccacacccttggtgtggaagaaaggagacaagatgtcatacgaagaggttctgttgaaagacgcagtcttggagctgggggttccggtgtggactcatgaggggttccgtctctgtatgtgtagctctgagctctgactacggagaaggcccagacatatgaccttctcagggcagtgagcaccccagcaccccgagtgtggtccctaaagaccacttcctaccagcgggacccagagctccttggagacatggttgactccagacctgggccaggagacgtacaaagcaggctcggagcaccctggtcagcagggaagccatcgaggaccagggcaggagccctccctgggccggccacggagctgatggtcgtcacgtatcagggctctgctcagtcatgggaactgagtcgtcaccccatttctgtggtgagcggcttctgcagaagacagatttgtttcatctgaagttatttattctgctgtcataggtgaagcctgctacacccatgtccccacatcccactgttctctccctgatggccggggggagcagggccggctctggtcttgtctgaaagggaggcacagagcagggccatcggctggggtcgggggagacagagtggtcctgaccagtagctgagcgcccggggtagatggttactgggtggttcccgtggggggctgggctgttggcagccctgagctggccccacgtggggtcagctagtggctgggtggggcaggcactttgaccagagccagctcactgctgtggccacagccccaggggtgccttgaggtcccatgcagggtgaggggactgcggggggcttgaggccctgagggctgccccgtttgctgttagcatgcacctggccgccctggcgcagccatccttgaaacactctgacagcaatgttttaagaatgtagagatggggtytcactgtattgcccaggctggcctcaaactcctaggctcaagcaattctcccacttccgcctcccaaaatgttagggtcacaggcgtgagctgccgcgcctggcctgaaacattacgtgtttgccagatttgtctttcttttcttcataccctcttggttttgtgtcttgcttagacggcagcctcattctcctttatcctctgacttcagtggttttatttttttacattaaatctttgaccccatgtggaactgattctgatccatggagcagatctgggagagccgatgttcgttatcgtgactgtttagaatttttctggccatcactatatgttttttgtccatttgaactttagaagtgacttcttagttaaaaattctcttcttcgggattatgctaaaattcaagattgttttatgcaaaaatcatctcctttctccaaaaggagaggagtgccgggccagcgtgtgggagtgaggacctgctgctcaggaactcttcctgggcaggggccagtggggccgggcagagccagcccagccctccccgctgctcccatggcagagccagcccagccctccccgctgctcccatggcagcgcaggaatggtcgtgtgaccactgagcagcggggctgatcctaacccagttccacgtcccgggagggtgaagagtgacgttgcactgggcctgggtcctgcctccctgctgttctagcacccccagccccctggcccgctttgccttggttacaattcctccttccccactggcttgttgtgctcctatgtaccctgtaaagccccatgcaaaggccccagtccaagcaggaagctcaccccttgtgtcctctccagatgctgagctygccgagtgcaggtgtggtgtctggttccctcgtagcctgtgcctgacctgcactgagacgctacggcccacgtggcaaccccccatcactgaggggacacagcccacgtggtagccccaccccatcactgaggggccccttggctgctctgtactgatggggggctttgcccagaggatgggggaccctggctccccgcccgactccacggtcaggccttacccagatctgctcttccctgatctggctgcacctgctatgctaggctcctgggacccaggccaggcctcctcaggcctcctcatgtgggccccgcctctctgtttggagacatcatgcttcctccaggctcagtcaccccgggctgtcacaacagacaccacagacaggctggccccagcagcagacatgtgcttctcaccgttctggaggccggaaggcatgcgatctcgagccagcatggsgggttcctggggagggccctcctcctggcctgcagatgccactttctctctgtgcccctatatggggagcgagggtggggagtggaagctgcactctggtctcttccttgtcttagaaggacacgaatcccattacagggactccacccgccctcaaacctcatccaaccctaacacctcccagaggccccacctccaggcaccatcacgctgtgtgttaggggtttggcctgtggattttgggggcgcacagtccattgcaccaaactctcagcctctccagatcccctgggggcctgggggtctccgtcccatacagtctcccagggggccctgcgtgggtagaggtcccctgacctgttcccacctctggtcccaggagcgcggccctgtcagctcccgaaccccagggaaagggatggctcatccactaggctctttccggccctaagccattcaggggtggtcgggatggggtcagattcaggcctgtcctgggttgagactccctagcccatgggccggcacccagtgggtttgaggacaagacgttacagaggtgaggggaggcccagacctgtgtggcccaaggcctggacttggctgcaggatgggaggtggrggtggggctggcacgacccggactgggcactcatggcctgccctttccacagatacttccgggtcatcctcctcctcctcctggccctgactctgctcctgctggccggattcctgcactcggacttagagctggacacaccgtaagtcctgcccccaccataagtcctgccccgggtacctcctaacagccccgaggacagagcctgggaccccagcatgatcacgccccccactgggcctgtctccctctggaagaggaggggtggatgggcccttccttggggggaccctgagagtctcctgttagccacaaacccacctgggcctttggggagggctctggggagcaggggccgggtctgggtttggggacagacccagtgtgtgcagagggtccctgtgtgtgggaggcagggctggaggcctccttcttgctccccacaacagaggtggcctgtgggcctgggctggatctgggaaggaaaaggtcagaaccgtgctcaggacagaccttgcagccatgggcccacctgggaccctctcccctgcctgcctgtggcacatcctctgtggagcccctgctgcatggaggtgcccacctgtgctcacctcgcagcccagctgtgcctccagacagggctttagccaggctgctggaagggtcttccaggccccgccactccccagcccctctggttggaggagacagaggaagcaccaatccctctgggccgagctgccagagacaggtgccaaggaccctgtctttgctcacccccatcacccaggctggccaggcctgggtaccctgaccccaccatcctggtcacttctgctggccctgttctggggcagggagggcgcctgctactccagccccactgggtgggtgtcatgatgggattctaggagtgggcccagccctacrtctggccgctggtctcggctttggggtccttccttttcctggtgtgaagggacaagaagcactgcacgtgtggctgaggtcacaaagccagctgcatgtgcgtgcctgggcaccagggagaaggctggggtgatgtgtgggccagagtgtgtagcccccgagggaaacagggatgggtctgaggacactgtctccgtggggccctgaggctggggctgagggtctctaggttggggtgcagtgatgggtctggtgggggttccagggttgggggtgtcaactgaagaatcatgacatctatgaatgtggagaggacactttgtttcttaaaaagtgtggacatcccacaggctgggagcacagccgccgacccaggctgggagcacagccgccgacccaggctgggagcgggcacttcgagggagggggtgggacaggggcttacgctgaacggcttggccaagtacacgttcagcaggtgacgggaggagctgtggatattcatgaagggggtcctgacgcacgtgtcctgaacaaacaggtgtgttacttacttgtgacccacgttcaccttggggtggagactgcacatctaactgcgttacaatcaggccctgcacgtcagaaggtggagccgggacgggaagcactcggtgcgcagcctctgtaaaccgccagaaccagtccggggctgggggtccctgctcaggggacagttactgaaatgcggctcttgtccgatggcagctgtggttctggctgggggagcaggggtcagcgaggcagcgtctggcagcgggtgagctgcacctgctttaacgttgttcgtctcaaggccagcgtttgggtgtcagagaaaaagaaaactcccgtggcaggtagaacataaataagtgcagcgtgtgtgacttcgcccctgcccggcatggcctcaggtcccgttgataatgtagcgtcttatggccacagtcagttctgctgggccatggtctccttttattttttaatttttaaaaaatttactttaagttctgggacacacgtgcagaacgtgcaggtttgttacacaggtatacacgtgccacggtagtttactgcacctattagcccgtcatctaggtttcaagccccgcatgcattaggtatttgtcctaatgctttccttccccttacaccccayccccgacaggccctgggatgcgctgttcccctctctgtgtccacgtgttctcattgttcaagtcccacttatgagtgagaacatgcggtgtttggttttctgttcctttgttagtctgctgaggatgatggtttccagcttcatccatgtccctgcaaaggacatgaactcattcttttttatggctgcacagtattccgtggtgtagatgtgccacattttctttacggtctctatgtaacattcacacccggcagctgctgggtctaaaccgcaaaggggagggggtgtgacgaggcgtctacctcccatcccatcactgctgggaactcagttttaaggtgggtctggggtccccttggccaagatggggttcatttagggttttatttttagttctcgggggcacagggttgggggagcatggttacgggagacagttgggggagtttgtgttcgggccaccagctgggaggttgtggagtggggcaaggattggggccatgggtcggtgcctacccagttggccccctggcctagagttggggggctcaggttgggaggtctctccttgcggttgccgggctgggggtcgctgttgggcgggggttggggcatctgcacccttgctgaaggctgcgtgtgccttccctcccagcctgtttgggggccaggctgaggggccgccggtcaccaacatcatgttcctgaagacgcacaagacggccagcagcacggtgctcaacatcctctaccgcttcgccgagacccacaacctgtccgtggcgctgcccgccggctcacgcgtccacctgggctacccctggctcttcctggcgcgctacgtggaaggcgtggggtcgcagcagcgcttcaacatcatgtgcaaccacctgaggttcaacctgcctcaggtacygcgggcctgctggggaggagggcgggctgcagccgtgcctgtggctgtgggtctgggtggtgtagcctggaggctggagagaaggagtgtaaggcttgggggcggggcgtgcagaaggcgggttgggagggcctgggccgcacgccctgctgagccaacccctgcccctccaggcggccagtcgcctgccgttgctcttggaatgagacctgggagccccacagcccctgcccaagggcgtccccagcgctcccccgcttctctggcctcctagttgtgcacaggcccggctctccccaccctgtgaccttcgcttctgtggctgcaggcccttctttgggtcccttgggtctcagcatagagccggcttccccccagggcttccctgaccttccttacaaaggaagcagggcagggagtgtgggtgggagggctgtgggcaggcacaggtgttttagggtcaccctgagcgctctgtggagaatggccagcagaggctaggtgaccaggcggggccagagggaggccgggtggggaraggtgatgggcagagagcggggcagcgggggtgtgctgtggggtgggggctgcggggcagagggaggaggaggggccgggaggaggggaaaggaagagggtgggggcagggaggaggcctcccactgttctctccctgggtttctgaggatggagaagcaggcggtgtagttgggcgtgactttctgcaagactttactttctgtgggtggggtatatcctccaggacctctgagggggcacaagcgagggtgagtccagacccaccctgtggggaacctgggtcacggaccttctctgggcctcagtttctttgtctgttaggtgggtgtcaccctggcctgtgggcagctggtggagtgctgaagccccctgtgccaggggcccgtggagggcccttcgtgctgtctgtgcgccacagcatcccactcctagaggcctctgggtctcctcgagatgccagtgggagctcctcctccctcctcctgctctgcccacggactcctcctcctgaggccccttcctggcgtccttggcctctgttctgggcacccgggaaccagtgactgggctgcagggcctgcgtgtggccctggctctgctcccggagctgccgcacgagaaggcgccaggcccaggttcctcggcagatgtgaggatgggggtgctccttgagcgggtgtggccagggcgcgcctcctccccgcgggtgggccaccctggcctgggcccgcggtccgcagcccgcctctctgtcgccacacaggtkcagaaagtcatgcccaacgacaccttctacttctccatcctgaggaaccccgtgttccagctggagtcctccttcatctactacaaaacctacgcccccgccttccggggcgycccgagcctggacgcgttcctggcctcgccgcggacgttctacaacgacagccgccacctcaggaacgtctacgccaagaacaacatgtggttcgacttcggcttcgaccccaacgcgcagtgcgaggagggctacgtgcgcgcgcgcatcgccgaggtggarcggcgcttccggctggtgctcatcgccgagcacctggacgagtccctggtgctgctgcggcgccggctgcgctgggcgctggacracrtggtggccttcaggctcaactcccgcagcgcgcgctccgtggcccgcctgtcgcccgagacccgggagcgcgcgcggagctggtgcgcgctggactggcgcctgtacgagcatttcaaccgcaccctctgggcgcagctgcgcgccgagctggggccgcggcggctgcgcggggaggtggagcggctgcgcgcccggaggcgcgaactcgcgagcctgtgcctgcaggacggcggcgcgctcaagaaccacacgcagatcagagacccgcgcctgcgcccctaccagtccggcaaggccgacatcctgggttacaacctccggccgggcctggacaaccagacgctgggcgtgtgccagaggcttgtgatgcctgagctccagtacatggcccgcctgtacgccctgcagttcccggagaagcccctcaagaacatcccgttcctgggggcgtagaggggccgggccggggacgaggcctcctgcggacaccagctcctctctccgccgtcaccggggaggccgrggatccttgcagggcttctggggcgttgggaaacccaggcccgccggccacggctctaaaatgaagagggcggagaccccagtgaagagcaccccccgcaatccgcgcagatccctcccagagaaggccctgagcccaggcggcagccacccgccccccttccgaggctgtgtctctgtttagaactgaacacgagggtggggagtgggggatgctggaccacagggcagcacctgcccggcaggatgcgcgtgcctgtgagccccgggactccccagggtcctgggcactkgggctgtggatcctcggaggaactcagagtggttcccctgaatttcccggccctggcgacgaggtgctggtcccagagacaggtgcaggcacaggcagtgccacaaagaccggcccgggagcggggcaggggccagggctcagccgctcccgaacagctccacagctttcgctgcaggaggtttggttctgatggaaggatgttttctacagagagatggcacaactgctcacaagaccagggttctagccggagcccaggtcgagytcagctccacgacccctgctggtcagcccctgatgcytcgtgaaggagaggagtctcacttgccaaaggaggctggagtggttgggggtacacacacccttggttgccttggagaccgtgttgggtgtggtgccagagggcagctgtgggtacccctctttgtcattcacagggagggacagagcctccctgcctggcaggaygtgatccctggctgccaggggctcagcgggtaaagggggtgcactcgccgggaccagccgatgcctggggcacccaggaaacgcagctactctgcagcatgctcagcctggaggctgagaccccagcagtggatctaggcctgcaggtctaggtgtgtccacgcttttttggggacgggaaaccagcatttcaaagaagggagagaaccggaaaccgcagcgtaggcagctccctcggaccccagtgtaatgggggagttgcaggaagagtgaattttcagtgagagtcggccgtgaagaatggcaggagctctgctgagtcagagtcagccagggacgtctgcaggccaccctccctccccctcaggcnnnnnnnnnnnnnnnnnnnntccgcaggccaccctccctcccccctcagcccagggacctcgccctccctccctccctcccccctcagcccaggaaaggcacaggagaggatcctgccaggtaaagggaaagtggcccgggaggagcccacgtgccaacaacaggagtcccagaagacagaaaagaccacagatgagaaagcagttcacgcagagaacaaaacrttcccggaccaaacccagggtcgggttgctcattcccgaggcccgatagcgagatgcagatgaactggggaagaagagggattttatttctgtaactggttacagggagaaggcctggaaatgatygccagaccaactccagattacagtttttccagagcttacacaccttctaagctctgtgtctccgtgtcagtgtgcattcgtctaaagacgtacgtgattcaattcttctcatctctaactgaggtytggtcctgaagatcttcctctgaagactcagtaaatttacttgatctaaatgggcccaggtgtttacccttatcttgtyttctgctaaatcatggaggtttggggagttccttctccacttgtttgtggaggcctggggagttttttcagacccccagtaaaacttgyttaatcctaaacgggtcctggtctcgtcatgcttcaaggcccaagaaagccctgggcaaaactcttgatgggcttttgttacgtcccagccctcgtgtgagggcgctggctctcagctttcaggatttcacttcaccctcagtcagtgctgaacagttgtcgcggaggcctgcgtgagtgaggcctggcgtgccctggaaacattcccctgagttgaagaaagactcacagttttcagcatccagttaccctctgagcatcaggcagaacccgccggccccaaaaccaggcccccttggcacatgtgggcccgagtgagtccagcatgaggaggtgccgcttctgagcagagctcaggttgtctctgggaggaggagcgagcgttgggtgcggtggccgctgcgttggcagccctgtccctgagcggaacgcaggtcgtctctgggaggaggagcgagggttggackcagtggccgctgcggtggcagccctgtccccaggcgtggactctgccctcagcttcacagtcaccgaagaaatgaagttacaggaggggcacaccgtccttttgtctctgcctttgaggttggcgggaactgaaactggtacggtctttttgaatagaaatttggggtctttctggcgacgtaaaactgtgtgtagtttgcagtagagagtgttgagaacagcctgtctgggctgtgcattgagaaggggcggttaaaatgctgccacgtcgtgcagcccataaaagggggacacagagtagccgaaactgctcttgggggagggggcacgtcccagccttccgtgtgatgctggggtcagcgtggcccctcggctgccagagctcacgaagacggttaaggaaagcttcccccgggtggctttcaccccacggggacagagccccagatgggcccagggacctctgagcagccgtgggccatggggtgacagttgggggttggtgggacccgtggctgtcatataccctgggtagacggtggcttgtccaggcagagatgcccaggggaagtgggtggcacctgagggcagatctgacttttcaagagaagctgaaaacacgggtttttctgtgaaatctctagattgaaaacagtgggcttgaaaagcctggagcagagggagtgaggcctgctccccaccccagctctgcgggcacaccctggccagacagccctgctccagacccggcctgtgtctcagggtggcccaggaggggactttgcaaggtgacgtggggcttggaggtcccgtttccctgtaagcctgggtacttaggggatggccctggtcagactccaccagtcccagacttgggggacacgagaagggagatgggccacccagttctggttgggctggggtggggcttctgaggggtggggaggttgtcccttcccacccacctgcccctgccccaggattctcggctgtgagcaggaggatgtgtacgatggccaagttgcctggactgggtccgcccctcctggggctgtgagtgcacaggacactgggcccacaggcacctctggggctctgtccccgtggggtgaaagccactggggggaagctttccttaaccgtcttcacgagctctggcggccgaggggccacggggggcattcagatgagtcagaaggagctggggcccacccctcctgcttcctcgccgcccccctcccagctgcccccagtaaatcccctcaggcccctaggacctggagggacgcggcaggtttatcatctcagcctggaaaccacgtgacctacctgtttcccaccacagcgccccaggtttcagaagcagctgaggatgcccttcgcaggggagggagggacagtgagaaaggagggtgttcagggcccagggatcccccacggaggctgccccatcagaacttaccggggacctgtggcctcctctgagattctggcctgggcagtggtcatttgagcattggttaccaaggctgcctctgaaatggcaggctgggggcaggccagcgtgaaagggactggcaggagtcctgcggggacaggctgggggcaggccagcgtgaatgggactggcaggagtcctgcagggcagctgtgctggggaggggtcaccctgggccctgagaggcacaggacattgcgatggggtgctggcctgccaggagcacagatacagagctagagcccagcgaggcctgtgctgcgaggggctgtgctgtgccaggggaggccccgcacccgggaagcccagaggagagtgtgcactcacggagccctcctggcagggccgcgtctctggagcagcagacccgtgtccctctgggaggtcaactgcggcctcacagctgggcctgtcccagcacagcccttgttggagggcgcacccccgtctcctcagcaccccagtgttgagtgcmttgacctgcagasgggagcctgtgctggtcccgggcgtctgtgtggctcctgggtgcccatctgcacccctggccctgctctgggcttcagtggagccgtgccaccgtgggagtgtccagggtcctgacgtagccctgagacgtggccagctccctggcctgctgcccgcacagtgggcccttgtctctgctctgggtcaggcgaggcagccacccatgatgagctctgcagccttcccaaggtggctggtgagtccctgccctttgcacccccagcaccctcacccctctacccgggcgcccggggtcaggacccgctcctgaggtatctgtccagctggccgccccctctgtctgggggtgctggacgagtcccactccttgccaaccccagggtggctcctcagctctcaaacaaggggcgggctgcagggattccgagggcccctccagcaggaggtcccacatgcatctcccaatgggacacttacctggcccacagggtgggtgtgacactgagggttcctgggggcagattcagggcatgggatggagacagactggttgtgaggggcccaatgcagggggccggccccagcccacagggtcgttctgcagatgggctggtcggggacgctctaccaggtgaagggtctgtggtcggagtcttcgccctggccagggcccaggacgctcacggtgcaggctgagggtcagagccgccgagggccccctgccgggattctgtgcaaagggcctctgcactttatgtgggtgcatgtgaatgcccctcgccaagatgttcctaccctgcacctgacacttcccacgacaagaagtgctgaccccagagggtgtgcgcggaccccagagggtgtgcgtggaccccagagggtgtgtgcggaccccagagggtgtgcgtggagggcctggtctgacctcaaggctcttggggcgcccacacaggatgggctgtgaggggttggcgggggtggggggggtggtctgtgatggccccctgctgagccagagtgacccctacaaccggtccaggggtccacggaccagaaggccaggttctcctggaggtcccatctcccctgggcctcggtttccccttctgtgactccacacccccaaggagggccctgtcagggagggcggggggcactggttaatgtccaggacatggctgtcccagtcaagccaaacccctggaatgtgctgaactggctacactgagcggggctggcctccgagacagaggggcctgccgaggacacggaggctctgtggaacccagggcctggccacactaactggggctggcctccgagacaggggaggtcctgaggacacggaggctctgtggaacccagggaactggtcacactgaggacacggaggctctgtggaacccagggaactggtcacactgaggacacggaggctctgtggaacccagggcctggccacactgagcacggctggtcccccaagacagagggacctcctgaggacacagagtctctgtggaacccagggcctggccacatggaggacacggaggctctgtggaacccagggcctggccgtggcaaggaagccccaagccaagtgtgtgtcagccttgtcctctctgtgggcctcagtttcccctctgtgcaacaaggggagtgaccagctggtttctggagtctcctcctctccctctctgtccccaggggtgggcctgggcctcatgtctgcagggggtgctgacacctgctcctgtggtccgggccttggggagggagccaagtgcagagagaatgtcttgcttgtgcctgctcagcccagagggacacatggcgtctgcacctgcttcccgcttgggcacaattgccctttgagagcagagccaggggcttcttggggacggaagctgctctcagaagccgcgcactggtggtgggggagcrgcaggaaggggccggccagctgtcctagccaagagcctttcaggaaccggtggcccagggcagaggtggctggaggtggagctgtctgtttgggcctcaggtgtcggggcaaggcctgcttgggttttacacgagtgttgcgcctttacccgggtctctgtcagtgggtcccgcctgacccgtgggtgtgcatgggtccccgtcgtaggcaggcgttctgccctggccaggcgtggtgtccggcatccggccatctccctcctccctccttcccttagccccgcatccaggtgccccgtgtgcccggcctgggcggctggccgtggatctgaccgctcctgcatggtggaggaccagcgttcccactgtctgcagctgtgccacctccctgtgccgggctgtgcgtgctcacgctcggctccgtctgcctttgtgcgatcagactgagagaccccccaggcaggtcccgcctgcaacaagcagaccccatgcgtgccccaaatgccccctcacccgggccctgccctggtgggtgttgcctgggagcaaactcccagaatggccgccgggccccactcggctttggagcttctgattcctgtgggcgcttctcaggtcagggccctgcaggtgggaagcaccaggcactggaatgagggcactgtggggccagctgcctgcaggcaggggtctgatcaccaagcacctgtcccctgcaggatccctggctgtggctcccccgatgacgttcaggaagtgggagccgatcccctgtccccagagagccccgtgactcccccgatgacgttcaggaagtgggagcggatcccctgtccccagagagccccgtgactcccccgatgacgttcaggaagtgggagcggatcccctgtccccagagagccccatgactcccccgatgacgttcaggaagtgggagccgatcccctgtccccagagagccccgtggctcccacaggtccctgtgggctcacctctttgtgtctctgctgtggcttccacggtgctgtggcctctattctggggacactgagctcctccttgctcgaggttttgggtcctcattgtccacatgacctcctgctgggcgaattctgggatgaccctgtgtcctgggcacatggctggcagggtcccgggggctctctggccagcctcccctgcaccctggcaccaaccagcctggccgagggtcagctcccagagccgtgttgagaggggaaggggctgattccacagacatttggggtggagtgggtgcgagggagggtgggggaggggctgctccagatctggggtgagggagtcagaaacagggctgaccccaaggtgggtacaggaagaggcccaggtgtgggcaggagctgtctgcacctcctgagcgcgttccccagtccagaccgggagcgagtgtggggctccctgggcctgtcttgctgacctgtggccctgtactgaccagcagagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcgggtgagtgagtggccgggggctctgtgtgggtgtagtggccggatctgctggggctgcacaccccgggatggggcgggggtggyggcggcaggcagatgcccgaggtagagatgagcaaaccaggctcagcgatcctgggtgccctgcggggggctgtgcccaggtccctggacgtcctggtcagcggaacttcctcctctgggcagtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcagggtaggcgggcagggtgccggtctgggtccctttgattggccacggtccacatggaagggagattccagcgggaaattgccattctg

SEQ ID NO: 12368 - DNA, 29349 bp, Homo sapiens
aattagtaaaaaatacctatgcacaagtacttctcaaactattctgccagaattaaataacaatggcctttctttgatgtgcaggtagaaaaaagtaaactaacaaatagaatttgttcaattttaagtttttcttctaaggacttcttttaaaccttttccacactattgcttatctactacacaagtaaaaagtacaaacagcaattgagtactgatagaaaaacttggaaacagttgatcaaggctagattcaattgtttagattttttaatgctgacttgtaattttatatgggtttaaaatgtgtcattttagttaagtttcttgttgaactatgattggatgctaaatctccgtttgtacaataaggttaaatgttacctcataacttgtatctgttttctgaaaaggaacaagaagcactggtttacaccagagagaggaagaattattttcaaaacaagagaatacactgttgctatttttctagtatctaaagcaacatatgtgaaacagattagagtgttactccaattccatttaagctttcctgagctgggcacagtgcctcccacctgtagtgctggctacttcagaggctgaggcaggaggatagcttgagcccaggggttcaagtccagtctgggcaacacagcaagattaagctttcgtggtggggtgggggagggggggactcagtttccgaacttgtaagataagtggattcaactagaaggtttgtgaaaacctttttagctctacatcattatgtttggttttcatcttctgaagttttctctagtataaatgccatagtggtatgatactgcagttggtatttaactttttatggtgctttacagtttatttttattttaattatttatttatttatttatttttgagacagagtttcgctctgtcacccagtctggagtgcaatggtgcgatcttggctcactgcaacctccgcctcccaggttcaaacgattctcctgcctcagtctcctgagtagctgagtttacaggggcacaacaccacacctggctaattttcgtatttttagtagagatggggtttcaccatgttggccagactggtctcaaactcctgacctcaagtgatctgcccacctcagcctcccaaagtgatagcagtacaggcgtgggccactgcacctagacggtgttttacggttttaaaagtcctgtcatacttcatatatttgcaaaaagtacaagaagaattcacttatcaaagtgttctttacataatcctggaagagttatattactatgacaatttaccaatcatattaatgatattgttgcatatattccaaatgcctatatacattagatgttgaaagaaaaaacggaaggcctgtaagttaaacgaattccccatgcttagttaaaaaacatccctagaaatatgctgtagaaaaatacaagctttcagaggatacgctaactaaaatcacaaatcttattttttcccttataatggttaatgtcataagagcaatataaaacaataaaaactcaataaaatgttatttctcatctcaatagatgtcgtactcaatagatgtctaatactaatgacattagatttagttatgagttcttctaaataaaaagtattctaaacatcaggcttgctttagcacaactggattctaggccatctctgacacccagtagctgtgctcttaaactatcaatcaaacaaataaaaggtactttaagccaggtattgtgccaggtgctagggatacaaacagaaataaacatggtccaggggcttggcgcagtggctcacatctgtaatcccagcactttgggaggctgaggtgggtggatcacctgaggccaagagttcaagaccagcatgggcaacatagcaaaatcctatctctacaaaaaatttataaaatgagccaggcatggtggtgcatgcctgtagtttcatgtactctggaagctgaagcaggagagcttaagaccaagagtttgagattacagtaagccatgattatgacacaacactctagcctgggcaacagagtgacagcctctctctaaaaaaaaaaaaataataatttttgaacataggatgacacaaacaaaacaaaacaaaaaaaaccatggtctctgtcctcaaattgagatgagattaatgactttttgctagatttgcttctgattgcattttagggctccatgagaggggagggaagggttaccaacactactgagtacctgccaggtattctacatatatcatcttatttaacaataatcttgataagtaaatattatttattttacaaaagaagaacttaaggcccaaataatggtttaaggtcacattacagagcccaaatgaaaactcagatctttcacctacaccacactatctaataactgaataatggcaattcatttcaacttaggcaactttgaagggtccttatagtgaaaggatttaagacatacctgaaagttatgaaagaaaaaagcatttgaggcacaaggaacagcaggggtaatagtatagaatgagtatcaggtatattcagaaggtaacaagaatgcttgtatgactttcatattggagagataagcttaggaaacaaaactgaaaaggcagattagtgtcaaatcatgggttccaaaattttgcataattttccaccagatgaagttccctgatcattaccactgtcctcaactgaatttccttcttctctgactttagtgtacttatattactttatgcatttgtcacacattaatacctaaaatttagtgaacatttattatgctctagtcactgttgtaagcagttcatatgtataattcattccattctcataataccatgaagtaggtactgttattaccatcaacttaaagatgagacacagagaaggaaattgtacaagatctgtcagtaagtggaagaactgggacttaaacccaggcaatctggctccagagcctgaactcctaatctgtgctatggtgcctgttcaaggaaaatcttatttcccctattaaaatgtgagttccttgagggacagaatgaaaagaggtttttgttggcttttgttgttgttggggacggagaggggggtgcgtatttacatcctccacacttaggacagttcctgagacacagcagacatttgccagtatttgttgagctgaactggcctcaaatactcaaccaaggcgtctgggctgggcgtggtggctcacgcctataatccccgaattttgggaggctggggtgagaggatcacttgagcccaggtgttcaagaccagcctgggcaatacagggagaccccgtctcttttaaattaaattaacaacaaaaaaaagccaggcgtggtggtatgcgcctgtaattgcagctactcaggaggctaaggtgaggggaacccttgggcccaggaggtcaaggctgcagtgagctgtaatcgtgctacaatactccagtctgggcaacagagcgagactctgtctagaaaaaaaaaaaaaaaagagagagagaaagagagagagtctgggttgttcttcctataggtcaaggatcaccaaattattctgtaaagggccagatagcaaatattttaggctttgcgggccataaggtctctgtcacaattactcatctctgcccttcctgtgcaaaagcagctacaatatgtaaacaaatgagcatggctgtgttccaagaaaagtttatttacgaaaacagtgagccaactggcccatgtgctccagtttgctgacccctattatacagataataggaatatattaaaggtttctaagcagagaaattgagtttttagattaactgtgatggcaatgtaaccagaaagagaccatctaggagtttccatattgaaaccaaagtcatggcctcctttatctttctataatcattctaaaacagtgttgtccaatggagatacaatgtaagccacaaatgtgagccaggtatgtaattttaatttttttctttttcttttttttttttcagagacaggatctcgctctatcacccaggctggagtacagtggcacaaatmrtagctcactgtaacctcaagcttaggctcaagcaatcctcctgtcttggcctcctaaagtgctgggactacgggtgtgagccaccatacctagcctacttttaaattttctagaagtcacattttaaaaagacttttaaaagcaggtgaaattaattttaataatacattgtatttaacccaatatacccaaaaatattgccatttaacacataatataaaaattgacatattttacattcttttttcatagtaagtcttaaaaatccaacgtgcattttcatatgtaaagcacaacaattcagataagccccatttcaaatgtctaataaccacatgtggctagtggctaccatactggacagcattaaaagaatgatcaactaaacctacagatctccatatgcagctgctggttttgggaccatctccttgaccggcttgccattgatttttgaccgaattctgaactatatatactacagtttgacattactggcaactcaataaggcaatgtcttcattttttatgttacatttgtacaccacttagttttcacatacgatttcacacctgatcctcattacaaacacgtgaatacgcaaaagatttcacacctgatcctcattacaaacacgtgaatacgcatgttatatcagttttacaaatgaggaaagaacgttcagagaaaaaaagagacaaccattgagtgttagaactgagaaaaaaaaagtaagtctcctgacctctggtcaaatctatttacgccccaataataccacctccttaatcaaagttgcacttctctgtgcgactggtctttatttcctccagtgattgtaaactccatgaagaaaaggactgtttttcctgaccactgtattcccagtgcccagtaaggtgttttacaaggaggcaatatttattgaatgaattaatgacgtttctgcttttctcatttttagtcggttaaatgtaatttacttttttaaagcaactgatgtgaagagccaaagtacgccaccaaattggtaggtttttaaaagttgaactttactgccaacatacttcaaaagagaacgagggggaaaggctcggagccaaggcctgagttctagtcctgaccctgccatgaactggctgtgagccctcacgtaaatttttttaacttctctgggccagagttcttatctgtcaaaagggaagagtagggctataatcttcacgattccgtgcacaggtagggtttttgacattaacttgatgtgagccggcttcctaactcctcacacccttcctccagtcccctctgcaacggccgacttggtgagagaggtaaccaccgggccctctgggttccctatccgcttcctaggggggccgactcgacacctaggtgcaaggtggatcccacgggccagaaccgccatctttccccattggcctgaccccaaccgccacccgcgggcactggatgacgcggrccttacctctcctcacagtctttgcatttcacctgcaacgggactagttggtggaacagcacttggctcatgttggctcgctgcctcggctggtgtgcagaaaagcccaacaggcccggccctcgggattagcctgagasgtccgggtcctgataaagtttgagtttggcgctcggcttctgcggaggaggcggggagggagaaacgaggggaaggcgtaagagacttggccctcgccagccaccatcggattcttccggttctgcggaggataaagggaagacggttgtggtagttccgggtattaacctgtgtggcgcgggggctgaggcagccatgtttgttaagggaaggagacccgaaggaagcttctaacttttcttctggttgccggatgctggacaccggaagcgagccctagaattatggcgacctccgcgacgtcgccgcacgcgcctggttttccagctgagggtagatgcggttactatgtggaaaagaagaaacggttctgcaggatggtggtggccgcagggaaaagattttgtggtgaacacgctggagccryggaggtgtggtatcgccctactctctcaagagtcggaaataagtatcctggtcctgtcggtgctggaacccggcccctcccctctttgacagctttctgcttgtgtcccctggattctccagctttcactttaataaacccagttttgccctccttgcggagcgattatgagttctagtgatgagaaattttttatttttctaagtaaagcgccagcagtgacccatttattttgatctatttatctcgatcttaactcatggtaatgctaggttttaatttttaccccaagctaccgctccgtcttcctgctggaaagtggtagtttagaaaaagtagtgattgaagtcccaaaggtttcactagttgtgttctaattgttatttcatgaaagagaagcacttctcgtgaatgcggttggaagaaactttcttttaaaaatttagacttgaggcccggcgcggtggctcacgcctgtaatcccagcactttgggaggccgaggcgggcggatcacttgaggtcaggagctcgagaccagcctggccaacatgatgaaaccctctctctactaaaaataagaaaatcagccgtggcgcgagctactaaaattaagaaaatcgtggtggtgcgagcctgtaaccccagctactcgggaggctgaggcaggagaatcgcttgaacccaggaggtggaggtggcaataatccaagatcacaccactgcattccagcctgggtgacagccagactgaatctcaaaaaagaaaaaaaaatttttttcgacttacagtttttaagaatgcaactttgctggaatgggaaggaaagatttttaaatatatacgaattgaccttttacaattgagaacaaagcatacaattttgtttgataattatgcatataaatgtactatcaaacactttatatttgtatatatgtatattactttaggatatatatgagatgggaaaataaaaaccagaggagcaaaatgctcataggaagagagcatgtccttatagttccacagaactataaagaataaaccaaagcgatcagcatcagatttcatgcttctgaatgttcagtattatttgcattattttatttcttaaggaatttattcttctagacaatatccagtgcagatcagtcccctgacccccttcatctgccactctccatcatagttgtagtctacttcctattttgttttgactggcatttaccaaaagtgaagcatactgaaacaaggacattcttgttttggaatatgggagacgtgatttgttgtgggaactctgaattatgcccatagtctattgactggttttgaggggactggcaaacatcccttgttgaagaatgagagttatgataggagaaggatttagactccaccttatccagatatatggaaggtgaaaacaaatagtgatgatagtagaatatgaataaatccttacaagctgattagtattcctatagaggaacgacatattgtcattagacacttgaagagagaccgcaaaacatcaagtggaaacacttttattgactactatctcgttttaaattgtggctatcctcctgaatctgtaatttatgatgtaactggatgttgtgtttccatctttttttctaagtgtcatatatagctgtgatgacaccactcatttttacccagtggttctcgactgggactgattttgcctccagtgaacacttggcaaaatgaagacattttggttgtcaaactgaggagtatcactgacatctaatggatagagaccagaaatgctgctaaacctcctacaaatcacaggacagccccctgcactcaccccctcaaaagaattacctgcccaaaacgtcaatagtgccaagattgagaattcctgtttctaaattcaactaataaattttaaatgtgctttttttttcctatgctacagttaggctctgggggttagaatagtcttttacatggaggttaggatttaaagtcagcaataaggaagaaattatatacagtattttctttttcttctattgaatatatagtattttcaaaaaaaaaatttcttagctttcccatgaaattcagtgtgaatagcttcatggacatgctgagaggcacattcgaacagaaataaatttttaaaagaataataatagcagacacttagtcaccacttactctatgtacagcactgggctaggcagttttgttttgttaactattagctcacttaatgtgttcaaaccttagaaggtaagacatatttttgttctcatctttcagatgaggcagtaagcctacctaactaaggtcatagggatcgtagctggtaggtagagctgggtatcatacctaggcagtctggctggcctgtgttcttaactgttatatgacccctatttatacagattcatgtggaatattgggtagaattgccaacattatcaattttcctttcttttttcccagttcatatagtcatgtgccacataatgacatttcagtcaacaacagaccgcatatatgatggtggtcccataaggttataatactgtatttttactgtaccttttctatgtttagatatgtttagatacacaaatacttacattgtgttacaattgcctacagtatttagtatggtaacatgctgtacaggtttacagcctagtagcaataggctatactatataggctagatgtacagtaggctatactatctaggtttgtgttactatactgtatgatgttctcccaatgacaaaatcacctaaagatatatttctcagaatgtattcccagtcattaagtgatgtaacttaggaatgagtaggatgtaactgatagtaaaaagttgcaaagccagtaaaatatggcacatccaaatggttaaaatgccatgttccattgtttctaagaaactttatttttacattttaacattctaaaatcaggatacatcttaaaatccatatgtcaatgggcagcattttccaaaaaatgattagtatgtgaggcaatacatgttaattagcttgatttagccattccacaatgtatacatatttgaaaacattatgttgtattaaaaccatacataaataatagtgtatattatttttattgccataaaaatcacaattacttttgtacaaacctaatatgtgataaatatatacaactatttgtcaattaacatgaaataggcagcatttttttctttcttggttgtgcataaaatagtcatacatataatagttgatgctatcttagatttcagacaccatatgtaggccttctctataccctgtttgaagctatagacccttgtttgtccaaagcagtatttgttcatatgtatttaagccagtacactggagagtttttgttaaacccttgggacctgattttgccaacttttcattatgtccttgtaaggtttccttaccttgttttgagattacagagacactgaagttatatctggtatctgtaagcaataaacttgatattttatttaaataaatgtatctcttaatttattaggaagaagatgctcggaaaagaatcctgtgtcctttagatccaaaacagtaagtgtggatcagatacgggtttttttttgtgctggaaacagtaattggcacaagtctcatttgaaataattttctctttaaatttagcacagtatatgaagatcaactagcaaagcatttgaaaaaatgtaactcaagagagaaaccaaaacctgtaagtgtttgatcagtaaaattgaatggtgaaatgtgrtatgtaatgccttggtagatgctgcacatggaatgtacttgtttcatagctgaggaacccaagctcaggaaatataatttttttttaaagagatagggtctcactctgtcactcaggctggagtgcagtggcgtgatcgtagctcactgcagccttgaactcctggactcaagcaatcctctcacctcagcctcatgactagctgggactataggcaaacgacaccacacctggcttatttttttatttttttatagagacggggttctcgctgtgttgcccaggctggtctcgaactgctggtgtcaagcagtactcctgcctcagcctcccaaagtgctaggattataggcgtgagccaccaaatccagccaggaaatacaaatatttttaaattgggtagtaggcaaacctgcctgacttttgttccataagtagacatttatttattacactgtacaataagggctgccatgcgatccaggaggtgacaccatttctgtcttccaagggtgcttggtatacaagctcccttgaaaaggtagtctgggaaaaaagataatcagtgcctttgcttctaagactcatagaaaatcgagacttatgggaggatgtcttgcaatagcaccgctcagttactttgacaacaaaatactcccattcatttccaaatgcctcccagttgagaaccactgggccagatggcataagtttagaaagtatttttacattaagatggtgtagaagaaaaatgatgaccctcaccaccaccacctacttaggacttagcccctttaatagaaagagagaacattggctttgtttgcaaatatcttccttacctaagttccaggtttcagttaaagcaagcatgtgcaatatgtgttcagagaaaagtttgagaggatagataaatttattaaaaatggaaacccttgggtgagtttcactgcataccaacacacagtggcaaggaaatggagaaaagcggtggaatgatgagacgaagaaagaaatgcaaagcagtatttatctggttcactatgtagagtaggacacttggaacccaggtaaaggcatatcactattctgctttactttgggaaactggtgaacaatttttttaaattttgtatactaaataaaagttagttggttataaatttctccagtataaatagttttcacatttaaaaatctaatctacaacrtaagttacctggagcactcttggcaaccattttgaactaagagtacatcaaattctmatacttaacagctagttttctattatagtttttttccgttatccagtaaaacattgtaattcctgcagtaaaacattgtaattcctgcagtaaaacattgtaattcctgcagtcttcactcattccactcamtcaccagtttccattgcaagcaacacacattctgtccatataggtaaagctagcaacacacaatcaggatgttacctttctgcctccatgtaacaaaagtccatttactacacataacataatgtccccaagagttattttcacttttgaaacaggatttgtagaaacagtactttttcattcatctagatccacaccgttcagtatggcagccactagccacatatgactatttaaatttgaattaaaactaaataaaattaaaaatctagtttctcagtcacactagtcatatttcagtggctgccatattggccagagcagatgtagaacatttccatcattgcagaaagttctgttggacaatggtaatgcagatccttacctagaatctgtatttctgaagccagactagaaagatttcattatgtgtgtttgtttgtttctttgtttattttagagacagggtctccctatattgcccaggctggtctcaaattcctgggttcaagggatccttctgccttggcctcccaaagtgctaggattacaggcctgagccactgtgcctggcttcattacgttaatttaaatagtgtgacaggacatttatattttcaagttttaattaataktttaaaatagaagaaatcagacttattgttataatatctttgtcttatctgtttttggtcatgctgcatgtctgataagcagcattgtgtagttagtactttgctgtttttactttagcactataagacaaaattattacagttctcagtgtatgctgtcaacagtctaggctgtagaacttttaataagtgttacaaatgaatttctttaaactgtaagtgcttattcagataatcacctcactagaatataagatccacgaacacatatttttgtcacttttgttatctactgtggtggagtgcccaatacctaaagcaaactagggcctagagtaaatattcaatagtgatttcatgaagaaatgaatggaggaagggaggatggcaggtacagagcaggggataaagggaagaatcagtattttagtttaatttttgtgagctacacattattaacagttcttttatggttttgtttttgttaaggatttctatattcaagatattaatgcaggcttaagagatgaaacagaaatacctgaacaattagtaagtacattgacttaatatttaattttaaaakatatttataagctctcttcatgatgtgaataaggcatgttctaatttttgtctcaagtctgtttttaatttagaatgcattttcctgtagacttaatattgttagtgatggttagttcctagacccagaccagctcatgccccataacaaaagaagctacaatatggccctgaatcccctttgattcttgaacccttctgagcctagacttgttcttgaccttgaggaagttaggaaaattaaagtagcacagcaaagacggagtagaaatttagcagttggacaattctgatggcagcttagggaaaaggcttgatagagagaagagcctaagctgtcatgggatttgcccagttggtaaacctctactcagtctctgttatgctactttaaagcaatttttggctacattatttagttttatttttgtatataggttccaatttcttctctatctgaagagcagttggaaaagttaattaagaaattgagaaaagcaagtgaaggtaagactgcctaaagttgcaagttcaattattttagagtaattaggtggtatatgagttgataccattctggtttaaaatatgttactactattgttcagaatcctacaattacatgtttggctgcttaagctgttgtgcttatatttggcacaggcttgaattctacacttaaagatcatattatgtcccatccagcattacacgatgcacttaatgaccctaaaaatggcgattctgcaaccaagcacctgaaacagcaggtatgtttaggctatagtaactactaaacatggcctttgttcatttgttaaaactgttttaaatgtaattattaataagattttattttgtttacctttgagggtaccaaatatttccatttcaaaaatatatagaaacatatacaaaaaattgagggcatggatgtgattctgagtaccgtatattaaatatttaaaggcaagagagaaaaattttaagtcaaatacaaattatcaatgtaagcatactgccttatgcagaaattaccttgctgttttcccatttgaaccaaatgtgtttactctagtttataaaataatcttgtgaagtttgcaggcttctattttaggtaacattgaaaatttaaagttacttggtccaagaagatgctttgttgagtttggagcgggaaagggaaaattatctcattgggttgatattgccttaaaagatgctgaaaaagttcacttcatcctagtggaaaaggtgaccacaagattcaaggtaagtgaaaccattgctctgtgttagtaaccaaacttgttttcattttttgtattcaggaaaaaagtgatagaaacatttcttaaaagaaaggaaaggaattttctttatctgtttgttgtagctttttattagttctaattgtattgataactcaaactgaaggtgaattttttaatctaagttttgatagtccattgatctgaattcttaaaattatttgcagagacaggaaaatatatagaaagagccaagytcaagctaggagttaaaagtcttgggctctactcctatctttgccacttgcccttcattcattaaacaatttttgagcatactgccaggccccacccaggctgaagtacagtggcaggatcgtggctcactgcagccttgacctcctgggctcatataatcctcccatttcagcctcatgagtagctgggactatagtcccacgccaccatgcccaggtaattttttaaaattttttgtggagacagggtctcactttgtcgcccaggctggtgtcraactcctgagcttaagccatcctcccaccttacccttccaaagtgctggaattacaagtgtgagccactgtgcccagccactttattacttatatttagaaaagagacccaggcaaatacataaatgattgtagtgaagtgttaaaatacgagaaaggtctgcacagagtacagcatggtttcaaagaagggagtgacaagttctattgcagggaagagatggagaatgactatgtagaaaaggtgatgcttgaactaaatcttgaaaggtgaattggtgtttgttagagagtttgagaagcattctaggaagcaagaacagtgtaaccaaatacctgaaataacaggaaaatatggaaacattcctgtataatgggagtacatggtgcaaagtagagttcagcaatgatgggactggagaggatggctagcctatagaaggtctcatattttatgctaaggaaggagtttgactatgctgctgtctggtggggatacaatagaaaaaagatttagttcttggctttgaggaagcttacgtctagtggagtagacatataaatatttgtgttcagtatgctaagtgtgttttgatagtggtaagtacccaatcctatgggagcatgaagatagagcaccaacctcagtctagtgtgggtcatagaagtttttgcagaagtgacagttgagatgagattgaaataatatgtaagagttggtaaagtagaaggaaatttttcaaagtttatcctagcagcaccattaaaactatattagaagagtctgatacttagagagattaataataaagataatttttgtccaacaatccaagtaagaaagaggccagagctaaagctattgcattgggatggagaggagggcaagagtatgagaaatattaagatgttggaagccacaagagttggtgatttgttagtaattgaatatgagagataaggagtaattctcggtaggatttttatggcttaggtgactaagtggtgttctttcctgagataaggaatgaaggaggcacaagaggaaggatggttttggagacagaaataatgagttcagttctgaatgtgtccagtttgctggtgaagtagagctttctagttcacaattgagtatgtgtctgatgcccattggagaggcctgagccacaaatgtagatcagccggtcgtgggcacataggtatagattagaatggttgtgatctttcaggagagcaagaagaggagcgaaccaaaaatagtacaccaggagtgacaaagataaaggagctagtagacaatcttagataaatcacttaagatctgtgaacttcagttcctttgtcagtgaattgggaatttttagggttaaaggaaataatgtctatgtaataattgataaacattttcaaatcttttttaaaaagtgtgatattttgaagttctcatcaaagaatgtacaatcttaatttttaaatatgttctgttgctctgaattttgaaaaccaataaaaatctttttattttcataaagcttttttaaatgtaagaagtgattattacaataatgttctgtttgtgcaggtggatggaaaacacagaaagaaaaattcagtgtttgaaagacttcaaattgatattcaacacttgtgtttgagtaagttgtgtaactttccattggtctacaaataaatcataactgttttaaactctgaggttgcttagaaatccaatcatgcagaactgtgcttcagggaaaacagtcaaatcaattcattgttaatatagaatgttttatataatgtttttaaatagatgtaaattgaattaaggttgagaattttaaaaattttcagtatcaagtggaaatgaagtgttatattagggaagagtttaaaagttttataatatgtacttctgttgtttctttgtcctgtttaaattaattttgagtctgttcaaactataaactagccttctgcctgcagttaacgtgactttacctaaaccatgaaagaaaatgagatatttctctgcctagctaatgtgtaaaagatacttcctagaattttaaattgtacaaaagaagtcatcactgtgggattcatattccatacacaaaacacacacagacacatacacacacaaactcctcaatcaacctctgtagtgccctttttataccttttctatttttcagattatccaaagaaaataatgcaaacatatctttgcaacctcttccattcaccaattttaatccagccatgaaaagcaacccagcatttgtatagaaatcaatgtatttaaaattatttagctgaatatattaactttctgatgttatgaaccctaaacaagttcttatgttatatgttgggttccataaagtgataatttttgtttgagtctctttcaggctaaaattcagagactctaattagttcyttcttttggaaggccacattaatatgtactttatttcactagacagttaattctcatttccatttcagacaagattcctgtgytaagagaagaaaaactacctgtggtaggaattggaaagcatctgtgtggtatggcaacaggtacgtaaacatactgataatgtttacattaatgcattaagttktggcctaacctggccccaaccatttcagtggtctcttttgaatagatatcttatgtttacaactcaataatctttatagagcactggccctgtgctttattagatgcatagctttcctatttatctgctcatattggccattttgcaggatgaattaagagttttgtatgtaaatactgcatcacattagaccttaaagttctttgggttaaatttcaaccagaaaaggaaaataagaccatttatggaaactgtatgattccacctagaagctactgattttttagagtagttgcttagaaagaactcagaaacctcttctactaaaagactattgtgtttcaggattctggggaaaaagaaaaaaataaatgttagacaaaaaaaaaaaatctaagatgtcttgtcttagcactttgatccatcagatctagcatggtaaagtggaaacagcatgtgctttagaatcagatagtctagccttcagctttgttgtgtaaccttgtcaaattacttaacctttctgagctttggttacctcatctataaaacagagatactaatatattaataatttaccgggttgcatgtaaagtgtctggcacataatagtgctcaataaatgttaattattgttacatcatcttcctaacttttgctagtttcatcatctacccatatggattacttggagcatccatagatattattcatattggctggaaatggcattgagtactatatatttgtgttggccttcatagtttttaagactatagtcatgtacaacataacgatgatttggtcaacaatggactcatatatgacagtggtcctataaaattataccatatttttactgtaccttttttgtatttagatacacaaataccattgtgttacagttgcctacagtattcagtaacatgctgtacaggtttgtagcttaggagcaataggctgtgccatacaccctaggtgtgtagtaggctacactacaccatctaggtttgtgtagtacactctgatgttcctacaatgatgaaatcgcctaatgcatttcccaaaacatacaccaatagttaagcaatgcatgactgtacttttgcataccttatctcatttaagcctcataaaagtcttctaaagtaaaccagttccatcccgggggtaggagggagtacactcttttgacctacagtggccatttctcatgttccacataattttttcccttgattcactgtatctgaatcctccttttgtctctgctgcagttgcttaccctttttgaaattccattttcttctcttttgcgatactcttatttcctggttcttcccctacatctatgccattcttctgtttatttcacagtctccttccacttctgtccttaaaatactaatattcaggccaggcacagtggcttatgcctggaaacccaacactggaggctgaggtgagatgattgcttgaggctaggagttcaggattagcttgggcacataggaagaccccatctctacagaaatttgttgggcacgatagcttgtgcatgtagtcccagctattcaggaggctgaggtgggaggatcacttgagcctaagagtctgagtctgcagtcaactgggatagcaccactgcactgcagcctgggtgacagagcaagaccctatctcaatcggtcaatcaatctcagacccatctgctacacaactaatgtgtctttccctttaaactcttcggtacttcctgatatagtccaaactctttgacataacgttttagtctcaatctggcttcagccttcctctctttacatttcctgtctcctactttgctgttcagcaacatcaaaccctgtgtgcttttccatagactgtactatttctactatatctggaatttcacccccattcacctactcacccaaacaaaacaactggtcaatttttactcatccttcacctcagttgtcaccactctcagggagctcccttaaataagatatgcctccttggtgttatcataataccctctgcatatttttaccttgtggtattttaattatctgtttatatatctaattcttccaccatgctctgaattttttgagtatatggtatatacttagtacgatgcttgctatataacaggaacacagtgaatatttgaatgaatgartaatcttggctaccaatttgctgtgtttccttgtccctttctgcatatgtggctttgtcttttaagttctttataaaagatgaattgagataaattgctaaagctccttctaattctgaaataacttaattcttttttttttttcttcgagacggagtctcgctctgtcgcccagactggagtgcagtggcgcaatctcggctcactgcawcctccgcctcccggcttcaagcgattctcctgcctcagcctcccgaattgctgggactacagactcgtgccaccacgcccggctaatttttgtatttttagtagagacgggatttcaccgtgttagccaggaaggtctccatctcctgacctcgtgatctgcccacctcagccggcgtgagctactgcgcctggcctgaaataacttaattcttttaataatttatctggttattcacatttctgaaaatcacttacttaagtcaaatatgaataaaacaatgactaaatgtattttgtcagaaaataatagtttatgaaataatagattagctatcactttctgcaaataatgggtttctaatgtttgttgacttaaattcatatattgaattaaatttactagtgaaatatcagatcatttaatagtcatttgtgatatcttagggtaataaaattttaaaatatgtatatgtttttgattgaacagacacaacatgacaatctaatgattaagaagatatgggtcctacrttttgggtctttccagtattgtcaacagtgtaggagttttcgatgggaaatagccatagtcatcaaaaatccatttatttagttttaaaatatactaaaatattttcattgtaatgtggagtacatctgcctcttaagtttgtgtatattaataattgtatcctcagtgctttgcacatgaaaggcattcagtaaatgtttgttaaataaatgaataaatacagtaaggctactcagtgaggcctgctttccagattctgttctgacgccctcttttcaactcttcagttcatcactatttgctatgagcctcttcaagacaagcatcttgacctagcatcaacctaaacagatttgtctgcccttcctccctcccttccttccttccttcatttttcctttcttaaactagaatgtaagtgtaggtgaataaagttttcccatacaagtcatttcctcagctaaggtaggaaaagtgagagacaattcaggtagttgggtaaaagttcttcaaattgtagatcttaagcttcagatagctttattgggaagtaggctttatgcagaataaatcattaaagaaattgagaagatagaagagcaaatttgaatgaagttgataattcatgatagtattattacaaatataaagctgagtaggtttttgctgtttttattgttgagtttttaaaaacagtactgcttaataaatgtaaaaagtatttatttttaaagatgatgtggtttgggggggccacataattgtgtttgcagatcttgcattacgatgtttggttgaaacctatgctgccagttttgaggaaaggaatgaagaacctttagccaaacgcataaagaatgataaaacagaaaaagaaatttacactttggccaaggaaggaaatgaaaaaaatgtcccagagaagtggaaccctgtggctggcattgttattgcactctgttgtcaccacaggtgtgattggagacattatgtgggcaaagaatatttcagggctctaggccttggagcagtggaattccattatttccagcgaatgagtagttgggcaacttgtgggatgcggaaaacatctttggaaacctcaaatagtaccacaaagaggcaagataatcagaatgatgatagtgaagagcatgatgatggaggatacagaatcacagatgatggcgctgattgtttgcctgggtaagagactacttttgtaatgcatgatactaaaggagaaatattatattgtactgtactttagatgactattatcaacaattcatgaaaatgtattttataatctaattttagaataagctaaaatatacacatcttttattgtggtcataaatataatgtgtcttggaagcatgggacaaagtacttagtacattatgggttagttaacagtctctcaataaatagtgacaaaaataattttttataaacttttgcaaaattttaacaatgttttrtgtgtgtttattcaatttaggcttcttagtgttgaagaaaagaagaaaatagggcatctttgtaaattgctgattgaccaaggtcgaatccagtatttgcagcagaagggattcagtcctgctttgcagtactatacagaccctctggtgtctttggaaaatgttttgttaactgctttaccaaatcattcttcatcaccagaaacaactgcttaatggaaaagaaatttgagcatcatctgtcttccaccaaaaaaawttttttaattatatttttatatcaaaaaaatatatactttaaatagcaaataatatgaactttaaaaaatgctgtggcctcattaaactttggtaatagcttttctttttacttcagaaatccaaacattagagaattcaccaaagtaatcctctttagaagggcatcttgaattatattatccatccgtatttatggagattggtaaagtagttgaaccgttgacttggtgatctgaaacatacataacatgtcaacacataattagcgtatttctgtttgtattaattttggaaatttatcttcctttgattttatttaatattttttatttcttaagttcaagaggtagtgattgattgtaacaagggccaatctgagaatttgacttatatgtggacatttttccctacagatctggaaagcacaattgtgattttctcaaatgcagacaattcagagatattcacaattaataaacacaattaattaatgaagtcaccttcaaatttccagagccatacatgtatatattgtcagaatctgtccatgacaaacacaaaactgaagagctgttttcaaagaaaaaagattatttcacttaattattttgttggataattgtctagttagaacttccaaaaagatacttacaaacataattcacaaatttgaaataatttctgaagttgattagctatctcatatcttttatcaggtcattttttatatatgtaggcacaaacaataagtatgttctcttctgtttgggaaaataatttggaataaaatagaaattagataatgaaaccaaaaaccttctcaaatttaggccttatttaactcatgactggtttctatgcacaagaaaatactaaaccaaatatatggtaggactgttattctcttctgcatcttatccctattttgtttctgcctttatttgtaaaaattgtcttaattgatggtacatttgccaagacaaaggttcagaattactaattttagatattatgatattctgaaataactatttttatcctgtagttctatgattatatgatttgtaaataagaagcctaaccaatttaaaattcctgactttagtctcatatatcttgtcagactgtctcggttcaaattccaaacctaccatcttcagttgtgcgaccttgggcatgctacctaatctctttgtgcctcaatttcctccttttaaaatggggatgatgatgataacaataatacctacctcacaaggttgttgtgagcatcaaatgagataacacaagtaaaatgcatagaacagttccaagcacagagtaattcaataaatattaactagtaatagtagtggtagtaactcgtgaatctttttaataacataataggctttgattttattatctctttaagttgttaacttttttcccttgttataagttttatgtcaagtaaggtagtttgtttaagttagttacccatgtccccaatcaagggaacctaaatgaagatatatcattaaataattaacctttttttattgtgtcaagcaatactaatttgtgtcataaaatttgttttgcatcattcaacaatttatgcccagaaataaacaatattctacaacaggcataatctcatttatgtttgataaaatatacatacacacccaagaattatcatacagaaacagttctgtggcccatttagcttaatggtatgtttctgacaatggtatcaagtaccttaaaggaagataagtttgtccttcaacatgccagccttaggtcaggattattgttttcctaactgttaatttgtcttcacatatcatgagaaagtgactgtgggatatgcatacagctatttcttgtcctgcagaattttcagattcaacaaacctcttcttgaacttcagattcacctgcacaattaccacaacttgcatgttccacaggtgcatcaaatttactgctaagggccaggtgtggtggcttacacctgtaatcccagcactttgggaggccaaggcaggtgaatcacctgaggtcaggagttcgagaccagcctgaccaatatggtgaaaccctgtctctactaaaaatacgaaattagtggggcgtggcgtggtggtgcatgcctgtaagctactcaggaggctgaggcaggagaatcacttgaacctgggaggcgaaatttgccaagtgagccgagattgcaccattgcactctagcctgggcaaccagagagaaactcctcaaaaaaaaaaaaaaaaaaaaaaaagactgccaaaattagaaatcatcttctgcctctaccacctgattctattcgccaacccatcttctgtacttcattctccatcttagcaccaccatctatccagttgccctctaaaccaaaaacattcattgtaaactcccttttctcatcttcattcaattaccaattctgtctcctaattgtctttatatattctctgctttccaaaactaggtcacaattatgacttttttgcctgtcttcccccaatctgtctccatgtcattgcttctatgaccttgctgcaataaatctaatcaccatttcctaaacatcctccactgaatgttagtaaaaattatttcctttagctgaaaaactctgtcattgtcttctcagttatattcatttttcaaactagttgttgcattaagttgaactaaaatctaccttttaagttaaaaattcttaacattttaaaattataagactatgatttctgttactattgtttcattgtttttattaacaaataattgtgcactttgtcctcttcccctgatcttggtttagcttaaaggccctcaattaattatcagagactaagtgattgaaatctctatatcaaaacctcacactttgttcattaaaatctgtgttctcagccagacgtggtggcatgcactaatagccccagttacttcagaggctgaggtcggatgatctcttgagcccaggagttcaaggctacagtgagctatgattgtgcctttgaatagccactgcactccagcctgggcaacatagtaagacctcatctctttaaaacaaacaaacaaacaaacaaacaaaaaactgtgttctcaatatttttcatccctaggtaaatttttttttctatttatggaatgacagggaaggtcagttcatggtcaaactgctatgtgtggcaagctggtagaatgaggtagcaaagctttaagaatcatgtcttcactcacttggttttacttcagatgcttagccaaaggatttatttccttcccccacttgaaagactttgaatatctttaaaacctctctctctatttcactttttttcttcccacaatattgactaagagaacagaatttgacagaaaacttaagatggaatgagaaatatataaaggaattaatcaaaaggcagcagttagtgatatacacattactctaccaaaaaacatttaatctgtgttatatacaaatcttatacctgctcttctccgtgactcttgtatgtatgtgtgcataaactgaaggccaaataattcccgttcctcttcttcatctgtgccttcactgggaggaagtgatactttcaatttcagtgggttgtctctgaagttgacaaacctagaagttcatcaaaaaacagtatttttataggtgtcatggaagtgtacatttatttccctggagaaaggtcaaatgataatatactaaattactcgtttttaactggtttcaataactgaacgacttggtgagatgtgatatatctcaagaatcttatgtttttttcctaagagaaaaaaaaacactagctttagacaacttactttcaaagcttataaaagcaactgttagtctagttgcacaggctggagtgtagtggcatgatctggactcatggcaccctccacctcccgggttcaagtgattcttgtgcttcagcctcccaagtagctgggactagaggtgcacaccatgacgcccggccaatttttgcatttttagtagagacagggttttgccatattggccaggctggtctcaaactcctggcctcaagtgatctgcctgcctcagcctcctaaagtactgggattacaggtgtgagccaccacatctggcctacagcatatatttaatgcaatacagcttaacttctaagagcaattttaacatatcttaaatataaaattagtgctatgaacttagtttctgcataatttatatacctccatcttacttatcattgtgtcttcaccacccagtacaaggcaggtagttgctgaacaagtgaataaatgaattattttgttatcgaagttttgggttttagtgggtattctcttattctcatttgtcagaagattaagctttggaagaaaaatacttgagggagcgttcaagatgggttaaaacttaaatgtcacatctgaaacagtaaaaatcctagaagaaatcctaggaaaaactcttctggacattggcctaggcaaagaatttatgatgaagacctcaaaagcaaacataacaaaaccaaaaatagacaaatgagatttaattagaaaaacttctgcacagtaaaagtaataatcaacagttaatagacaacctatagaatgggagaaaatatatgtaaattatacatctgacaaagaactaatatccagaatctacaaagaactcaacaagaaaaaaaccaaccccacaagcgggcaaaggacatgaacagacatttcccaaaagaagacatacaagcaacctaaaataatctaaaataatttttaaaaagaaaaaatgcttgacagagttttgatagtacttagtaaaaagttatatctagtggctttttgtttgtttgtttttgttttgtttttaagaaatagtctctgtttcccaagctggagtacagtggcgcaatcttggctcactgcaacctcgaactcctgggctcaagcgatcctccagcctcagcctcccaagtagctgttataggcatgcaccaccactcccgactaatatatctgctatcaataacataattgtttccctttgtgcttatttaggaaataaacacttttatgcttttgatttttatgttgtgagtgaagtttttttagctgtataattttcatgaaaatgtcatcaacagaggacatttctttttttttttaggttggtattataacatttattaaaataatgctatgggttaatacaaacagcgaagaaccaaagaattaaaatgcaagctatgtaaaatcccaactaaaacccaaaaatgtctaatgtattcattcatttagctaactagaagcccaaaagagacaagacacccaatataataaagtactgcaaaacaattggcaattttcagttatcaaaattgtggattttgcaatttgtatccttttctcaagaaaaaaaattccttttgaatgttatgtaacatacatataaaacaagatagaaaaatacactataaacttgtaacaatggctgtaaatattttatcttacatgtttctcataggcaataggttggttatggtacatacatagcatgaaacataataaagaaaagacaaaaatacttgtcagctgtatggtaacatacaagtgacactcccatctacccatgctaaaaaattacataatactgtgagaaaaaaagtcttaaaaactacatattttaataagaaacaaattcaatgaagaatgataatactgagaaccaaggcattcagagatttcaagtcatgctttttttcagttgattcaaaattttgtcaaccaagttttcaaaagtttgttcagagccaacattacccataaaggtcacacatttattatttcatacatttactttcttccccataaaagacctttgataaacatctaaaatggaagacatttcttaaagctgataaatcccaaactgctttagttttaaggattctttcttgaatagaccagtgttatatgaatcctattcatcaaattatagaatgtcaacattggaaaagatttttaagatatccattcacataaataacaactgaaatttattaataacaatctctctacagtacttttttctgtagccagaaagaaagcaaggtttttcagttttgtgcctacaactttttacctcagatttgccatttcttccatgcatactggaatatcttgcagtttattgttgctgagaacaagagtacccagatttttcatattgctgattgtttgaggcaagcatgttatttcatttcgttgcagccataacgtatgtagattttgcattctgaaaaattaaggtttctacaattaattacatataatatgaaaatattggttttggagttttaacaaataattttaagaggtaggggtcttatcatgttgtccaggatggtctcaaactcctgagctcaggctattctccccctcagcctcctaaagtgctgggattacaggcgtgagccactgcacccagcctttggttcttatgttaaaaatcaaatgtcttttacaacatctttaaccagtatacttattgagttaactgacatcacattacctggttattagagaaaccacatcaggaagtttatctctacagtacaactctcatgtcatatggcaatagaaatgaaatcaaatcaacatattctagaattctttcactattctcataggatttcttgaagaagaactactgtaaatgttacctaatctgagacagagtcttaagagaacaataaaatgatgaatatgcccatttatagcaaagcagtatgcataatgcgtaacatcatgaactctggggccaggctgcctaggttcaaatcctagcttgcccacttactaacttgagcgagttagctaacatctctgtcattagtttcttcatccacttgtaaagtgcatagaagtgcttggcatatgctaagcaaggtggttattgtggcatattcttgttaatttctcaaagtcagccacttttggccaggtgtggtggctcaggcatgtaatcccagaactctgggaggctgaggtaggtggatcacttgaaaaaagccagttttttcttcttcccaaacccttttacttacttggaacaaatgaaaatattctgttaaaacagtgtatttcaaactagttggacctattgtgattgattatgcttgagatcccatttgtcttgcttggttatttttcataagaggtttcaagacttttatcattagcataaagagttatttcttttacctttctatagtatcaggaagttgttcaagtttgttgcttcccatgtccagccactcaagggcaggcatgttcaacacagcaagagggattgtagtaaaatcgttcatactcagatcaaggtgagtaagttttagcagattgctgagctgaagaagaaagcaaggtttttcaaaataaatgtccacaatgtaaactactaaaagactcacattggtaaaggagatatttcacatccaggaatattcacattttacttgggctttatttagtcatattagtccgcaacaaattaaaaataaatataaagctaaatgacctccaggga

SEQ ID NO: 12369 - DNA, 41916 bp, Homo sapiens
aaaggaaataaaaaatattttacaatagctagaaagaaaaaaaaatacttagaaataaattcaactagaggtgaaagatctgtccactgcaaactataaaacattgatgaaaaaaattgaagacataaataaatgaaaagatatcccatgttcatagattggaagaattaatattgttaaagtgtccatactacccaaagtgatctacagattcaatgaaatctctatcaaaatcctaatgactgttttcacagaaatagaataaacaatcctaaagttccacaaaagacttcaaatagccaaagcaatcttgagcaaaaagaacaaagctggggtgttgacactacctgacttcaaaatataccacaccgctacagtaatcaaacagcatgataaggctggacacagtgacccacgcctataatcacaacactttgggaggctgaggcagaaggattgcttgagcccaggaattcaagaccagcctgggcaacacaggcagaacctgtctctgcaaaaaatgttttaaatgctgggtatggtggcgtgtgcctgtggccccagctactcaggagactgaggtgggagaattgcttgggcctgggaggtcgaggctgcaaagagttctgattgtaccactgcactctagcctgggcaacacagtgagatcctgcctcaaaaaaggctgcaagaaaacagcatgatagccaggtgcagaggcacatgcctatagtcccagctactagggaggctaaggcaggaggattgctggagcccaggagttcaatgccagcctgggcaacatagtgagaccctgtctctaaaaatacaaataagtaaaacagtatggtactggcataaaaacagacgcagaccgatagaacagaatagagagcccagaaataaattcacacatttatggtcaattggttttttgtttgttttgagacagggtctccctttgtcacccaggctgaagtgcagtgatgctatcatagcttactgcagccttgagctcttgggctcaaaggatcctcctgcctcaccctcctgagtagctaagattacaggtgtgccccattatgcccagctaattaaaacttttttttttttttgtagaggcaggggcttgctatgttgcccaggttggtttcaaactcctgacctcaagcaatccacacatctcagcctcgtaatgtgcttggattacaggcataagccaatatgcccagccaacagtcaactgatttttgacaaaggtgccaagaacacacaatcagcaaacaacactctcttcactcaatggtgttgggacaactggatatccatatacagaggaataaaactaatacttcatgctacattaaaaaataaactacaaatgaattaaagacttaaatataagacctaaaactataaaactactagaagaaaccatagaagaaaagctccatgacattcatctgggcaataattttttggatacaaatccaaaaacacaggcaacaaaaacaaacattgacaaatgggattacaccaaactaaaaatctcttgcacggccaagaacacaaacaacaaagtgaagagacaacctgtctgcaaatcatacatccgataaggggttaataaaaaaaaaaaaaaaaaaaaagaaactcaactcagcaatgagaaaacaaagaactcaatttaaaaattggcaaaggatctgagtagacatttctccaaagaagacataaaaatatccaacaggtatatgaaaaagtgccccaaatcaaaaatcacagtgagatatcacctcacgcctgttagaatgactgttatcaaaaacacaaaagataacacgtgttggtgaggatgtggagaaaaggaaacccttgcacattgttggtgggaatgtaaattagtacagcccttgtgaaaaacagtatggagattcctaaaaaaaattaaaaattaaaaaactactataggatccattaatccagtactaagtacgtatccaaaataaaggaaatcagtatgtcaaacagatatctgcaccctgatgcttattacaatattattcacactagccaagatgaaatgaacctaagtgttcatcaacagatgaatggataaagaaaatgcatatgtacacaatggagtgttattcagccttgaaaaagaaagaaatcctgtcactagcaacaacatgaataaatgtggaagacattatattaagtgaaataagccaggaacagaaacacaaatataccacttaatttcacttatacacgggatctaagaaagttgaactcatagaagtagagaatatggtggttaccagagacttgggagaggggttggggaaacagacaaacaaactacctatttcaaaatttttttatagcagcctgagcagactaagacagacccttacccaataccatgtataaaaattaactcaagccgggcgcggtggctcacgcctgtaatcccagcactttgggaggccgaggcgggcggatcacgaggtcaggagatcgagaccacggtgaaaccccgtctctactaaaaatacaaaaaattagccgggcgcagtggcgggcgcctgtagtcccagctactcgggaggctgaggcaggagaatggcctgaacccggaaggcggagcttgcagtgagcggagatcgcgccacagcactcccgcctgggcgacagaacgagactccgtctcaaaaaaaaaaaaaaaaaattaactcaaaacagatcaaagacctaaatgtaagatccaaaactataaaactctaagaagtaaacataggtgaaaagcttcacagcattggatttggcaatgatttattggataagacatcaaaagcacaggccacagaagaaaaggtgaagtggatcaggcctataatcccagtactttgggaaacagaagtgggaggattgcttgaggccgggggttcaagattacagtgagctatgattgcgccactgcacttcagtctgggtaacagagtgagaccctgtctcttaaaaaaaagacagactggatatcataaaattttttaaatttgtgcatcaaaagacactattaagagagtaaaaaggcaacccacagaatgggagaaaatatttgcaagtattatatctaataagagattaatatccagaatattgtcattcaccacttaatgatggggatacattctgagaaatacgtcatttggtgattttgccattgtgagaacaacatagagtgtattctgtgtgataaaatacacataacattaaatttaccatcttgatcattttttttttttttttttttttttttttttttgagacggagtctcgctctgtagcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgatcatttttaagtgtacagttcagtggtattaaacacattcataatattgtgcaaccatcaccaccatctatctccataattttttatttgtccttttgtaactggcttacttagcataatgtcctcaagaatcatccatgtcgtagcctttgtcagaattccagaattacattacagtacttgcctagtaagggagttgctgctgctgatcccagaaccagctacatctgctgaggctaggcaacttttgctgccaaaacaaaccccagaacatactgcttttgctgctacccatgccagcaaaaatggacaccagcgacacaagtcacccaacagagccctttgttggtgtatataattagtggaaccttagtagtgtataaaattagtcacataccccattccagtagcaggggaggctgggatttcttttccccctcaaattctaccttggaaaggtaggattcatgatgtgggggattataaaaatgtggatggtgttcaaaatattttggacagtcgtaaatgacagatagatattcattatatagtgcctgtctctttgcattcactttctacatccctccaaagtcaccaaaattctggctaatttgtgtcataaatagctcaggcatctattcactttccctatcctcccgggcatttctttagtgtaagtcactccatggggatgggaaataaaaggtagataagggaaggagaagagagatgccttgaaatttgtgggttctctataaatactgtcaaattaaaatttaattgtacgtagtgccaaaggcagaaagaaatcttaattttctccaaggtaacaatatactgttctttttaactgaaacaaaactccctggatctgtctctctctctctctctttttttttttttttcttcagacaaggaaggctctgttgcccaggctggagtgcagtggcaccatcacagcttgacctccctggctcaaggtatcctcccacctcagtctcccaagtagctgagactacatatacacaccactacacctggctagttttattttattttatttatttttatttttatggagacagggccaccatgcctggctactttaattttttttttttttttttttttttttttggtagatacagggtctcactctgttgctcaggctggtctccagctcctgggctcaagtgatcctaccatcttggcctctcaaagtgctgggattacaggtgtgagatcttgatttttacttatgaacacatgcaagcactctgtatgtgttgggtggtgtacactctcgggacagggaagttagagtttcaattgtggccatggcttctttactctttctgtgatcttgagcagtcccacaactcttagaacttaattcattatagaagtgttggagaatttctgtgagataatcaggcataaatttttaaagcattaatattgctgagatgtccaaatgactacataaattatgatccacctacacgctaaactgctatgtagccattaaaaagaatgacgctgctctaaatatactaatatgaaacagtttccaagatatcctgagtgaagaaaagacagtatagaacaatgtatatagtatgctaccatttttgtatgtgtgcatgccttcacatatgtgtgcttttaagggatataggcatatttaagctcgtaaattcatagaccatctttgtaaaggtacacaaagaactggcaatagtggttgccttcagagaagagaacttgaagagaacctccctactggaggcagggatggtggaaggggtgggggatggagagagtggagattgagcttttgaattctgttccatgtgcatatattataaattcaaaaaaagatatagtttattttttaagaacctggaattaagtcctatctatgaaagctgaagagatcaaagtgagaggtaatttaatttgaagcccaggtacagcagaagtttggggcttctgtgttactcatgcttatccacacctttattttttctttttctaaagcatctgggtctttagttcaaatatttgcagatccatggtttactgggtagaatttttgttgtggcatacatcaacatattccaagtttctctgcttggatggaatagatgcatgaaattctgtgaaatgattaagctgtgaaaagtagaaggactttgaataggcattatttttcaagatcttataaatagttatgcctgatagttttataatgtctgtagcgtattttgcagtccacagaaygcactcacatacattatcagctgatccgtcgcaaagaagcctcatgtgattctttctattctcagctttgtccatgaactaaaattagaactaggctgacattacatttcacttggttacagctgactggggattttaatcatttggagccacactgaaaaaaaaatttccccctgcaatctactcttaactgatagtcgctaactttggttatgtgtggtaagtatttgacaatggtaagtatttttcaaaaacatttttcctttcttcttcacatgtaaatagattgctgctgatacctatactgtgtctgtattggttggaatgtccaaacaaactggaatagaatttaaaagtttttttgcggggtgttcatggtcactcatataattgtgctcctctggaagatagatttccccagaagtaagaaacaattcttctgcaattcttttctatgcttacctcacttgtcacattatgtgctttttttctattatggtactaatcagagtagagagcagtcctgtgctggaggaagaaatatatcattattgacttgtgtttccctaggggaagttggttgttataggaaaactgatggatgagcaacatttaatggcaaatgaggaaatgaattagcaaatggatgaattgttttacatgtcttctaaaatacatgtatacatgtagatacttgggaattcaaaaatatttttattcgagtatttagcaaaaacttcaaactttcttaaattagagacaataaattgtaaattggttgcaatatgctcaggaagttggattaccagtgtatgtatcccaaggtttcttcacagcaaagagatctcgcattctgttcctgagtaaattcggcatgccttgcttagagattctctcaacaatttcctgcctatgccaattatttatcaatcttgaaattttaaacttttttctgtaatatagttctcctctttctttgactgtctcacacacatatatactgcataatattagtttaaaaaatcaataatttagaagaggttaataatgaaaagcaatattatctatccgattcctctctatcaccagtcctgctccctagaagtaatcattttaaccattttggaatttagttttcagtggttatctccatatttctctcttttttttctttttcaaagacaattgcatgctatttttaatcaactttaaacatctgtggagcttcattatgagaggtggggattaagttcccttacactgccatagagttatatccctatttttagcttctctcttgattaccttaataactttaagcaaatactttaatctttatttcttgttccataaggtacagacagtatctgttgattccccacttcgaagatgtggatatcggtgttcttatcatttacttcttttccttatttccttcttccatattctgttaaaagtactgtcacttttatgttttcaagatatatggcatttatattctgttctgtaaccctcaataagtcttccttacttttttatagattgatttatttcaaaagtttaagaccaatacatagactttactatgtaatttctgttttctgcagagccaacatttccttctcagtatcaatgtcatattcattgtactaaagaagaatgttaaaatagattctcctttcctgcacttcaataaatgctaaaaaatcatgccacattttgttsgctctatatatggactgtggctttcttgtacagtgtcttcctcaacacaatttctgactgcctttctttttgcttattgggagaagaaatttcatcttttcaccatatctccaatgtcacacagttttttcccccttaattctagctatttttataattcaatggatgaatactgccattccttttttttgtttgtttttgagacagagtttcattcttgttgtctggtctgtagtgcaatggtgcaatctcagctcactgcaacctctgcctcccgggttcaagtgattctcctgcctcagcctcccaagtagctgggattacaggcatgtgccaccacgcctggctaattttatgtttttttagtagagacggggtttcaccatgttggtcaggctggtcttgaactcctgacctcaagcgatccaccagcctcccaaactgctgggattacaggcgtgagccaccgtgtccagctattgcttttaaaacattgttttactttatttttaatttttttactatcatgtaaaacattgctgggaacagtcttgttcatgtttcctggtggagacacacccttcctctaggtacatacctttgaatggaattgctggatcataagctgtgcttatcttcaatattagtacataagtatttcaaaatagttaatactaatttacaatttcaccaatataccaggagtccatgaggatttctgtaactcaaattctcaccaacacttggtataatcagccttttgaattttagccgttctgacagatgttcattggtatcttattatgtttttattaaggtggagcacaacttcatatgtttttggtcatttggatttttttttctccacagggaaagttctaccatttggattttattttttgaaaatttcctgttcaattgtattttctgttgcctttttcagctgattttaaggagttcgttatatattctagatgtaatccattggtggttatatatattgccaatatcttcccccactaatgtacatggtattccttttattttctaagtgatgtctttcaataggttcttaattgtaatgtagtccactttatcaatctgtgttaggctgttcttgcattgctataaagaaataactggccaggcacagcagctcatgtttgtgatcctagcacttctggaggccaatgcaggaggatcacttgagcccaggagttcaagaccagcctggagaatgtggagacatcctgtcactaccaaaaaaaaaaaaaaaaaactggcacactggttcttgctgtagtcccagctattctgaaggctgaggcagagggggcccaggagatcaaggctactataagccatgattgtgccactacactccagccttggtggcagagtaagcctgtctcaaaaaaacaaaaaacaaacaaacaaaaaaccacaaaacaaagaaatacctgaaactgggtaaattacaaagaaaagaggtttaactggctcacggttctgcaggctttacagggagctttcaatcatggtggaaggcaaagggggaagcctgcgtcccgcaaggccagaacaggagcaaaagagggagcagggggaggtgccacaaacttaaagaaccagatctcccaagaactcactgtttcaaggacagcaccacgccatgagggatcctcctccatgatccaatcacctcctacctagccaacacctccaacgttggggattacagttcaacatgagatttggtgggaacatatattcaaactatattgtgatatagtatatcttttcctttatggatatgctttgtattctgttttaaaaagtgttctctactttaaggacatcaagataagtcctatattgtcacctaaatgctttattttttctactttcacttttagatctacaattcacatggaattaattttggtaatacatagatattcaactgtcccaatataatttctcttaaaaaattattcccatggccaggtgtggtggctcacacctgtagtcccagcactttgggaggccaaggcaggcagatcacttgagcccaggagttcaagatcagcctgggcaacatggtaaaaccccatctctacagaaaaatacataaattagccaggtgtggtggtgtgcacctgtagtcccagctacttgggaggctgaggtgggaggatggcttgaacccaggaggtggaggttgcagtgagccaagatcatgccactgctctccagcctgggcaacagaaccagaccctgtctaaaaaaaaaaaaaaatttccacaatgttctgcagtgcctatgtgtatatgagtctgtttctggggttccttattcaggtacactggtatgtttttctattgcaccaataacattatctagyaccatagctttaaaagagatcttgatgaatgcaaaataaatcctcccactctagttttctttggcaagagtgtctgggctattttgtatccttagaattgtcattaaaaattagaaactgattgtcaggttgctcctctccttctccaaatgaattttgtattgagattgattatagttcaatgtggggataattgacatttttacagattgagtctttctatcaatgaatatgatgtatatctcttcatttatttaggccttctttaatttcactctaatttttagttttctgtatagaagttttacatattctgttcattgttaagaatttgatttttatgctattgaaaatagtatatttttcagaacttaatatatattttccgctggaatatagacacataattgatttttcaaaatattgacttgtcagaagtcttgctaaattctatatatttagttgtaaattctcctggattttctagttcataattgtactcatgaaaaatgtccttttgttttttattccttttcaaactttaagccttttatttctttttcttgcttttatgcaatgggtagagccatgatacagtattgaatggaagtagtgagagcagacatcttttactaattttaaatgaaaggctttcaatgttacactatcaagtatgattgctgcaggtttttattagacatacttggttaggttaaataaattatcttctacttagagtatgttaagacttgtttttaatcacgatattaaattttaataattttctacatctattggaatgatcatattttctttctcttctagtctattcagaatattacattaattgatttctcaaacaaaggtaagcaaacaaatcttaatctctggaataaacccaatatggctgtaatgtattttcttttttttgttttgttttgttttgttttttttttgagacagagtctggctctgtcgcccaggctggagtgcagtgccaccatctcagctcactgcaacctccgcctcttgggttcaagcgattctcctgcttcagcctcccaagtagctgggattacaggtgcatgccaccacacctggctaatttttgtattttttatttttatttattttatttttattttttttggagacagattctcgctgtgtcacccaggctggcgtgcagtggcatgatcttggctcactgcaacctcctaatttttttttttttttgagacagagtctcgctctgtcacccaggatggagtgcagtggcatgatctcagctcactgcaagctctacttcccaggttcacgccattctcctgcctcagcctcccaagtagctgggactacaggcgcctgccaccacgcccggctaattttttgtatttttagtagagacagggtttcaccatgttagccaggatggtcttgatctcctgacttcgtgatccccccgcctcggcctcccaaagtgctgggactacaggtatgagccaccgcgcctggccacaattttttggtattttagtagagacggggtttcactgtgttgcctaggctggtctcgaactcctgagttcatgcaatctgcccacctcggcctcccaaagtgctaggattacaggcatgagccaccacgcctggccttttttgtatttttttagtagagacggggtttcaccatgttgtccaggctggtcttgaacacctgacctcaagtgatctgcccgcctcggcctcccaaagtgctggaattacatgcatgagccagtgcgcctggccagtattttctttttcctatattgccagatatggtttgccagtatatggtttaggacttttctctgttaatatatttgttagtgagattagtctgtatttttctttctagaattaccattcttggggtttggtatcaagcatatgctaatctcataatctgaattggggagtatttcttttctattctcaggaagagttcattctatgattagtgttattttttacccctcaaatgcttggtagaattttccactgaagtcatctctgggaccagcattttgtttgtggagagattttagattattattattgtattctattgtgtcattttaaaattttatacatgtgtgtgtttatctataatattccctttcttctgttttctttgtgtttgttttatctagcttcttgagatggatgtaaattttttagcctcatttcttctaaaatgtatacttaagactagaaatttccctctactacattacctatattccatacactttgatttgtggtatttttgttaattcagttcaaaatgccttctaatttcatgatgatagcttctttgactacaggttatttagaagtgtgtttcatggatgggtgcagtagctcaagcctgtaatctcagcactttgggaggctgaggtgggagcatcatttgagcccaggagtttgagaccagcccaggcaacatagcaagacccctgtctttacaaaaaaaaaaaaaaacaagccaggcatggttgtacacatctgtagtcccagctacttggaaggctgaagcaggagaattacttaagtcctggagtttgaggctgcagtgagccgagatcacgcctctgcactccagcctatgggacagaacgagaccatgtctcaaaaaaaaaaaaaaaaagaagaaagaaaaaaaaaagtgtgtttctttagctgaaataatataggctttttttccaggtatcttttcattattgatttctagcaagtttatattttgattagaataaaaacttcatgctactttaatcccttgaaattgactgagacttgctctatgaccccaatatgagattttttttctgtgactcttccatgtgttttttaaagcattatgtattctgtcattgtaggatatagttctttatttatcatttaagtaagtttattcattgtgtggttcaaattttcagtattcttcctaagttttaaactgcttgtgcaaccaattgctaaaagaattgttaaaatatcccacttcagttctggaatccttgattttcccctttagttctgtcaattttcctttgtatatttggaagccatgttattagaggcatgtagtttaaagttgttttatatttcttgtggattaaatctcttattatgatatgattgatcttttatatctgtaaagtatttgtgcctaaagtccattttgtctgctattaatatattgatactagccttcttttgcttagtgtttgcatagtatatcttcctcagttctcaaaaaatttaattgattagccagacatggtggcacatgcctatacttccagctacctgagaggctgaggcaggaggatcacttgagcccagaggtcaaggctgcagagagtcatatcccgccactatattgtagcctgggtgatagagtgagaccctgtctcaaaagagcaaagaaagaaagaagaaagggatggagggagggaaggaggaaggaagaaacgaaagaaataaagatataaaaaagaaagaaaaaattaattgaaatataattcatatataaattctctcttttagtgtacagctcagtagttttattcaagagttgtacaatcattatcactaattctagaacattttcatcactcaaaaaactgtacagttagcagtcactccctatttccccctctacaaatcccctgggtaccacaaagctactttttgaatctacagatttgcctattctggacatttcatataaatgagatcatatatgtggtcttttgtgtctgacttctttcacttagcataattttattcaaggtttatttatactgtggcatgtatctatacttcattcatttttatggccaaataacattccattgtatggatataccacatcttgtttatccattcatcagtagatggccatttgtgttgttgccactttttagctattatgaatactgtttctatcaacattcatgtgcaggattttgtgagaacatatgttttcatttctgtttctatatacttaggagtggatcttttcctgttcttgtactgtccacttttctctacctttattttttaggtgtgcctctcataaacaacactcaggattttgtcttttctttaactggacaacctttgtatattaacttggaacacttaatcatcagggaagtacaaattatgaccaccctgggatatggctttatgcagtaatggatgtatatcaacggggacccttatacagtggtagtaagagtataaatgggcacaatcaatttggaaaacaatttggctctgacttataaattggaacatttacatacactatgatccagcaattctaattctagatatgtacccagtagaaataattccactggaacaccaagaagataaaaacattaattttagaaacattattgcttataatagcaaagctctgggacccaaatattcacattcattagaatggataaactgtgggatagttatatattttggagatcatggcatatgaatatataagatacctttcttttcttttttttgagctatataatttcccatgatatgggtagactatagtttaccgatgaaatattaggttgtttacaatattttgctgttatgaaaaacactgcgaataacttcaaaaatatttgagggataaattgctagtgtggatgagcattagtgagtttagtaagtattaccaagtttctctccatacagaatataataataccaccattgatgaaggaaagtgtctgtttccctatgttgttgcaaattttattgctttcttttccaactacattactttctatttactttacttcctttatggttttcctataatgttgaatagaagtgattgtgaatgtctttgcattcctgaatttgaaaggaaataattcaaataattgtgaatcaaattattttattattactaatttgatcaaaaatcagtacgattattttaaggccataggatattccataaaatgtacctaccataatttacataaccattttcctattattgagtattttcctttcatttctgagattcaggtcaaaatccttaatactgcgtcatccatttgcaatttattttacacaaaaggaaacaatcccaatatattatcacttaactgaatttctacttgtgcatatggtgtcctgattagattgatatctcaagattccagtctttttaaaaatctccattatttaaccattttcctataattggacatgaagactagttgcagtttttcattattatgaaatacacagtaacaaaggaatcatatattagatatgagacccccaagaaaattgttcaccttctttaaagcttaattttctcatctatacattagtcaataaaagtacctatattatagtattttatgagagtttttaaatatgatatggcatgtaaagtatataaaatagtttttggagcatggaatgtgttctataaatattagctattatgatcattatggtactcaatgaacagtctgaaacattgctttttttctctggtacatttaggtcctttctgaaatggtatctatgattcagctattcaaaacctaatgaagttggtgactatgacaatgtggagaaatcatgacagaaaatgtggtttgtactggggctgtcaatgctgtwaaggaagtttgggaaaaaagaataaagaaactcaatgaagacctgaagcgagagaaggaatttcaacacaagtatgctaawacatatttattattttgaattagtgaaaattcatattatcatcaccataaaaaagagcattctaaatgccttgttattgaatttgatatagaattttatttactgaaaactcaaaatatacttaaagaaaacagctgactcaattaaatktgtctatgcgataggagtcacaaaaaatacaaatgtgaaaatggtagctatcwtataccctcataggactctgtttaacattcatcaaagtttgattagtatcatatagtctaattttcaggattgtatgttcagcattatatgccctaggacctaaaacaacatttgacagtagaaggtacagtagattctcatttatttgaatagccatgtgttctagccagagctgctggatcacttgattccttgatctgggctatatttatttgactctcatttcctctgcctccattttatcttacctactttcctgattggatgtcaccaaaaagtattctactaatcctgcaaaaatagtccctttcctcatagatgcatatagttccatacaattctcattcattgtctctttctatcattattattattattattattattattattattattattattattatttttgaaatggagactcactctgtcgcccaggctggagtgcaatggcatgatctcagctcactgcaacctccgcctcccagattcaagtgattctccctgcctcagccttccaagtagctaggattacaggcgcatgccaccacactcagctaatttttgtattcttagtagagacagggtttcaccatgttggccaggctggtcttgaactcctgacctcaggtgatccacccaccttggcctcctaaagtgctgggattacaggcatgagccaccatgccaggccattgcctctttctaaacattaaattagcaaatgttatttgccgatgtcagttagcaaataacaaaaaattcaactaaagatggtttaggcgatagggaagtgaggctgttctgaagatagtcaatgcaaagcctcaacatcttttaaaagtcagcttttttttttaatcaccttccactgttaatccctgtgtcagtctgatcctcggattagcttccttcagtgttacaagatgactgatgcacttccaggcatcacagccaatgatcattatgttttcagaaaagtggaaactatttttttctatttcttctttaagagtaaagaaatctttcacagagggtccctaacaaacctctccttcacttctcattggccagaattggatcatttgtacacatctaacccagttaccttctaggggaatgagactgattggtttagataaattaagattcatccctggtgtattagtctgttttcatgctgctgataaagacatacctgagactgggtaatttataaaggaaagaggcttaattgactcacagttccacatggctggggaggcctcacaatcatggtggaagatgaaggaagagcaaacggacatcttacatggcagctggcaaagagagaatgagaaccaagtgaaaggggaaacctcttataaaaccattgtcttggtgattaacatgtggctcctcattacttatacaaatttctgcagccagcttgaatttctcctcagaaaatgggtttttcttttctatcacatcctcaggctgcaaattttctgaatttttatgctctgtttcccttttaaaactgagtgcttttaacagcacccaagtcacctcttgaatgcttcgctgcttagaaatgtcttccctcagataccctaaatcatcttcttcaagttcaacgttccacagatctctagggcaggggcaaaatgctgccattctctttgctaaaacatagcaagagtgacctttactccagttcccaacaagttcctcatctccatctgcgatcacctcagcctggatttcattgtccatatcattatcagcattttggtcaaagccattgaacaagtctctaggaagttccaaactttcccacattttcttttcttcttctgagccatccagctgttccaacctctgcctgttatccagttccaaagtcacttccacatttttgggtatctttacagcagtgccccactctatcggtaccaatttactattttagtccgttttcacactgctgataaagacatacctgagactgggtaatttataaagaaaagaggtttaattgactcacagttccacatggctggggaggcctcacaatcatggtggaagccaaaggaagagcaaagggacatcttacatgacagtcagcaaagagagaatgagaaccaaatgaaaggggaatcctcagccagacatggtggctcacgcctgtaatcccagctacatgggagcctgaggcaggagaattgcttgaacccaggaagcagaggttgcagtaagccaagattgcaccattgcactccagcctgggcaacaagagtgaaattccatctcaaaaaaaaaaaaaaaaaagaaaggggaaacctctcataaaaccatcagatcttgggagagagaatgagaacagtataagggaaactgcccccatgattcaattgtctcccactgggaccctcccacaacacgtgggaattatggaagccacaattcaagatgagatttgggtggggacatagcaaaaccatatcacctggattacttggtaaacacttggacttggaagcaattgatattcttccagtaaacgagggtggggggcaagaagctactgataagcaatgatttgtgttgctaaatatctgtaaaaacaaaagatcttgacagggaggaataatttttcccacttagtttttagtaagtgtgcagacatagcaagattcctgttcaaagtggattctgcaaggacagagagggaagcccaaggtcaatcctggtcaagcagaggatgtggagcctggctaaagttttgataaaagggatctttgtcattaattaagaatcacttaatttcagaaatttcagaagttctctatataggaataatgagtgtgcagtcttgccctttcttactgcttgttcttttttggcatcatctattttatgattagggaggaggattctctgttagcaaaatgtaatttccaaaagttaagttagaccaaaatcagcttctacttttagaaacattacatggaatttgtgtaatgtagtttttcaaagcacctttcccttaatcttaaaacaattacattgtaaaatcattgtacagtattataaagcttggattgtggttaaaattaagtataaactactttaaaagtaaattatatagagatcaaaggttaggtttaaaacctgtaatatgactaaataaataattttccaggtatgctggcttgtgcctgtaatcccagcactttggcaggctgaggtaggaggatttcttgagcccaacgagcttgagaccagactgggcaacatagcgagaccccatctctaaaacaaaaagttagctgggcgtggtggcatgcacctgtagtccccgttacttgggaggcagaggggtgaggcgggaggatcaattgtgccctggaggtcaaggctgcagtaagttacaatcacacccactgcacaccagcctgggtgtcagagcaagacactgtctcatttaaaaaaaaaagaaaaaaattaataaataaacaatcataactgacgcaaaatggtaagaatctgagagaccttttaaagtgagacagagaagctgattaccagagaaaaggctaactggaaaattcatagaaatttaaaaccaaccaaaggtaacccaaagaaatgtccttacttttttactctgctctgaaatagaccagtgtttctcaaacttgtctgcgtaggaatcccatagggatcttatttaaaatagcttctgggttagtaagtctggagtaggaccaagagtctggatctctaacaagctcccaggagacaatgatgctgctgttctgcaaatcacactgagtggcaaggaagtagacaaaagaagcagatttgaaaggggtcagtacacaggcaaggggtaagaagggtaagaatgtaatctaatgctgcttcgttcagctaaattggctagagctttagctaaaaaatgaaagaaaaaaagcctacagtttaaacagaaattgtgttttctcccttttgatgccaagctccttgaaaaaatcaagtacttaggtaacgattggtgtggcaatatcagaaaaaggccttattctacaataaaatttgtagaatcaaattttattttgtttttttagagacagagtctcactctgtcacccaggctggagtgtattggcgcaatcttggctcactgcaacctctgcctcctgggttcaagtgattctcctgcctcagcctcctgagtagctgggattacaggcccacaacaccatacccagctaatttttgtatttttagtggagacagggttttatcatgttggccaggctggtctcaaactcctaacctcaagtgatccatctgctttagcctcacaaattgttaggattacaagcgtgagccaccacgcccggcctcaaaagggttttagaagagttataaaatttcgattagagacctgaaagaatatcaagattaaaataagcagcttcacacctgtaatcccagtgctttgggaggctgrggcaggaggattgcttgagcttaggagttcgagaccagactgggcaacatggagacagcctttctcaatttttttttttttttttttagaaaaagctgtataggaattatagaatatttaagctggaaaatacatagatatcatttaattataacctcacattttataggtaaggcccacagatgggggatgtcttgctcaaggtaaccaaattaataaatcgtatattctggacttagatcataaaaacacagaaccagaaagaatttagcgatctttacagagatggaaatagatttttctaataatagcctgaccgtgaactcagtaacaacagagctttttgtatctccaatgtctagtacttggctataatggttactggattaattccttaagttaaaggtcaagggataagattcctaatttacttgttactaaatcttgctctgaatttcatttctgtcttagtaataataaccattaagcccattgtttgaatagttctatttttataataagtaatataattgaatagctgacattatacattttttcttagttacccacatctatgggaagcttagctgtttagatcagaaggccacacatatcccactgccacagggcacctgttagcagattaaattttaggcaagtgatagatcaaaatacacagatactaagagaggtattttacaaacccaaatacttaaagacagcaaattcaacactttgtttacttttggctttctgttcattaaaataaaatccttattgaagatcagttaatatacaaaactgctaaaattatgtattaactctcagaatgtcaagagatttctggcaaacaaatattcaaattagttaaacttcatgctttcaggactgctcatatttattatgtatccttttaacagcctaaaattttcaaaattttcaattctaaacttactctctttttcatgagtgaagaattttctgggatagaaatagctttttgcaaaaggttttccagtttcttttctttctttttttttttctggagaccgagtcttgctctgtcgcccaggctggagtaaagtggtgcaatcttggctcactgcaactttgcatcccaggttcaagcaattctcctgccttatccttcctagtacctgggactccaggcacgcatcaccacacccagctaatttttgtatgtttagtagagatggggtttcaccatgttggccaggatggtctcgaactccacctgcctcagcattccaaaagtgctgggattacaggtgtgagccaccgtgcctggccggttttccagtttctagtttgcatttttctagtttgagatcattcttatgtttgcaatagatcaaaaatcaacaggaatgtgcttcaaatgacaaagattttatacatttttatatgtaaaaagtaaagactagataaaattaacatgtagtaagatgaaattgaattctgaagtgtgaactgtattctttgcaagccattacaaagtctattaaatatctatagattactcaccaggaaaacgcaaatcaaacccacaatcggataccattcgcacccactagatggctataataaaaaagagggacaatagcaaatattggtgaggatgtgaataaatcagaaccttgatatgccactggtgggaatgtaaaatggtgcaaccattttggaaacagcatggcagtttctgaaaatgttaaacatagccaggcacagtggttcacgcctgtaatcccagcactttgggtggccaaggcaggcgggttgcttgagtttaggggtttgagaccagcctgggcaacatggcaaaaccctgtctccacaaacaatacaaaaattagctgggcgtggtggagcatgcctgtagtcccagctactcaggaggctgaagtgggaagatcacctgtgcctgggaggttgaagctgcagtgagccgtgatggtgccactgcactcctgcctggatgacagagcgagactttgtctcaaaaaagaaaaatgttaaacataaagttaccatataactcaacaattctactcctatgaatatacccaagaaaaatgaaaacatggtcacacaaaaatttgtacatcaatattcatagcagcattattccaaatagccaatagtggaattaacccaatgtccatcagttgatgaattggtaaacaaaatgtggtagatccatacagtggaatcattctgccacaaaaagaaatgaagtactaatacatgctacagcatggatgaactttgaaaaaaacgatgctaagtgaaataagcagacacaaaggctatatattgtatgatcacatttaaataaagtgtccaggataggaaaatccatatacaaaaagtagattagtgattaccaagaggtatgagagggaagaatggagagtgactgctcatgggtatggagtttcctttatgagtgataaaatgctttggtattagatagtgatgatagttgcacaaatctgtgaatataccaaaatttactgaattgtgtacttaaaaaagtaatttttatagtatgtgtatcagacctcaaaaaagttattaataaaatctatagagttatgatacttttaaaaaatttaaaaatagggcatttgtggtactaatcatatttataattcttgcaaaataagttattgtctgatttccaggtactaatagtcaaatggtttttgattggtaattaaaatatatatatataaaagtggctgggcgcagtggcttacacgtgtaatcccaacactttgggaggctgaggctggtggatcacaaggtcaggagttcgagaccagcctggccaacacggtgaaaacccgtttctactaaaaatacaaaaaattagccgggtgtggtggtggacgcctgtaatcctggctactcgggagtctgaggcaggagaatcacttgaaactggaaggcagaggttgcagtgggccgagatcgggccactgcactccagcctgggcaaaagagtgaaactctctctctcaaaaaaaaaaaaaagtgaatgccacttatgtaattgtctatgaactaaaatgatttcctggtttcctaggctagtgcggatctgggaagaacgagtaagcttaaccaagctaagagaaaaggtcaccagggaagatggaagagtcattttgaagatagaaaaagaggaatggaaggtaagcttttatagaatatttgattttccacattttgcattttgtgagtcagttgagasaatgattctgagactgtgtaattaagactagaatagttagaaactaattttaataatacaccaaatgaatttgagcaacatgtgcaactgaaaagaaacacaacttcacaattattttgcaaaagttcagtttgcttcaaccctgcctaaacctaaatcatttgtgatatttctcctattaatccttcttatagcaacctctcatttcccataaaaaagataaccatctgcctaataaaaataatattgcttttccaaagaaatgctcagttaaaactttatggaatggaaatattagtattttcagtgggtctaccacctaactcatattctttcttccccttacacacaaactcacagttggttaattatattaggcatactctaatttttacaagagcttctaacccttgggtcagtgtttgtttttatgttttatgtcagtgtttgtcagagttagctcctttatattctctactggctattttaggctgaaagggaaaaggcacagagttcagaatagttgaaactcttaaaattctcaaattaaaaaataaatttttaaaaatattcgtgtatttcaaaacagaagtggaaaagcagtttgaattattgattgaaattatttttttggattgtctcattttcaataacatatatgtactttaggaaagcctaatactgcataacagaatcatcaggacatactggatgtgtgtacattattgatcaaaatatttttgtttattctatcatgattggggtttgaaggtttagccaaaaaaaaaaaaaaaaaaaaagaaaaagaaaaaaaaaaggaaagatcttaaaatccggaagtcacacaaagcacttggaaaagtaacccactaaggaaaacaaattccaaatattccaaagtgcttgtataagtcaaatatcacatttcagggtggcgtgatactaaaaaaatttaagtaatatacaacaaccatcatttcttttactgtagaccctcccttcttctctgctgaaactgaatcaactacaggaatggcaacttcatagaactggtttgctgaaaattcctgaattcattggaagattccagaacctcattgtgttagatttatctcgaaacacaatttcagagwtaccaccagggattggtaagaaagattacttttattcctgtgctattttatccacctgcagatgtgctttttattaagatttttttggatacatggaataaagacctctttatacagccctcaaccttgagaattttaaacatttaatctaaattraagcttctaggggattcaagtttgtggatttactgaggtgattcaagatgagatttcaatgaaagaaaagcctctttggaaaatatcctgtgattctcggaacaatattgtcggctcagctattcctcttaggaaacaacaggttgaaggcaataaagcaaaacaagaagattcttcaaatgggaaaaaaaaatccaaatagaaaattgctgaggattttgtgtagacaaaatgaaaatagttttcgatttttttttttttcctattgcacggataaacttgtcccttgtttgaagaagggacaggacacagactgggaaaaggaaagacactaagaactccgaatttgccaatacaaaattggcaagtaagttatgctgtaggccgggcgcggtggctcacgcctgtaatcccagcactttaggaggccgaggcaggcggatcacgaggtcaggaaatcgmgaccatcctggctaacacggtgaaaccccgtctctactaaaaatacaaaaaattacctgggcgcggtggcgggcgcctgtagtcccagctaccgggaggctgaggcaggaaaatggcgtgaacccgggaggcggagcttgcagtgagccgagatagcgccactgcactccagcctgggcgacagagcaagactccgtctcaaaaaaaaaaagttatgctgtaataccttaataactataaagattattttatatccaactcctctctattgtatattattttttataggactgcttactagacttcaggaactgattctcagctacaacaaaatcaagactgtccccaaggaactaagtaattgtgccagcttggagaaactagaactggctgttaacagagatatatgtgatcttccacaagaggttagaaagacataaatgcctatgattgtattttccatctgcagtagttgaccactcaatgtgtggttgttaacaataataaaactaatgagaaaattctatgtatttcagaaaaaatatttagagaaaaccatttccttaagtataatgcaggttttaactggagaaagatttagtgtaaaagatacttctattattatcacagtactgacatcatttgttaaactgtgatctccttgaaggccagggtgagagttgtattatagtctcagaattgagggcagagcctaggttgtagtgattacttaaatgctttttgaattaataaatggttatcataaagcacagacaatgtagtgatagcaatgggactggaatgcctccaaactttgatttggtatgatgtcttgttattggtcaaaccaaattgatcatataaaaataaagacatttgtattactttttgaaaatatttaatgctcttagaatcagtgaagaagtttccatggtgctttggctttgaaaacaatgactttacaagataaaagttaagaaaaataataaaataggctattcccttctcccactttatcttaattagtgtatcagacttttcttccaaacaagcaaacttgtcaccaacaattgtcgctcttgcaaataaaacacagtatatacatatacattatatcttctaatagttcaatttaatgaaatgtatacccttgtgtattagtctgttctgacactgctgataaagacatactcaagactgggtaactaataaagaaaaagaggtttaatggactcagtttcacgtggctggggagacctcacaatcatggcagaaggcaaaaggcaygtcttacatggtgggaagagagaatgagaaccaagtgcaaagggaaaccccttataaaaccatcagatctcatgaggcttattcactaccatgagaacagtaagggggaaaccatcgccatgattcaattgcctcccaccaggtccctcccacaacacatgggaattatgggaggtacaattcaagatgaaatttgggtggggacacagccaaaccatatcactttgcatacaataaaaatgataatcatatggataatttcttacacatacaagagggccaataaatattttatttctaactcatgtgtttttgtttctgggttggctccatcattataaaagctatgtgattttgtacagtctattaaccagtctttttttttgagacagagtctcaccttttgcctaggttggagtacagtggtgtgattctggctcactgcagcctcaacctcctgggcccaagcaattctcccacttcagcctcctaagtagctgggactacagtcgtgtgccaccatgcccagctaatttttaaagtattttgtagagacagggtctcactatgttgcccaggctggtctcaaactcctggactgaagtgatcctcctaactaccaaattgcctagcaaaatgctaggattataggcatgagctacccctttcctccaccactattatttggaagttaaatgttgagttttcccatacaattctcaactactggatcaaaggaaaacatgataatgggtgcttactctcagggaaaaaaaggttttgccaggcacattctataaaccctgaaaccaggttattatgaaagataaattttcttcaaatagatgaactttctatgagagttttccacttccctggaggtcatttagctttatatttatttttaatttgttgcrgactaatatgactaaataaagcccaagtaaaatgtgaatattcctggatgtgaaatatctcctttaccaatgtgartcttttagtagtttacattgtggacatttattttgaaaaaccttgctttcttcttcagctcagcaatctgctaaaacttactcaccttgatctgagtatgaacgattttactacaatccctcttgctgtgttgaacatgcctgcccttgagtggctggacatgggaagcaacaaacttgaacaacttcctgatactatagaaaggtaaaagaaataactctttatgctaatgataaaagtcttgaaacctcttatgaaaaataaccaagcaagacaaatgggatctcaagcataatcaatcacaataggtccaactagtttgaaatacactgttttaacagaatattttcatttgttccaagtaagtaaaagggtttgggaagaagaaaaaactggcttttttcaagtgatccacctacctcagcctcccagagttctgggattacatgcctgagccaccacacctggccaaaagtggctgactttgagaaattaacaagaatatgccacaataaccaccttgcttagcatatgccaagcacttctatgcactttacaagtggatgaagaaactaatgacagagatgttagctaactcgctcaagttagtaagtgggcaagctaggatttgaacctaggcagcctggccccagagttcatgatgttacgcattatgcatactgctttgctataaatgggcatattcatcattttattgttctcttaagactctgtctcagattaggtaacatttacagtagttcttcttcaagaaatcctatgagaatagtgaaagaattctagaatatgttgatttgatttcatttctattgccatatgacatgagagttgtactgtagagataaacttcctgatgtggtttctctaataaccaggtaatgygatgtcagttaactcaataagtatactggttaaagatgttgtaaaagacatttgatttttaacataagaaccaaaggctgggtgcagtggctcacgcctgtaatcccagcactttaggaggctgagggggagaatagcctgagctcaggagtttgagaccatcctggacaacatgataagacccctacctcttaaaattatttkttaaaactccaaaaccaatattttcatattatatgtaattaattgtagaaaccttaatttttcagaatgcaaaatctacatacgttatggctgcaacgaaatgaaataacatgcttgcctcaaacaatcagcaatatgaaaaatctgggtactcttgttctcagcaacaataaactgcaagatattccagtatgcatggaagaaatggcaaatctgaggtaaaaagttgtaggcacaaaactgaaaaaccttgctttctttctggctacagaaaaaagtactgtagagagattgttattaataaatttcagttgttatttatgtgaatggatatcttaaaaatcttttccaatgttgacattctataatttgatgaataggattcatataacactggtctattcaagaaagaatccttaaaactaaagcagtttgggatttatcagctttaagaaatgtcttccattttagatgtttatcaaaggtcttttatggggaagaaagtaaatgtatgaaataataaatgtgtgacctttatgggtaatgttggctctgaacaaacttttgaaaacttggttgacaaaattttgaatcaactgaaaaaaagcatgacttgaaatctctgaatgccttggttctcagtattatcattcttcattgaatttgtttcttattaaaatatgtagtttttaagactttttttctcacagtattatgtaattttttagcatgggtagatgggagtgtcacttgtatgttaccatacagctgacaagtatttttgtcttttctttattatgtttcatgctatgtatgtaccataaccaacctattgcctatgagaaacatgtaagataaaatatttacagccattgttacaagtttatagtgtatttttctatcttgttttatatgtatgttacataacattcaaaaggaattttttttcttgagaaaaggatacaaattgcaaaatccacaattttgataactgaaaattgccaattgttttgcagtactttattatattgggtgtcttgtctcttttgggcttctagttagctaaatgaatgaatacattagacatttttgggttttagttgggattttacatagcttgcattttaattctttggttcttcgctgtttgtattaacccatagcattattttaataaatgttataataccaacctaaaaaaaaaaagaaatgtcctctgttgatgacattttcatgaaaattatacagctaaaaaaacttcactcacaacataaaaatcaaaagcataaaagtgtttatttcctaaataagcacaaagggaaacaattatgttattgatagcagatatattagtcgggagtggtggtgcatgcctataacagctacttgggaggctgaggctggaggatcgcttgagcccaggagttcgaggttgcagtgagccaagattgcgccactgtactccagcttgggaaacagagactatttcttaaaaacaaaacaaaaacaaacaaacaaaaagccactagatataactttttactaagtactatcaaaactctgtcaagcattttttctttttaaaaattattttagattattttaggttgcttgtatgtcttcttttgggaaatgtctgttcatgtcctttgcccgcttgtggggttggtttttttcttgttgagttctttgtagattctggatattagttctttgtcagatgtataatttacatatattttctcccattctataggttgtctattaactgttgattattacttttactgtgcagaagtttttctaattaaatctcatttgtctatttttggttttgttatgtttgcttttgaggtcttcatcataaattctttgcctaggccaatgtccagaagagtttttcctaggatttcttctaggatttttactgtttcagatgtgacatttaagttttaacccatcttgaacgctccctcaagtatttttcttccaaagcttaatcttctgacaaatgagaataagagaatacccactaaaacccaaaacttcgataacaaaataattcatttattcacttgttcagcaactacctgccttgtactgggtggtgaagacacaatgataagtaagatggaggtatataaattatgcagaaactaagttcatagcactaattttatatttaagatatgttaaaattgctcttagaagttaagctgtattgcattaaatatatgctgtaggccagatgtggtggctcacacctgtaatcccagtactttaggaggctgaggcaggcagatcacttgaggccaggagtttgagaccagcctggccaatatggcaaaaccctgtctctactaaaaatgcaaaaattggccgggcgtcatggtgtgcacctctagtcccagctacttgggaggctgaagcacaagaatcacttgaacccgggaggtggagggtgccatgagtccagatcatgccactacactccagcctgtgcaactagactaacagttgcttttataagctttgaaagtaagttgtctaaagctagtgtttttttttctcttaggaaaaaaacataagattcttgagatatatcacatctcaccaagtcgttcagttattgaaaccagttaaaaacgagtaatttagtatattatcatttgacctttctccagggaaataaatgtacacttccatgacacctataaaaatactgttttttgatgaacttctaggtttgtcaacttcagagacaacccactgaaattgaaagtatcacttcctcccagtgaaggcacagatgaagaagaggaacgggaattatttggccttcagtttatgcacacatacatacaagagtcacggagaagagcaggtrtaagatttgtatataacacagattaaatgttttttggtagagtaatgtgtrtatcactaactgctgccttttgattaattcctttatatatttctcattccatcttaagttttctgtcaaattctgttctcttagtcaatattgtgggaagaaaaaaagtgaaatagagagrgaggttttaaagatattcaaagtctttcaagtgggggaaggaaataaatcctttggctaagcatctgaagtaaaaccaagtgagtgaagacatgattcttaaagctttgctacctcattctaccagcttgccacacatagcagtttgaccatgaactgaccttccctgtcattccataaatagaaaaaaaaatttacctagggatgaaaaatattgagaacacagttttttgtttgtttgttkgtttgtttgttttaaagagatgaggtcttactatgttgcccaggctggagtgcagtggctattcaaaggcacaatcatagctcactgtagccttgaactcctgggctcaagagatcatccgacctcagcctctgaagtaactggggctatyagtgcatgccaccacgtctggctgagaacacagattttaatgaacaaagtgtgaggttttgatatagagatttcaatcacttagtctctgataattaattgagggcctttaagctaaaccaagatcaggggaagaggacaaagtgcacaattatttgttaataaaaacaatgaaacaatagtaacagaaatcatagtcttataattttaaaatgttaagaatttttaacttaaaaggtagattttagttcaacttaatgcaacaactagtttgaaaaatgaatataactgagaagacaatgacagagtttttcagctaaaggaaataatttttactaacattcagtggaggatgtttaggaaatggtgattagatttattgcagcaaggtcatagaagcaatgacatggagacagattgggggaagacaggcaaaaaagtcataattgtgacctagttttggaaagcagagaatatataaagacaattaggagacagaattggtaattgaatgaagatgagaaaagggagtttacaatgaatgtttttggtttagagggcaactggatagatggtggtgctaagatggagaatgaagtacagaagatgggttggcgaatagaatcaggtggtagaggcagaagatgatttctaattttggcagtcttttttttttttttttttttttttgaggagtttctctctggttgcccaggctagagtgcaatggtgcaatctcggctcacttggcaaatttcgcctcccaggttcaagtgattctcctgcctcagcctcctgagtagcttacaggcatgcaccaccacgccacgccccactaatttcgtatttttagtagagacagggtttcaccatattggtcaggctggtctcgaactcctgacctcaggtgattcacctgccttggcctcccaaagtgctgggattacaggtgtaagccaccacacctggcccttagcagtaaatttgatgcacctgtggaacatgcaagttgtggtaattgtgcaggtgaatctgaagttcaagaagaggtttgttgaatctgaaaattctgcaggacaagaaatagctgtatgcatatcccacagtcactttctcatgatatgtgaagacaaattaacagttaggaaaacaataatcctgacctaaggctggcatgttgaaggacaaacttatcttcctttaaggtacttgataccattgtcagaaacataccattaagctaaatgggccacagaactgtttctgtatgataattcttgggtgtgtatgtatattttatcaaacataaatgagattatgcctgttgtagaatattgtttatttctgggcataaattgttgaatgatgcaaaacaaattttatgacacaaattagtattgcttgacacaataaaaaaaggttaattatttaatgatatatcttcatttaggttcccttgattggggacatgggtaactaacttaaacaaactaccttacttgacataaaacttataacaagggaaaaaagttaacaacttaaagagataataaaatcaaagcctattatgttattaaaaagattcacgagttactaccactactattactagttaatatttattgaattactctgtgcttggaactgttctatgcattttacttgtgttatctcatttgatgctcacaacaaccttgtgaggtaggtattattgttatcatcatcatccccattttaaaaggaggaaattgaggcacaaagagattaggtagcatgcccaaggtcgcacaactgaagatggtaggtttggaatttgaaccgagacagtctgacaagatatatgagactaaagtcaggaattttaaattggttaggcttcttatttacaaatcatataatcatagaactacaggataaaaatagttatttcagaatatcataatatctaaaattagtaattctgaacctttgtcttggcaaatgtaccatcaattaagacaatttttacaaataaaggcagaaacaaaatagggataagatgcagaagagaataacagtcctaccatatatttggtttagtattttcttgtgcatagaaaccagtcatgagttaaataaggcctaaatttgagaaggtttttggtttcattatctaatttctattttattccaaattattttcccaaacagaagagaacatacttattgtttgtgcctacatatataaaaaatgacctgataaaagatatgagatagctaatcaacttcagaaattatttcaaatttgtgaattatgtttgtaagtatctttttggaagttctaactagacaattatccaacaaaataattaagtgaaataatcttttttctttgaaaacagctcttcagttttgtgtttgtcatggacagattctgacaatatatacatgtatggctctggaaatttgaaggtgacttcattaattaattgtgtttattaattgtgaatatctctgaattgtctgcatttgagaaaatcacaattgtgctttccagatctgtagggaaaaatgtccacatataagtcaaattctcagattggcccttgttacaatcaatcactacctcttgaacttaagaaataaaaaatattaaataaaatcaaaggaagataaatttccaaaattaatacaaacagaaatacgctaattatgtgttgacatgttatgtatgtttcagatcaccaagtcaacggttcaactactttaccaatctccataaatacggatggataatataattcaagatgcccttctaaagaggattactttggtgaattctctaatgtttggatttctgaagtaaaaagaaaagctattaccaaagtttaatgaggccacagcattttttaaagttcatattatttgctatttaaagtatatatttttttgatataaaaatataattaaaaaawtttttttggtggaagacagatgatgctcaaatttcttttccattaagcagttgtttctggtgatgaagaatgatttggtaaagcagttaacaaaacattttccaaagacaccagagggtctgtatagtactgcaaagcaggactgaatcccttctgctgcaaatactggattcgaccttggtcaatcagcaatttacaaagatgccctattttcttcttttcttcaacactaagaagcctaaattgaataaacacacayaaaacattgttaaaattttgcaaaagtttataaaaaattatttttgtcactatttattgagagactgttaactaacccataatgtactaagtactttgtcccatgcttccaagacacattatatttatgaccacaataaaagatgtgtatattttagcttattctaaaattagattataaaatacattttcatgaattgttgataatagtcatctaaagtacagtacaatataatatttctcctttagtatcatgcattacaaaagtagtctcttacccaggcaaacaatcagcgccatcatctgtgattctgtatcctccatcatcatgctcttcactatcatcattctgattatcttgcctctttgtggtactatttgaggtttccaaagatgttttccgcatcccacaagttgcccaactactcattcgctggaaataatggaattccactgctccaaggcctagagccctgaaatattctttgcccacataatgtctccaatcacacctgtggtgacaacagagtgcaataacaatgccagccacagggttccacttctctgggacatttttttcatttccttccttggccaaagtgtaaatttctttttctgttttatcattctttatgcgtttggctaaaggttcttcattcctttcctcaaaactggcagcataggtttcaaccaaacatcgtaatgcaagatctgcaaacacaattatgtggcccccccaaaccacatcatctttaaaaataaatactttttacatttattaagcagtactgtttttaaaaactcaacaataaaaacagcaaaaacctactcagctttatatttgtaataatactatcatgaattatcaacttcattcaaatttgctcttctatcttctcaatttctttaatgatttattctgcataaagcctacttcccaataaagctatctgaagcttaagatctacaatttgaagaacttttacccaactacctgaattgtctctcacttttcctaccttagctgaggaaatgacttgtatgggaaaactttattcacctacacttacattctagtttaagaaaggaaaaatgaaggaaggaaggaagggagggaggaagggcagacaaatctgtttaggttgatgctaggtcaagatgcttgtcttgaagaggctcatagcaaatagtgatgaactgaagagttgaaaagagggcgtcagaacagaatctggaaagcaggcctcactgagtagccttactgtatttattcatttatttaacaaacatttactgaatgcctttcatgtgcaaagcactgaggatacaattattaatatacacaaacttaagaggcagatgtactccacattacaatgaaaatattttagtatattttaaaactaaataaatggatttttgatgactatggctatttcccatcgaaaactcctacactgttgacaatactggaaagacccaaaatgtaggacccatatcttcttaatcattagattgtcatgttgtgtctgttcaatcaaaaacatatacatattttaaaattttattaccctaagatatcacaaatgactattaaatgatctgatatttcactagtaaatttaattcaatatatgaatttaagtcaacaaacattagaaacccattatttgcagaaagtgatagctaatctattatttcataaactattattttctgacaaaatacatttagtcattgttttattcatatttgacttaagtaagtgattttcagaaatgtgaataaccagataaattattaaaagaattaagttatttcaggccaggcgcagtagctcacgccggctgaggtgggcagatcacgaggtcaggagatggagaccttcctggctaacacggtgaaatcccgtctctactaaaaatacaaaaattagccgggcgtggtggcacgagtctgtagtcccagcaattcgggaggctgaggcaggagaatcgcttgaagccgggaggcggaggatgcagtgagccgagattgcgccactgcactccagtctgggcgacagagcgagactccgtctcgaagaaaaaaaaaaaagaattaagttatttcagaattagaaggagctttagcaatttatctcaattcatcttttataaagaacttaaaagacaaagccacatatgcagaaagggacaaggaaacacagcaaattggtagccaagattactcattcattcaaatattcactgtgttcctgttatatagcaagcatcgtactaagtatataccatatactcaaaaaattcagagcatggtggaagaattagatatataaacagataattaaaataccacaaggtaaaaatatgcagagggtattatgataacaccaaggaggcatatcttatttaagggagctccctgagagtggtgacaactgaggtgaaggatgagtaaaaattgaccagttgttttgtttgggtgagtaggtgaatgggggtgaaattccagatatagtagaaatagtacagtctatggaaaagcacacagggtttgatgttgctgaacagcaaagtaggagacaggaaatgtaaagagaggaaggctgaagccagattgagactaaaacgttatgtcaaagagtttggactatatcaggaagtaccgaagagtttaaagggaaagacacattagttgtgtagcagatgggtctgagattgattgaccgattgagatagggtcttgctctgtcacccaggctgcagtgcagtggtgctatcccagttgactgcagactcagactcttaggctcaagtgatcctcccacctcagcctcctgaatagctgggactacatgcacaagctatcgtgcccaacaaatttctgtagagatggggtcttcctatgtgcccaagctaatcctgaactcctagcctcaagcaatcatctcacctcagcctccagtgttgggtttccaggcataagccactgtgcctggcctgaatattagtattttaaggacagaagtggaaggagactgtgaaataaacagaagaatggcatagatgtaggggaagaaccaggaaataagagtatcgcaaaagagaagaaaatggaatttcaaaaagggtaagcaactgcagcagagacaaaaggaggattcagatacagtgaatcaagggaaaaaattatgtggaacatgagaaatggccactgtaggtcaaaagagtgtactccctcctacccccgggatggaactggtttactttagaagacttttatgaggcttaaatgagataaggtatgcaaaagtacagtcatgcattgcttaactattggtgtatgttttgggaaatgcattaggcgatttcatcattgtaggaacatcagagtgtactacacaaacctagatggtgtagtgtagcctactacacacctagggtgtatggcacagcctattgctcctaagctacaaacctgtacagcatgttactgaatactgtaggcaactgtaacacaatggtatttgtgtatctaaatacaaaaaaggtacagtaaaaatatggtataattttataggaccactgtcatatatgagtccattgttgaccaaatcatcgttatgttgtacatgactatagtcttaaaaactatgaaggccaacacaaatatatagtactcaatgccatttccagccaatatgaataatatctatggatgctccaagtaatccatatgggtagatgatgaaactagcaaaagttaggaagatgatgtaacaataattaacatttattgagcactattatgtgccagacactttacatgcaacccggtaaattattaatatattagtatctctgttttatagatgaggtaaccaaagctcagaaaggttaagtaatttgacaaggttacacaacaaagctgaaggctagactatctgattctaaagcacatgctgtttccactttaccatgctagatctgatggatcaaagtgctaagacaagacatcttagattttttttttttgtctaacatttatttttttctttttccccagaatcctgaaacacaatagtcttttagtagaagaggtttctgagttctttctaagcaactactctaaaaaatcagtagcttctaggtggaatcatacagtttccataaatggtcttattttccttttctggttgaaatttaacccaaagaactttaaggtctaatgtgatgcagtatttacatacaaaactcttaattcatcctgcaaaatggccaatatgagcagataaataggaaagctatgcatctaataaagcacagggccagtgctctataaagattattgagttgtaaacataagatatctattcaaaagagaccactgaaatggttggggccaggttaggccaaaacttaatgcattaatgtaaacattatcagtatgtttacgtacctgttgccataccacacagatgctttccaattcctaccacaggtagtttttcttctcttarcacaggaatcttgtctgaaatggaaatgagaattaactgtctagtgaaataaagtacatattaatgtggccttccaaaagaaagaactaattagagtctctgaattttagcctgaaagagactcaaacaaaaattatcactttatggaacccaacatataacataagaacttgtttagggttcataacatcagaaagttaatatattcagctaaataattttaaatacattgatttctatacaaatgctgggttgcttttcatggctggattaaaattggtgaatggaagaggttgcaaagatatgtttgcattattttctttggataatctgaaaaatagaaaaggtataaaaagggcactacagaggttgattgaggagtttgtgtgtgtatgtgtctgtgtgtgttttgtgtatggaatatgaatcccacagtgatgacttcttttgtacaatttaaaattctaggaagtatcttttacacattagctaggcagagaaatatctcattttctttcatggtttaggtaaagtcacgttaactgcaggcagaaggctagtttatagtttgaacagactcaaaattaatttaaacaggacaaagaaacaacagaagtacatattataaaacttttaaactcttccctaatataacacttcatttccacttgatactgaaaatttttaaaattctcaaccttaattcaatttacatctatttaaaaacattatataaaacattctatattaacaatgaattgatttgactgttttccctgaagcacagttctgcatgattggatttctaagcaacctcagagtttaaaacagttatgatttatttgtagaccaatggaaagttacacaacttactcaaacacaagtgttgaatatcaatttgaagtctttcaaacactgaatttttctttctgtgttttccatccacctgcacaaacagaacattattgtaataatcacttcttacatttaaaaaagctttatgaaaataaaaagatttttattggttttcaaaattcagagcaacagaacatatttaaaaattaagattgtacattctttgatgagaacttcaaaatatcacactttttaaaaaagatttgaaaatgtttatcaattattacatagacattatttcctttaaccctaaaaattcccaattcactgacaaaggaactgaagttcacagatcttaagtgatttatctaagattgtctactagctcctttatctttgtcactcctggtgtactatttttggttcgctcctcttcttgctctcctgaaagatcacaaccattctaatctatacctatgtgcccacgaccggctgatctacatttgtggctcaggcctctccaatgggcatcagacacatactcaattgtgaactagaaagctctacttcaccagcaaactggacacattcagaactgaactcattatttctgtctccaaaaccatccttcctcttgtgcctccttcattccttatctcaggaaagaacaccacttagtcacctaagccataaaaatcctaccgagaattactccttatctctcatattcaattactaacaaatcaccaactcttgtggcttccaacatcttaatatttctcatactcttgccctcctctccatcccaatgcaatagctttagctctggcctctttcttacttggattgttggacaaaaattatctttattattaatctctctaagtatcagactcttctaatatagttttaatggtgctg

SEQ ID NO: 12370 - DNA, 162562 bp, Homo sapiens
ccttttcccctgttctacattacatctacatttcagattcaggaactcaaattttcattaaccaggatgaataattaaatatacccatttttttggagttaaatcttttaaaaatcggtttaatgatagcattgtaaaggacctcacagattcgctactccagtgttatcctttaggaggggaagaaaacaaggcccagggagttaaattgttcagggcttccacactagcacacaagtcaagcaagggaccaaaataccacagacataacttttagctccatcaattgatgggagagttgtgtgaaatttgatttatcatttaggacttgatatttacatttcaaaataaggtaacactttttgtttgtttgtttaagttttggtttatccttcctgttatctcaaaaacaagtggggaattagtaaaatatttacttaatttcttgaaagcagtctgtaggccagtcatgtaactatttgaaaaatggaaagggtaacttcttcgtgagactttgccgacaagaaagaacctaagtatcccttggtgtacaattccaatgaagaatatttatttcataaaccacatatgggtaaacatatttctggagtaaaatgttgaaaaaaatttgtttaaatcataaaccacatatatactactactcatcttgaaaatgcaggcttctttttaaataaataattagcactataattttgtttcttcaatcagtctttatataacacaaacaacaggaccattcttctagaatttctatcacctttagagaagttagataagaaatgaacaagtctaattacaagaactctctaacagttttaccctacccagagtgagagcctgaacagtcaatatagagaaaaattttaaatagataaaaagcattacttttaaactctgtcagcccatataatctgtttccaaaaacagtccctcagcaacctgataatacaatagactaatgaaggacaaaatttaaaacattttaaataaggctttattaacaaatacaaagatttccatatacttttaaaaaacaaattaaaactactgctgttaaaactattccattttcaatttttgctttttgtccctaactttggtccataaattgatatatcaacaactgaagttaaaatttctttatttctttttttttttaagacggagtctcgctctgtcacccaggctggagtgcagtggcacaatctcggcccactgcaacttccgcctcccgggtccaagtgattctcctgcctcagcttcccaagtagctgggattacaggcgcgcaccatcacagctggctaatttttgtatttttagtagagatgaggtttcaccatgttagccaggttgttctcaaactcctgacctcaagtgatccacctacctcggcctcccaaagtgctgggattacaggcgtgagccgccgtgcctggcctaaaatttctaaatctataattagcataacagtcaaagttgggcatggtgggacacatttgtaatcccaacactgtgaggctgaggcagatagactgcttaaggccacaagtttgagaacagcctggtcaacatagtccctaaaaaaaactaattaataaacaaataagaaaaaggaaaaaagtcaagagagaaagcacataaaatgttccttacttctccatttccatgtttttataaccatttatctaactatctatctatctatctatctttctatcaatcaatcaatcaatcaaagacagggtctccctatgctgcccaggctggtcttgaacccctgggctcaagggatcctcctgccttggtcacccaaagtgctaggattacaggcatggaccaccacacctggccaagcttttaaaattacatcatctcctattagcttttttagtagaaattcattttgcaatgtctaaaatctacaacaattaaaaatgcacctgcattcaacaaaaactgctgagacaattggttatccacatggaaaaagttaaccttacaacctcatctcacaccatacataagaattaactcaaaatagatcacatagttaaacatcagggctaaaataataaaatatttacaagaaaacataaaagaaaatctttgagacttgggctaggcaaagatttcttgcctatgacatcaagagcatagtccataaaataattttaaaaactaataaattggacctcatgaaaattcaaaacttttatacttcaaaagacacaagaaaatgaaaagacacaacaaactggaagaaaatatttgcaaaatatatccattaaaggatctgtatccacaatttacaaagaatcctcacaactcaacttataagatgacaagtaacccaattagaaaataagcaagagatataaacagacattccatcaatgaaaatacataaatgactagtaattacgtgagacaatgttcaacatcattagtccttagggaaacacaaaattaatgcctcaatgagatactatttcgcacccactagaatggctataataaatcaggcagacaataacaaatgttggcaaagatactcagaaaagggaactttcatacatctttgatgggaatgttataaaatggtgtgaccattttgggaaagtgttgcagtttctcaaaaagtaaaacataaaactacgatatgacccagcaattctacttctagttatttacccaaggtgtatgaaaacatatgtccacacaaagacttacatgtgaatattcgtagtgccattatttataatagcccaaaacttgaaaccatgaccatcaactggttttgtatagacaaaatgtggcatatccacacaatggaatattattcaactataaaaaggaacaaattaatggcacatgctatgtcatgcatgaatctcaaaagcattgttaaagaagctcgacacaaaagatgacatattgaacgatcacgtttatgaagaagagcctagaaaaagcaaatttatacaggcagaaaacagattagtgatttcctgggactgagggtagaaatgagattaactgtgaatgggtataaagaatcttactgtggtgtcctcaaatgtcctaaaacctatctataatgatggttgcaacattcggcaaaattagtaaaaatcactgaattgtacacttagaatggatgaatttcatatataaaatatacctaaataagttgttttcttttcttttctttttttttttttgagatggagtcttgctctgccgcccaagctggagtgcagtgatgcaatcttggctcactgcaacctctgcctctcgggtccaagtgattctcctgcctcagactcctcagtagctgggattacaggcgcctaccaccacgcctggctaatttttgtatttttagtagacatggggtttcgccatgttggccaggctggtctcaaactcctgacctcaattgaaccgcccgcctcagcctcccaaagtgctgggattacaggtgtgagccacagtgcccaaccataaagctgttttctaacaaaaaaaaaaaacatgactttttgtttcgcttgtcccttgaagaattatatgagtaacaattgtactaatcctaatcttggataggaaaccatggtatcacttttgagaggatctaacacagtgttaggaaaactccttcaactggttgttcattggacagaggttctccaggaaaagaatttctcataaatcaaagttctttctgtttatattttaagaagccagtgcctggaaacaattcaaaagtacatacaagagatttaagttgtctttggcaatggactgattgatctgatgagtattctactctacattcagattacagtatatgaacttaaaaagacaagcaaaaacttttaacacaatatgaaaggacatagggttaagttatataactttgtgtgtacatgtccaaatgtcaaaggcgctgtttgcttgagcaactgtataatgttgtaacacaatagtccttaataataatactaaatgacaagtaacattacaggcattaatccaatccctggattgtcctgtattcatcttaaatacattctaactatccactctacttataaggtctttcaaaaataacccaggactttataaccctcacaggacagcaaagaattttacaaactttttaggtctttgcaaaaataccaccttgtctgaccaccttattgaaaactgccaacctcacaagactctctatcttcccttccctgattcgtttttctcaataaaattaaacataccttttacatatatattctgattactgtctgccttctcctactagaaagctaaacaaaaagatctgttttttccttgctgtatcctcattgcctagaacagtgcctaccacgttgcaggtgctcagcgttttttgaacacatgaatgagtattaaatatgtgcaagaaaacaggagctgattcttaccaaaggaatgaaaaatgagtctcttctactcattcaacagccttgacttggggttaaaatatgaattttacaaggaaatagagacctcagaataaaatttccagactgcctacccagcatttcttcagcaaagagaaaaaataaaggtcaatatttcacttataattctggatttgcaacaaagtatttttaataaacaactgtctctattctggagagaaggcaggttaattaaatcmcatgtgactaattaacaaaaaagaaaacaaatgaaagttccatacttaactattcttactagttacttaactcgaataaagtataacatttcaaaagcagcctgtttttctacattcaaaaggggatcctatctccatgaagacagaccttagcagaatatgccttagcagtcctgacctcctcagcctcaaatcctccaaacaccaaggaaactttttctctcccttaccctagaagtcttcccatagccattttacaaacacaaacaccttcagacctctctgttttaattaacctctgacccaatccagctgcattccagcgttaaacaacaccccaggaagaaagactcacaacctctggcccctggagcatcccccaaacagtcacccccaacaaccgagagtcctggaacgtgaaggaatctggggatggcagggacctcccagcaagaccagaattggaggacatcttagacttcactctggtactgaccatttctgtgtgaccttgggcttgttactacatctctaggggtcctagttttctcacctttagggtgaggacaacatgttgaccaagtcactgtgaggattcaatgagattccatgtaaagcacctaacagggcacccggcacgaaacggcgcctcagtcctcagtagcgtggatgatccccgccctaagcctacaggctcagagctggaaggcgcctcgcagaacgagtccagttctcccgattttgcagaggaggacactgaggtccagagaacacagaagtgccttgctccgacctccagaaaggcagatgggcgcggaacctggaacccaggacgcccatcctcagctcacacccccgccctcttccctggaccctgtggggcccgggcgccggtgccaggcgaggcggtgcgcgccaccctcccggggccccagctccgcgcgacccgggaccgctccacctgccgccgagccccgcgcccgccggaggcccggggctcccgcctctcccctcggcctcccgcaagtcaggcagccccgcacagcggtccggagcgcgtactcaactcttcactttgccgaaggtgccgacgcccagcgtgtcgcccagcacgtagtgtccgatcttcacccgcccgtcgtgcttctgcttctcagccatcttcggcgcgcgcggcctcgctccaccgcctgccgctccgcgtagccgccgccgccgccgcctacccacagtgcagcgggccctgcgggcgagggggcggaccccgagccgcgaggggcgcggggcgggcgcggggtcccgggagagggcgctgggcgcttcgggcccaggtgggaagcaacgggcgagcggcgggcggggcggggccgagggagggagcgcgaggcgcccgctcccgggagtgagaggctcctgcggcggaacccgaagcagcgacagcgggggccggggacgcggggcgctgggcgggagtgcgggaggggctgcgccagatgcgcggggtccgagtgaggggcggaggcgacaggtgctgcgaggggggtaggcgagggtgccgagggaggcaggaggccctttctgaggaaaaccgaagggggtgaaaatagggggtgagactggggcccgatcctagggaatggaaagacttggaagtcaaactggaagaagagacgggcctcgcatgtcgggagcgaggggctgtaaaagggaagaatcgggaggggagactgcgggaagggccctggccaaaggggcagtggcaggagagcctctaggaagctcctcaagtctcgtctgaggcttttggatacaggtcgcggcacagggagaatgcacgcagctctgtgctctcttgaattgtcctcctctacttattctgtaattcccaattattttgtcctatagatggaagagaccctctccgccagagctctcaattttaactaatttgcccacagttttccaaaaaatctcagtcacggtatttgctcgagtgttttttagcacatgcttatataaatatgtagttttaccacgcgcttatataaacatatagtaccgaaatgtgatacagctgtacaagaaggaaatgggaaagacgtggaaagggaaacaatgttctgcccacagaaagtaaaatacgtaagcgacagaggaattgtgaagggcgaggccagtataaggtcacatattaaaggaagaataaatgtgatatagaagtgaaaagagtggtaagaggaaattagaagcatgatgcctaggcagcgtgttcaaagactgacctccccaccctccccccacaaaaaaaaagaaaaaagactggcaaagaattaggtaataaagcgattatctctgcctctcttccttctctcccgcccttccttccctccttccttccttcctttaatgttgtctcattctttaatgttgttctgtctttcagtgattaaagtttatttgcttctcaccacacacacaaaaagattcgtatacaatatgtttgttaattagcttgacttatagccattccacaatcaatatatttcaaaacatatacatactraatatatacaatttttatttgccaatgaaataaaaaattttaaaacagtaaaaaaaaattctgtttggggataagtaattaaggattagtcaaacatttatagcactgcatgccagtagagtttcaaggtcacattcctcaaacatgaagtctcttgaacactgtttatatgtaaattgaaatgtattgatcaaaaagaataggacacaacaaaactttgttttctgataagtactaaatatagaaatttcaaacattcattctcatccaaacatcaagacaatctgatgagagatgatcacagcttataaattatagatatcacagctgttaaacagaggctatttttgttcattcttcagatcatctttcttgctgacaagtatcatctaggaatcactctacctcgctggcaattttgagaaaatagccagttatttttgtgctgaactttcatctggttaagggtcattccttcagtattcaagtgagtaagaaaagacctattctgcttttgaggtatgagatgtatatgtcttctgctctaatatcccgttaaaagatgttgaaaagtcttcacttgaagttagatgattgctttcttgaagctacataaagactaactgtaaattgagatttcaaagcatttcgtactgtcttaactatttgttgataaatactgtaagttaaattattatatacttcataactatgattcttacatagctactgtggactaccttatagttttgttactatgtgaaacatctatgatactttgttgattaagaagttcatttaaacacaattatttaattgtcataaaagaaagattatyattcccattttatagatgataaaacttagtttttccctttctgatttgcccagggctaaaaagtggcagagtcagaactcatatccagttctgacttgtccttcagtctgcctactataccgcagctgcctatgccaaaagaaagtatggtgctctaagaaagttaaaaattgtcacagttgtggttccattttcatatttttattatttcttgggcagtccaataatatatcctataaatttgtaagtatttaaactactttttgttgtttttctgacttttatttagaggaaaggttgaatggtaagtgggtaagaaggacaactcttggtggcagtactcagccctctgttgtcctggacacttcaagataaggttccatatttgcctcttcctaytcagcagtagaaaactcgacagttaatcagagtagatctccttaagggtcatgcctcttggaggtctcacccctaaagatgacctggtaaatgcaatgttcccattttattatcttccaatgaaggtttcacgccgctattgtttagtaccaatctctaagaccagtgccccagggaggtgttcagttcttagcgctggtccaactattgctgctttaccctcctgcttctgaaactttggggttgttttaccttcaaatattctaaaataagtcctgagtaggacattaatgcaagaccactaaactaatatactgtactagacaccaytggtattatcagtaaccaattatttcaagtctttgctcacagtcaccttcttggtgaaccctaccctggccaccctatttaagttgcagtttcttttttttttttttttttgtaattttttttaaatttttttttttttttttttttttttttagaagcagggtctcgccatgttacccaggctggtctcaaactcctggactcaagtgattgtcctgcctcagcctctcaaagtactgagattatgggcgtgagccaccgcaccaggcctaaattgcagttttatctcactcatgctctctgccctgcactctcatcccctgaccctcctcaacttttttacatagcactagccatgtaacatactatttaatttatgtgcttattatatttttgtctgtttctcccaattagaatctaaacttcacaaaagaagagaggccttttttctctattttgttcactgatgtatccttagctcccgggacaatgcctgacaaaatatagatatccaagcagattcagaatgtggcacctgaagtttattcagtgtgggggaatctctttaagggaaaaaaaaatgcaaaattgggtatgaaagtgagaatttgaagtgaaaaacaactctctacaaatttataaaagctgacaaatgccacaaacatccccaaatccagacaaataacaatatttttataaattaattatctaacatacctctataatacctgttttctacattttctggctgtatactctttgattacctctttatattttgtaaatttttaaatagaatagaaagataattctgacattaagcatgattcattaagtttttcatcacatgtttctttttaggttttccattgtacatgtttaatatagctaatatagaatttatcaattctattatcatatacattatacatacatatagatagatacatatatgtatttatatttacatattatatatgcaaatgatatgttcataccccacttgctgtttctggggcctagtggaacctggtatatcattccaaaaatatttgctaaattgaattttagaaagggttagttactaagctagagaatcaagtaacaacaatacagggaagagtgcagttttattttatgtatacacatattaaaggcaaagcataattttacatctcagcacagcagtcattagtgaggttagagaggcatgagttagcacctttgaagtctatagattcatgatatagggcttctatggctgtctccaatttaaaataaaaaatttggacactcaatgaataataaaggatgtttatggtattttataggaagtacaagctcaataattacatttttaaaattttgtgtgaaaaacttcaaacatacacaaaagtagagtaacataaataaccttagcatctgtgatgatcaacaattgtcatcatttacccatctatctctgcacttttaaaatttattttcaggagtatgttaaagtaaataagcagattatttcactggcaaatacttcagtatataggtctaacagataagcacttctttttaacacaaccatactactactaacatatctaacaaaattagcactaattccttactgttatgaaatacccactctgtggtgaatatcccttgattgtctcaggaatgtagttttacagttggtttatgctcatcaggatcaaaaaagtcacacttaccattttgtcaatacatctsttttaatatgtagtgttttcycttcccactcttttttaaaaatgtcatctattagttgaaacattgaattattttaactgttgaatatcccgatcttgttggatttatctcaataattattcatgatcacaagaggtagtagagaaagctcagtatttggaataaaaaatcatggcctggtgcaatggctcacacctgaaatcccaacactttgggaggccgaggcaggtggatctcttgagtccaggagttcgaaacccgcctgagcaacatggtgaaaatgtgtctgtacaaaaaaataactggactggtggagtgcgcctgtagtcccagctactagggaggctgaggtgggaggatcacctgagcctgggaggcagagattgcagtaagccaagatcacagcactgcatttcagcctgggcaactgagcaagaccttgtctcaaaattatatgtataattaaatatgtgtgtatacatgtatatacatatatgtatgtatgtatgtatatatgtacgtatatatgtgtatatatacgtacatatactctctctatatattatctatgtgtatatatttgtatatgtacatgtacatatatatcctgagttcatgttccatcttagcctcttagcaatgtgtccttaaacagatcatttcacttcttattggtaaaactaatagtgttgaactagactataaagtactaaagtacctgtcaggtgttgggacattcaactcccaaactccactccctgttttagagttaaacaatagagggaaaaagatagagtaattactgtaaagtattgtaggtcaccatccaaggtatctcaacaaactgatcttgccacattattttccctatacacagtttatctcctaatatttatcatcattggtttgtaagtttaagagaatactattatgggcctagcccccttcaaagagataagtagatacacgtgacaatacttgaaaccctttaaaggaaatgtaataaataattttgagatgttatttttagcaggtaccctagtaacaaatattatacttaatccattttcattttgtggctgagtacatttctaaattgcttcaatatgagtcaacattataattttcagtgcagctgagaaaaaataaaacgttttggatcagacttccttcatgagcaaatgcattaattggaataacaaaggttgtttgctttgctgtataaacattatggatctgacagcacttttagaatcttgctttcatgtgtgtgttgacagtttgtctgaaaaaaagctcaaacacacttttagatcagttaaatcaattatttccctcttggcatggattcagtgactatctgtactgaatacttttgaactggtgaagttggagtaaggagataccagtgtcaccttgagttgattatcatctctgttatggctgtccgttggaattaaaacaccccttgacaaaactgtgtaatataccattatttgaagccttttataatactcttttaatgacctcaagtgggtgttaatgctttggctgttggcacaatcccgttaacattaactattaagctttgacatgattaatgcaaacttaagataaataggtaatttcaagttctaaatgctctataaataataaactaattctcctttcaagaataaggaccttaaaaaaatcagataattcaatttctttttttaatttgtatataggcttagactaggtgccctttcaagactctggggtttcaattctgtaaaattctgttaatagttttaaaagcattaagtaataaacttttcaccttctacttttaaaatattgaaatgtttttaaattgttacacaactagctattccacagacaaaagatttctagattctcggagtatatcattgctttgttctaagtacattcattcattgaacaaagatatattgaatacctactgagtggcacactactcttctaggcactgggaatgtagcaatgaacaaaacagatagtataacctatcttatttactacttataatggtagtttttgttaaagaaaataataattcatgacacttattaaagacagtaaggcagactttatttgggactattgtgaaaggtataggacctcctgcaatgaggttttacagtaggagacagagattgggctcaactccaaatacaacaaagaaaagtagagatttatagccaaggaggagggacaagatgtgttgatgaatggaaaattactaggagggtggggtaattatttgctaaacggacctaacaggattcttgctgaaggcaggccagggtgatcagctattacccagggaatggtgtgggggtgagaaatttggttagacrtcaagagtgatcaggtagtgagggtggggaattttggctaaattggcttagcagaattcttgctaaaactgggctcttgaagacatgcccaaggacaggacctagtgggtcagaggagtctgactagagttaggtcragaaaaaagtgttttgttgcattctactgtaagaaccagaaaataaggagtcaaataaatatataatgtaaggttagtgttaagtgctgtgaaggaaaagcagaataaatgaatacagagatgaaagtggggatgggggagggcaggcattttatataggtcatcaaaaagtctttctgagaatgtagcatctaagaattatgtgcaggaaggagccattgaaatagttgggataagagcattccaggcagaaggaatagcaagtacagcagtcctgagacagtgctaaaggcatattggtggaataacaagaaggttgatgtgtccagagtggtgtggacaaggaggaggatgaaagggtttgtggttagaatgcctatagctagattatactgggtaagctgtattaaaacctttagatttttaaaaaagtgtagtcaagtatattctgataatttttgaacargagagtgacacgatatgaattataaacttaaagatggctctagatggttgtgtggaagagagtctaaggggtcaaaagtgtaaacaaaaaaactaatttagagactattgaagtagaccagatgaatgctgatagtagcttatactaggatggtagcagtgaaaatggtgagaggcattcagatttggcatgaagattttgaagttaacatcaagaaattttggtgatggttagatgaaaagtgtgcaaagaatcaaaaaagagaaatcaaagacttggatttttggcccatacaatgagatgaataagagtgccatagactgaagtgccaaagactttatgagaaataagctgggggaaaagaagggaggttgcgggacaaaattctgatctgaccatgcgaagtttgagatgcttaatagcaatcccaaaggacacaccaaataggtagtttgtgaccagagtgaagaggcccagactcaaaaatgtaactttcaaaatcatcagcattcagggaagaggcccaaattcaaaatgtaagtttcaaaatcattagcgtatatcccacagcactggagatcccttaggaagtgaatgtagacagcaaaaggaagagactccagggctgaaccatcccagacttagagacctataaaaggaagaggattggccggtctcggtggctcacttctgtaatcccagcactttaggaggccgaggcgagcggatcatgaagtcaggagatcgagaacatcctggctggctaacacggtgaaaccccgtctctactaaaaatacaaaaaatcagccgggcgtggtggcgggcgccagtagtcccagctacttgggaggctgaggcaggagaatggcgttaacctgggagctggagcttgcagtgagccaggatggcgccactgcactccagcctgggcgacagagcgagactctggctcaaaaaaaaaaaaaaaaaaaaaaaaaaaaaaggaagaggatcctgaaaagaaatatccactaagccaagaggaaacttaagagaatattttcagctattgtaagacattattatcaactgtatccagtgctactcaaaggtcaaggaagatgtgggtgaagagttaactaccggatatgatgactgtgacaagtgactttgtagtggagtgatggagatgaaagtcagagtgaagtgagtttatgaaaaaattgaagtgaagaaatagagaaagtggttctatacaattcttttaagttttgctatgaggggaatagcagcaaatggaggatatggaaacaagggtagattttttaagatggggaaaagtatagcatgtttgtatgctacttgtatgatccatagaaaaggacgaactgatgtgtgagagagaatgaataactgaagaacatttagcagtgaatccaaatgacagtctttcaggacctttcacatcagttttccaggaacttgtactctaatggaaaacatacacacttcagaaataaatttcagctgggcacggtagctcacgcacgtaatcctagagacttgggaggttgaggcaggaggaccacttgaggcctggagtttgagaccaggctgggcaacaaagtgaggctaggactatagtcccagcaacttgggaggctgaggtggwgagatcccttgagcccaggagttccaggctgcagtgagctatgattgtgccacagaactccagcctgagtgacagagtgagaccctgtttccaaaaaaaaaaaaatctaataaatttcaaaatggtgcaagaagtgatatgacaaagttacatataggattgactaaagagtactgagcagtaagttaaacgctcttttatttgacaaggggaaaaatgatgaggacctgaaccactggtagtcccagtaaagaaggaagggaaaggatggatttaaggattgtttaggagaaagaataaataggatttagcaattgcttagttattaattagaagaacaatgaagcaatttgggatgacttacagatttctggaatgatacagaaatcttgtggatgrattgatcattcaaaaacagttcgtagcctatcacctccttccttaaaagtgttcaataatttaacataacctaaagattagtgtttaaaactctttagcttagtgttcacagcccccaaaaagtctgcctttttggtatgctctttaccttctgtattagtctactctcacactgctaatgaagacatacctgagatggggtaatttataaaggaaagaggtttaatggactcacagttccatgtgactggagaggcctcacaatcatggtgaaaggcaaaggaggagcgaagtcatgttttgcatggcggcagttaagagagagaatttgcaggagaactcccctttataaaaccatcggatttcatgagacttattcactatcacaagaacagcatgagaaagagccattttcatgattcarttacctcccaccaggtcctccccatgacacataggaattatggcagctacaatttgagctcycctgtggggacacagccaaaccatatcaccttcctaatgtacttccttgaaactcaaggaagtagtgggttccagtttgaaaattactggtctacagagaaaaatcaaagtccttaagtctggattcaaggctctctatgatctggtccctaccaacctggtttcttgtctcatctttgttatccaaagctctagtcatatcaagtttctgtcagtcctgtgtatacaccaagttggagcaggccactgcacctttactcccactcttattgtctggtacttccttcatccttgatattctccattacaatctgcctaacaaatacctccacatctttaaaaactcacctcctctatgaagcatttccacaacctcccacacacatttgacctccgtatctttaataatgctgtgcaccttgggtatttaattaaatccatcattgtacttatctgtttacatgtcttgtccaccatttgactatcaatcccttgagagcaagcactgtgaacatagtaggcacttaatgcatgttagttaaattaatgagtaataactgaatgaaatctcagttcagaaatatcttttttttcttttctttgaaagagtcttgctctgtcacccaggctgcagtgcagtggtgcaatctgggctcagttcaacctccgcctcctaggctcaggtgattctcccatctcagcctccacagtagctgggaccacaggcaagcaccaccacactcagctaattttttgtatttttagtagaaacagggtttcaccatgttggccatggttgtctcgaactcctgacctctagtgatccacccacctcagcctcccaaactgctgggattacagatgtgagccactgtgctcagcctcagaaataactttatcttattttacctatcccttcccaggtagcactgaaggctttttcctatgtattgttctgaggccctatatcacctctgttctagcactatattgtggtatgacattgtatttgttccatgacattatttttcttcctttttttttttttttttttttggtgtatgtgtcccctacctaaaatattcaagggcatggattttatcctgtttatctttatatccccaccacttgggtacccagtaagtgttttaagaaagtattatttaataattaaagagccaccttaccctttaaagtcatacatcatgtaattatgcccagctttttccacttttgtgaagaattttctaatcattcctggcttgagttaatctttctctctggaattctattacctgtagttttctctcttttgagtaattatcactctctggaactggaacagttcttgatttagagtgactataaaagcccaaggacaagaaaacttttattcttcgctatattgctatacagttgtggctctcaactctccttttttgtgtactgctatacttgagtagcacacagccataccaatttccagggtgctcagattcattctaccctttcctactggaagaggtaaaaaagcaacaccctagaatctgatatgatttattttatcaaaataaacaataagctactgcttttgcaccattacttgcttctatttataacaacctcttgccccactgagaatgacaacgttatagtcattctttaagtagtgatgaatgaatttaaaaaaggaaggaatgctatttctattgtcacgtccacagggaagtcagaccatgccttttatgcaaaactggtttgctcatttaatatattactatttatggccaggcataatttatttgtgtgggctagaggaacacaatattgtccttcataaactaaatcccaaataaaataataactttactttgaaaaattatgctttttttcccagaccatgctagccttggcgacaaatggaaatgttgcaggaactgaatttttcctgatgttttacaaaattctgctctctgttctctatggaacccaagtgacccatactcatttccattttccagtgttccttggctctgctcatccatccagcgctcattgcaagtcctaaactttaggagaagggattttgttttctcttcacattgcctacaaccctttaccaattgaaaagatgatttggggccaggcrtgatgactcatacctgcaatcccagcactttggggggccgaggcaggtggatggcttaaggtcaggaatttgagaccagcctgggcaacacggtgaaaccccttctctatgaaaaataacaaaacattttaaataatttaaaaaaaaagattattttattcctttttacagccctttacgaagcaggatctgcaacaaatttctcaggaaacgggctgagcaacacatgagggatatcacccacaaacagtgatgagtagttattgttgcaaaccataattkwgttgcccgagtctagtgtrcctttcttctttcttttgccacttgggtaattctcaccttctcagggaacatcttccactttcccccaaattgatggcagcttttttttccccccagtttggttttcctctttgtatcatcatcctagtgccccagaaagcttctcctaaagggggcagggagagaacaacgcatgtttcaaggaggtccccatgcaaatttgacactttggtacccttgccagtgttccaaagtgaccatgcagatggcattgccaccataatcctgttctttttttgagacagagtctttttttgttgcccaggctggagtgtagtggcatgatctcagctcactgcaacctccacctcccgggttcaagcgattcttgtgcctcagcctccattacaggtatgtacctccatgcccagctaattttttgtatttttaccagagatgaagtttcaccacataggcctgactagtctcaaactcctgggctcaagtgatctgcccagttcagcctcccaaagtgctgggattacaggcacaagccaccgcacccagcccataatcctgttcttatgttctttcattatttattcacttgattactaacatagattacgtaataaattgtgtagaatttcaggaacacttagggaagtaataaaaattataatgtatactgagatgcttatcatgccatctctcatgagtttttccaggaaaaaaaaaatagaggtcaaagctatcttcaactgtattctcataagtggggctttaaaatgctcccatgaagaataaaaagaaatcatcctatcttcctctatttttaaaatgtatatttaaaggcttttctgatatttctcaaatgttttaggaacaataaaaaaataaattgagagatattctctttttttgtactgattctaagtcactttataaaacatctacttcttttaatatgctttattcagttaattataatttggtttgctataaagtttactcattggggaaatattttttagtaaactaaatgctagtttttcagaatgtaattcaagcctcaagaattttttggccgggcgcagtggctcacacctgtaatcccagcactttgggaggccgaggtgggtggatcacgaggtcaggagatggagaccatcctggctaagatggtaaaacctcgtctctactaaaaatatgaaaaaaaaaattagccaggtgtggtggtgggcgcctgtagtcccagctactcgggaggctgaggcaggagaatggtgtgaacctgggaggtggagcttgcagtgagccgagatcgtgccactgcactccagcctgggcgactcagcaagactttttctcaaaaaaaaaaaaaaaaaaraattttttattgtctaacatgctagatacaaaagaattatcctatgaacaacaccctcaaggcttttaccttctcaaggagaagacttgtacccatgaaataattttaaaacaagttacttactttttaattcatgaatttaaatggcaccttattatattcctttcaccaagctctctttggttatataagaaagaagttaactggatttttgctacctattttcattgactattacaaaacacttggagtcatagacttataaaataagagtgtgattatacaccctttatgcccttttctttactaccccattctaaaatctaatgggatctttatgatgcccacagggcaaaagctaagtcatgtggtaatttcttaatgaaaacaacctggaagacaaggaggaattttttttctttgagatagaattaatcaaaactgtctttaacaaatgtcatgtttctaagtcccaacattggactatgttccttgaatccaaactcagcttccattctgaattattgctggaaaggctctcagcattggttgtatagacacctgttgttaactcttatcacttgcctcttactttgcctcttagtttactgattaagtctaatctgcattcttgatacttagccctgttttccattcctactttattcaacatctgaaaagctcaacaacttcttgatcatctccatcagtccaaaactcattctatgaaatttggactcaccctaggaaactctaggctttcacctgaagttggcataatatcagataaaccaggaacataccactctgtcaagtttcttggtcacaacaagtaatatccttaacctggtcatcacctagcatttatcgacattgaaaagagagattgctctttcctctttcttgaaagagggtgccataaacacttattcttggactctatttaaagacaaatctattgagaggtatcagatgaagatatatgtagattagttgtagagggaatgaataactttatgaattggggaaatgaattcctagtttggttaaaagcatattctataccttatttcctgttcaataaatggagcattttcrtggaaaaaagccaaaagttttatgaatagtcccttactttttcccatctgttagaaacatttttcaaatataaattaaaaatgaatccctacaagaatttgcatgttctcactcctttgctgttgggagctctatattatttgtgtcacgagtcttagcctagattgtatctgatggaatccttccactaaatgcaataatcagataaaaagaacttgatcttactatattccaagtgcttttctgcactaaacaaaaattttgagaattcagatgttaactattttaaatcattttactatttcttccataatatgtctaagattctaaatttaaattttctggatattcattacaaatctgatatttcatgaaacaagacagcttttttgtcaatttttggataattcatctagtctctgtactgttattccattttgacctataaggaaaaaaaaaccaacatcacttaaacacttcactaagaaatcacatccatttgagtcctcagaagttttgtcatgaacaattaagtttcaagatctcttttccttttgtataaccacattaaaataattttttctacttttttttttggagacagagtcttgctctgtcgcccagcctggagtacagtggcgggatctctgctcactgcaagctctgcctcccaggttcatgccattctcctgcctcagcctcccgagtagctgggactacaggcacccacgaccacacctggctaattttttttttcatatttttagtagaaacgaggttttaccatcttagccaggatggtctccatctcctgaccttgtgatccacccgcctcagcctcccaaagtgctgggattacaggcatgaaccaccgcgcccggccaatattttctacttttgacacatgcttagtctatctataactacagaattgtaaaatcttggtttggaggagcaaggggaattgtagagatgatatcactatactatttctggatgactggaaagatgcgattttgtatgaacttcatcttaaagtacttcatgacttcagtgtgaaatttaaattataaaaaatacgcagctaagccaagtgagtttagcaataattttatagaaattgaaatgtttattatatgtgttgaatggtaatagaaaacagtttgcattctactatttccattttttaaaaattatcagctttttcattcgtttctattgttatctactatttactgtgaaggcactgcattatacaacctaattgaaatgtttttaacagtgttagtatagtaacagtcctcctgacagtctcataactacaggatgtcaatctctgaaggtattcccagtaaggaaatcacaaaagaaagaaatgtagaaagaacaaattcaagaactgattttcatcagtagtatagtaaatgaatagtgagtactccagtgatatttcctaaacatataaaaattgtttgcacagatctctgtcttatacacacacatacacacacaaacacacacacacacagcttagcaggaaaatacttcagtatgtaacagagaatgttcaacattgtttctttaaaatcaaataatctcactgagggaaggaaaagtgaaaagtctcaggtagaaaaagaaaatggggaggaaaaaaccaatacagtatgttagttcttccatgttatataatataaataatttcagcactgaaaaaggaatagtaagaacaatatattctgggttatgtatgcatgcattcatgtagtcattcaacaaacattcattgagtgcccactctgtgctaaggattttactcggccttgggtatatgaagaaaaaaaaaagctttatttttatctcagaaatgaaaaatcagaaagcataatgacaagtaaaatgatagaggtaagcacaaggtatgaaagaagcccggaagaggcataaatactcttttgttttatgctatcttatgtttaattaatgtattagatttctttctctaaatttccactctggctcccaagcaatcatgttctttgcaaggagttgtccaaagaaatatttaaaatttccttaaatttacaatgccattttagtatttaactctttttgcaactcaggcacatgatttagctttttaatctgtagtcatagtagattgtgttatttttcagctaatatttgctctcctacatcctcacccaccccatggaaagaatatatgtcacttcatcaacaaaaggcttggccatgtgactttctttagccaatggaatgtcagtagatgtaatttaccacatccttgcagaagttttagatgtgcctgcatgaattggcttggtctcttgagcttctgatctctaccaaaagaagcgctttcctcaggcagtccaggactgcaaaaacacatacagcccagcaaagctgtagccaacgcaaaggcctgtaagcatgaaataaatctttattattgtaagccactgacgtcttggggttgtttcttactatagcaaacattgactaatacaagtgttgactttataagcacactgtaagaaaagccataagcaatataaacaaaaggcaggatgtttgaatttactttcaaaacaaaaagatgctaatgttatacacagattgtggaatatgctacaattgtgtcatccttaacacagctactttttcaccttttagtaatagagtgtatgcataagatgcgaatatttaggagccagacagtaacctataggtatgtctatgtgtctatatatttgtgtgattaatagctgtggatctgtcatgattcttcttacattataaaatttaaaaggacagtgagtcatttttataataaaatctattgccatcattctaattcaacccaaataacttagatgggacagaaactctgttttaccctaataaaatagaacttaaggcttagtaaatgcttcagacagttttctctatgtaccagtgaccacaaaaaaaaaaaataagtattgtatgactacaatgttacataactatataccacggatatgtgcgrtaataaaaagagcaagaataccaaacatgagtaatttccctcatttgtagcaagattctggttcaaaaactgagaaatatttctwgttcaatattgtacattagtaatggatcccaaaactttaaaagcatctatgactaacatttatcctgcatatgcttctgctattctcactagaccatatttgcaatattataggaagttggctatctcaaagtagactgttctaaaattaattataatgttgaagatctgtgtgtgtgagggcagaaaacatgtaactgtataaaccaaaatgatgttatgccattcccagggtgaatagttttatgtactctaaaatcatgcaagaaagcctgcttttataaattgagaaatgttttataagcaccagtgggatacaaacttcttttcacaaagacatatattgactcattcctcaagtatctggtatttgtgatctaaatgaaaagtatttttgcagctgattttttgcaatagcttttcattgtaccctgcagatgtattaatgtgtttttatcatgttgacatcttattataaacaaatccattttatgttaaacttaggtgtttctcccatgcatgtattaagaggaagctggggactaatttgcatcaaggaagcatctctaacagttcctccaggagtccctgtagacttttaccagcttgagactgaatatttgagggggagggggtcaggatacaatcatctaaaatgcaaacaaaaaaagtgttttcctaaagttctccgaattaaaaagaaaagaatatgtttgggatacaatacacaaatttatttgaattcctttgccaattccaagtgaatccacagccaaacgaatgaaacttatggttgcacagctggaggcttattacttcttcattttataaaaacaaaaccacaagtgattgtgaaccagttggtctgaatttatacttatagcaaataagtataaattacttcctctgctttctcaaggtgctgaatggaagcatttgtcataaattcatcatagactgaatgtatgagactgaatattaagactgaaaatacccttttaagaagtcatttttgcccattcattctgttttgttcctttgtccttctgyttctttatttattcagtcatttcgcaataaatatttattgagttcttcccgtgaagtaggcactgtgctaaattttggggatacagtggtaaataaagacaatttattttggaggagctccaaagacaattccagatctttctcagatttactgatccatttattcctgtttatttccaacacgtaatacaatgaaaacagtcaaacagacatgaatttaatttgcatttcatcttgggcaagatgtttaaattctcagaaccttagctttcatatctcccatctacctcaaagaatgatggaaagtgaattacaaagataacctataaaactgcttgacattttgttctccacccccaccccaaatatcactgttccctacatatgttgggtcctagaggtataaattgataggatacattttctagcactgtgcttagttgtagctaagaatatagagaaaaaacaaatgatgttcctgccttctagaagattacatttagaataataatgactaacatttgatatataccaatgactgttctgagcactataaatggatgaactcacatatcctcacaataatgcatgagaaaggaattgtaggcatcatgttttctgaatggggaagcagaagcacagaaagttaacttggccgaagtcacacaaatagtgagtagcaaggtagaattcaaacctaggtgcctgtctctgaaacttgttttcttaatcaccatacctcactgcctctcaagaggaggctattaagtacaagaaaattactgtaactgttttatgagtagtttaagcagtaagtgaatgagagaagagaaatcaggggatttggtccagaacctgaaaaactaatcacattttaatagaaagaaatgtaatgatgaagagagatactatagggcattttgggaaagttttatcactttagaaaatgattctttcatacatctaacccaaatatattatgttggacctcaaatcattccatttagtggagatacggaacatgtatttagaaaagtaactaaaaaatattattgtttctgatttataaaagtaacacatgctaataataggaaacctaacacaaatagcaaagtataaagcaaaacatttttaaaaaccactcctagtttcatcatccagaaaagataataactttaatatttagatattgtatcagtctgttttcacactgcsataaagatactacccgagactgagtaatttatgaaagaaaaaggtataattgacttacagttccaaatggatggggaggcctcaggaaacttacaatcatggtgaaaggcaaaggggaagcaaggcatgtctcacatggcagcaggagagcaagagagagctcagcagaaactgccagacacttaccaaacaatcagatcttgtgagaactctctcactattacaagaacagcatggaagaaacagcccccatgatccaatcaccttccaccaggtctctccctcaacatgtggggattgatgagatttgggtggggacacagccaaaccatattattttgcccctggcccctcccaaatctcatggtttttttttcacatttgaaaaccaatcatgccttcccaacagtcccccaaagtcttaactcgttctagcattaactcaaaagttcaagtccagccaggcacagtggctcacacctgttattccagcagtttgggaggccaaggtgggcagatcacctgaggtcaggagttcgaaaccagcctggccaacatggtgaaacctcgtctctactaaagatacaaaaattaggcaggcatggtggcaggcgcctgttttctcagctacttgggaggcagaggcaggaggctcatttgaacctgggaggcagaggttgcagtgagccgagattgtgccattgcactccagcctgggcaacaagagtgaaactccatctcaaaaaaaaaaaaaawgttcaagtccaaagtctcatctgaggcaaggcaagtgtctttcacctatgaatctgtaaaatcaaaggcaaattagttattccaagatgggtggtacaggctttgggtaaatgttcccattccaaatgggagaaattggctaaaacaaagggtccacagggcccatgcaagtccaaagcccactagggcagtcagtaaaacttaaagctccaaaataatctcctttgactccawgtctcacatccaagtcacactgatgcaaggggtgggctcccaaggccttgagcagctcagcccctgtggctttgcagggttcacgccctgcagcagctttcatgagctggcattgtgtgcccgtggcttttccaggcgcatagtgcaagctgtctgtggatctaccatcttagggtctggaagacagtggccctcttctcatagctccactaggcactgccccagtggggactctgtgtgggggctccaaacccacctttatccttttcactgccctagcagaagttcttcatgaggaytctgcctctgttgcagacttctgcccggacatccaggtgtttccctacctcctctgaaatctaggcacaggttcccaaagctcagctcttatcttctgctcacctgcaggcccaacaccacatggaagccatcaagacttagggcttgcaccctctgaagcaatggcctgagatgtaccttggccccttttagccagagctggagctggagcatgagatgcagggcaccaagtcctaaagctgttccggtgagaaaaccatttttcccatggggcttgtgatggcaggggctgccatgaagatatctgacatgccctggagacattttccccattgtccaggctaccaacatttggctagtcattacttaggcaaatttctgtggctagcttgaatttctccctagaaaatgggtttttctcttctgtcacatggtcaggatgcaaatttttcaaacttttatgctctgcttcccttttaaacctaagtttctcrtctccatctgagaccacctcagcctggacttcattgtccatatttctatcagcattttggtcaaaaccattccacaagtctctgggactttctagacttccaaacatcttcctrtctttttcagaggcttccaaactgttcctacctctgcctgttacccagttccaaagccacttgcatattttcacgttatctttatagcaatgccccactctttgcggtacacatttcctgtattcatcactttcacactgctataaagaataactgagactgggtaatttatgaaggaaagakgtttaattgactcacagttctgcatggctggggaggcctcaggaaacttacaatcatggtgggaggcaaaggagaagcaaggcacattttacatggtggcaggagagagagagagtgtgcaggggaaactgccagacacttatgaaacaaccagatctcatgagtctcatgagaatgccctcattataatgagaacagcatgggggaaactgtccccatgatccaatcacctgccttgacacatgggaattgcaactggagatgagatttgggtagggacacagccaaaccataacagatatatttcctttaattctcttttctgtgcatattgtattaaatatatttttaaataaaaattgacaagggacttatatgtagttttcagttctgctcttttcaccggatttttttttttttttttttgagacggagtctcactctgtcgcccaggatggcgtgcagtggcacaatctcagctcactgcaacctccatctcccgggttcaagtgattatcctgcctcagcctcttgagtagctgggattacaggcactcgccaccatggctggctaatttttgtatttttagtagagacagggtttcaccatgttcgtggcgatctcctgacctcaagtgatctgtccgcctcggccttccaaagtgctgggattacaggtgtgagcccccatgactgaactcacctgatgttttatccaaagcaacaaatactactttttcattaatgtcccaacaatccctatagtctgtttctgctttattttctagtatgtggtatttagtagctaatgtttactaacacttatcaccacctacatgctgcactttttaaaatctttgtctatctcctctcccactcctctatacacatacaagaaartaatatccatgaagacaagaatatatttattttgttctctactgtatccccagtgcctaaaatagtgcggagcccatggctggtactctatttgttgcatgaacaatctcacagaggaaggtataatggcaccatcacagtagatatcttaatttaaaagtagattagataatgttaagtactacattgaatgaatgtgaataatattaattacatagtcaatccttttcatgtcttacattaagtacccattcctagttatgtaagctaacatgtacaggtaatgaaatggacaattcctcaygaataatgaattagaggcttgcagcttatacatagttttgttctcaaaattctcttttttccagacgtttctcttatctcatcctctttgtcctgtcttttccttgtgcttcatgtattccctataatcctgtgttccagcttcactgttttttaaaaatttgcagtttgtcatacatacatacttactctttgaacttgatttcactttttttttttcagacatggtctcgctttgtcacccaggctggagtgcagtggcacaatcttggctcactgcagtctccacctcctgggcttgagggatcctcctgcctcagcctgctgagtagctgggaccacaggtttgtgccaccatgcctggctaattttttttgcatttttatagatgcggggtttcaccatgtggcccaagctggtctcgaagtcctgagctcaagcaatctgttctccttgacctcctaaagtgctgggattacaggcatgagccattgtgcctggcctaaacttgatttcactttgattgatgttttgttcatttgttcagctacatcttataatacataccttcaatgaaattcagcaattatctacattacctagatgttaggtaatagggaatgtacctatacgaactcccatcttctatataattaaaacctggatcattggaaatatttgtattcaaaaatcctgtctcttatctttatcaataatgtttgtattttctctattctttaacatatatacataacaagatgcatataaaagttacatttttaactccactcgatgctacaaaattatttaaataagataatgcatacgaaagtgcttggttgtgaaccaactggtataggtcaggaaaaagaaacttaaaaaatagaaaaattttaaaaagaaagtgcttggtaagctttcaagcactgtgcatacattatcccaatgcaagcatctcaaactagtatagtatgtcacttatacataccattccatgtgtgaaaatccttcatgtgctagaaggccatcctcaaatcctcattccaattttcagtctgaataaacctagtttatttaaaatttcctcctacagtctctttctcaatctctttttttaatcccttaatgatttttgtattttgtgacttttctctgatctattatttagctatctttgttactatgatgatttcacaagtgaccctcactttattaaataaagctatgtgaaaatagaatctgtataaattgtgtcatattacaaatccactaagagagctacagttccttttttttgttcttgagacagggtctcactctgtcacctaggctggaatgccatggtgcgatcacagctcactgcagcctcgacctccccagctcaaagaattctcccaccttagtctcctgagtagctgagaccacaggcatgcaccaccatgcccggttaatttttaaattttgttatagggatgagttctccttatgttacccaggcttgtctcaaacacctggctcaagcgatcctcctgccttggcctcccaaactgctaggagtacaggtgtcagccactgtggccagtccctagtgtttcttaaagatcctttgtagagaggaaaagggcattagaaaataacttatgtttatgagttcgtgctctactgctgatctgtaatatgaccttgttactgagcttctaagccctagtgtcccatctgtaaagtagaggctgtcaacccctcctgcagtggttcccaatggttggggtcatggggcacacttaaaaatgtgcaggagtgttttcagtccccacaataactgtgagtggttgttgctatttaatgaggagactgagtttaaggggagtgaagggcagggacataaataccctgcaatgcctggagcagtccctcttaactagcaattgtcctgccacaaaatgttggtagtgatgttattgataaacagataaagcaatacctttgatgccatttctacagctacctgacccccgacctctggaaggagactgtatttaccaagtctcccgatcaggaattcactgaccacctcgtcaagacccacaccagagtctccatgcagcggactcaggctccagctgtggctacaacatagggtttttatacaagaaaaataaagtgaattaagcgtaaaaaaaaaaaaaaagaaaatttctcctgataaactagtgagcactagatagcagaacgggagcactttatgatttaaaaacaaaaaaaaagctgggcatggtggctcacacttgtaattccagcactttgggaggctgaaatgggaggatcacttgaacccaggtgttcaagaccagctgtctctataacaaaatggaaaaaaaatagctggacctggtgaggtgtgcctgtatgtcccagctacttgggaggccaaggcaggaggatcgcttgagcccaagaagtcaaggctgcagtgagctgttgggattgcaccactgcactccagccttggtgacagagtgagaccctgtctaaaaaaaaaaaaaaaaaaaaaaacagggaaaaaaagaaagaaaaaaaaacgaaaacccattcagaatccctgagacttttctgccccgctaagataataattttaaaattgtttcctgcatgtctgtccaaataaaatttgaaattctcctgttatgtagaaaatatctttaaaatctctgatcagctcaccagccagataaggagacatctgttgattactttagaaatagatgagctgattttcattttgtctgtgtttctaaagtattacttggctttagtcaaatcaggtaagccatattcctagttgtaaattgtatcagatgtttctttggacgtagacgttctttgtctctttgaaggcctaagttaaaagaacttttctgctggctcttccttacacctgtctcctcccatctcagggcttcctttgccttgcagccccttctaggcactactaggggcgggcatccagacatgggcaacctggaagcccaacaggtgaacttatgatgttagagatcacagctartggataacatcttcctcttttctactgcctcccccactaagtgggcagtcctgagatacagtgtattctgattcttaggagcacggcacttggcagcaactcacacatgacatcctcactctgactcttcctccttccttctttcactgtctttgtccttaactcttcttccatgggattgtactccctaataaaataaaagaatataaactcactgcttcagacctgcttttggaagatctcagctaagacataagtgaagtggagaactgaaaccatcatttggttatttcagaccaatctcttacggagatcaatttggattaatttacaacacaggaagttaagtacacaagaacaatcatattgccaattggcaagtaaaatgagctgtcagcactgtccaaccatcataccacatttctcctataagctcactttcctattcatggagatatctgtttcatagaatatctatctccatgcctattactttcaactgacaacctctcttcaaattaaattgagaaagtagaaaccatcagatgggcacagtttcataatcttatcattagatccatgaacccatctgcatctgccctcacctcttccttctttcctgtttcatctgatgatgggttctttctcctacggttggccagttcttcaatatagatctaattccctttgctctcctcagggggttagttccttgttgttttccactttttcttccaccctctcacttcactgaattgttcccatctgtattcaaaatattctctcatctttaaaagacctcccttcatctcacattctcctccagctatttctacacttctgtatttcctatcccagttaagcttctctgaaggaaaagctgtaatccatgttcttaccttctatttactcctcaacccactttaattaggcttctgcctccatcacttcagtgaaactgcccttattgaagtcactaatgacttctctgttgctcaatctaatgatcattttttatggcttcattttaactcagcctcaagcagcaatcaacacaatgaaacattctttcctttgtataggccctttccatgccttccttttaaccctgctcacgtgctgttatttctccatctcctttgtgtgctcctccttttctttctgttgcttctgttgtcagtcctgtaggcttggtctagacctctcctgtcctcattacatacttaggcattctcatatacacccatgactcaaattacaccatttgcagatgactcacaaatgtatagcaacaaccgagacctctcccctgaactttatttccatgtagtgcttactaacatatctttgaatatcaaatgcacctcagtctcagcatgtctaaaaagccaactcagcccgggcaacatagggagaccctgtctctacaaaaataaaaaaattagctgggcgtggtggcacgygcctgtaatcctagctacaccagaggctgaggtgggaggatcgcttgagcctgggaagtcagggctgcagtgagccgtgatcacaccactgcactccagccagggtgacagagtgagaccctatctcaaaagattaaaaaaaacagaacaacaaaacattaaaaagccaactcggccagccatggtggctcatgcctataatctcggcactttgggaggccaaggtggccacatgacctgaggttaggagttctagaccagcctagccaacatggtgaaaccccatctctcttttttttattttatttatttacttatttatttatttatttatttatttattgagacagagtttctctcttgttgcctaggctggagtgcaatggcacattctcagctcactgcaacctccgcctcccgggttcaagtgtttctcctgcctcagccaacaagtagctgggattacaggcatgcaccaccactcctggctagttttgtacttttagtagagacagggtttctccatgttggtcaggctggtctcgaactcccgaactcaggtgatccgcctgccttggccttccaaagtgctgggattacaggcgtgagccagtgcgcccggcccgtgaaaccccatctctactaaaaatacaaaaattagcagggcatggtggtgcacacctgttatcccaactattcgagaggctgaggcaggagaatcacttgaacttgggaggcggaggttggagtgagccaagatattgccattgcacaccagcctgggcaacagagtgagacgccgtctcaaaaaataaataaataaaaataataaaaagccaactcactatttccacccctgccccacaccaactctgccccaacctggctgtctttcagtttttcctgttttagtgattggaatcactgtccatcaactcataaaagaaaaaacatgattaagggaaacactcccttaaacaatccatcgctaggttctatctttttacatatattaaatctattaaaaatatttactcaatctttctactttgccacaaccactgccaccagagtatgtcagtatctcttgcctggactactccaatttttgttcatccagcagctagaatgatgtttccaatccccaaatctcattatttcacccagttgcttaaactccttaaatggtttctatatattttagaataaaataagaaatccttaacatagcctataaaccctgcctgtttgctaccaactgattcttgctctccaactgattttcttttgctctttgtgttttcaacacattgactttcttttatttcctttccatgcacattcctaccacagtatcttaggaaatgccttttcctctgcctagaatgccttttctctagttagtgcctcttcagtcttccaattagtattatatactctctcctatgttttttgttttgctttgtttttgtctttttctttgtttgtttttgagacagggtttttctcctgttgcccaggctggagtgcaatggcacgactttggctcactgcaaactctgcctcctgggttcaagcaattctcctgcctcaacctcccaagtagctgggattataggtgtgcaccaccatccccagctaattttgtatttttagtagagacggggtttcactatgttgatcaggctggtctctaactcctgaccttcagtgatccacctgcctcggcctcccaaagtgctgggattacaggtatgagccactgtgcctggcctctcctatattctaagatacaaataatatgtgtaagagcatgtccaaagagttcacaggactttgaattaaagcagcggcttcagggattaaaagtcagaactgaatttgaaacattcctacaaggtaaaattactttaattgtatgtctattttgatggtggcagggaataagaggaaggttggaggtaatctccaaatgtttgagttgtttgacttaatatctagaggttccttgaaggaagatgacaaattaaagagaagaaataggtttacaagaatgactaccagttaatatctagcaaaattatacatatatattagttatttgacttagcaattacacttccaaggctctgatatggcttggctctgtcctcactgaaatctcatctcgaattcctatatgttgtgggagggacctggtggtaggtaattgaatcaygggggcaggtctttcccatgctgttctcatgttagtgagtaagtcttatgagatctgatggttccataagggggagtttccctgcccaagttcactctttgcctgctgccatccatgtaagatgtgacttcctcctccttgccttctgctgtgattgtgaggcttccccagccacttggaactatgagttctccattaaacctctttcctktgcaaattgcccagtgttgggtatgtctttatcagccacgtgaaaacggactaatacagtaaattggtaccagtagagtgaggcactgctgaaaagatactcaaaaatgtggaagaaactttggagctgggtaacaggcgagactgggacagtttggagggctcagaaaaagacaggaaaatgtgggaaagtctgaaactttctatagaattattgaatgactttgaccaaaatgctgataatgatatggacaataaagtccaggctgaggtggtctcagatggagatgaggaacttgttgggaactggagcgaaggtgactcttgttatgttttaagcagagacttgcggcattttgccctgccctagagatttgtggaactttgaaattgagagagataatttagggtatgttgcagaagaaatttctttttaaaaatattttgttatactttaagttccagggtccaggtgcacaacgtgcaggtttgttacatatgtatacatgtgccatactggtgtgctgcacccattaactcgtcatttacattaggtatttctcctcatgctatccctcccccattcccccaccccatgacaggccctggtgtgtgatgctttccgccctgtgtccaagtgttctcattgttcaattcccacatgtgagtgagaacacgcagtgttcggttttctgtccttgtgatagtttgctcaaatgatggtttccagcttcatccatgtccctacaaaggacatgaactcatccttttttatggctgcatagtattccatggtgtatatgtgccacattttcttaatccagtctatcattgatggacatttgggttggttccaagtctttgctattgtgaatagtgctgcaataaacatatgtgtgcatgtgtctttttagtagcatgatttataacacccagtaatgggatcactgggtcaaatggtatttctagttctagatccttgaggaatcgccacactgtcttccacaatggttgaactagtttacactcccaccaacagtataaaagcattcctatttctccacatcctctccagcacctgttgtttcctgactttttaatgatcaccattctaactggtgtgaaatggtacctcattgtggttttcatttgcatttctctgatgaccagtgatgatgagcattttttcatctgtctgttggctgcataaatgtcttcttgtgagaagtgtctgttcatatcctttgcccactttttgatggggttgtttgactttttcttgtaaatttgtttaacttctttgtagattctggatattagccctttgtcagatgggcagattgcaaaaattttctcccattctgtaagttgcctgttcactcttatggtagtttcttttgctgtrcagaagctctttagtttaattagatcccatttgtcaattttggcttttgttgccattgcttttggtgttttagtcatgaagtccttgcccatgtctgtgtcctgaaggtattgcctaggttttcttccaggatttttatagttttaggtttaatatttaagtctttaatctatcttgaattaatttttgtataagatrtaaggaagggattcagtttcagctttctacctattgctagacagttttcccagcaccatttattaaatagggaatcctttccccatttcttgtttttgtcaggtttgtcaaagawcagatggttgtagatgtgtggtgttatttctgagggctctgttctgttccattggtctatatctctgttttggtaccagaaccatgctgttttggttactgtagctttgtagtatagtctgaagccaggtagcatgatgcctccagctttgttctatttggttaggattgtcttggcaatgcaggctcttttttggttccatttgaactttaaggtagttttttccaattctgtgaagaaagtcattggtagcttgatgtggatggcattgaatctataaatttacttgggcagtatggccgttttcacgatattgattcttcctatccatgagcatggaatgttcttccattcgtttgtgtcctcttttatttcattgagcagtggtttgtagttctccttgaagaggtccttcacatcccttataagttggattgctaggtattttattctctttgaagcaattgtgaatgggtgttcgctcatgatttggctcgctgtttatctgttattggtgtataagaatgcttgtgatttttgcacattgattttgtaccctgagactttgctgaagttgcttatcagcttaaggagattttgggctgagatgatggggttttctaaatatacaatcatgtcatctgcaaacagggacaatttgacttcctcttttcctaattgaataccctttatttctttctcttgcctgactgccccggccagaatttccaaaattatattgaataggagtggtgagagagggaatccctgtcttgtgccagttttcaaagggaatgcttccagtttttgctcattcagtatgatattggctgtaagtttgtcataaatagctcttattattttgagatatgttccatcaatacctagtttattgagagtttttagcatgaagggctattgaattttgttgaatgccttttctgcatctattgagataatcatgtggtttttgtctttggttctgtttatgtgattatgtttattgagttgtgtatgttgaaccagccttgcatcccagggatgaagccaacttgatcttggtggataagctttttgatgtgtcgctggattcggcttgccagtattttaaggaggattttcgcactgatgttcatcagggatattggtctaaaattctctttttttgttgtgtttctgccaggctttggtatcaggatgatgctggcctcataaaatgagctggggaggattccctgtttttctattgattggaatagtttcagaaggaatggtaccagctcctctttgtacctctggtagaatttggctgtgaatccatctggtcctggactttttttcgttggtaggctattaattattgcctcaatttcagagcctgttattggtctattcagggattcaacttcttcctggtttagtcttgggagactgtatgtgtccaggaatttatccatttcttctagattttctagtttatttgcatagaggtgtttatagtatagtttgtatttctgtgggatcagtggtgatatcccttttatcattttctattgcgtctatttgatgcttctctcttttctttattagtctttctagcagtctatcaattttgttgatcttttcaaaaaaccagctcctggattcattgattttttgaagggatttttgtgtttctatctccttcagttctgctctgatcttagttatttcttgccttctgctagcttttgaatttgtttgctctcgcttctccagttcttttaattgtgatgttaggatgtcagttttagatctttcccactttctcttgtgggcatttagtgctataaatttccctctacacactgctttgaatgtgtcccagcgattccggtacattgtgtctttgttctcattggtttcaaagaacatctttgttctgccagtagtcattcacgagcacgttgttcagtttccgtgtagttgtgtggtgttgagtgagtttcttaatcctgagttctaatttgkttgcactgtggtctgacagacagtttgttttgatttctgctgttttacatttgctgaggagtgctttacttccaactatgtggtcaattttggaataagtgcaatgtggtgctgagaagaatgtatattctgttgatttgaggtggagagttctgtagatgtctattaggtctgcttggtgcagagctgagttcaagtcctggatatccttgttaaccttctgtctcattgatttgtctaatattgacagtagggtgttaaagtctcccattattattgtgtgggagtctaagtctatttgtaggtcttaaggacttgctttatgaatctgggtgctcctgtattgggtgcatatatatttaggatagttagctcttcttgttgaattgatccctttrccataatgtaatgatcttttttgtctcttttgatctttgttggtttaaagtctgttttatcagagrctaggattgcaaccccttgcagaagaaatttctaagcagcaaagcattcaagaggtgacttgggtgcygttaaaggcattcagttttataaagaaagcagagcataaaagttcagaaaatttgcagcctaacagtgygacagaaaagaaaatcccatttgctgaggagaaattcaagctgcctgcataaatttgcataagtaacgaggagccaaatgttaatacccaagacaatggggaaaatgtctccagagcatgtcagaggtcttcacagcagccccacccatcacatgcttggaagcctaggaggaaaaagtggttacatggactggacccagggtccccgtgctgtgtgtagcctagagacttcttgccctgcattccagcccctccagcattggctgaaaggagccaatgtagagcttggactgtagtttcagcaggagcaagccccaagccttggcagcttccatgtggtgttgagactgcaagtgcacagaagtcaagaattggggtttgggaacttctgcctggattttagaagttgtatggaaatgcctggatgcccaggcagaagtttgctgcaggggtggggtcctcatggagaacctctactagggcagtgcagaagggaaatgtggcatcagagcccccacacagagtccctactgggacactgcctagtggagctgtgagaaaagggccaccatcctccagaccccagaatggtagatccactgacagcttgcaccatttgcctggaaaagccgaagacactcaacatcagcccatgaaggtagccaggagggaggctgtatcctacaaagccacagcagtggagctgcccaagaccatgggaacccacctctttcatcagcctgacctcgatgtgagacataaagtcaaaggagatcattttggagctttaagatttgactgccctgctgaatttcagacttgcwtggggcctgtagcccttttgttttggccaatttctcccatttgggatggctgtatttacccaatgccrgtacccccattgtatgtaggaagcaactaacttccttttgattttacaagctcataggcagaagggacttgccttatcttggatgagactttggactgtaaacttttgaattaatgctgaaatgagttaagcttttgggggactgtcagggaggcatgactagttttgaaatgtgaggacataatagttgggtggaggcaggggtggaatgacatggtttggttttgtctcctctctcaaaaaaaaaaaaaaaaaaatttccaggcatggtggctcacccctgtaatcccagcactttgggaggctgaggcgggcaaatcacttgagggtcaggagttcgagaccagcctggccaacgtggcaaaactccgtctctactaaaaatacaaaaattatccaggcatggcacatgcctgtaatcttagctacttgggaggctgaggcatgagaattgcttgaacctgggaggtggaggcttcagtgggccaagatcgtgccactgtactctagcctggatgatggagtgagactgtctcaaaataaataaataaataaaaagttggtcatatctaaaaatactttcacagcaacatgtagactggtatttgacgaaatatctaggcaccatagcctggccacaagtackcccctagttctatctggaaaatgctaattcttcctgctcatttagagcagtgaccctatcttcccttctcagggtcagcataaacccagctacattatgctgtcactccacatagctattgactttgatgttcagrcccagtagcactgtagaggacaagtctcccacagagagtgctagctcttagtaaggagaggcaggccacttctgcggttctaaaggtttagctaaggctaggtaacacaaatcttcagaggcactcaaccagatttctccatcccatgtttcagaatcccagatttttcccaaccaagattctgacattagcataacagacttctttggttaagtgtttttgagctrggcaattctaactattcaatcttgaatctggttttcagctttttctgctactcactacaggagataagagcctctttctaacaaggctctcttgccgtcacaattaattttgccttcagcttttcattatatatatatccctctatgaagtgtaaatataacttattaacaagccagtggtctcacatgcattgcctccttccccatgcctgaattattacaccaaccgaggcacccccccttcaccagaacatcctctcaagttaccactggtgacagttttggcaactgggccaccaccttgtattacagatgatccatgatccaatttctaccttgtgtgattttcctttagtcagaagaacttcctgtaacattttttttttgagatggagtttcgctcttgttgcccaggctggagtataatggtgccatctcagctcactgcaacctctggctcctgggttcaagcaattctcctgcctcagcctcccaagtagctgggattacaggcatgcgccaccatacccagctaatttttttgtatttttagtacagaaggggtttcaccatgttggccagacgggtctcaaacccttgacctcaggtgatmcacctgccttggcctcccaaagtgctgggattacaggcatttgccaccatacccagctaatttttttgtatttttagtacagaaggggtttcaccatgttggccagactggtctcaaacccttgacctcaggtgatccacctgccttggcctcccaaagtgctgggattacaggtgtgagccaccaagcccggcccctttaacatttcttgttgtgcagktctattggcaataaactttctcagcttttatttgtctgaatctatattttaccttaacttttatttatttttattttttaaattttattttatgaatatctaatctgccagcattttagaaatttgtttctattttctaaattttattttatgatactttcacttttaaaggatattttttctgggtatatagttccagattgacagtttctgtcccatttcaatactttatgttgttacatttttttctggcttgcattgtttatgaaaatggccctgtgtgtaatatgtctgttttttttcctgctgcatttagactttgtttatacacttctgttcggcaatgtgtttattatgtgccttggtttgggccatgtgcttgtgtgtgtgtatatatgtgtgtatttattgggcttgatatttgttgaacttcttggatctgtgggtttatagttttcaaaaaattttaaacttttccaaccattatttctctactccactgagatttgaattacatgcatgttacactgcttgatattatccacargycattgtaattgttcattatcttttgttctttttcctctctgagcttcactttgggtgtatttcagttgactatgtcttcaagtttacccgcctttccttctgtagtatstaatctgttaagcccattcagtgaattcttttatttagaatattgtgttttagtttccattttactctttttagaatttttttttctgtattatgtttgtatttctctttaaatttttgaactgctttaaaattcctgcctgcacctgttatttctggatgatttatattagcttatttttctcctgattatgggtcacctttatttcttttccttttttttttttttttttttgacagagtctcgttctttgtccaagttggagtgcagtggtgcgatctcagctcactgcaacctccgtctcccggttccagtaattctcatgcttcgttctcctgagtaattgggattacaggcatgygccaccacgcctggctaatttttgtatttttagtagagacaggttttcaccatgttggccagggtagtcttgaattcctggccccaagggagttgcctgccttggcctcccacagtgctgggattacaggtgtgagccatcacacctggcctatgggtcatcttttcctccttccttctatgtccagacattttgattggacattagacattgagattttatgatctccaatatgtaaattttgatgtctttttaaaaagaatgctaagctattttgagatcagcttgatacttttgaggcttgttttaagttttattggggtgaacccagtactttgtagcctttactctaggactagttgaattctactactatggtatgaaccttttactactgtggtatgagccttctcaggtttctatcatatgctgtaggtgttcaataatgtctctgttctttagtttattgttacttgaatatctctctgctcttctgtgggttttgagaatcattcagcttgcaggccttcagttgctgttttccagccttatggagttttactctacgtattcaaaacttagtattcaacaacagactcagtcggttcccatgcagtttattgaaaatctttttctgtgtggccccctctgctttggtactctactctgaaaattccagccatttcagccttccttcaattcagtgagacaactgtgctctttctccctgcttcatattctgtagagtacccccaagtaaaagaaatggggcaatcatagggcttttctcatttgtttccctttccttgggggtcagagatttgttatgcttaatgtccaaattctgaaaacaattgtttcatatattttgtccattcttctaawtttttttaatggcagtagggcaagtccaatactagctatcccattatgatggaagtggaagttttgtagagtaagtgttttgatagatatgggcacataattaatccaaccacataggtcttagagcagtcttgcaaaaagactttctagagaaaagaatgcctcctctaaaagagaagccaaaaggagaagaggtaaaggatattttaggatatttcagataaggaagtagcatacacagaggcagagaggcatcctagaactatcaaaaatatagctgaagcctacaataagacttgcagagaagcgaggagagaaataaagagagattatttaggaggacatcaatcatgaatattttccttttgtatttaatatagcaaagtggactaaaaaaggatgcttaattaaggtataggcagtgatttgaacattgtaatttmttarttacagtgtaattgtaaagtgacggttatgaaaactatatagcagtgagggggtgtttataatatgttacatgaaaacatcagaaggtaaacatttgtacatatactaatatcatattttttaaaaaaatcagatgcataggaaataacatcataaggaaatgtaccaaaaaaattgtacaaatgtggtagaaaatgaataatggttggccaggagcagtggctcatgcctataatcccggcactttgagaggccgagatggatggattgcttaagcttagtagttcaagatcagcctgggcaacatgttgaaaccctgtctccaccaaacaaaatacaaaaattagccgggcatggtggtgtgtgcctgtgatcctagctaattgagaggctgaggaagaaggatcatttgaacccaggggggcagaggttgctgtgaactgagattgcaccactgcactccagcctgggtgacagagcagaccctgtctcaaaaaaataaatagatagataaataaataaataaataaaaataaagaataatagtagctgggcatggtggcatatgcctgtaatcccagctactcaggagactgaggcaggaaaatcacttgaacccgggaagcgaaggttgcagtgagaagagatcgcaccactgcactctagcctgggtgacagagtgagactctgtctcaaaaaaaaaaaaaaaaaaaaaaaaaaaaaaggatagtgaatatccactaaaataaataaaaataaagaatagtggatattggtatgatccttctcaggaaagagcacagacaaagcacagaagtttcactgaattgaagagagaaagagatcaaaagttagggaagctgagctggctggaattttcagagcagggtaccaaagcagagggaactacacagaaaacggttttccctcactttttaatgtttcagatacagacacacattggagatattgtagattcggaaccagaccactacaataaaactagatctcattaacgcaagacacacgaattgtttggttttcagttatgtttagactatctggtagtctattaagtgtgcaatagcattatgtctaaaaaaggctaatgatcatctgaggtttcagcaagttgtaatctttgcttgtggggagggtcttgcctcaatgttgatggctgctgactgaccagagtggtggttgttgaagggtggggtggctgtggcaatttcttttagggagaccagaatgttkactgcattggttgactcttcatttcatgaaagatttctctgtagcatgttatattatttgatagcattttacccacagaagaacttttaaaaaaaatttggagagatggcagctatagcctcataaaatgtatttcttaattagtaagacttgaaatcaaaattatcccttactccatggactgcagactggatgttgtattagcagacatgaaatcagcgctcatcttcttgtacatctccatcagagctctggggtgactacatgcattgtcaatgagagtaatactttgaaagagagttttttttttttctttctgagcagtaggtcttaacagtgggcttaaaatattcagtaacccacgctataaacagatctgttgtcctttaggctttgtttttccatttatagagcacaggcagagtagatgtaacataaattttaaggccttaggattttttgratgataaatgagcattggcttcaacttaaagataccagctgcactggcctctaataagagagccaacctgtcctgagaagctttgatgccagacattgacatctcttctctagctaggraagtcctagatggcatcttttttcaatagaagactgttttatctacattgaaaatctgttatttggtgtagccacctttatcaatgatcttagctagattttctgagtaacttgctacagcttctccattagcatttgctgtttcaccttgtacttttatgttacggagatggctttttcyttaaaysacatgaaccaacctctgctagttttgaacttttctgcagttttcttacctctctcaaccttcrtagaattgaagagagttagggccatgttctagattaggctttggctcaagggaatgttggagttgatttcttatttagatcactaaaacgtttcctatatcagcaataaggctattttgcttttgtaacattcgtgtgttccctggaatagcacttccttcacaagcttttcttttgcatttacaacttggctaactggtgcaagaggcctagctgtcagcctatctcactttttgacttgccttcctcgctaagcttaatcatatctagcttttgatttaaagtgagagatgtgtgactcttccttttacttgaacacttagaggcaattgtagggttattaaccagcctaattgcaatattattgtgtctcagggaatagggaggccagaggagaaggagagaggagaagggaatggctagaaagtggagcagtcagaacacacacaaaatgtgttaagtttgctattttataygggaatggtttgtggtggtcctgaaagaattacaatagtaacatcaaagatcactgatcacagatcatcttaacaggtaataataatgaaaaagttggaaatattctgagaatatcaaaatgtgacatgaagacacaaagtgggcacatgctgctggaaaaatgacattgatagccttrcttgatacagggttgtcaccaactttgcattgtaaaagtgtactatctgtgaagcacaaacaagtgaagtgcaataaaatgaggtatgcctgtattctgtgctttgatactaaaaagggtgttgttgaggaaaatgtcaatgcatatacatacgtgcatacctacatacatacaactcttcccttcagtgctttcgttttctactctgtaaagtggaaattttgatagtatgtctcttattttgtgtgtgaattaaatgggatataatgtatttatataagcatttagcagcacaatccatgatccatattcagggtgtgtattagtccattttcacaccactgataaagacatacctgagactgggtaatttgtaaygaaaaagaggtttaatggactcacagttccacgtggctggggaggcctcacaatcatggcagaaggtgaaaggcatgtcttacatggcgacagacaagagagaatgggagccaattgaaaggggaaaccccttatgaaaccatcagatctcatgagacttactaccacaagaacagtatggggaaaactgcccccatgattcaattatctcccaccgggtccctcccacaacacatgggaattactggagctacaattcaagatgagatttgggttggaacacagccaacccatatcagtgtgtcasgttttttgtttttttttttcaccaggactactgttgcattcatgtgggatatttattatgctgtattatgcaatattcctgggtcccaatcactatgtacatgtagtcatagtgactataaaaaaatgttatcacatacttccaaatatttttggctgaaaactacatgtgaaagagttatgaattaaaaagtataggaatagatatatgaaggtaagggttctttcttgctctcaattctttggtaaaacagaatccttcacatgaaaaacaaaacaaaagcaatgtggtgtggtgggagatgcacagaactgggaatgagaagacttgggatcttggtttttctctatcgtaagcaaattccttagtctctgtgggttaatttccttcttgtagaatgaggccgtggtccaagctaccatcaagagtcttcctagctctaagagtggattatttttatgcattgaaggaataatttttctgacatgcctttttttatacagcaaaggtggacattcagaccagttttgcaacttgtaagtcacagaggggaggaatttagattctatcaccctttctcaaatttagatgctatcagataatccagaggtcagcctcccgagtagctgagattacaggcgtgtaccaccacaccaggctwtttttttttttttttgagatggactttcactcttgttgcccaggctggagtgcaatggcgcgatctcggctcactgcaacctccacctcctgagttcaagcgattctcctgcctcagccacccgagtagctgggattacaggtgcctcagccacccgagtagctgrgattacaggtgcccgccaccacgcccagctaattttttgtatttttagtagagacggtatttcaccatgttggccaggctggtcttgaactcctgacctcaggtgatccacccacctcagcctcccaaagtgctaggattaccacatccggcccagctaatttttgtgtttttagtagagatgggttttcaccatgctggccaggctggtctcaaactcctggcctcagatgatctgcctgctttggccttccaaagtgctgggattacaggtgtgagccactgcgcccagccagtctacctttaatactaataacagtgaaacagtgaattcactaggatcccaaacttctcatgtccacccttcctatggggtcctggatgaagtttccttcctgctgctgctactccaggtgtaccttactgctctggcacttgctgggctcatgccaacactgttgctttatcccttactggtatcactggcctgcctgggaatggaaaagttgtatttggttcacaaagaactttaaaacgtcttccctctggctggagtgaaatgcatttcatagtgattcagtgtcctaggccaaacaactcctttcaaatgatgaacttcagcaccaccctgactcatgtgtctgaactctttcttacctggggatgattttaccccatataaaaaagaaatgatcattatttcttcccttcttcttttctttttttttttggtttgttcctaggactgaacacagactaaatgtctaatcaatgtttatttgaataaatggataaatccatgaaacataatatttaggtaacataggaaaagtcgtgtagtgcagcctttatgtatttaaatatacctgtgtaatacatttgcacatgtttttagacattatgatttattggggatatgtaatttttaacaaagtataactatacctgtgtttcgaaacacttcttattgaagaatgaaatacaaatctttttctttttcttttttttttttttttttttgagataggatctcactctgtcacccaagctggagtacattggtgcaatcttggctcactgcaacctccccatccatcgtgatccaggttcacacgatcctcccacctcaagcctcccaagtagttgggaccacaggcatgtgccaccactcccagctaattttttttgtgtttttggtagagatagaggtttcaccaggttgcccaggctggtctcaaactccacccaccttggtctcccaaagtgctgggattacaggcatgagccactgtgcccaaccgagatacagatctatgttaataaaatgacatgaagaacctaggtcaaggagggatgaatccatatcgctctctctgtatctagttagctataccctctcaactcaatctctgtctctcaaaacttttttttttttttttgagatggagtcttactctgttgctcaggctggagtgcaatggcacagtctcagctcactgcaacctccgcctgccgggttcaagcgattcttctgcctcagcctcctgagtagctgggattacaggcacccgccaacacgcctggctaatttttgtatttttagtagagacggggtttcaccatgttggccacgctggtctcgaactcctgacctcgtgatccacctgcctcggcctcccaaagtgttgcgattacagccaccacgcccggcctgactcaaaacgttttcttcacatttttagtattagtaatgacaaggagggacacacacagtttaataatttattataaatatatggtatctctccaaacactcacagaatgtattaggtgatccatactaggtctctcaattattcttgtgactaactgcttggatgaccacgaggaacactgtgctgttattggagactgtgtgaatagagaacccagagtggtgcagccacatgcagcaaccctagcatacatttccaaaaattttatggacatatttttctatcccctcatttgaaaaatcatagagcacaactctcaggttagatcactatcatatcttagcattaaactgggagtctgctaaattattctatttaagaattttgatcattttaacaataaaaataatgtactaatagtgtgtcttctcagaaattgttttctttcttttctttttttttttattaagagacagggtcaccctatgttgcctgggctggtctcgaactcctgggctcaaaacaatcctacaatctcagcctcccaaagtgctgggactccaggcatgagccacactgcctgattcagaaatctttttgaagatatttttaatagagtcattttagtctacaaagaatttcattatttcattgtgtttctacattaacccagtgtataggatctgcaattctcacttcatcaaattgagaactgaggatcagcgagggatagcaacttacccaaagtcacacagctatttggggatagacctaggattccaactgctgcttttaattgcaataatcttttcattatgctactttttataaaagttagaaataagttgcatgtgccagagagaatttcaatgacctcataggtgtgtatgaaatcatgagctgtttaatgatattacataaaagctcaaaagagcagaaaacccacccacggatatcagaagggtccttctgggaaatttaattttattgtactttatagtttagaaaatttattttattattatataattggtttattgactcactcattaattcaccatacatttttctagtgttcatgattgataaggcatttacctgaacagtctgtgactggcaaaaatgagtcagagacaatcactggcatcatgaaatgaactaactcagagtccacaaggaacaataatagcagacagaatgttataaatgccataccagaggtgtgaacataatgttatgagaaattagcagagaaacacgagaggcaacataatttgaattattgtccatattaaatgtgtatcactcttgtagtaataataaaagattatttgttgtttaaagaagagatattattaatttcatggtaggaaaacaatggtataaaattggccatgccatattgcccaaagtaatgtatagattcaatgctatccccatcaagctaccattgactttcttcacagaattagaaaaaaactactttaaatttcatatggaagcaaaaatgagcccatatagccaagataatcctaagcaaaaagaacaaagctagaggaatcacactacctgacttcaaactatactacaaggctacggtaaccaaaacagcatggtacttgtaccaaaacagatacatagaccaatggaacagaacagaggcctcagaaataatgccacacatcactattcacaatatcaaagacttggaaccaacccaaatgtccaacaatgatagactggattaagagaatgtggcacatatacaccatggaatactatgcagccataaaaaatgatgagttcatgtcctttgtagggacatggatgaaattggaaatcatcattctcagtaaactatcacaaggacaaaaaatcaaacaccacatgttctcacttataggtgggaattgaacaaagagaacacatgggcactggaaggggaacatcacactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacgtaaagtataataataataaaataaaatttaaaaaaataaataatgtcacacatctacaaccatctaatctttgacaaacctgacaaaaacaagcaatagggaaaggattccctatttaatacatggcgttgggaaaactggctagccatatccagaaaactgaaastggaccccttccttacaccttatacaaaaactaacccaagatggattaaagccttaaacgtaagacctcaaatcataaaaaccctagaagaaaacctaggcaacaccattcaggacataggcatgggcaaagacttcatgactaaaacaccaaaagcaatggcaacaaaagccaaaattgacaaatgggatctaattaaactaaagagcttctgcacagcaaaagaaactatgatcagagtgtacaggaaaaaaaaaagaaagaaagaaaagaaaaaagaaaaaaggtttgtatttcattcttcaataagaagtgtttcaaaaaaaatgtatagttatactttgttaaaaattacgtatccctacagaatgggagaaaatttttgcaatctacccatctgacaaaggactaatatccataatctacaaagaacttaaacaaatttacaaaaacaaaaacaaaaaaaaccagccccaccaaaaagtgggtgaagggtatgaacagacaattctcaaaagaaatttatgtggccaaaaaacgtatgaaaaaaagctcatcatcactggtcattagagaaatgcaaatcaaaaccacaatgagataccatctcacaccagttagaatactgatcattaaaatgtcaggagacaacagatgctggagaggatgtggagaagcttttacactgttggtgggagtataaattagttcaactattgtggaagacagtgtggcaattcttcaaggatctagaaccagaaataccatttgacccagcaatctcattactgggtatatacccaaaggattcaaaatcattctactataaagacacatgcacatgtatgtttattgtgcactgttcacaatagcaaagacttgaaaccaacccaactgcccatcaatgatagactggatacagaaaatgtggcacatacacagcatggaatactatgcagccataaaaaaggatgagttcatgtcctttgcagggacatggatgaagctggaaaccgtcattctcaagctgacacaggaacagaaaaccaaacaccgcatgttctcactcataagtgggagttgaacaatgagaacacatggacacagggaggggaacatcagacactggggcctgttgggggttggggggctaggggagggatagcattaggagaaatacctaatgtagatgatgggttgatgagtgcagcaaaccaccatggcatgtgtatacctacgtaacaaacctgcacattccgcacatgtatcccagaacttaaagtattgaaaataataataacaataaataaataaataaataaataaataaataaataaataaatagtggccatggagagacaggcatatataaacacaaagttcttgtttctttgcccactgagttaacaggagaaggaaaagaagccgccttctctggtaaaattccaaaaatgctgtcaccttgagaaaatcagttttcagttaagataagtaaaatgaagaatttttagggctgcagggcagggggtggggcagagtgggtcttggctactatcttgcacaactccccattttaaagttgaagaggccaggtgcagtggcttacacctataatcccggcactttgggaggtcgaggcaggtggagcacttgaggtcaggagttcaagaccagcctggccaacataacgaaaccccatgtctactaaaaacacaaaaattagccgggcttgtggcacacgcctgtaatcccagctactcaggaggctgaggcaggagaatcgcttgaacctgggaggtgaaggctgcagtgagccgggatcgcgccactgcactccaacctgggtgacagagtgagactccatctcaaaaaaaaaaaaaaaaaaaaaaagttaaagagactaaggcataaataagtaaagatacttgctcaagatcacataatcaatcaaaatagaaagggaactcatacttagatctccagaccccacactgctctcattgaaatatgtagaataccatctgaggcaaagagttaggttacccttattaaatatctacagttggccggcacggtagctcatgcctgtagtcccagcactttgggaggctgaggcgggcagatcacttgaggtcaggagttcgagaccaacctggccaaaatggtgaaaccctgtctctactaaaaactacaaaaatgtaatcccagctacttgggaggctgaggcaggagaatcgcttgaacctgggaggcggaggttgcagtaagccgagattccccccttgcactccagcctgggtgacagagcaaaactccgtctcaatagaaagaaagaaaaaaaatcgacagttatgcctcaaaattaaattaacaacactggttacttaatgttaccaggatgatatctattatatatacaagaggtgtcatatatatatgtaggtccttttggatccactttcaaaatatatatatgtctacctgacatcttgacacttagatatctaatagatatttcaaatgtaatatgtccaaaactgaatttttgatctttcctccccagacctgcttcactctcagtcttcctcatttcttttgatggcagctcctccatccttctagttattcaggctaaaacccttggagttatctttgatgcctctctttttatcctactgcataccgattttgtcaacaaatcctgtggaatctgtcttaagaatatatccaggaactgaccatccttaccaccttctctactgtgaccaccttaattcaatggacagtcatctctctcttggattactgcaatagcctctgaaccaaactccttgcttctacctttgtcctttgttttgttctcaaaacagccagaatgagctttttaaaatattaagtcagatcatcacttttctgactcccatctaaaatggacattcattttgtttagagtaaaagctgaagtcctttcagtggcaaaaatatttatagcagcattactcataatagccaagaagtggaaaaagctaaataaacatataaacaaaaatgtgttgtatccatacaatggaataatatttagcattaaaaaaagtgaagaactgatatgtgttacaatttggatgaaccttgaaaatattatgaggctgggcacggtggctcatgcctgtaatcccagcactttgggaggctgaggcagggggatcacctgaggtcaggagttcgagactagcctggcctaagtggtgaaaccccgtctctactaaaaatgcaaaaattagctgggcttggtggtgggtgcctgtaatcccatctactcgggaggctaaggcagaagaatttcttgaacccaggagatggaagttgcagtgagctaagatcacacaactgcactccagcctgaacaacagagtgagactccatctcaaaaaaaaaaaaaagaaagaaaagaaaatattatgttaagtgaaagaagccagtcacaaaagatcacacattttataacactatttatatgaaatgatgaaatgtccagaataggcaaatccatggagacataaagtcaattaggaactacctagggctagaggggttggaggaaacagggagtgactgctaattgctatagggtttcttttagggatgataaaaatgttctaaaatggatcgtggtgatgatacgggtctctgtgaatggactaaaaccattgcatggtatagcataaatgggtgtatgttatggtatgtgaattacatttctatattacattgctataaatctgttttgtaaaaaagagaggtaatagaaaggaaggaaagaacataataaaaggggcagtaataataataataatagtaataaggccccatattaggaaggaacttaatatctatgagttgacagatatcatggtacctatgatattagagagaaggccaatatccttaaggtgtacgaacaagttggaaaataagctgcagtcagataaggaccatagtatgaggattttaaattttaccagaacccccaaaagaaagatttagagggatttatgcaagcaaatgacataatcagatttccatttaaaaaatcattctgtctggctggcgtggggagaattagaagtgggaaagtgtagaaactgggagagcaattaaaagttattgcagtggactaggaagaaaggatggttgaaatgaaggcagatataagagatggactttggtgtctattttggagacagaatcagtgaaagttggcaaactgagtggacgtacggcatgaaggatatgagtagatggagatcccacttgcttagattgagaaaccctggggaagagtcattttaggtgtagttctggctacactaaatttgagatgcgtttgaaaataaccctgtagacacacacatcaacagtttgatatatggtttagattgggtttaaatattggctctgccatttactagctacgtgacactgaaaaccattattatttttccggattccttcatctgtaagatggagataacataacctgcagtagccaactaataatctactggcttattacagcttgttggtttaaggcacagactctgaacctccaactgcctgcatttggatcctggctttgacatgactatagttgtatgatcttggagaagttacttaatctctttaagtctaattttcttaatcccaaaatggggataataatagcacctatctcatagggttgttaaataaagatacgcattagataatatatgcaaagtgcttggggctggcacttagtaagcagatataagtggtagttaatgatattatctcactgggttgacatgaagagatgagataatacatacgaaaggaaccagcacgtattagatattcaaagaatgttactaaagtttccttcctcatttttcacctgaattttgtcttaattaaactttccacttttatttggactaggttaacctagacattttctcagtatggtaaagcccagtaaattgcccaccagtttaagatgggagataaaggccaatgaacattgccgcaggagcagaaaatgaagaaaagaatgtctaaatggggaggcacaatccaggttggggagacagaatgcaatcagcaaatatgaacagtggaccagaccatatcattcctgagaaaagtgggattggtttggaacattggctgctatgagatgaaccccacagctgtgtgttttatctaatgaataacaaagaagcaggcctcttcaaatgaggacacgacttcaacaatatgtaagagcatcatgcactcctcctgagagctttgtgtgtgtgccatccccactggtccttcattcattcactcacttgcgcatttgtttattttctagtttattcaacaaatatttactgagcaccaggcatcagggagacagaagggggaaaaaggtgaatgttcttagctcgatggagtgtgaaatatagtgggggaagacaggaaaggaacgacaagtagaatatacagtgtcaggccgggcgcagtggctcacgcctgaaatcccagcactttgggaggccaagacaggcggatcacctgagatcaggagttcaagaccagcctggctaacatggcaaaaccccgtctctactaaaaaatgcaaaaacattagccaggcgttgcagtaggcgcctgtaatcccagctactccggaggctgaggcaggagaaccacttgaaccagggaggcggaggttgcagtgagccgatatcatgccattgcactccagcctgggtgataagagtgaaaccctgtctcaaaaaaaagaagaagaagaaggaatatacagtgtcagataaattctatggagaaaaagaaagcaagggcatcaggggagatgcagacacggtagcaaagtaaaagtttgaagaaggggagcactccaacagagggaacatttcgtgcaaaggccctgctcattgtatctctgtcattctgaatcccattttcccatcctccaaaatttaaagaaatagaaaagtttcaccgggctgaggaaggtaatgttcttagtattagtttctagggctgctgtaacaaattaccacaagttgggtaacttacaacaacagaaatatgttatcttacagttctggaggccagcagtccaaaatccagcagggccacattcctccagggaacttctggaaagggctcattccttgccaatttcagcttccgggggttgcatcagcatttctggctgcatctctccaatctctgcctctgtctttacatggccttctttgtgtgcccatgtcttctcttctgtctcttataaggacacttatccttggatttagggtccacctgagtaattcaggatgatcacatctaaagatccttaagccaggcgcagtggctcatgcctataatcccagtgctttgggaggctgaggcgggtggatcacaaggtcaggagatcaagaccatcctggctaacacggtgaaaccccgtccctacttaaaatacaaaaaattagctgggcgtggtggcacgcacctgtagtcccagctactcgggaggctgagaaaggagaatcgcttgaacccaggagacaaaagttgcagtgagccaagatcgcaccgctgtactccggcctgggcgtcagagctagcctccgtctcaaaaaaaaaaaaaaaaaatccttaatttaattacatctgcaatgactcatttccaaataaggtcatagtcacagattctggccattaggatatgaatagatcatttggggggctaccattcaatccactacactcaataaaggcgtttcagttcttctttgtccatgttatggactttctcacgttcctcatcttttttctctaagttgaaaagttgtctttgagaaaagttttttcttttcttttcttgtttcttttctccctctctctctctctccctcccttcctccctctctctctctttctctttcttggagtgtctatacagacataagtgaggtagatgactgagaattatctgagatagagactttcatatggccacagccattaatatggttcaaggacaaaatcatgttggcatctgttcgggaattgcaatgagtaagtacgttaaaatttcagaataattatttctctgttggccaaacaggaaatggataaatataaccaatgttcacaatttggaaaattgaacaaattcttctgtttaccccttttcccattcataccatacatagctaagttatgttgccatccttattcatactttcatttatactttttctactttttgactgtttaaatctttgttgcagtataacatacgtgcaatcggtacaaaagctttatgttcacatattaatctcacactgtttttacatatctgtttaaccatgtaatcatcattcaaatcaaacattcagaaggcttcttcccacttaacaatcccttccccaaaggtgaccacatagtatgcactcctgtgtaaatttctttttttttttttgacatatgtctgaaagatgcatccaagcccttttgtgtagcagtggtttacttttttcagtactgcatagtatttcactgcgtatcactgtatgatatatatttattctaatttctgttgtttccatttgtgagttatcatgaataaagctgctatgaaccttattgtacaagtcttttggtagacaaatgtcatcatttttgatggccgtatccctagaagtggaattactgggccatcgaatagacataggtttggttttagtagattttacccaagagttttccaaagtagctataccaattatctctccagttggtccatatcttcaccatttgatattgtcaagcttccaaacgttagccattctgatgggtatatattggtgtggagtggtatttcattgtggttttaatttgcatttccctaatgactaatgatgttgagcactttgtcatatgtgtatcggtcacttgtatatcctcttttgttaactgcctattcaagaattttgccccccccttttttttaaaaaaaaaaaaagaccacatctttgcttgtctgtctttttcttatcggtttgtaggagttcttttacatactctgaatatacatccttttagtgaatatcctttttggccatgtattgttccaatctgcggcttaccttttcattttcttaattttatgttttaggggtcaaactttttttgtaaagagccaaataataaatattttaggttttgcaggtcatgtggtctcttttgcaactagtcagctatgccatttagtgcaaaagcagctacacacaatacgtttactgaataagcaaaaactttatcattcttcttttgattgtttttcggccatgtaaaaatttaataattattcttagctcacatattgtacaaaaacacttgacaggctggattaagtttatagtctgatatggttgggctatgtccccacctaaatcttattttgaattgtaattcccataacccccatgtgtcatgggaggtaccaggtggagataactgaatcgtggaagcggtttcctccatcctgttctcgtgatagtgagttagttctcacaagatctgatagttttataaggagcttcaccaccccctccacttgctctgcacttctccttgctgccaccatgtgaagaaggaygtgtttgcttccccttaagccatgattagaagtttcctgaggcctccccagccctgtggaactgtgagtcaattaaacctctttcctttataaattactcagtcttgggtatatccttatagcagcgggagaacagactaatacacagtccatagtttggcagctctggtgtattttataaatacaaattatgaattttaatgaatttcagtttatccgtttcttcttttgtcatcaatgcttttttattactatttaagaaatgtttgcctatcccaaaatcatgaatatattatccttcatcttattctagaagtttcattttattattcatgtttatgtctatgatccatctgggattaggtgttatgaatgatgtaaaatacaggtttcacacatgtgcttctatgtacttaagttattatacatctttttcaattttattatgcaactatgacttatctgttcgttgaagctttccctgatacccttaccttgtgcttgtaactttcctctagtcattctttcaacaactactttttgaagccttattattatgtaccatgttaggaacatggtatggtttgtgtctgaagatatgtgtatttacttgctcatttaatcattcatcaaatttcatgatttcatcaaatttcatgaagaaaattatagttttttgaagaaaacaatttaaactttacaatgaaatatgataatattgcaagtattggttcacatgtttttctttttttttttgagacagagtcttgcactatccctgggctggagtgcagtggcgtgatctcggctcactgcaacctctgcctcctgggttcaagtgattctcctgcctcagcctcccaagtagctgggattacaggcgcctgccaccacacccaactaattttttgtatttttagtagagacagggtttcaccatgttggccatgctggtctcaaactcctgacgtcatgattcgcccacccgctttggcctcccaaagtgctgggattacaggtgtgagccaccacacctggccctgttcacatgtttttctaaaaattagtcatttgaagaaagaagccataagcattaatttgattatctccagcacctagcataaatcctagcatagaaaaggtgatcatgaaatttgatgaatgattaaatgagcaagtaaatacacatatatattgaataaatatacacatatgtatacagtgagtgtatatatatacatatatttgaattcggtgaataaatgcataaatgtttatatatatatgtgcacatcatgcacacaaacaaccttctgctcttttctcccagatgcacacaattaaagtaccacttcagaaaccactaatctttctcctgtgtgccttagactaggcttccccaacccccaggccacagatcagtagtggtgcgtggcctgttaggaactgggctgcatagcaggaggtgagccaccagccagcgaacaaagcttcatctgtatttacagctgctccccatagctcgcattactgcctgagctctgcctcctgtcagatcatcgatggcatcagatcctcataagagcacaaaccctactgtgaactgcgcttgcaaggaggagaatctaatgcctgatgatctgtcactgtctcccatcactcccaaatgggaccatctagtcacaggaaaacaaactcaggggtcccactgattctacattatggtgagctgtataattatttcattatatattacaatgtaataataatagaaataaagtgcacaataaatgtaatgtgcttgaattatcctgaaaccatccccccactcccctccccggtccacggaaaaattaccttccaaaaaaccagtccctgatgccaaaaaggttgggggctgctgccttacacagacaaagtttattcattacagattaattattaacatcttagccttttcacaagatggcgctgaagatgaagaaggaagctcctgcccccaccgaagctgatgccaaaacaaaggctttggccacaaaaaaaaaaagatccatatggcaccctctttctggtggcccaaggcactgtggttgtggaagcagcccaaatatccttggatgagcacccccaggagaaacaagcttactcactctgcctcatcagttccactgaccactgagtctgctatgaagaagatagaaaacaacatgacaatcgagatggattgatggataacagaatgatagatatgtgataaaacaagtagaataaagtattaatggtggattctagggagtgggcatataaatgctcatggtaaattattttcaacttttctgtatatttgaaagtcttcatgataaactataaaggaagtaatgtgcaaaaacgaaaaaggaaacaattatacacttgggttcattgtggatatcaaggccaacaaacaagcaccagatcaaacaggctatgaaggagctctatgaccctgatgtggccaaggtcaacaccctgatcaggcctggtggagagaacacatatgttcaattgcctcctgatttacgtttcggatgtggccaacaaaactgggatcatctaagctgagtccagctggctaattctaaatattcaccagaaaaataatcatttaaaagtaatagtaataaagacttgatggctcctatctcagactgcctgggttcaaatccaggctctatcacctggcagttaaagttacttaactttcctgtgccccagtagcctcatctgtaaaatgaaaaaaccttccttacagggatgcttggaatattaaaggagttaacacgtatcgaataattaaagcctaaaggttcaatgaggacaggaatttttgttttattcattgccatatccctagcttatagaagagtgtttggtacatagcagatgctcaataaatttctattgaatgaataaccaatattaggatagtcaaaatcgaatcgctgttggctattattttatgtttgctataaaagttcttaattcccatttcaatcattccccatcccccaattactgccattttcactttgggagccatggcactttcctataatgacacaagatggcagcatcactctccttttaagttatcagccaagctctagttgaccagttttggaaattctctgaagcatctttatttgcaagttcctccatccgttctaattttttttttaatgaacaacattaactgtttgaattaccataagattagctcttaactgctctaatttctagctaagaaaagattactacttgtaaaagggtaaaaatgttgacatgaatccaagactgctttccagtaccactacgattttgtgttcttaaagctccctttttgtaacaaaaaaactgcttgacaaattatgaagccaaatgtgtttcagagacacaaggtgcaacaatgttgttcccttccaagcctgtaagaaattacaaacaaaatacaacttcccctctgtctctttactaaagacatgaagctaattcttcagtccctctaagttactctgtgaattcactgttgaacagcagaaatttctgagcacctttgagtgtgagaccttgtggggtaaagaaaaaaaccttagtttagaaattaagagacctggattccagtggctcttcaggaatctcctcaccaccaactttaatcaaatctcctatctttccaagattcaatttccttattctaaaacaaggataataatctctgccttacctattcggaaacaagatcagtgaatgtaaatagcattataaactgtaaggggtataactgtattataaatattataaactgtaaagcattatacacttcaccctgcatgagctaatgttagaatcattttcattttacctrtggggaaaaccagttctatccagttaagtgagcttgcctcagttttctcatctgtaaaatgggactaatgatagcaactccacctacttcagtgagttgtaaagataaaaataagataatagatgtgaaagtgcttttaaaatgaaagtactttcacttgtactctcacaagattattagcttaagcaaatggcttttcttagatttcacaaacaatcctgaagaaaacaacatataagtaaatcgttcaagaaaataagtattttgaattaatactttctgaaacctcaagaaattgcatattttaaaaagacaggagttgagaggctgaagatgttattttattcagggaaggatgactacaattaaatggttatattcaaggtggtacttgataaatgctttttaaatagctgtatttaaatgaggtattttgtagaaataaagtgttcattgaaaatattaacattcaacttgccagacgcagtggttcacgcctataatcccagcactttgggaggccaaggtgggcggaccatttgaggacaggagttcaagactagcctggccaacatggtgaaaccccgtctgtactaaaaatacaaaaattagccaggcttggtggccatgcctgtaatcccagctgtggcacgagaatcgcttgaactcaggagggctgcagtgagctgagatcgcgccactgcactccagcccgggtggcagagcaagactctatctcaaagaaaaaacaaaattaacattcaactaatatttattgattgcctattgtgtaccaagcattttcaaatgtattatttcattttatacttttaaaccctcctcacaactacagaaaatgtcagccccatttaaaagttgaggaaactgaggttcagggaggttattcagcttgcctcaggtcaaacagcagaaacccttctgctaatcccctgccccttcctgccttttctcaggagtattacggtagatgtttccattcagtcctctggaagcaytcgtgatatcaaatccaacacttatagcagcaagctagcaatttttgtttagtaaaaaccagaggtggaatatgaatataacagtttggaagaatctggataaacagactcttcttagtcaaaatgtctatgtcttcttaagttaacttcaatggcttaagaaacttaggctcttactttttgaccatacaattttatataaaagggactcagctactttcctcttcaatatttctagagccaattcataccttttcaaaactaaaaataattaattattaaatattgggagtcaaaaagagagagaaagaaaattatgaggtaacgagagatcttagaaatgaaggccatttaaatgttgggaggtatcagttatgtaagaatgatgtgctgttgttgtcacacacaataagtcaatcttaaaaaggcatttatccctgctgatrttatagtttttatacagaccaatttaatgaactggatgtcattttgatgtgtgaattttggtaagtttgtttgccagaaattctaattacttaattaccttgaaatgacaccattctaaattatcaagtctgttttattgcaatttatttgctggtaagattattcaactttagggtttaaggcaaagaggccttcaagtttatatgtctggttagctgctttatttcccattatctaaagaaatatgttgacactatattttattacttgttcaaatcagttttataataacaagtatttgtagcggtcctttgaagagttacccaaatataatacctgtttgcatagaactacatacatcaattaacactatgatcttttagttatggaaaaatagcccacagagccttataaatggaaatataaaagtcttatttaaacatccatttattatcccttttatctgcttttggaataacaggctttttgagacagagtctccctctgttgctcagactggagtgcagtggcatgatctgggctcactgcaacatccacctgcccagttcaagcaattctcgtgtctcagcctcagggagtagctgggactatgggtctgtaccaccacaccagtatttttagtagagatggggtttcaccatgttggccaggctgatcttggagtcctggcctcaagccatctgcctgtcttggcctcccaaagagctacgattataggcgtgagccactgcgcccagccagtctgacttttaaaaatatgtgtattcttaaattaataaaagtcatttcacagataaggaaaagcagacaggaaacatacagggaggtacctataaaattcatgtagttactatttctttctttgacttaggatttcaccattattgattgtggtattaaggtcaaggctctcgcctcatggagctaacaatgtttgagggacaaattatgaccacttgcaagtaagacaagccactatattccactgcacatgaccctgtcttattatttcactttgcaagtaatttcatgatttgcaaagtgaagtaatcagatagggccgtgtccagtggaataagaccttgagtatctactcaaggtcttttagagctccaaggagggaaagatcagagaggcctgcagtttcaagaaagcttgcttttagattggaattccaaaagcatggtttggtgactaagaatttcaaagatgactataattacaaagacaattgagtaggcaaagaccctggaatcctgaattcctcttagaatgtcagtaattatgaacctggccttgttttgtttccactcttttaacttttcaagagaaggtgtttctcaagaaaaagctatctcaagcatctgccttctgaactaccctggcttttacctgtgctatttgaattgagagtgctgtgtgtgatttgcagttggatgcttcagctccaaaacttcttgggagagtcagatcttcttgcttccagaagatagcaatgttgtctttctttgcaagccccacttactaaccggtgctaacttgagcttaattcagtacacagcaaatcccgtgctaggtactagagagatgccgcggcgctgataacctacacagtttgctagtctttaccatctgtaacaccaaatcaggctgacataggctcatgcctgtaatcctagcactttgggaggccgaggcaggcgatcatgacgtcaggaatttgagaccagcctgaccaacatggtgaagccccatctctactaaaaatacaaaaatagccgtgtgtggtggcacgagcctgtaatctcagctactcaggaggctgaggcaagagaatcctttgaatccgggaggcggagattgcagtgagccaagattgaggcactgcactccagcctgggcgatagagtgagacgccatctcgggggaaaaaaaaatagttagaagcaaagagttgacagtgaagttaattctgtgcaggaatgaagaaagtactcagagaggaggtgacatttcagaggatactaaagcaagagaagcatttccctaactagaggaggaaagggtatgcattataggcagagcgtgcaggagagcaggggtgtggagtgtgaaaggattgtaccagaaagggcaattgtaccagaaagggttgatggtggctgcatataaagttatcaaaacccaaaacaagtcagtgtaagaaagaacatgattcatataatgtatcaaaaagctacaaatatttccatttctgaatgcacacaaagaaccacctggaaaaaacatccatttattgtccactgtgcccaggtccatgctaggcactatagaagatacaagggaaggcccttgccctggaaatgtttattctctatctggaaaaaagattaactcacataaaataattaaaaataagatgccagcctctaaggaaaaatgttagattgtctgaaactcaagcagagagcattttggctgccctggaattccccatagtagtagaattactcttggggccaagagaggggttgcctgagactccttcacccagaaaaaaggtaattgctaaccctcacagagcacttcctatgtactgggcactgttctaggagcttatacggattaacaaattaagtcttcacaaccaccctatatgaaaaggaacagttatctctagttacatacggggaaactgaggcacagagtcacaggattgaaatccaggagatgtggttccacagtcgtgcagtctttttcattttagtattctcaaaatctagcgtagtacccggtgttggatgttaagatcttaaacaaacaaacaacttgttttccttaaaaattatattttcagggtaatacaattcaagtcacaataaagacctgaaagcctcaggtttgtaggtgaggaaaaatgcattttagctgtacagccctaacttttacttgacccaaggccagcaagaaaatgtttctttttatttatatatattttttctttggtgacaatttggtgtttctgaacgctaggggctcccggtttctctggtttgagagtaacttttccttttaggacttttttttttttttttgaagggggtgggggaaaatgtggccttaattatcctacgtcttaggcagcttaaggaaggggctgtgctttcggaatcccatccgagccaagtaaggaggtccctctctctctctccccccacgtcttctctttttaaaggacctcgtgaaataaaagtgcagaaaacaaacccaggcgatcacagcagcagccgccgcggcagcagcaccaacagcaggaggagcaggaggagccggaggaggaggaggaggaggaggcaaagttagagttggggctggcgctccggagttgctgggctcagcgcagctcccattcattaaggaaccagctgcggaggaaggtggccgagcgcccgcgctgcccactcgctcgctcgcgcactcagacgcgcgccacaacagcgcgccccaagctgcgcagctctgcaaaagtttctgctcgggatctggctctcttccccttggactttagaacgatttagggttgacagaggaaagcagaggcgcgcaggaggagcagaaaacaccaccttctgcagttggaggcaggcagccccggctgcactctagccgccgcgcccggagccggggccgacccgccactatccgcagcagcctcggccaggaggcgacccgggcgcctgggtgtgtggctgctgttgcgggacgtcttcgcggggcgggaggctcgcgccgcagccagcgccatgcaaaactacaagtacgacaaagcgatcgtcccggagagcaagaacggcggcagcccggcgctcaacaacaacccgaggaggagcggcagcaagcgggtgctgctcatctgcctcgacctcttctgcctcttcatgggtgagcccagccccgctgtccctcggcccctcggcccctcgtccctcggcgcgcgtcccagcccagtccggggccgcgcagcgccgcgccgcgccgcgccgtcagctccggggggcccccgcagccttcctggggagcctttgcgccgcccaggcccgaagcccccgccctccccgatcccaccgacttcttggcctgtacttgagtgggtctgggcgtrcttaagcgttcgtgggcaactgttaaaccagctcagtaaaagtcgtctccacgttggaagcccgggcggaatcccgcggaaggtgtgggttcgtccttttagcgtaggggaagttggttgagccgcgctctagagccagcgtatagctagctggtcgccctccatccgagtgaaatggatcgccccgagagtcgggctcctgcctggagccgagctgccttcccggcggctgtatgtaaacatccagcccttccgcctttgctgcccaggctcgccagactggctagccggccttttcacttgctcctctcctgtaggtgctttccccgggcttggtgctgggcacggcttcagcaatcacttgagtgcctactgtgtgccaggtggtaggcggcttcaggggcatcagttttagctcgcccactctctgactcggtgcagcaggggtgatgagccccatttccctgatgggcacattgaggcactgggaaagccagctgcgatcttgtttggggaccacaaatttaattgcgcccccagaaagttgaggcgatggtccacttctgttttccaaagtcgttggaagccacagctggaagagcggtgggagttaaaggaattggagtgggagggcgaggaggatttatgaactcggtaggggagggagaaagcgcttcacaagaatgaacaggacttccaaggttgaagtcagcctaggatttttttttttttaaagcgaatcatggtgtaatggaaaacgcacagtacttgtcatcagaacactgccactcttgccacttgctgggtgtgccacttaactgcctcatgggcctcagtttcctcagcagttgaatgagtgggttgaagtagatgctctccaaggccccttcccgcattaggaactcggatttggtccagaagctgttctgccaactctgctaactgaagaaacatctgtgttcccaattcagttcccttaaaatacagctcctgcacagacttaagtcccctttgaaatggatttgtccatgcagattttgcagaccagagacttcttaggctggagttatacctctctggtattcatgactctttctgtagcactgctcttactgtgcagtgtcctcttgatggtccatagtaaagaaagataggattcttagagtttaaaaataagaacggcccccttcaggtaagaagagacagctgaaggtataattgtgctctgtggaagggtggaggggtggaaaggaagaaaagtcactgtagttcaggtggcacatcccatttccacgtctctcaacattaattcaacattaagatgctatgtaaaggaattgtcactggggggcctaccttcctgaaggcagctggctcattatcatgcacagtgggacagattactacttaaagtcttgtaatcaagctgttgaatttttaaaagaccctctctggtcccaggggagtacaaggaagcactaaacacatggaagctgtttgctgtaaacttgcctggaactccctgtgtttactcagtgtgttttgttggtggcagggtaagctctttctagagtgcctgtgcaggataccctcctacctcctactttgtgattaagaaagcagagctagaacatgcttgacagcctttgtacaatttcctttccacccttgtgattttagaaggcagtcccaagagatggtgtcttatgaaagtgaaaaggaaagagatgtaaaggaatttgcaaaaagacacaaccatcagctgtagtttagccagggatgtaaaaacccaagctactctgttgtacattgaaggtgtaaaaaaggtgtgtgtgcatgcatgcatgtgtgtgcatatgcatgtttcagttcttcatttccccactatcccccgtccccccaaagctaatattctaacctgtttattatatttattcactgttggtcttatgtttgaacaaaatgattttgtttatctccaaaaagcaataaggcrtcaggaccatgtattctgttatagaggcacatagctacttgttttcaggggtgctttgccattaaaaccatggcaacattttcaaagtgacttattgatcaatgtttcccctgagcacaggccaattacaatatcactaattaaatgtctctcaaacacctttaacaggaaaaattctttgtaagagaaatatttaggtgagatatttatgcaggagaactctatttggcttccaaaagaaaaattaatagcacaacatgtgattttaatattccgcacaccacagtcctaaaaaaaattgtttccactttttgcctaagaccgtcagtataatttaatttttatatagtttattgatcatatggtctggattacagggcactaatatattaagaagagagacagttttctgtttattctctcacaggaatatataagaaacttcatctagtatctggaaaaaataaaagctgatgtgctatgtcagtgttatgtaagtggaaatatgcaagtagtttaacttgtttcacatacctttttagaacgttaaattcttggtgaaaaagcagaagtctactcttgtttgaaagccaagacaatctggtgtcaaataacaccagtgggagtttacctttcattggacagctatctttaccgattaattgcttttaaatacagttatgaatctttgcgtgatagttttcctgaaattgattttgttttccttttaattaagtaatatttatcacctcctggtttttgtacattgattgtggtgtatggggttacaggagagcracagacgattcccaggtaagaagggaggaacagttattgtctttctaagctctgttagtctcttttttatataaattcatatatgcatgctttaatgcaacccctatgaataaattatctccattttataaaccagaaaccatgtctcagaaaagggaaggatagactaacactgaagtcgatttgaattgatccccagttctcagtttagcatgagtggaatcctttccccacctgaagaatcttgaaattcaggttcttatcagaaaattctgaagctcggtttgcagaaagttctgcctctcccgatttcccagttacccatttgcaccaaagcagaaaaataaagttggtcccagtcttccagtcagtaatacggaatttgggtggtcagcaaccgtgctatttaatttggttgctccaccacgtttttggatgttttttgatttccaactaaatggttgagctaaaattctagaactggttctatatatgggatacatagagtcatcatttattattatttactttaaatagtgagagaggggcagcatggtatagtgcaaaaaagacacttagagtcagaagcttyaggttccacgttggccagtgccactatcgagttgcattgtgtggatgagtcggttttctgtgtgtctcagtttttttccacctgcaaaatgactgtgtgggattatgtctattattrccattaaacatgcggtgaccgatttctagtagaggcttgacgttagagacttgacatatgctgaatgtctaccctatgcatctactctgctgagctcttcattatatattagctctgtgaatcatcacaaactagagacagtcattatagtcttgtactgccactgcactgtacagctttggaaaaattcatttaaattttctgagtctcagtttctttaccattgcgaaaaagggaaggaactagaccatctttcagtgtccttctagctgtaacaattttataagtctaggctggtaaatattgtgatgtagtaacatacccactgcccctcttagaccatttgtcattaattgaattgttatatatgtatgaccaaagaattaatgttgaaaattagcttaagttggtgttaattctggaggggaggtaagcactgcttttattaaggttaaggcaatacgttgagaaactgactagatttttcctacgccggatgtgtcctttcacctgcttcctgaaatttacatattttcattaatcaaccggtaaattgcctagccaaccatccttcgtagattaaaataaagaaaagagcctcgttgggtgcagtggcttactcctgtaatcccagcactttgggaggcagaggcaggaggattacttgagctaaggagttcgagatcagcttgggcaatatagtgagaccytgtctctacaaaaaaatcaaaaattaaccgggcgtggtggtgcaagcctgtagctgtagcccagcttcttgggaggctgaggcaggaggataccttgagactaggagttggaggctgcagtgagccatgattgtgtcactgcactccagcctaggatcatttagtaggtaagccctgttgacttttctagtatggttaaaagcttttattcactgtccataatggttagggtttttttttttttttgagacagagtcttctctgtcacccaggctagagtgcaatggcgtgatcttggctcgctgcaacctctgcctcccggattcaagcgattctcctgcctcagcctcctgagtagctgggactacaggcacgtgccaccatgcttagctaattttttgtattttagtagagacagggtttcaccatgttagccaagatggtctcgatctcctgactttgtgatctgcccgcttcagcctcccaaagtgctgggattacaggtgtgagccaccgtgccaggccccttttctgcttttaacccttttgattacctgtcaattttagattcttcctttaccctttcttgtgcagttgtttgggctagaaagcccagttggtcacagcgtgatgctaatgagaccatagtcaagggcttcttccctgtgtaggcagttatatttatggagaaaccctgtcctgtgtgtcagttcaatccagtacacgttatgtgaggagtaatactttgttttggggttgcctattacaccagtatttcataaactcacctaacatggggcctatctggtatgaaatacagattctcggactcttctccaggatattcagattcagctggctttgagccaggacctgggattctgtgttttataaacgctgccggtgattcttatcaggccaattttagaatcactatgttgtttaacagctgatatcttaagggcaatttaattatgtagtgggctttttgtccctgcactgaatgttctggcattttctgcattgttaggttgtctgtactttttttgtttgtttgtttgtgaccagtgcacctgtctttttcagtaaagataatcaagtttgcaagaattcttccgaatggaaaattacccctggatgcagacctgaaggtgtcctgtgtctttcagtgcaaagacttggtgttgtttctaatgccaagaggctaaaatctttatgtattttctggttgtaaaccgaactctatgtaattgaagttgccagccatgtgactctttggataaatgaggtgttaattttaaatattttcttttgagatattgaagtttgtgcatgagtgcaaggtgaagcaggaataaattagattcctaaatagagcctttagaagataaaataagcttggcaaagtagtgtagaaacaatacaagctttggatttccccaaatctgtgtttgaatcctgacataaagcaaacagccaccttttgccagcatgtaattttgggcaaaaattatttaacctcctccaggcttcagtttcctcatctgtaaaataagcaaacctggtaatacttgtttgttgtgaaacccaggtgagataatgaaactgaaagcattttgaaaagttcaaaatcacgttatcattatcaggtaggaatgaagttgctgttgttcttcatagagtcgaattttcattttcctcccagttttcttactcctcaatggttctataaaatcctcttatttcttggcagcaaagttgcctgaactatattaaggaaaaagattctgagaagaatcccaagaaaacaccaagcagagtggacacaaatgttttccattagctgaagaaaagcagtggcaggtttcctgaccctttctgggaaagtcaaagtgcaggaacctcaataggctttggtggttgcattcttcccctttgaaagggacaargccatattatcttgagagaaagacagatatgccttaggaagggtgggagagaatttagacacgtggtctgttttagggtcaactctcacttgggtcattcctgtcattsaacagcccagaggaaaaccaaactaaaagaacagcaaggccaggcgtggtggctcacgcctgtaatcctagcactttgggaggctgaggcaggtggatcacctgaggtcagaatttcgagactagcctggtcaacatggtgaaaccccgtctctactaaaaatacaaaaattagccgggcatcgtggtgtgtgcctgtaatcccagctactccggaggctgaggcaggagaattgctggaacccagttggcagaggctgcagtgagccaagatcacgccactgcactccaggctgggtgatagagcgagactctgtctcaaaaaaaaaaaaaaaaaaaaaaaaccagaaatgattggaaatgatcgaaacgctggtcatctaggggaccctctgtatttgctgaggaaggaaggtactgagctaggctaccatatttattatacaggccaatcatgtggtatagagacgatcccttttatagaagagggaactgtagctcagagatgttaagtaacttgcacaagggcacccagctagaaagcagtcaccaacttttccagagctcttgtcaggttaccttgctgccccacttttcaatttgcaattaattgattgcaattaatgcaatcaaagcagtctttttcatttctttccattttgtttattttggtcttaaggatattattgggcagtggagtagacagagtaatatgtaaataattgcaaaacagcttaaagcttgatgaataagcttctctgtagacataataaagagaataccattggagcaattcctcattgcctagattcatggaatctttagaatttggaagtaccttggagatttcattatcaacgataccaaggtcattttttaatgtcagttagaaaaataggcctttttgagctggggaagggagagaggtgtgaggggaatagcacgggctttggagtcagactggagtctgctcactattattggccatagaagcttaagcaagtttacttgatctctgtgatgcctcataaatcctcatttacgaaatgagattctgtgtgcactgtgacgtggtggggacatgcctagtacagtgcctggtgcatagagacactcaagaggtagttgctgcagtcattatcatcaccacatcctagtcaatgcccttggttcacaaatgggaactagaggtcttggttggttagtaattgtccagtgacagtgaaagaggaggacctagaaccaaggtcttgcctttctaccattctgcttttcggatgtggacttgttggtttgaaatttgatattattcatgaggagagttccctggagagctttctctcttgcgtgcgtcagtagaaaaaggaacaagacaaacaggtttaacttttaatccatatcagtggatgttagctgagtgaagccaaagatacatgggacaaatgtgaaggactaggcagtgttttgaaatattacttttcttcaaactggtattttttcaggaaagtacttattaccaagatcactgctgaatgatttgagctggaacaggtgccacctttttcaaatgatgtatctcaggggagaaaaaagagactccatgttttcaaagtttttgctttttattatttatttatttatttttgctttttaaaagcctctcarcaaactctccttattcccatgtgactgaggatgaaacaktctcagattaaacagacttctcaaggtcacgcattgtcagtgccaacattcaaaagaaggctaggtcaggttcttgaacatccttgtgaaattattcttcccttaagtctgggttaaattataaattatgatctgcatttaaattcccaaatttaaaacaaaccaaacaaaacaacgcacttcagactcttttggaaacctttgaaaggaacttgatttctgtgtgmtttgaaagtatatattgcaatcaaggtattggtggtaagtgtgtttttgaggtttgtcacaaattaacaaaattatatgcctraagagttttgcagagaaatgcaaatcattrtaagcgccttgtcataataagtagtgtgctttggttcctgtttatgtatccctaaaacacataatacactattacattgacacgaaggaaaccattctcattgatggtttctttatatctggcccccaaattagtttgtggtatcaatcagtataatttctagagagcctattaagcctatgtttgtacctgtctttcaggtataagccttgtcttctgcagatgattcttgagcacctactatatgccaggccccagggtttccatggccttaaggaattcccaggctggtgaaagtggaacaggcttttgcctaatgacaaacactatataagtgatgactttggagccttaagggagggcctactctagcagcacagtgaagagtgatgaagcttgcctgagggtgtggagctgggtcttgcaagataaataatagctcacaagccaggaagggggagaaggtattgcagcagagtgaagcacaggtgctgagacttggaagcagggacctatttgggaagagtgagtagctggaggctggaatgtcaatattgtgtgtttgcactgtgcgggggaagaaaggaggacattggagatgaggctggagagataggttagagctagattatgaaaggggactgggtatggcaggcagctaaggaatttgagttttattttggtgaacgaggagagcaaatgaagttttctttttgtttttctttttatttttatcttggaagatttcatagagaaacctactacctaggagtgaaattgctgggtcctatggtaactccacatttacctttttgaggaactgccaaactgtttttcatagtggctgcaccattttagaaatatctaaaggcggctgggtgcagtggctcacacctgtaatcccagcactttgggaggatgaggcaggcagatcacgaggtcaggagtttgagaccagcctggccaacatagtgaaaccccgtctctaacaaaaatacaaaaaattagccaggtgtggtggcaggcgcctgtaatcccagctaatcaggaggctgaggcaggagaatcacttgaacctgggaggcagaggttgcagtgagctgagagagccattgcactccagcccgggtgacagtgtgagactacatctcaaaaaaacaaaaacaaaaaactaaaggctagttacagtatgtaagaaaaatacaatagttttataaaagacctttggaatgaacatattcatgaaaagattggaggagggaattaatttaatcttatttgggtttgggagagatgactggatttgagggtaggcaaatgggaggcagaggagctaaagaccagtggggtggcaagtgcaagctgaaccgagggtactgtggtgggagcagagagggctggataagaaagacatgacagggccgggcgcggtggctcacgcctgtaatcccagcacttggggaggccgagtggggtggatcacaaggtcaggagttcaagaccagcctggccaagatggtgaaaccccatctctactaaaaatacaaaaaaattagccaggcatggtggtgggcacctgtagtcccagccactcgggaggctgaggcagagaattgcttgaacccgggaggcggaggttgcagtaagccgagatcacgccactgcactccagcctgggcgacagagcgagactcgtctcaaaaagaaaagaaaaagaaagatatgacaggtacttcctgaactccaggttgggagcctctgaactatggtgaggccactccttccagaaacactttaaatgcaggatttataggagatttatgaaatctattagtaaatgcttttttatgtgcatagccttattatgaagacgaggctgtgagttatattcttttgttctggactttttaagtttctcaaatgccccttaaaataagtgggctataaatcctcttggcttagagaaagggtttttcctgggttgcaatggtattttattcaaagagctttattgagatattcacatactatgcaattcatttctttaaagcacacgattcattggtttttagtatcttttctttttttttggtttttagtatcttcacggttaggtaaactatcaccacaaccaattttagaacatttcatcactgcaaaaagaaacgatacccactaccagtcactccccatttttcctccaccttcccacatctcatggcaaccacgaatccaatttctttctccatagatttgcctgttctgaatatttcatgtaagtataatcatataatatgtggtctttcgtgactggcttcttccacttggcgtacggtttttaaggttcattcatattgcagcatgtatccttcatttctttttattgtcaaataatattccattatgtagacataacacatttcatttttaccttcaccacttgatgaacatttgggtgatttccactttttggccattatgaatagtgctgctatgaatatccatataaatgctttcagttctcttgggtctgtatacctaggagtggaattcctggatcatatagtaactccatgtttacctttttgaggaactgccaaactgttttccgttgaggctgcatcattttagaaataccttaagattgggctgggtgctgtggctcacgcctgtaatcccagcactttgggaggccgaggcgggtggatcacgaggtcaggagattgagaccatcctggctaacacagtgaaaccccgtctctactaaaaatacaaaaaattagccaggtgtggtggcgggtacctgtagtcccagctacgtgggaggctgaggcaggagaatggcatgaacccgggaggcagagcttgcagtgagccgagatcgcgccactgcactccagcctggrtgacagagcgagactccatctcaaaaaaaaaaaaaaaaaaaaaagaaataccttaagattaatgcagacatgtaagggaaacaatgccagaattttcctgaagatttggaattaacatattcataaaaccactaaagcgtcactttgtttttagagggatttttcacaaagaaacacgttttgaatcagtttagtggtgccactgggtttaagatgagtgagcagagaacaataagctgactgggaaatcgatgctgggtggtcagctagacccgctcacccactgagtagcacttccacaaagcaggctgtgactgtgacgtacagactcttgtctcagcagaacaaagaatggatcttcagagtactttgaaaacagttaaacatgcaaatagtaaaacctatatatccctgggatctgctttacaatattttaaaggcatgaaatagaaacccatctattttcagttcctgatgaggctgatttttcacccttttccccacctctggatatatggctgtgtatgtgtagttgtcatcttaggaactaaaattaccatgtatcttttagactcatgtgctggatgccaagaaatattaaagaatataagacacaaatacaaatcctgaataatgagttgakctataaatgcactaaaaaatcaagttgtaagtatgtgaaaattaaacctcaaatattacaaaagggtgaggaaaagggatccccatttattgttaggtgcttcacatgatatctcacttaacctttttaataacagaataagggaaatgtttcaaacctggttttgcagctcagagagggtaaatgatttgcccaagttcttacagctgatatgtatcggggctggaatttggactcaagcttgactaaataatgacgattgctgacatttattgagtgctagctaggtacctctcaccaggttaagcagcgtgtatacattctcttatttaatcctcccaatgagcctataaagtacttgttactattgtctccattttacagaacggaggtaagagaggttaaaaataacttaccaaaggtggtgcagtgagtgagtttgagaggtggggtcagacgtctgcctggtgaggtcattcttaactactaggccctactgcctatattctccacgtgtttctgaatcccatgcttttctccactactccatgctggctttcgcattggcaacccctgaagcgtcgtccaaaatgagttggactagtggttctctggacctgtgaaggtctgttaggtcaatcatggggcatcctctgctattttcagtacttcagaaatatctaggcatactgaactttcaccagtgattaacttgtcaagcctaactcacagcatcagcctctgcctagactagtcaaagtatcagcatgctgtgtttgtgatgtgaatgactgctgtcagttcactctggtcttgtttatttctgctaatgatgagatgagacactttttgtgcttggattagcaaaaataaacgatgtgaaatatagtttacttggtaagtacagatgtcttctagatgtgtcatagaggggcaagaattaactatgagggatttttgttgctgaaaaggctggacaccctagaatggaccatcagctctaaattttgaggtaaggaagaccactgggtcctggatcctatagaaggctttctaaagaaaggaggggctttaggccaggcgcagtggctcacacctgtaatcccagcactttgggaggctgaggcgggcagatcacctgaggtcaggagttcgagaccaacctggccaacatggtgaaaccctgtctctaataaaaatacaaaaattagccgggtgcggttgcgggtgcctgtaatcccagctactcgggaggctgaggcaggagaatcgcttgagcctgggaggcagaggttgcagtgagccgagactgtgccactgcactccagtctgggcaacagagggagactctgtatcatttaaaaaaaaaaaagaagggactttaggccttttatcattcacatcaggcagtggtaatgggtcactctgtttgtgaccctttttgtaccttaggctcgagctactgtccttgtggtttggtgtaacctttaagtcacattgaaagattttgagcttctctggttagtggctgcggatgcagctccttcattaaatgcagtacatggaacttctaccagtagcctcttccccacaaatgacccacattgttgtwaagttagcaaccactgacaggaagtggcagaatgcgtctcagccacacagcagatttcattagacactctcccaaagtagctgtttgggtcaatttggcctcagtaggtttatagagaagaatggcttaatccattatttctcattgttacatttgtcttgctgtcatcttagccttaatggatgttttcattagaagcacagtgtcttccttggaagcaagtgcacacacatatgatcagagagaggaacttccagcaagctgagattttaaaaatatttccaaagttgttaccaacttactggagaatcttttgtttattgggtttgtcatttaaatctgtctggagagtagcagctccagtgacaccgcaggagggattttgggctgcactcacctttgtgactgattgctttgaaaggtcagctctatagatgttatatgaaagcagaattcctagggactggctgggaaattaaaatatacttcttgagtcaaagcattcaaaatacagggctttcaattcgaggggaataataagctgtcttgattttaggtttaattttcctaaggctattaatggagttgagggacctttacttatgattttgccataaatttgttgttgcagytgtgcttgccctagctgtgaaatccaaggatttattattaattaataatcccttttactgaacaattctaccaaatgataacgtttgcatctgagagtttgaatttatatattctttcttgcctcaattaatttttctcattgtagatctccagttacctagcccctcaaagcaaacaaaacatcagtaccaccacatgcaaaatatcattgttcacatgtcagttggaacaaagctgggaaactaacctttttgagcattgacagtatagtcagacacatccacgaatctcatcaaatcatacaagcctgaaggggaggtattcctctaactggttttatagatgagacagtcrttgtgcagagagattgaggggcttgctcaggatcttgggactagaaaatggtggagcttgtaggctatgacccaaccaacacctatgctctttcctccaagaattaagattgcaatttgaattttcactattagtttcaataatgagcatatgaagaaagcaagcaagtcagaaaatttaaaaatgaaattatcacaccttgtaaagtgttcagatttgacttgaagtttaaagtcttttgtccatttcagtatttcctgtttctttgtaaatccgtagaggatagacgtgaactccaaacctttacactggaagagagaggcatgaactttactgaatacttaatatgtggcaggcagtgagctaggggcttttcatacgttattaactcacttggatttcacaacaacactatgaaggtggaggttgaagttcattctgtttttctcagaacttggtcagcaatgtctatagcaatcctcattgatgggttggtgacacactgttaataattcagctaatcagtagcagaggtcatttactaacatttcagggaaaatgctctgctagaatctgctttgagctggtcacttgggccatctatccacttttactgaaaatatatcagagagaatctcagttccagttctgtagagccttagaagaaaaggtcaggagccatggtaggagaatacttggccaattttctacagaaatggaatatcttttctgcagagagacagcaatatcagattgtattgttaattcttcttatcagtcttctccaaaggtgttaaaaagccagggaaatgaaacattttgagtgaaggagcctgcactttggaaaacgctccgtgtatttcccaggctattgtagggcccctattcagttgggatttgaatggtggtgtgattagcatgaaagcaagtgtataaagtaggtcttttctccctttcctaaaagaagttttgtggcatttctttttctgacagagttggcatgaagctttgacaaacacagacccatggaaaagttaaataggacttagagtaggtccattttgtacagatcctacacacttagaatgcagagcaggaaagcagctggcaagaggcccctcaaaccataggaatcatagcaagggctcttcctccactgtggaccaaggatgaataggaaacacccacaagaccaatgggaaagtatatcctgggctgttgatcattttctgtattaccagaaaatgacagataagcacatgcctgtgagtccactgcctatctctcccagtatttgtggagataaatacaaagtgctgagggaaagtctaagaaatataagaggtggaacctgccctaaggaagaaggtgacaagatgagaagatggacacacagatggaaaaaacatggccaggtgtcctgagctgataattaaatgaaattttaaaaatatwgagtctaagagatagcttgatgctgttcttgcctccagtctcagctttgctgtattagctgagtgaccttgggcaaatgttttctattttgtgaatgataaaatggggatgatgatttgttccctgcctacctcacagagcttttgagaccaaatggtatagtatcccacaggtatagaaaaatattttgcaactgcaagctcttgtttgtacaatgaatattttttttgttgtgtctgaatttgctctcttttctccattcttcctttttcgactgcattttaggcacatgctatcatttacccagatctgaaaaaatgtctttacagattttatttctaggttgatagtctctcctcccccgtgtattctttatgcagtgagtctacagggtcatttgttactactacaatcccgatcacataggcctgtctcttcagaacaggactttctgaccccttgttgactacagaatccatttctcagcatatttgagactcttcagaatctaaccctaaccaaacctttcaatttcttgcttctcatccccattaccccactctctcccaaccccttcacacccttctcccagacatctccactctggggcttttccaggtccttttctaccatgccattctttctctttgcttggtatgtgctatttacttccttttttttttttttttttttttttttttttgkgaaacggagtcttgctttgtcacttaggctggagtacaatggtacgatcttggctcactgcaacctccgcctcccaggttcaagtgattctcctgcctcagccttctgagtagctgggattacaggcgtgtgctaccatgcccggctaatttttttatttttagtaagggcagggtttcaccatgttgcccaggctggtcttgaactcctgacctcaggtgattcacccgccttggcctcccagagtgctgggattacaggcgtgagccaccgtgctcagccaaaaaagaagctacttacctcttgatagtcacttcaaatcctgcctgcctcctctctgaaatctcttctaaatagattttgaactccttgtacataataggtgctgaaaaattttcattgaaaaaaagtatataaagatattttataaaatataaacaagaagtaaaaagaaaaagaaaaattttgttgcctataataccacaatcctgaggtagccactggtacagtttatcttttctataaatagctgaattattattaagtataattataaagctaaacactgggtgcttaaggcctgcttcctgtaagtcagtgtgatgaaatggaaaaaccctttacttgctagagtttgcagcggtcaataataaagtattaactaacctgagagaattgagaatatgtaactaacctaagaacagctaggtattttacattcagttttgcattcatgtagtattttgaacttgtttaacaaacaaaatttgtgctaaccatgatagcttctattaaaaaaaaaaaattctaacctaccctaaaagctagggctgtatttagaaggcattacttttttcatcctcctctcttgccttaaagagggctctgggccgggtgcagtggctcacgcctgtaatcccagcactttgggaggctgaggcgggcggatcacaaggtcaggagatcaagaccatcctggctaacatggtgaaaccccatctctactaaaaatacaaaaaaaaaaaaaaaattacccgggcatggtggcaggcgcctgtaatcccagctactcgggaggctgaggcaggagaatggtgtgaaccctggaggcggagcttgcagtgggccgagatcaggccactgcactccagcctgggcgacagaggaggactctgtctcaaaaaaaaaaaaaaaaaaaaaaaggactctgaatggggagaggaaaaccccctgaagggaaaacataggcaaggtgggagacaagaaatctgagtttacatcttaactttgttactaactgctatggtctgaatgtctgtgttctgccaaaattcatatcctgaaacctaatcaccaaggtgatggaaggtgggggggctttaagaggtaattaggtcatgagggcagagtgctcgtgaatgggattagtgcccttataaaacaggactgagggagctttttagcccctctgcccttccatcatatgagaacacagctagaaggggccatctttgaaatagaaagcaagtcctcaccagaccctgaatctagtggcacatactttcagtgatgctgagtttattccatggaggcagttctaattgttcaaaaggttatgttgatataaaatcaaccttcccataattttaacccagcatcagctatgtttggtacagttttggtaattagtagcattaataatagtatctatcaattttataattgaaagcacctgaacaattttataattaaaagcacctgaataaatgatggtgatgagtcatttccacaaatatgcattgagcacctttaatgcaccaggttctgtgctgggtgtcgaggtctaatgatgaatggggagaggtttcagtccttgaatcttctggagtagatgttgggcaggtgcagttctagaaatacaatgtatactctgtatagaggtarccgagttgaagggattattaacactatgtttgaggggctctgggggaaggcttctgaaagtggtaacatcacggttgtttggacaggcaaattagcagaatgcttttaggcaccattgtcaaggaagggactgcactgaagaattccctttagcagaatggtttctttgcctcagctctgcccagtaccagtgaccatcctttagaataatcttagaatacaggagatgaaggggacaagcatcaaaagttcttccttcctcatccccattttccagatgggaaaaccaggctcagagatattaactgtcttggaaaatgagtaaaatatagagaaaacaaaactcttaccttgtgcaggttcaagttcaaatccagtaaataccatagtttaaagcatccctttacacaatggatttggttattttgcaaaacagatattagccccatgtgtcagtaatctacagtcatttgtaccttaacataaaatgccaaagcacagtaatatattcttagtgtaaaaaaaaaaaaaaaaaattcaaggctgggggtggtggctcacacctgtaatcccagcattttgggaggccgaggtgggaggatcacttgagctcaggagttcaagaccagcctgggcaacatagtgagacctagtctcttaaaaaaaaattaaccatatgattatgtttaaaaggaatagccccttgcttactgttcctctaaattccactccccagaggcatctattgttcacagtttttggttctgctatccttattttgaatgcacaggtattctcattgataactacctttatccatattagtctccttgcttcctggaagcaacacacagaaatctgtattccagcctttrtttatgctctttcctctgctaacgcacccgctccttcttctctgcctatacgaagagtttccattctttaagctggtttctgctcaccctaccccctcactactccaacctgaggtaatttcacctcctaatctcaagccattccagctctggcactagttagtgaccttaaacaagtcacttgaactctgttggtttaaattttcttccctaaataatgaggcagttgaattaaatggtctttcagaactgcagaggtcatcaagtataaaagactctaggacagtgcctgatagttggaggtcttgactgtgttgaattaaccctgtyacaaggtacaaataggaggaaagatgaagagwttcaccaccacgagttaccacaattttaacccagaatcaaagttttgaagtttaggagacattggaacacagtggaaasaggatatgtcttagggccagacagttctgggttccgatcctggccccatcacttggtagcttataacctggatcaagtgttgtagtaaacttsagtttcctcacctgtaaaatggagacaatgatttctactttacaggtgtccggagagaaaaaaatacctcacagacagtgggctctttgacatgaatataccctgacccttaagtgtttagaaactgttatctgtcataaataattggcaagctttggaacaaataaatgcataagagagtgctacctgggtttataaaatgtgtaagtacaaagtatggattagacatagtttatctgatctttgaaaagttaccttggagtcctgccagagaatcatatggcagctgcacagatggagctacctttccatttgtgcttactaaagcatgtgttttccagttggaaaggaagatgctggaaatttgtctttaatgcattccagtgttgggagatgaaacctacctgagagattgagcagagcgtattaaccaatatcatttcaagttgattaaaactatcatcttaattaaataccagagaacaagaagttctcagtcttctggtagcaatgaaagaccaaagagtcaatctgaagttgtttttgcaactcttaaaataatactccctctcctccctcccgtgaaaagagtttcttagctatagacatgccctcacattgaggtttctgaaagctgttaaggaccacaaacctgctggcaaagccttctgctgccaaggcatcagagttctcaaaagcaagggggttcaagctcaggatacgctgatttggaaagagagcccaaacaaagggccttttgaggcaagaaactgggctttggctgcagcgcagagcaatatggggttggaaaagcgccccggggacttgcagagaagaaggactatgagatcgatggaggaagtataaggtttctccatacagtgagggtttagatttcaaaaccctcgaaagttggtttcagaagctatctttcctctgtcagcttcaccagcatgtctataaaatgtggacttgacaatgttatatgtctttgagcagaaaagggaaatgatccatggaggtacatacatataaccattctagtaaagatgtctgacctgaaagccagtggttttcttacaagacccaaagcaactgcattcattagtgcattcattcacccacttaattatacgtgtatcaactgcctactgtatgccaggttgctatagctatgaagttaaaagatacgattctatcaattctgattcagctcaaagaactcaaaatctagttcatcaaaactggaggattgaagtaaaggagacaatctttctttctcttcctttcctttccttttttttttgagaaggagtctcgctttgtcaccaggctggagtgcagtggtgcgtctttggctcactgcaacctctgcctcccaggttcaagcgattctcctgcctcaacctcccgagtagctggggttacaggtgcctaccaccatgcccagctaatttttgtatttttagtagagatggggtttcaccatgttggccaggattgtcttgatctcttgacctcatgatccacccgcctcggcctcccaaagtgttgggattacaggcatgagccaccgcgcccagcctctttctctctctctcattttttctttctttctttctttctttctttctttctttctttctttctttctttctttctttctttctttctttctctctctctctctttctttctctttctttcttttctttctttccttctttctttctttctttctttctttctttctttctttctttctttctttctttctttctttctttctttctctctgtctctctctctctctctctctttctttctccctccactcccctcccctctttttctttcttctctcactatgttggccagtctggcctcaaactcttgacctcaagcaatctatccacctcagcctcccaaagtgctgggattacaagtgtgagctactgcacctgcctgcccagggacagtccttcttgataaatacttcacactacattcacctatactgtccctccctgaaccacccagaccagtttttaaatttggcctttcctgaagtgaaacttttttttttcttttgaggcagggtcycaaaaacccaagtcatttttgacactagcataaaaatgttgctttttttctaaaggtaaattaatttatcattattgatgctttaaactataccacctaagatttggaaaagacagggaacatcactcataatctaccataaatactattgccattttggcatatttctttttactcatgttgattttctttcagttattaggtatatatacatatgatcttctatgttctaatagtcttcataattaaaattattttatcattacttgatcaatgaccctttaacatcattcataattaagtattcctgtatctttgtgtaatctcacctctctatatatctctgtgaccaaattcccccattttatagggacaccagtcatatggggttacagcccgccctaatgccctcactttaacctctatgaagaccctatctccaaataacttcatactctaaggtgctgggggtgaccacttcaacatgaatttggtgggagagggcacaatttacctttaaacctcttctctctacccctcaaattatgtgtgaggaaattgaggcccaagccaagtagtttgatttgcatttaggcctgactctaaaatgatacattttcatcacatcctgtttcctactcatgaatagaaaatactgtgaaccagggggaaaaaaaatgtcttcctcgatctgaatttgattagtgtgagactgtttgatggttattaactgctaaatttaactaagtttggccagttgaagccagcatcatcatgttatttaaaaagcaggttaagcacacacactagacttacctaaaactttttattgaatttaaaatatgtggctcacacctgtaatccccagcgatgtgggaggctgaagcaggaggattgcttgagcttaggagttcaagatcagccttggcaacatagcaagaccttgtttctacaaaaaattaagaaattagccaagcatgatggcccttgttaagcatgtttcacaaattgttccattcagggacacagtgacctagaggctaactggcatgccaataattccctggtaattggaccacattccatagtaaaagtaggcagtgttggatacttatcatcgatttttctcttgtttcttcatcttgagtttttgggtgtttttgtttgtttgtttgttttttgttttttttttkttttttttttttttttagtgtttggccttccttctcctgcataagtgattatggcaaattgcacacacacaccccaacaggcactagggaaggccagaaccagtataacaataacgagataatgtaaccagccagcccatggtccttacggtgtccatgtgcaggggacagataaaagtccccggggaagtcaccaagcaggagggattggatggggccggttcagctgcttccatgatggaggagtggaaatggcaacagcattggtttcagccctaactgagattgaagcctgtgagtggtgttcctcggagttgtgcagggcatggccacctctgtccctttccactaagtatcatttggcaaattacaactccttttcttaatttcctcacatgaatacaaaataacatttgaactgtgatcaccacatataccccattgctcctaagtctgtgctctgttcatcataggtgcttcataaatatttattgggaaaaaaaaatgaatgaagggagagtgaaaaatactgtgaaacagagatagggattgactatgagtgtgaagtgaacttgggaagttccaagacacattttatttaaaccagtgtggagtgctaagaaaatccccagttattttcctttagctggaaataatggaacattgaaaagacattggtatctttaaaactctacataggctgtttcccttgcctgctttaaagggagggaaatactctcacacagagacaaagagctaccctagtcatctttctttattctaatgtattttgagagaagaccatgaataataacaatactttccatggattgagtatactttatatatgacactgtatttcttttttttttttttttgagatggagtcttgctctgtcgcccaggctggagtgcagaggcgtgatctctgctcactgcaagctccgcctcccgggttcacgccattctcctgcctcagcctcccgagtagctgggattacaggtgcccgccaacacgcccggctcattttttgtatttttagtagagtcagggtttcaccgtgttagccaggatggtctctatctcctaacctcataatccacccgcctcggcctcccaaagcactgggattacaggcgtcagccaccgcgcccggccatggcactgtatttctaaacttcacagtaacccgtcaagattgattctagcctgttttacagatgccctagagaggttagcagcctgcttaatgtcacaggactaaaaaaaaaggtagatctaagctttaagctttaaacacaaatctatttgaccccaaacctgtgctttttctgctatccatattctcaatcacccactcgagtctcattaaaaaaaaagccaaagtgggggggaaaagccaaaggcttgatgactttcataatacgtggtcagtatgtgaaataaataatggatctctttatgggccaagacaacacttgtctctttccttcttacagaaggcacatcattccatattcataagagtaacatttactgagcattttctgtgtgccaggcattgtatgaaccttcttcgcacactcggttttattcctcccacatcactgtgagaggttagttggcttgttttaggttaaaattaggacccaagtgtatctgactccaaaatccacatacacaactgtatacatgctactgtttgccattgtatgtcagttgccagtggatagattgcccttctcttgctatttagttcgaatttagtcttaggtatggtcctgaatatatgtgttaagataacctgagggagtctatgtagggaaactccagcaatgagtttcagagaggtgtttgaaggaaagaagcaaccagccccagatgctcttggagagcaggcagtgtttatttgagctgtgctgtccaggacctggtgtggtgtcatggctgtaagaggccttaatgcacctcattcagggtggatgggatgtgtctccaagtgcagaaggcttttccttgggaaggtggttggtcacacctgggttagcaggagccagctaactaaagctcccataccccagtttatcttccacatgtctggctggcagggtgtactttctaaaacacagccttgccgtgccactcccttccccagacatagtcatattttgagtccctgctgggatatccaggactgtggagaggataaatattaaacattggccctgcagctaggaaatcagtcttgtttgaaagccacacacatgaatcatatttttaggactgattagaggttatttaggccagcatttctcagagaatgctctgaggaaaccaagttcttctgggttgcacatctcccaggtaaaacttaacaataaactctgatgaaggccctaggatgaaatgtccatgttgaatttgctttgggacatgaccagctagtctagcctcttctctctaatacaggctcagcgaagaaaagggactttcttcattcgcagaagaatccaaccttgaactcctgagacccccagcccaggactttttctgctgcacagagggcctctgcattttactcccctctttcagtttttgtctttaggcagtcctgaggcacatattttctcctgtatcttgaagccatatgtttctcaggcttttctcctcttctaagataggctgctaatgtttagcatctgaaatcatcctgtttctttcttaaagttgtcctgggaaagatactggaaagctaagttcccaactaggctgatgagaaagggagaggagaactgcaggtttgagtcctcacagggtccctgtaggggaaagatcaatttttctatgagaaccaggagctctctgagggcagaaaccctgttttactcatctcagtatttctcactcctggcacacaataaggttgtcagtaaatattgtatattcagtgtggtttaaaattgtgttgacttggtatatgcatatgtaaattgcatgctatgtaaattatatatcaatttttttaagcccttttatttaaaaatgaaatttttaagttttagagtagtgattctcaaatcaccttgggataaaatcacttggaagtcttattaaaaatcagaattctcatgcccttcccctgaaattcgggtcacgtagatctgggcagggcccggaatcagtctatctatctatctctccttctttcttttttttttttttttttataagtgcctctgatggtgaatggctaaatctgaaaatcactgtccagaggataatccccaattttacatttaggaggcagacatgaaaatatgccttagccttcaggtctggaaccttaaaacaaacaaacaaaaaccagtgtgcataggaatatrgaaagaacatatccggaacagtcagccagtaataccttgtgtcagatgcaaggggctatggagagaaatgatttgcaagcctaattagacctgctccccagttctcaaacctgcagctctaagccttctgctaattggcagtcccttaatagattaggacttggcatcaggtttgcatgttattataaaccacacacagaaaaacccagtggctgaggaactcctgccaaaccccagcctaggttttgtgaggcttttgaagtgcactggtcttttcagtattttgtatagtcagtgcactgaaaggcatcaaaccatttctttggatgggatttgcgaagggcaagtttgttgaataattaattcgccaagacccattctatcatcttgatggacaagtaggagctcacgtatgccgtttgctctcagaagtacctggggtatgataggagagattgtttctcatggatcctgtcccattcccaggcatcttctccttccccttcatgctttgagtggggaggggaggaggaaacgtgtgtgtgcacctgttcgaggcaggctgcttaccacgccatctcttctgccatcctcatgtcagcccttctagactgcaggacctgtcttgaagatgagcaaatgaaggtcctgagaattcactaatcaagtatcacactgccaggacttggcagaggtggaaggggagggacttgtatctaggtctgctaattgcacaccaccaaaccgaaccgaaccgaaccgaaccgaaccgaaccaaaccaaaccccaaacccagaaagccatttttgatttctctggtgttcgcttgattaacatgggctgtgaaatggttttctgcagttcacattgtgcgcarggatacctgtgtacatctgtggataatatgtatatactgtaagtgcttccctccccctcacattatattatagagtttccattctgaggtgaggctacccacgacagagtacaacattgtgcagtaggacagggagggagggtggagagtggggctttgccagagttcgcaaaggcctatgggttcccaaagccacactcaagtattcctcaggcctttgaacaattcygggggccttgctctcccctcttgtccttccaattagattccagttggggattcttccacttcttttcaaggccacttccacaaagggggagctgtcgtggaagctgatatttccatgaaaaccttccatttctcaggcaaacataccaggcagctstcatggcaataccatggtgaaggggaataatgttatttggcatttcgccctttaaaaaagtgtatgtgtgggggtgggtgggaggaggaggatgggcagagagaacagtgggggctttgtaatttactgcaatagaggggtcaggtgggctgggttacaaggggaggaggggcatagagaaggcctgaaccccccttgggcttcgcaaccctcttcctcccctctgcctgattcacacgttttgagaggttgtaaaggggaagctggggagtttttatgttttgatttggaagagggactctagacattctgtccctctgagagaagctggctccttgctgctttgcaaggattaagggcctggcttccagaaccattgaagaaacatcccaggatctacccttttctctcaacagctgaaaaatgcattacccagcagtggcttcctggagagttctggcaaaagagcctccctctggaacaatagggttcctataacaaaccacctaggagttgtttactgtagccagttctcccagtgtatccgaatgccttacattttgttattcccattctggtgggggaaggggcagcgctgcaggagcaactgaggatggtcccagagtacctggatttctgactacaggaagcagctgcccagtttgtgagtggctcccctccttagctccagttaaaagtacctaaagatagaatatctggtggcttcacagttccatggaaagtcagccrgacccagcgtccctttctggcctacttctctgtggccttatcactattcttcatttctagtctttgtaaaatcaggctcatactccttacccggaaaggattattggtcagaataagggaggtgcagcaataaagtgaccaggaaagtgtctagcggtagctaatgttaattcccacctccctccaacccaccgcccatttttgctgatgcctactayttcagcagagccaagagctgccaaacattcgttcaatttttatctgaaggtctgcagattttggggtgttttctggagctgttctttataaatgagcatctttgaagtccagaggtctctactcagccagtctgccttcacaaacctaaaagaaagttgagtgctcctcagttaccccagctgggacaaaggtaggtagtgaagcccctctatcacgtaaagatgctatggaaatgaaaccttgcttacaaaatactctgcagtccttggataaagatgaaaactcttaaaataagaaaggtccacaagacacctgggaaaaccagccctttcattttgcacatgaagaaaatgaaccccagagagcagatgaggaagtgtgatcckgtgatcaaactggtagttggtggcagagctaagactgatggtaataataacataaagttattacttaactcccagacttgcttgtgcagtcttactgatatcagacatttcttcattgaaccaatgactartgttgacttactttccctgccaggatattgacagagctgatccaccttggaccacttgaggcttccattacccagtaggcaaaaagaacggccacacagaatagaacgcctccagtggatttcaatttatttcattttacaataatcctagtgatgactaaagtagaaaccttttttcccaagtaagaaaattcttctggatttaacaacattaacatctttcactgccagttcgcttcctttttagcaagcatcttttcagcatctattgttttaggaactagacgggctccctcaaagtacttttctaatttttttccttagcattaaaggttgggagataataagaactgaacaaagcagcagttttgttaacttcttgggaagaaaaccttttcagttctggatctttttttttttttggtatagccttaaattggctataccaattggcattcaaatgacatggcattcaaatgacagcaaggagtatttcaaattcatttactggattagtcagtaaataggtattgcrtgccagctggctgccaggtcatgtgctgagggcatcctcagtgctctcactttagtaatgcccctgtggaagttcttgtcacattgttgatgggtggttattcccagagtatgcatttttaggggggcagagaccacatcttattaacttctgtagctcataattctcccagtgaggagtctccccttcaaaggaggaattttctccctcattttcttgccacccattgccatttggaaaactcagtgggccatggagaagccttagatctctgggaaaagaagtttgcgttgtacttcagttgggtattttgtaatgccatttactccctggatacttctaaaatgaaaatgtagcctgtaaggacagcacagagagaggaaatcaactacaaattaaaaagtgattagtgagtgtttaggcagaaggtcaaagggattagtttggacttcaaacttttcagctttcaaggtttgtattgagttacaaaattacatccctgaattatttgtgcaggtggcagctgtcagatttgaagaaagtttctgtgttttacaaaaggaacattgacaggactgggaatggggagtgtgctcccagggtgagggttgtcctatccacagcaccctggaacggctccagtcttgctcaatgcaagtgacagtccttgtctgagctgacacggccctgtccaggttactccaaccaccttagtgaggaaaccagtcaagccagttgattggcatcatgtaaacagcttgatagtagattttcaggactgggaaggaagagaactaatctttgttaaatacctgccttctgatatttcatcctcacarcttttcaaagtggatattggcatcctctttttagagttgaggctcagagaaattaggcaacttgctgaagatcacatagagtgtcagtggcaaaactggttttcaaacccaggtctgagttgctttcttgagatctgtgctcttcctcttacttggagctgtctttagggcagaaattcccaagaggatcccagcaaatgggttaggggtgtgctgaaatggatcccttagcccttgggcagctgggcagggtggggcatggcagctgaatcactgagcagcagtctcctcagcttgcctaggagtgccctatagtgtattttctaatagtatcactatgtggaaaaggctggaaactgaagataagtgtcttattcttagccatccggcctaaccacccatctgagacttgaagctrgttaggatccctgtaaacaattcctgatggaattgtctactctttattagggtatgggatgttgtgctgttttgggrgattgcattaaaaaacaggatttgggatgtgggagagattaggttaaaatttagaaagtggggagaaaacgatccacaagtcctagagtgtatttggtagggggccaggtcttccagattttggtttgtttcctatgcatttattcagtacacatttgttgaactcccactatgtgccaggaattcttccttgtatcagggacacagagataaataacatgaacccttttctgaggatcttagctagtgcaggagatttatgggaaaggaataattatgatgttagacagagggggccctcaaccttcccatctattaaatgaaaacaartgacattaagatctcttacagttctaaactttcatcaggatattactgttatgcacctaactccattctgagtaagatttatgatgccaacaaatatctgatggactttaatttttaactcccttctcaccttgcttttattttttattctttagaattagtgggcttctatcagaagattgtttttgttttgattttagatagctattgcttttaaaaataaaactctctgatattcccatttagtatcacatagagagctataagttgggtccactgtatcttctgaagcataaccatgcaatttattaagataagctgtttacctggccagtaaggtagatgttcattttgacctaaccaccagcctcatggagtcaatttggtaagggctttctatttcagcaaggctttgtttcacatccctgttcattttactgtgtgacctttggcaagttacttagcttctaagcctcagtttccccataactaaaatgcagaaatgaactaccttgccctggtgacttgacatgatctttgggtttataattgaaaacatagataggaggctcagtcttgggttaagattaagacatacgcataaatccatacacacacataaccatatacacatatatatacatgtctaatgtggccattacttactatgggagacattacggcatcaagagttatttctattttcataggtttacccaagagtcattaaccaaggactcttactctctacagcaaggataaagtcaaatgtttacaaagccaggcaattaacataaatgactacagtggaccaggtataagaaaattgacagtgcaagctcaatgagaatggcaacccacagacagccttcatgtcagggagatagtggggagtaggtggctcctggagaatgtgtatatgctccctgcgggaaggcagccgctgttattactgcctgcattgccacacactttagagctggtttaagaagctgggaatctggatgttatctgcctgttattaaatgttaacaatttaaaacattttaaaccctgggtaggccaaacggaacatctctacaggccagatttggccatgggctgccagcttgtgacctttgagctagatcgcgggccatgtagctcagtggcatacctggagtgcccttggattgctcaccagggtgattttgttcttgcagggcctcccataatgctcacctcttcgcttttggcactgcatctggctccagtcttgccttttgactatctcgatctttggctgtccctggtgtctggtgtcctgccagtccacgtgttgtttattctgccacatagacggggtgttttgtgtacacctgggtagcatggcttggatgggagtgcacatgctgacgaatgaatttttaactgctggaaaaataaaaataaatgtatttttctcaaccttattatagacttgcctccgatacagcatcatgtgatcttttgagaatatatggcagggttcccactgtgatgtttcttccctatgtcagggttccgggtcttgctaaccactgtcaaagccccatttgtctacccaatcccaagaagttcctggaattataggacttcatgagcatgcttttccctgcagattagattgcgtatgggaagtggctggtgggcccatggctacttgcatgagctttggacagaaatctggtcacatcttacccccacataaaagcttttggtggctccctgtcacatataagagcaagaaataacttattttatcaactacatcttagtcctcctaatcaactctgtacattgggaattaatgtgccaactcttattgtacagtgataaaaataaagttcagagagttaaggtcatacagcaagaatgacagttgataggagtggaatatgaaatcttgtctgcctgactccaaagatcatgattaaattggaaaaaataaagaagcaattaatcctgttagagtgggttacatggctaagtaaatcctttgttggagagatttaagtcttgaaggatatttaagtcttgaaagataaataggagttgtttwaattcagatgttaaagacattacttcatggagttgttaggaagatcaaatgtgatgatttatgtaagagctcagaaatactttgcatggatgggactattgctgtgtcttaactctgggtagccatgttgcaaatgaatgcctttgggtcataagggagacttatgaggcagagagagagtggctggatctgtatggttccatcttaacatctaaagaggagccttggtttctgcccttgtccactttcaagagtttcgtagctgactttctaggttgctaatatgtgaatagacatagttcatgtatccttagcaataaaggctaactggtcccatctctgaatgaattctagagtcagacagttctattacatatcttgtttatgcctcttatcctcagagtggatactgaaacaaattacaacctctctgacccttggtcttttgtctatatcctaataattaatttagaaaattgttttgagaattaaatcaattgatgtatccaaaactcctagcacatagtgggtgcccaataaatgtatacttactctcccttatttaaagaggattcaaaaggaaggaggtcttgggaagtgactcagctttacctgggatggaaggattatgagtcctgttggctctggtagttgtgtttcactagaaataaaacacctcatttgtgaaatatataatgatgacaaaagaggtttggagttctttcaattaaagatatgaaccatgagttgctggtcagtttgttttatttgcagatgaatgtggcaaccctttaaaaatccaacagaaagggctgaaacagctggagctggggattttaaggaggctgatgttaattattttaaaaataaaatgttttcactgtaagcactttcaaataagaaaggacatccaaagttctttttaacgcccatggtgaaagtaaaacaggtttctctttgtcatggaaactgagactttcagaaggcagggaactcaaaatcactgcagtattttactcacctttgttttccccagcacctaacacagtactcagtacttaggaaagagccatacttgtttgttgagttggactaaagaccttgatttggggtcaggaaacccaagtactaggactagatctgccactggtttctccatttctaccacgtagttgcttttggttccaacagtcttctttttgtggagaaagggcctgaactttccagtactgaagaatgagcaattgctaaggaagacctctagacccagaatattgcgtgttcacaccagccaacagcaagtgtttttcatggcagcctgtttcaaaggtagaaaaatgccttcatagtaaacttagttttgtctcatctggattgtgtccagtctaaaaatctggacaaatatcgtaaaccaaagaaagtttgcacacttctaagaccagtagcaattaattactttaaatagaagccctgtcacttacaagcaacataaatatttgtattttgaacctctaagtaatarttgtgttgaccattctggccttaagtgatttaaaaaaatcagtgagtgatattttaacagggaatatgtttataaagaaagggagggtcaggtcatagagtaagaaaatataagccaaaagacagacagatgtgggttcaaaacccagtgaccaatttactcacttgaggaccttgtaccagttataaaacttctggcctcagttttctgttgggtatacatgaaaataataacccacaacgtttcatagctatcgtggagattaaattaatcaattcctaaagtctaaactccttcaaggtccagggtcttcagtctatattttgaataggtggtccaaattgggaccattgctagctctgcattttaggtgaactgatgaacatttctgatcctcagtttttccatttrtaagatgggtagaacagtacctactcataactctgtactgtaggtaagatgtataaactttttatcacagagttctttttttttttttttgaaacaagatctggctctatcacccagactggagtgcagtggtgcaatcttggcttactgcaacctccgccttctgggctcaagttatcctcttacctcctgagtagctgggactacaggcatgcaccaccacactcggctaatttttgtttttttggtagagacggagtttcatcatgttgccaaggctggtctcggacttatgagctcaagcaatgcaactgcctcagcctcccaaagggctaggattacagaaatgagccaccgcaaatggccttgtcacagagttctaatagctgcccaatttgagtaattatgctataccagatgcctatttttgtgcaaccagtattattttgtggatagatgtgtaggctttctgcagatgttagtttaattattattctcgcagatcctggacttcacgtattttataatgactatggattgttttgagtggaaaattgaacaactctggaaaaggacatgaaggacctggtatgtagaagacataaaagtcccctcctggtgctctgattttggtcaaaaaatgcaaagattccttcttcacccttcccatcattctcttcttagcctcaccaagggctttctaaaaagcactttgtgagaaggaggctgtgtttaattttgtgcaaaggtgaactgtggctgcagggagcagggctttggggccaggtcacttgggtaacacttcccacatgagtttatcaatgggtgggccacaaaaacttagtctgtgtttttttacactccacccccaaaccacccaacctgccccagtgttagtttttcaaagccagagaagtttcaaaggcctgaacccaacacaggggcctttcttcatgctttgattttatgcccattaagtgtttgtcagtgagttcatatttcacctcctctgcaacctacacatcccaagaaatccccagaggtatatgaagttaattgatccttgattaaaggaaggagaaatgcttgggtctgggtctcggtctgcactcactagattcttttttttttttttttttggtcatgctttgcaaaaattttgtaatgcaccttttattacgaatacatttaaactccaggctattgcrttcagagtttgatgaaattagttacctagcrcatgtgtgatacacagtgaaagttcagttaacttgagccagtgccattcccttgattgttctgaacagtgcctttttcatcagaggccatgagatttgctgagcttcagttaatttactaatacttatagatgcttccttctctgaagagtgactcacttactttatagaaagcacccaaaatcagagtcagatcatttgaaacctgttcagctccataacttacttgcagagtgactggtaagtcactttaatctctttgaaccttagggtggcttaatgtattagtttttatgactgtttatcctattagcctttgggccacttgaaggttggaacgtagcctctttcatttcagtggcccagtcaatgcctagactgtggtaggcagccaggtttgtcagtctacaatagtttatatggggaccctcaagacagtttgggcacatactaacttactaactgtttagtaaatgttacctattatttatgctttgtgctattttcgcctttctttccttcattcccttcatctcctctagctctatagcaaactttaaaattgtatttgtttaatagccatcagttttgtgactgacaatattgaaatccctaaactgcactgatttttttatggttgtacttagcccgtggactctagaaacccctcctacttatataagggttaactgaagtctcccaccctctgttggacaccttgaaagactctagtagaatagtctttgtgtccttggtgtactctatgcatatgtcagtcatcacactagaaataattcagggttcttgcttttttgactatcttacaacactgtgaactcctccggggcaggtactatgatgtattgacttccagaattccagtgtctagcactgggaaatttctccaaatgaagtgataagggactatagtaattggtaataaagatggtgatggtattggaactaaaggttgttggagaagaacagcctcttctctgtgtcctggaagggcaaggcacagtgttatatctctgcctagttgcctagttggactagctgcctagttggggggatgtttatgcttttcccatcaactgaaggaaatctgtggttactcttcctggatcaaaatcaagatttgactggcatcaccctcaataataccacaagtttataggggagacaaaaaaaagccatcgggttttgtaaatgccatctgcatgcctttcaagaaaataaacagaacatattcagctccaatttcttgtctgtttgtggtcttcatccacataatcagaaccggaaaccctccccaagccataggcaaagaaagaggaaaaaggatttggactgttctcagtttaaaagtgggcaaaggactgaccagatttttttcccttgccttctctgtgaggcttttttcccttctctttttaacattcattgagtgtccacagtgtgtcccggactctatgctggcattactcagtgctattgccttgactttcttctcaactgattttgatgatatgtgtcttcccctgctggattgtaagcttcttgagggcagggtctgggtcatctttgtgttccttgtaacttaatatatatagttaagcctcaataaatatttgttgaatgaatgctttaatttttatataatcccaaccaccctaaagttagatttcattcttcccattaaacagatgagaaagggagttttggagatgtgaaataacttactcaagtagtagggagcagagtcaagatcattaacccagttctgtctaactccaaaactcttttatatgtgttttattgtccatagaaacatatgttttacaggcctatcatgtgagcactattaaaaatagaagctggaggtctgagagtggagtgcaaatgtaaggaacttggggtctgttcccttcctgagtttattagcaacactttggctcctaggcaccagagcaactgcagctcaacttttaaatctcaatatgtggaactttaaaagcagactattaataatatcatactgctggcttctcagctacttttcatagccaacttggttgcatttcaaaatgtttaggcagtggcatgaagatggttcgggaccatatgatttctctcccaggctcctaacccctaaagatcatttctaagccagaacgtttatccactgcctttccctgcccccctctcctccattgcagagacaaagttttaaaacctaatggctattgcctgtcatggcccctctgtgtttactttgagaaggtcaggcacaatactgtggtgtgttgctgttctttcttttcaaagcaccagtatgaatttgataaagtaaattgttgttctagcaggaagcagttaggggtcacaaaataaatagccatagaattcaaataaatccaaagaataaaaccaaataaatccatgtgtgtatgcacagtgatacataaatacactttttagaaagtgagcatttttatcactgctggtctggaccaaagtaattgaaaaattgtggagttcatggtacttttttttagaggtggtctgggacttcaagcaacatgatgtgaatttaattctttttgaaaaacatgaaaaatgggattttatcttttaaacaactgtttatcttgggatttttcagctaatgaaattcacatttgaatgaaatcaatttgcaaagttaaattagggatttaagcatttggaggtggactaagagaccctgaatgagctcagtattctctctgagtctctgttccctccacttgaagatgggtggtagtgcttaaataatacttcaatgcaaaaatggatataaagaacccaacacattgtgagtgtgcattcaatagtggctgtattatccactgtgttttttttttttgcagcccaraagtcttgtatttattttattttatttttttaacatctactatgccatgagttcatacgttccagcagcaggctccttccccttggttctcacaaagttgcacttctcttggtagagcaggctggcacttcagttgaactctttggctttctttttctgatcattttccttcatgttttttaggaagttatctcagctcttggagtgcttaatgtgctcaatatgcacattaattctcttggcaagaatcttccccttaacttttttgtttacaacagtaccaacggcatgctggggaacactgcagactcttccagtttagccatggtaacacttgtggggcattctttttagagcagtacccattcccttagatgtctacagcatcacctttctcatagattctcatatacgtggccaaataaacaactccatgttttctaamaggcctagagaacatctatcgggtgcctctyctctttccctttgtgtttgtcattttggtgaattactggaagatggcagttccagctgaaaggccactgtgtttttggtggtcttccctagttccaagatttgtaaaagaactggtccttttactttgcgaagtgtcattggagcttggtattgcagttgggtagttggggaggaagaggtattttggtctaagagaatagcatgaatccacagtctctgtgtactggtttcttggaggcttactgaagaggagcagcagagcatgaagctggagagatgtccaggtcatgggaactcctaaagtcatacttagggactttatttcaccctgtgtcatggggagccattgaagaggctttagcaaggctttgacatgctcatggtccaagcccttcaggaagcaaactggtggctatctgtagaagggaatgggggccatgagcctgattaggaggctcttgtagcatccagacaagagttatcatgggcctttgctttttaagtcaaggttgtgagggacttttcttggcaggtgatggaatccatttgccatgacctttgagagaatagtatctgagctggccactgataaccagcagcaactgcaagagtcacttggttctcctgggtgccctgggccctctatccaggtctgcaggcagcagggccaagctcagctctgctcactcttattggtagttctttgaacagtgaaagaaaagcctggaaaatggcattcatgaagcagctactatgtgccaggcactgtgctagaggttgtgtgtgygttgatctcctttagtcatcaccacaactcattttactgtgggaaaaaactgggactcagggaaatggagtgggaaccagaggaagtgctggatctggggttcacatccagatttttttactccaaggccttcactaccccaggcagcacagccttagtgaacttctcaaaggggaaatggttaagagctaagaaatgaatgcccttggaagcataaatcatgagatttggggctatattagtaaatgttgcgattcgggctttaatttttagcagggtattgtagaacagtgggaaaacccctgctctggctctttcactgcctacctccgagctcttggggaagagaagaggataatgcctctctcctcatgggggtgtggaaaggaggaatggggttgtgcatagcgaaagctctctctaggcagtagatctctacaaatggaaggaacgattatcactctcagtgatatttgggatggtcttttcttgaagttcctctttggcactgatgttttccccttcctttttttctttttttttctggtatatgccatggttccacctggaccagcgggcctccccttcctcatcatcgagacaagcaccatcaagccttaccaccgagggttttactgcaatgatgagagcatcaagtacccactgaaaactggtgagacaataaatgacgctgtgctctgtgccgtggggatcgtcattgccatcctcgcrgtaagtgtccagaytctgctatggtggatcctgtctgacttcttcctgtattgtcatattatagaatgtctgagccaacagagacttataccaagtagaagccaactttctctggcctatatttagccaagaaggaaggtagttaatcctgagaacactaaatgtgaagtaagtgctatcacccccattatacagatgggagagttaaatgacgtactcaaagactacagctacaaaaaattcaggttcagcctgtgcctggctgatttcaaaccccctttccatctcgcaracttacakttcaggaagkctaacctgtccaaatgaactgctcaaggggataggcagttagcttatcttgcctactctggatcaaatgtaagctgctgatgttacatgtaccacatttcatgtagttttcttttgacttgcccactctggaggttggttgtaaactttgagacccctctttgttttttaataacatcgtaaaccaggcacacaatcaacagcttgaatttggggagggggaagggaggctagtagaattctttccaacctttaaaagaaaaacagtccatttgscagtagtttcttaaaggtggactaaggatctttgtgtttgaaaactgaaaaatgaaaggtctagttttcctgtgtgctccaaattgacagttgtgggtttgagtttctaggaagaatggctttccctgaaaaaggtgtttgttgtggaaagcaaataattgcacagtatcatgtattgaggtttgaacaggtgtttttgaaagttggaggatcagttaattgaacgcttcaaaggagcccgctatacccaagagtgtggtgagataagaaaagcacagggacaggaatgtcacatgctcgtcactctctgtggcattattcccagcttgcctagtgggctgctcccagacacagggcagtggaaagagacactcttcagagcctctcgtagctatgtgaattaggtggatcattgatttctttaaccttcagtttcctcatctgtaaaatgagattgctgtttggattccctcaagaggattgctgtaagaatcaaatgaatgccataatgcctggaattgcactctgcagcagtgggctcactggaacgttgagagtcttttagttgggaatggttctggttttctgacctggccccaggatgggcaaaggaaaatgctaaagtagcttctttagagttcatgtgtctcctcccatccttccttccccaagcagagcttcagatcagcagctcttcgcttgctgcttgccaaggccaatccctttctccttaagggatgtcagcatttcttagaaaaaaatgtgctattgagagcttcattgtggcttgcccctttccttgtgttatgttgatattttaattacaatgcttcctgacctcccaggttttcttgaagcagtcatgtgctgtggcctcattatacaatgagcaacagcattgcttccccaacccatacaatggcagcaaaatggattagatagtgctttcctatagttccggagaaacacaagccaagaaattactgcaataattgttatctcttgtccagtgctactgtgtatggggatacaygtgaaaaatgtggatgcatttcacccttgaaaccccaagagctagatattcttagggttttcagtttagcacagggttaaaagcacatgccctggttcagacctgagcacctctgctgtggaccatgtggcaaattaaccttatggtgcctccggaaatacatctgttacatagagatactatgtctacttactaaggttttgagaattaaatgagctaatgtatataaagtaactcagtgcttggcacatatggtatgcccagtaaatgttaactatttttattctaaatgagtaaacagagtcaaaaaatggtgaagtgacagccagatgttatatctggtaaaaatacagtaaggaaaggaaccccagccttagctacaccccccactcttatcttatagttatttaattagaacccaggtctcttgattctcactcctctttgcaataggaatttcttacctcttggtccaactgctgttgcatttcagctggagacacgtgaattgggggctcctaatgaagcctcctagcctgcttacctgtcataactatcaagggtactcacagaaaaaggtaaaagcaaagacctcagaggtggaggggataattcacttttgcattctcagttctggaaaagctatagagtttaaatttaacaacaacaacaacgatgacgtcgacacatttcccactttcccagctggccccatccagaacccggttctgattagagggcaagagtgacagacgtggagggtggaggggcccagagctggaaattgaaccatcatcctgctgcttgcwgtcctgagccttctcctgctgaatgtcaggtttgtttaaaacagcaagagaggccttgactgagttggatgcccctgctsccattcagatggtccccacaacaaaggaacggaatggcagtggaggagaccagtgtggtttagagatgcaaatcatcacgcgttatggagaaagcagacacctttcaatggcaggagatatggaaaaacctagtcatgttgacctctttttcagatgtatctcagattctggaattatagcataataggaattccttccaaatccacaaagcaatggttcctatccctgccttgcaaaggcttaatgactctagcagcagtaagactaggagcaaacagtaaaatatcatctcctatctctcagttttgtcttgcactgtattacaaagagtatcatgggcaaagatttaaaatgggcagaaatgctaagtattcattttaaatatacatgggctcagtgcttgcctcgctcagaacctaaaaggggtttatacagattcttaatatctaggaattgatgcatggttgagtcacggatgaatctccttctctccctagccataaaaatgctacctaacttgactctgacttctgtaataatattcctaactagagaaaaagtcaaacttaggcatcatctgacttaggtacatgtcccaacttgagtgcttactcattctgtgacttgtccttcaacctcagaagagccattgggccccttggagctatactttgcttttctataaattggtcacaacggttcaccaatgccataggcttgttttgrttgtcaaatcatgtgatattgtgtgtgtgataagtgagaatcatccttcatatgtctgtagtgttgtacagtttacagcgtggcttttatgtgcacgctcttctttgcacctggdagtaatcctgggaggttgattcttacagctaactcaaccggggctcaaggatattaagtgactctctcataactaagtagtggcatggccagaccaggagtcctctgattcctactgctgtcttctgcagcctaccctccttccacaattacttatcaagggcctatgatgtgtcaggtgttcaccacacagtagtgaacctcagcacaaccagctgcatgttgtctcttgtcatgaaacttagcagctaccccatctcgagcaggcaaataacaccttaatacaaactgtcataggccaaggcaggtggatcacttgaggtcaggagtccgagaccagcctggtcaacatgrtgaaaacctgtctctactaaaagtataaaaataagctgggcttggtggcacgtgcctgtaattccagctacttgggagactgaggcaggagaatcgcttgaatccagggggtggatattgcagtgagccaagatcatgccactgcactccagcctgggcgacaggatgagaccacgtatcaaaaagaaaaaaaaaaaaagctacataataggttgctggaagacggggccaggtcttttcctctgggcacatggtaggtacttaaacaccaggcggacatttctccaggaagcattccgtasctgtctcctcccccaccttccaaaggtcacagagaaccctgggcccacctctgtggctgcagtcactgtgctgattgtcatgtctgtttacttgtatatttcttggctaccctgttagctgcacaggggagagacagatctgatttgatttggtattgctagtgtgagacatagaccttggtgctcaatatatgtttgtgaaaaatcacagaagaggccataaactgggggcagaaaatcaaaagcattaggtcaaaagatatcagaggattcacagagcaggggaaaatgtcctgttttcttccttaaaatctcaactatgctccaggaggcacatgggaacacactctgtaccacatgcaaatttcttgctggagagacaagaagaagagcttagtacctgcaagacttgtttattcagtatcatgcttcactttgcccacatctggacttcattagttcctccccacccctccatctccctttatctacaagagccctgccaagaaaacaaggttcctcaacattgcctcctcattaaaggctagtcgagttttcaactctgaaaaatgtgcagttgtgctggcccagtggtgcattagtgggagacccagtcccccagtttacaatccactacatctgtgcaattaccaagaccaccaacagagagaggccacattaatccttcaactgtgttgtcccctgatcagatggctacagagttcttctragaccttcttatccctgggggaacagtgggagggggcatctatttgtgatttaacaacacaggcatggagaktgcactaaattttcatctgttccctttctccaccacccrcactcactctcatgtcctggaagaagtgagaacagcagcaattcttccttagttaggtacagctcttagrgattcatgactatttgaaaaacgtatcaatacggaggtgatgatatgctccatttgaagtcataatgcttaggaggccgagaaatactttctgtgaggggcagtgtgtgttggggatggggtggagagtcagataacatttatgagctatttaatggaccagaaactcatgtcttatcttaaatcctcttcaacagctatgtgaggttgctattatttaccacatttgacaaatgagggaggacactgaggcttataaggttgaagtgactagcccgaggttactctgcttagtgaatgggggaacacgaattaaaacctagatctgtttggctttcaagcctaagtgctttaacagatgctaatgaaggcccactctggtcggtgctatgtagagtgctctttatttagttagctataaaagcttttagttactgggcttggagagttaaatgtatggaggaagataaaacatctagaccactgggcagatgactgcccaagattgacagtgtgcatcaatggtttgtagagatggtgatcacctgctgtgtgtaggtaggtgccgggtgawacctcccttatagmaagcaggctttgtggtaggcaccttggcctataagctgatgtgtaaaatacagatcttgcctttggatcttatggtttaaagggaattcaagacaagtacaagtctgactataggattagaccctcaaggaaaggaaataattagtctgagaataagaggagagtcagggcagtgcatggtggtggctgctagggaggggagagcttcaaggacgaaacatatcagatgctgcagattgtctgaggtctaaataaagtgctatgggagttcagaggaagagcacttaaggctaaggcttatgccaaggcttcatcatcatcattattcactgagcactcgtctcatataattttcaccacaaccctgcttttgatactgtcatcatcttcatttttagagataaggaaactgagacttagagagctcagttgtacaagactcataagtcaaagagccaaactctaacccagaacactagttggcacttgagctctactttaaggcataagtaggattttcgtcagagaacctgacctaggcagaaggagtggcttcagccattttagagacttcaaaacaatgaagtgttttcagggaatgtagagcagacctgtttggctgaatgaatggaatataagggagtagacaaggttacagcaggaaaagaagattgtggcaagatcgtgaagacccttgaatgctgaggaatttttactccagctaattggctagaggttgatgagagtattttaagtgagcttggtcaattttctaattaaggtaaagatgaggcctgaaccacagtggtggcaatgcaagggaaatagaaaaagatggatgcaaaagaccttgcaaaagccggatggacaatgggataagggagaggaaggagtctaagattgcacatctttgtcagtcatatgcttggtggcatcttgagcagaactagagggaagagaagtgaagtttgggacaggagtgggaatgggtgtgaccttagacttggttaatttgaaatggtactaacatctccaggtgggagagttagcagaagattggaattgggccaattaggggaaaggggtaggctgaagctagagagagacagagagatgcccttttgaaggtcatcttcacagaggtaacaattgaagctattgaagcagctgagatcacagcagaaagccaggaacacaatcctagggaagacccacatttattgggtagaagtcagatgtggaaccactagaagaagcagacatacatttagaaatagtaacaaaagcatggtggtgtgatattaaggaagcctaggaaattcaaggtaaaaaaaaaaaaaaagagtaagaggttgcagtaggcaatgctgcagaaagaacagccaggagattcttgcatggactggcagagttgggcattcaggaggcccatgactctgagtccctgacttttgggaaaacaatgatgctttatgcctcagactctcttcttcatgagacttgtgggcacagggcagccactgctaatttcaaccataaataacttctgtagcccctctctggcctctttgctgtctttattctagatattggagttctgacttacccataaagcccagaaattatactggtgtctttggacagatctatgtcttcattacctttcccagacagtgaggcactgatcttctgaaaaaggctgaagatgataaccaagtgacagaagaatcagagaataaatttccaatcaactatttctagttactaaagacgctgcactttattgcagtagatggagcagtcagtgccagagaaaatacagccatacatctgtctccatccttagaaacaggacccagtacattatatttttcctttcctttgggactgagaactaaagtgagaaatgtgattctcccttcacgattctccatcatcaacagtttgttgaattaatcttttctgggcaaaagaagttcatcaattcatgtaaccgagatgtaaaagaacaacttgaccctctgtggctagcaggaacttagaggtgcaggtgcctttcaagatggcaggcccttactgggtgttctgtgaacatmtgtctctctggagacatacatactactgcctagtaggacttctaagagaaagccagctcgatgccattgggaacagcacaggaattagaasgaggaagccccagcttcagtgatggtcttcttgctgtctcatttttatcagagtgattcactgccctctctggccttcatcatactcatttatataagtgttggtaataatttagtaattcatatggtgttgtgagaagcaaacagtatagtggatgtgaaagtgctttgaaagctgtaaagtactaagccaatattattaaagcagatcagagtataggaaagtttgtccttcagactcagyggtggaagatgagttctcagtctctgaaagagattgttaggctgctgtgcaaaaatattacttttcttgggataatttacaaatagagtggaatgttaaaaataacacaaaacagtagagtagggttgtcccttctgctttgggtttagactttgcttctgtcttgatctgctgaaaaatacatactagataaaatgatcaaaagcaatgtcatccatacatacattttctggtcctaccctggaggggtggtatttccaaactcttcatttaggtatggtatcgtccaaggagctcttggaagagatactctctacaaaacatgttttttatttgtttgtttgctttcctcttcaatggagggaagaaaaaagttaacttttggagggctctcctgctaggtgccaggcgattgacatatcaccttatctaattccctggcaatcctgccacatagatattattaaccttattttatagatgaggacatctaagcccagagaggtaaagtcacatgcctaaggtaatagacaagattcagacaggtttttctggctacaacgttgttgcttctttcaccacctcttgctctatcttttcccaaaaatctatcctwatttttcttcatatttcctctccataacagttaaatatttgtaaatatgtgggcagttgagctctttttcaccagaaaagacaggaagaggagctgtcttgcagttggagccaacctctctccaaactgcagcccttctcaggcaaggactgatccctttctgtccccttgtagcttaattgcaatgctttcccattttattagtttccagattctgtgccaagtgctttaaaaggcaggtaggggagaattctctgcttgcctggcagcctgccatcacccccagaatctgttgcttgctgtttcagaaagggatcaacattgaaggcatttttctcagcagtgaaatttacatatcagaaccttgctgactgaggcagaaatgagggctctaggggcaggagtctgggagtggggacagagtctttgtaggaggagggggagggaagagcttattttcttacccaggaataaaaacattgtgagtaatgaataaagtccgaaagcagtaaatctgggactcgagagttaggtgtgtaacgtgtcggagaacaatttaagccttcgcctcgtctgtagaggtgaggtattcaggctgcctttcacaacccaaatttcattaaatagacttttaagggttaggattacaagaagccaagtccgsctggttcataatgatgatttatggctgtgttgtcgactccctgacccttctgtacaagggratagagaaaatacataatttgttgctcattcactctaaaatctgtcaaggctgccccagaagccatgtggtcctggagtcatgtgtctgctaaatggcttcagcctggccctctccttaaaaatctgcaattgctcttctgcagtggaaattggttttaataacaatagaaatgataaaattatctcagtgtagtctgctgtgggtctttgagcttaagagtcagaatacctgggctctactcttaactctgtcacttactggcctcaaatccttcagaaaagtcactgtctcccagagccttagtatctccatctgtagaatggaatatcttcttcacagagaagattcaatgaaactacagtacaaaataaatgtaagagatggctgctgttaacattattattaggaatttgaggtactgcaaaatgttcttttcatctccttgttttcccttgagtgaaggaaacattttactttkcaatttactatcttaagactgtgacactaaaaatggaagttttagagatgggacattagagctgaaaagaatccctgaattgtaatcaaaccccgtctccctaaagtaactggagcagaaaggtgactcatctgagattaatcagtaaattcataaaagagatgctaatttgcattggaaactcacatgttctttctcagcatcaaacaggaaatcgtgttgactgatcctcaggccacacctgcttagaaacagttccttaatctgtagcagtgtctggttcagggaaccagagagcaatctgaggtcagggattttatctggggccttggttctgctccctgcttctggtgtcatctctgagcaagtaactttcctctgccattgcttattacctgtgcttggttggcaggctagtggtggatggtggacgtagcccaggaaagttgagaataaatgtcattgcagttatgaagtcataaatcagagtctagcaccctcgttttgcaaatgcagaaaccaatttatcccaaattcactaaacaagtagggacttgaacctcggctacttgactcctagttcagtgctcttcctcctgcataaaaaatctcatatgacttataaataaggaagaataaaaaagattaagagaacatgattgtggtaataaacatctggaacttgtttgcctgtgaggttacatagggtaaatgtataaacaggttcaaaaggggaattagatcatgaatggtaggaaagaatgctgggcagggagtcagtgcacctgggtttaatctttagatgggagctaatttggacctaagtttcttctaaatataatggtccctttcattaatgacttgccatgcttcctggagtttaatctctgcaacgtgttatcaaagcattcttggtaatgttgaggggatacttccaattttgtaataaggcaactctgaggactaccgtcctgctccctttccttcatttgttccttcaactgatagtctttgagcatctatgcagggtcccatactagttttgctctctcaggaaacggctatgccaagatgctggctagagtggcctttgcctatgttcctctaatacagaattgtactcaatatgttctgggaaaacaaaatgtagctcttatatataaagcatttatgaacacagagtcactgtgtcaatgttggcagtgataatagctgttctcactgctgcacctgtttgtccctgggcccagctggtgtttccttcctacgtggtcgtcctcccccagactttggagcccttgaggaccttgatcagacctcatgccttgatgctttcctccactgtaaaagaatattgggagcctttgcaaaggagtgtccggatatgccagactattgcttcccttgtggctgtgcacatgctctcttccctctgaaagggcaagtgtaactcatcatcctgccctgggaggaagtgtgaagggacttttgtggtgagtgatgagttgaccatcactgtctctgggctgtggttacaagcaggaagtggccatggctgggctgtggagttaagacaaagrcagcagggtgtgtggttgtgcacatcataggcatttaccttacagaacatcagctgtcccccatccttaatgtaaatgatgtcactatatctatcttgagcatcaggatttcgtgacataaagaatataaaagcaatgtctggtatataataggtaatcagtaattggtggattattttcagtagtgataaatctcctctaagcatcatatcatagatacagtatgaaaatcaagaaagatttgagaaggatcktcaggctcagagaagacagcacaggctgactggaggaaattcacaaacactgaagggcatcgtactacaagtttcttagttgttagactggtattctattcatcacactctgcttctaaaaagtaaaagcatcactttctgtgatccaggtcatttcccattcatgttatcctatttgaaccaacaactgcaaaggtgagcagcctccttttatggagcagaaggccaaagcttggaggatgtagattattgctgaaggataccagattggtggcagagtctgaattccccaggacttaaccatggtgtgtccagctcttcttacagaaactctcaccatggccaatgtcagcacaaggctgaggcccttactagagtcaggtcattgttggtgatcctttaccccaaatctcagaatctcgagatttgctcagaccctgtgacatcatagctaccctttaccttgtcgttgattcttcatttagtatttcttttctatagttaagttcttgtctctcccttaaaaaaaaagatacacacacacacacacacacacacacatacacatatatacatataaatatatttggttgtatatttttgttgttacaaaggggcttaaaacacccaactatattagygctttgatcttttcttctgtgcatatttgtgtctgtatatttcataaatagaaaattaggacactcctttgcaaatactgaatattctcctgtgttgttgaatatccgttacggcatcagtgttgatgatgaatcttgatactgcctaattcccctgttggattccttttagatcatcacgggggaattctaccggatctattacctgaagaagtcgcggtcgacgattcagaacccctacgtggcagcactctataagcaagtgggctgcttcctctttggctgtgccatcagccagtctttcacagacattgccaaagtgtccatagggcgcctgcgtcctcacttcttgagtgtctgcaaccctgatttcagccagatcaactgctctgaaggctacattcagaactacagatgcagaggtgatgacagcaaagtccaggaagccaggtgagacaccacctccgcatggccagagcctggacccctttcatacagtgcagttcagtgagcacttactagctgggccctggtttagatgggtgaataaggcatagttcctattcttgaggaactcacagtcagatgattgagacagatatgtaaatcaatacttccgatatagcatgggtaggtacattcattcattcattcttttgtttattcatgaattcataggtgcctgctatgttccaggcatgggtccaaagcactaccaaggatgcaaaaatgaacagggcctagtgcctgctctcaaggttacagtctagggagggaagacagacagacaagtgtgtatcagggatgtgaatacggccctttcatggccctctcttgctcttgcaggaagtccttcttctctggccatgcctccttctccatgtacactatgctgtatttggtggtaagtacccaccctttgatttgagcagtgctcagttccagcttcgatcccttctgatatgatagccctcaaaatagtttaggggcatgccatcactgtgaaatccttgaaaaagaggttagctagaaaagttaggtttaattctgagcgctgccactgccttagcagaagttattttactttctagttttttcccccatttttcaaataaaaatagtatttgccatagctgcttgataagcattgtggacacattttggaattttaaagtgatamagacacttgtattaggttggtgcaagagtaattgaggtttttgccgttacaaaaacccctggactacattacttaaatggcaaaaaccacttactcttgcaccaccctaaatataacattttagggtacaaacactgttttctgaaaatctatggtgggaaaagattgctaagtaagtctcagaaaattaaagtgaactgccaaaatgtacgtaacagcaggactgttgctcaagcccaagccttctgataaatttttttgcaacgttcaccatgtcagtcctctatattctacggatggaagggctttaaggatcatcattacctaagtatttagaataattttgagttttgcaaaatacttctgctccatgaggacgcatgacttcataacaacactgtgaagtataaaatccatgccccatttctcaaatccacagaccaaggcccagagaggataagcagcatgtttgagttccttcaaccagtagtagaaccatgatttgattcccatgctcttctcatggccgtgtctgctctgatttcctggagacggttgggtaatgcaggtgaagtgccctgcttgcctccagctgctggacagacagagggctggtctgtttttctttgtcagttacatgtgggtttccctgccttgcctttccccttgaatgaggtccgtgtgtgccaaggcacttcctgctttcagccgctttgatagaattcagagcgagaaggtgctragaggtcagacatagctcagaggagcacaagctgtttgaaaaaagaacattttgatttcaacttattgaaaaagcacaattaggaattgggaaaaacagcagaaagtttgttttatttatttatttttccccccaatcctttctaagtttagaggcctctaaactaagccaacattggcttcccattaccgaggatgcagagctgaaagatgagccccaacttatgacaacattaaacatggattttatgtgttcatgaatagcacttccctccattcttcatctttttttttgttttgctcttagaaaggaaaatttagcaaagatatttaggttcctgctccctttgtgtattttacccagggctggaaacaattttaaaaatgtaatttcgatgttttataaaagtgcttagaggaactgggtatgtgttcatttttttcatatcccttcattttattccaaatgaaaaatactggattgttttgaagccagcactgtgcactgtagccttcacagctgcgcagcaggtgaagatgctgacacactttggatgccttctgtgtgccaggcaccatatctacttactctgtgacatttgcttctcagtgacctgatgaggtgcattttgattatcctatccaatttgaatctaagaagttcagtaacaaaagttctaccatcagtcagaggcagaaaaggtatttgcaggccagactccagcattgttttatgttcttttcattgtactgtgctacaaaactcaaaacaaacaaaaaccagacctcttcaggttgaacttaaggaatattacctcttaaccctaacttaaattttgcctgaaggagacctgtctccttttgctttgatggttgagatgtcccctccctccggtccccaactccaattacctccttaccatctagagatctctgtggggatgatgggtgagaggtatattttgattgaaggtttatttgcatccctcagagggaggaaaaagttgtagtgcttccatattgctggaaggaaggaagagaaagagggaaggaagagaaaagggagagaggaaaggaagagagagggagggaggagagcctcctttggctggatggtggcttatacctgtaatctcggcacttaagaggccaagataagaggatcccttgaggccagcagtttgagacaagtctggacagcacagggagaccctgtctctttaaaaaaataaaagaaggagagcctccttaatccatcctctcctcagcatgttattatatcccccacctcccaccccactgtgcacatacgctcttcagaactcttgcacaaacacacattcaacactcacaactcacatatacaacatatatatacacagctctatttttagctctaaggttatcttgccctaaaacaacctgtgaagataagggtcaaaaagtgaggacagcactctctgccagggcatgtgtttatgtgatattacagagaaatcccagctcttgtaacatctgatctgcaaaactttctttgttcttcttcttcttttttttttttttttttttttgagacagagtctcattctgtcactcaggatggagcacagtggcaccatcttggctcactgcaacctctgcctcttggactcaggtgatccttccacctcagccacctgagtagctgggaccacaggcacatgccaccacacccagctaatttttgtatttttttgtagagacgaggctttgccatgttggccaggctggttttgaactcctgggctcaagcaatccaaccaccttggcctcccaaagtgctgggactacagatgtgagcctccgtgctaggccgatttgcaaaagtttctttttttttttttttttttttttttgagatggagtctcgctctgttgcacaggctggagtgcagtggtgcaatctcggctcactgcaacctctgcctcccagattcaagcaattctcctgccttagactcccaagtagctgggattacaggtgtgtggcaccacacccagcaaatttttgtatttttaatagagacagggtttcaccatgttggccaggctggtcttgaactcctgacctcaggtgatccacccacctcagcctcccaaagtgttgggattacaggcatgagccaccacccacctcagcctcccaaagtgttgggattacaggcatgagccactaggtttggctgatttgcaaaactttctaaagaaaattgaaaggacacaatttcggcccaccagaggaggtgggaaactctgcagtcagtccgagaagcccttagaccctcccccagggcttttatgttgagctgcaggaagttctggagttgggcaargagactggactccccggtgtacccagtgctgtttttttgttcatgcagcctgtgattcatagcttccctggggtgttggggagaatcacatttgggtcagccaggtttagcactgacagttttgtctttagaatcaagcagatgtggaatcaaatctggctgtatccatgaccagctctgaagccatgagtgggttacatagctttagagcctcagcatactcatctggaaagtggaagtgatcatgtctattttgcagagttgttgccacttttcctctctggaccccactttccccatctgtcagatgaaagagtgggatgagatggcctgtctatttatctctcaatcacaatggctctatttgaaaaaagtttgaactgccctaagtgctaaaaaggaagatggggagccatcaagacaaacttaggcctacattaccatcgagttcagagaatggcagaccggaagcaccagccagctccactccaggcttttcacagcagccacttctagaggctccataactttaagggcacttcatgttaggtcaatgaataaattttgccaaatgatgagcttggaaaaaccatgccccaaacaccaaattatcctgcacacagaagcttaagggtgaggttaaggcttgttagagattaatgcaagttctaattaaaaaaaaaaaaacaaacccacagcatatataagcacaaagtatgctttatacctctgagccctggcctgaaccccagaggaccacgtctgtattgaccctgcacctccatggtcggagactgaggatgacatgctatctggataaaatgtcaacaccagggcagacaccaattcatgcagctgaatgtctgctgtgttgtgctgagccctgcccttaaggaactcacctgtgcatccaacattgagcatttggtatatgcttagtgagggactatgatgcaccaagcaccagctaggagtgggaatggggagatggttacagcccttgcataatttagtctagagaaacagtacacaatgataatagtctgatacattgtccctcaggggcaaggggatatgtaggttatattacggactctcagaattatgacccctaggctcacctggagcagagagtggcagtagaggtagttagtcacatgaagatagaggagactggaagaactacatgtgtgaaggtgaaaaggaggaggtgatttggagaactgcaggtattcagttcagtacagcttggatggctgctaggaaccagggaatggagggcacgcttgagagtggaaaatacctttgggatcagtcccagctcctcattttgcaggtgcattaggcagccactttgtgtcaaggcctttccttagctgctgttctccccgcaccccaccccgaaatctgcaccttgcccccacccaccttctttagaagcctttcctgactaccctgtttagaatgacaaccccctcctctgacactgttctccctatgcccctttgcagccttacgtctcaccatctgacatactacatacttacttgcttttttgtttcttccaactaaattataaattctggctgggtgcagttgttcatgcctgtaatctcagcactttgggaggccaaggcaggagaattgcttgagcccaggagttcaggatcagcctgggcaacatagtgagaccctgtcwatatatatatatatatataaatgattaaaaaaggctgtaaattccccgggggagagattttttggtctcttcattcactactatatcctacttcccaaaataatgcctgatacctagtaagtgtgcaataaatatttgatagatgaatgaatgaatgaatttcaggtcttctgacactcgggccatccgcctttccattctgatcagaactttttttgtctcctcatcacggacttgatagattgctaagggcctgtgtaatgtagggaaagtctttgctccctctttgctgagctctctccctattgaccctttactgtgctgtcccaggagaactgtttgtgtgtcagagggtttgttgggtgccaaggaaatggaagtggctgtgctctgacagccctttctctgggctgtgcttgttagccattgaggttttgttcagcatgtatggcgccctggagcctagggtctggtatgcccacgaggtgtacccacagatcctgggagcagctgtagaaactcctttggggagcaagattgttgtttccaaggggaatctgtaccagatgtttttcctcttttttctccctatatcattcactcaccccaccacacatccatctatttctgagtacctcttctgtgacagaccctgtgtgagtgcctggggacaccaaaagagctcataattttgtgtggaaagccagagaagtaaatagtggccaaacagctggatgcattctctgcttaggggtggactcaggggatggaagtggccctcacctctgctatgaggtataatgagtcagctcttaggctcccttcagcttcagatcaggtcagagattattccactgtaactcttacaaaagctgtacgcttgtgtttcaaatgtggaggttgatggaagtgtgtgcaggtgaattagaggagtctgaagttctaaatgtcccctggaggttgtcctttggtgttttgccctcaaactgcctcttttctccaaagacagaggtccagtataaaaagactaagactttatgtgaagcagtaattccctaaggaagccaggcggttctgtgcttagagcacagactcagaaagaggcaaatatactcaatgtacatcatatctcttggttaccttgagcaagtactgtggcttcttttagccttgatttcttcatctgtagaatgggcacagtggtatccacctaacaggattattgtgacaattgcaggtaatgtaatttaaagcactactggcccaggggctacaccaatgctcagcaaaatggtggttttctttcctccctctgatagtgacagaagataagataggattttcttctaaaggaaaagtcaatcgaaaattcttttgtcctgaaagtagttaaagaacattccagagagattctacaatatgtttgcaagctacccaccaggcacatgaaccagagcccagtgaaagccatagaggaaattagagaagggagaaagtttctcactgggtgtcagtggtctggactggcttccaggaagagggtaggcagggacctaaggaaggacaaaagccttcttttcactcttagcggagctgtcccaagagcaatggaaatgaagtgagaggacagtacagacctgttccaccagtatgcaaatcatgtaatgaaacacaaatgacttagcaagaacgaatgtgactcacacactcatctgactctgctggttcagaccagaggaacagcctcaagttcagtcggacctttctaaggaggttttgttggaattccacaagaccctagttctgaaggtaggacaaagaaggagaagagaactgcactgacagagtgagttctacatgccagggccttacatacatcattttggggtatgggaaacagacatacatctttctttttctcatatccacaatcagcaatttttttttttttttttagcaacggaaagcgaaatcttaatacaagaaaaggcctttaagattatatacaagctgtacgtagcagagaaaaggttccaatctagttgctgtggctgcaaatcactttctgcggtgtcattgtggggcttgggaagtagtttcagagggctgattctctagcccagaggccttcatgcagatgaggaagtgaatgcagataagccagaatgtcagcagtagactagaagaggtcaagatgattagactttcagsttttgtccagctctacttaccctttcagggcacctaggactttactaaagcccctctgggtattctgatctgggaaagtgtgttttggtctagaatagggggatgacatcatctatcagcagggtttgacttcctttcttgaataagttgtacctgtcttctgtggagtgggaataaatggagcctccagagttacttgtccccaggctccagaatgtactcactgatcctagtgaggcccaaacctgtggcctggagtggcttgtgtgaactgggttctacactggcaaaatccaatccatttgacagcagtgaaattggagtgggatggagaaggtcatcgtatcctttcatcaatcccaaagcctgttgctaccggcttttttctcatatcagatgtagccactggatggaaagtcattgtgcaatctcattctcgactcttctttaagtttcaccaaaacttacttgttttggtgaaattgccacagtcattgagtaaatgtcattcaccagggcagaaaggtaacctggatttctgaaaagtatcctgagtgcccgtcctgtgccggacaggttcctttccatgtcatctcctttgatcctggcaacccagagaaggagatagtactgttctacctattttacagagaaggagactgaggcttatagaagtaaactgaccacccacttagtaagtgacagagccaggactggaatcagggctattgtaccccaaaatgcactttactattgcactgctttccccaaaatcccctgctgcagacaccaggatcagtgctgaccttgaggcattcctccataaatgtgttagttaactgatggatatcagggaacaagctctcatctgcttactgtgatgtctgactgactgcttcccaaaggcgttcttttcccttggctccctactcctttctcattcataagcactcccttcctttctggagctattctgatgactggtctcttcctctcttctcaaattcttatggtgtatttatttttttcttgtattaagctccaaccttaagtatctgaatcaggggaaggggagatgtgggctttgtccggttgggaaacacgcccttcctctgccccacccttgatttccaaggcttgtgatctaagcctgcatgcaggggcagggggaatggttgaaggactcgtaacaagcattttccgaggacctacagatttttcagcaagggaatttagaaaatcttgccactccaaattaagaaatgtgattaaagaataaaatcacctatttgttgagtagtatttcatgctatcctcttgatctacattatcaaccaacctggaccacagcctctaagagagtggttgctacacttattttatatgtgagaaaatggaggctcagggaggttttcctgattaaaatctgtgctctgtctgttatgcaccccacccttgtccactgccaagaatagctgagggaaggccaaacatactgagtacactgcaagtggatgattccttgttcttgaatttgccattgtcctgaagacttgtgttgagttggagctagactaacaccgtcttcatccccatttccaaaaggaggcatattttcatccactggtaggtcattaagggagtagtctttggcctatatagctccaattcactgactttggtattgcctatagtgacccagtcttgcctagagctcttgaaaagcactgagagtgtggtactcagtgctttgcatgaaatcatttaatttttcaccattgcttacagtaatattttccaattgtgattcaaataggtagatgttctctgaaaatagtgattaaaggtcaaataagtattctttccttcaggacttctcagaggctttagtaatcttataagcatgataattgacaaaaataaggatttagtatagaacattcacctatcttttttgaagaaacccttaatattcagtggaatatggtttgggaaagactggcctccaaaataaggtctgggttgcttagtttgacactgaaagcccttcgtgaactaggccctccttgtctctgcagccctatttctcaccactgctcacccaccttccccaacaccctcttctccagctatactgaactatttgaagttttggggaacttctgtggaaggcctctgagccacccctctgcctggaatatatatcccccactcctgcccccttaaacccagcaaatactcattcacctttaggattctggtcaagtatcccttccaaatagtaattgaccccagcctctaacttctttcatagctcctataaaacacattagtatacttatttattttcttgtatccctcaactgtctgctctatatgtcaggatttataaatcctcatttttctttgtctttagcacttttcatagtgcctagcttttttctttttttttaaatttaatttaacgtatttatttatttatttattttgcctagtaccacagatttggtcttttagattatctttagaataattttttccccacatctttttcggatgtccatggcaatctaatagtatttacatatcaacttctgaatttaaaagtttagtgttctaagtaaaattctccctctctgtctcttcaaattgtcctttacctcctttattccataaaggctctatgctatcttcttttacatttttaactggttattatttatatatgagaaaaccattgtttttatcccttgtttagcaggcaacggcctcagtgtgatcttttttgtcagtattcttattttttcctcttaagtttttccaataatacatttttataatttcaaaatgattatamagtagtctgctgtcttccatgtctgcttatttgaaatagtgttccacgtagttgaggattcagtcctagacacttatggctaagaatgattctgggatcttccactcttctgtctcatcaagactggccactggcttgctcttttcttgccaccgaaggaaggtgtccatctgtcccaggaaggacaaactcatgtcttcagcactgccacaggtctatctttaggccatcagccacctcccctccgctctcttcccttctcytgcctctccaagtgctttgatttgtagtcggaagttcctcttgtccacttgcctcttccccctcatttcccaagttcccacaggaacctgggaataggttgtgcccagaggttagaacggaaactgcagcaagataactctgaggggacaatgcccmgttgacgtcatttcaactactttgcttcagctagaggtggttttttttttaatcttccatttttcttcaggttactcttctactccaccctgtctagtgtctgtcaacttctatttgaaaattccctggcattgtctcgttggtttattgtttccttatattctcattcaatatccatagttccaagtggtgacttagaaatgtgtccttgatagagttgctttcttctgaagcagaagcatctcattggggatataataacttcctcttatcattgcatatttaatttccgtgctgacaccaggtagtgtagggattatatagccgtaatccccagggaaatacacaaatgtgttaagtaagttgtcatcaattgtaaaaaaagaaacctttacaagccctggttactgctctttaattattagtttcagtcaagaggaagataaaaggaaactatcatttattacgttcctactatgtggcagtgtgctaaggccatttacatatattatattgctcagctttccctggtttatctccctagataaactctatttttcctattttttagtgtgagaactaagactcagcatttatttatttatttacttacttacttacttatttatttttttgaggcagagtctcactctgttgcccagaccgaactgcagtggtgcgatctcggctcactgcgacctccgcctcctgggttcaagtgattttcctgcctcagcctcctgagtagctgggactataggcacatgccatcacacccagataatttttgtatttttattacagatgaggtttcactatgttggccagactggtctcaaacacctgacctcaggtgatctgcccacctcagccacacgaagtgctgggattacagacgtgagccaccgtgcctagccaggctcagcatttaaataactggcttgaggtcatgttcaaattgctgtatctacaacatgccacccaaggtccagatgatccctgttcgtagaaatgtagtgtgtgtcacctggggttatagtgcatgtgagtggggagtcacttaatgtctgttcctttttgtctcctttctccagctatayctgcaggcccgcttcacttggcgaggagcccgcctgctccggcccctcctgcagttcaccttgatcatgatggccttctacacgggactgtctcgcgtatcagaccacaagcaccatcccagtgatgttctggcaggatttgctcaaggagccctggtggcctgctgcatagtaagtagcatcttgtcctcaatatgcaagtggagccctggactgttgcttgttaaatgtttccagctcagtgactaaagctagagagccctcgttcctgtcctctgcttggtgtctgaagagtcacctggccttaggccttaggccttaggactccttcagtaaaatgagaataattcctgcttcttcccagcctgtgagttttgatctgatagggtctgtaaatctctgtaaatacagaggttttgggctcgtagaatgttgcaattggaagagagctgagatattgtccaacttgctcatgttatagatgaggaaatttagggaagaaacttacccaaggtcatgtgtcagcaggtcatgcttagtgtcatgctaagtctgttgacctagtagcaagatctaagtctcctgactcgagtgctcacatgctgttttggtggacacagtacgcaatgggacttctccgcttcttggaaaatgcctcctcttccctctgtgaccttgggagtgactcacacagaccctaaactcagtgttcattggagaagaggaggttatctgaaggctgagccctctctcagcctgaggccctcgtacatcgagtcacagacttcctagggataacttgggatggaccacatactgatttgccccaaatgaatgggttaccttttcacatacttcatctctgactccaggtgaaggtgggagaaggcattgcacttctctgagcctccatctgtaggcactgcttttcctgcctgctaagagttttgaggggcttattcagcgaacatgactgagcacctactttgatattgtgacttcctgggccctactgaggggagctcaccccagcccagcaggaatcccagagtacaataatggctggatatttaagcaccacacatgtaggttgtattgttgttagtattatccttgctcattcacagtaagaattatgaacaatagagagatctaaaccagcttcttatcctttcctggtttctgagcctggttgcaggcttatgtctcactatgcagcctctccccagctcctctgtaacagcacttaacactctggattgaaattgtcgatgggtgtcttcttttaggctgtaagttcttgggggcagggaccatgtgtaatatatatgttactctccctatcttatcaaggcctctcagggattctagctcagactaagcaaatgtgtgcctaacaagcaaaaagccagaatcaatgagttgatctaacctttcttgagaacactgtaggaagttatttcttgaaggtataggaatgaataaggctcagccctcccaaggaaattccatccttgctcctctcacagccaggccaagcacaggagcttaatgctgtgggggctgtcatagtgacatgtgtagggggcttcagcaggcagggaagcacctgactccatgtgcaggggtcaagaagagggagaaggagttgcagcaatcagagtgggcaccacgaagaaagcagtgtgtgaactgcctgcagcctttgacatgggaatcccagcctactggactggctgttttaatggctttctcccttgctttctttttcttttttctttttaaaagtaaaggccagaagggagagaacctgggggagcaaaccgttaatgagagcagctgtcactgaccggcttgttctctggtgcctggccctttaatgtgaggtgacagtgggggatgggtgtttgcactgaagggtaaccctttgctgactgtgcccttctgagctttgctctcagcaggaggacagcccgygggggcctgctgttgtggttccttcttggcgccactgccctaattggagtcccctgcacccccagttaaaaaaattaaaaggttgggggatccttactagccttcctctcttttatatcctaaaacatgggccataagcaattagacagagcgttcgggaggactatggcttatttccaagaagtgaaatgaaggttctgacttgtgtcctgtttggctctcgctgactgtagcacagtataggaatttgatcctagcgtttacaaagcacctactctctgctggtaccattctgatactttacccattgtcttcctttttttttttttttttttttgagagtctcgctctctcacccaggctagagtgcaatggcacgatctcggctcactgcaacctctgcctctcaggttgaagattcttccccctcagcctcccaagtagctgggattacaggcacccaccgtcatgcctggctaatttttgtatttctgtagagatggggtttcactgtgttggccaggctggtcttgaactcctgacctcaggtgatccgcccgcctcagcctccaaaagtgctgggtttacaggtgtgagccactgtgcccagctgcccactgtcttcttttagtcacattaagccattgtactacagccattttacagaagtaactagctcagagaggtaacttaagtcatccagggtcagagagctaatagacagctgcaccacgattctcatggactcaaagctatgccctctgcactctgcaaggagaaggggtccctgaagctgaaggccctgcagttaacccgaaacagaagctccatagttagctgcttaaagagtatcatttaattgtgtcacggagtccttcctaaccctttgggtggatccagttattgctttgagtttgaaagcctgatttacaatgtaaagatggtttggaaaggggtgataaatctctttccctgccttttactcactcacctgtgaacatgcaagaacagggactcaatcttacytatcatttttctccaaatgcctgacacccagccttgtgctcagtgggacctcatggtccagaatggcttggaatcgcagcactgagagattcatttcattgaagccatctgagaggccaggacagggaagtgcctggaagctgtggctactgagaataaaagtttggaaatgttcagctgggaggaaagaaggtagtgtcttttccagccgtaagctcccaggattctgttgtcctgggtttgattgtgagggagacagaagcaaagctcaggaccctggattgaggagagatgggtagatctgtgaggaggtgtggggaaccagagaccatgtgatgaaggcaccaggtgcctgggagagggaactatgagtaggatgacaggcatctgcctcatgggttttgcagctttatcagggttgtgcaatgtagctgtcacgtgccaagcaggagtctgtgacctctgctctgcttgtgccacatgacagaactcttccccacgaatcagggccgctgtcccagggaatgccaggaaggascaaagttctcttcttactcacaactatggctgtattgaatggtttttgaaacacagagacatcacctgaggttaagaggattgataaaaaagcagcatgtatggcacaaaggccaccacttgaggtgccaagaaacacagaatccattttccagtctgccagataacctcctgagccaagcctttayggactccctgttaattgagttgtaatcttcgctgacatttgctgagagcccaagcactcagagagaaggtagcaaagctggagttgaccccagacagcctgacacagagctggcactccaagacccaggctttggcaggtctcctctcatctctccaccccttcacctcccrgcatgtcaaacatttcaatattttccaacacctgagtttctgtattagatacctgtcccctttgatggaacacagttccagtgtcacctcatctctgatgaaaccttctgtattagctgcctctggctgctgtaacaaattaccacaaatttagtggcttaaaagaatgcaagtttcttttcttacagttctggaagttgggagttggaaaagggtctcactgagctaaaatcaaggtggaacacattccatctagaggatctaaggggagatctgttttcttgctttttctagctttctggagctacctgagttccttgactcatggccccattctccactttcaaagctagcagcatagaatcttcacttctccctctctctctcacacacacatatactttctctggcctttgcatccattgtcacaccttcttctgtgacttttgtccttttgcctccctcttttacagatgctgggaccaccttgataacccaggatgatctctccatctcaagatcttaacttaatctcattttatcatgtagcatcattcattgcttctgggacttaggatgcgggcatctttgggggacattgttcagctttccacaacttccccagtccctggagacagtattgtctcacttccttccagtcccccatggccttttgcactttcttcctaccatggctttaggcctcatctactcatggcctgctcatatgtctgtctcttcagctagattgtgggtgccttaatagcagaatccatggcttaaccttctgattatttattctcggtatgtagtacagcagctgacacaataggtgcttcatcagcattgggtaaatggtgaatgatgaattagcttgtggcttcaggccagacacttcccttctgggcctagtttcctcacctgtgaattgaagctggaggccttgtagctccatgacctttgtgcacagacattctatggcacagctgactttgtagtaactgactgaggtacagtgcattaaccctagaatgctggttccataactgcagagccttaggcaacaggcatgacagccgagaacttttacctgggtctgttgagggtagatcctgtcacaacaggcagacttgtctagacaaaaatcacatgtcaaatggaagtctggtttcctcctccattgcttactaattgaatgctttccagaaaaggaagacaatggaagccagcacagacagaaaacctatacagtgtcatgaactcaacacaaagacacaagcacttagggtcggataggcctgcctgcacaccttcagagatctggacagaggtacacaggacaaaggagaaggccacagcccagatagaccatgaggtgcatgggcagacccaatcgtactcagaaccacagacacacataaacagacagacgaataaaaaaaaaacacaggctcatattggctctcccagccccctcccgcctacacactcactaagttacccctaccaaagatgtgagctttacagttggactcacacagggactaggacgaaggaacagacatcggttcatttcctgtctggtgacaacttgcatatctggtcacctcctccctgaccctctaacagatggcaaattaggggcccctgggaggggtcaggggagggcccggctgccattgctgtgggttcagcagaggaagcagctgctcatggatttcgtaaatacacagcagagtctttcctggttttcctcttcccgggggtgtggctccgcttgccgttgctcttttgtgtgctgctatcttcctccagatgtagggaagggcgagggcgttctttgtctctgccccagtgaggtgaccttgggaaaagacaccagcaagaatgccagtgtgaagaagagttcagcgatgacaacccctgcaaaaggaaactgcagtgcagggagaggccaggacacgcccaaggacacatagtagcagagtaggaaccaaatccccagtttcttgattccatctaaagggctaaacagtaaattccaagcatgcttagccatggatttgcaaggcctcttccttctctaacaggagagagtcccatctattcccttctgatttactccagggctgcctgggcacaggggaatggatgaaatgagctcccaaacctcttctggccctgcagaagtctarctctttgcccagtaatgtgaccttgaggtaatctgatcttgccactgctggcccccactcttaggcaggcagaaacatggatgtgggagagagaaggaagcaaagaaataaactttggccgccaatagataacgacactatctttgtagtactctacaactgttcaaaatacagttgaccttgaacaacatggggactagaggttccgacctccagcacaataaaaagtccaaatagaacttttgactccctcaaaacttaaaactactaacagcctaatgttgattggaagccttactgataacataaacagtcaattaacatatgttttgtatgttttatgtattatatacagtattcttacaataaagtaagctagagaaaagaaaatattatcaagaaaattataaggaagaggaaatatatttactatacattaggtggaagtgatcaccataaaagtcttcatgctggttgtttccatgttgagtaggctcacgaggaggaagaagaggaggggttggtcttgctgtctcagggttggcagaagcagaagaaaatttgtgtttaagtggacccatgcagttcaagctcatgttattcaaggatcaactgtacttataaaacttcctttcttgttcccctgctaagatggatgagctgacgaagcagaggttcagagaggaagttatattcctgccacttgctaggtaggctgtcagggcaagtcacttcacctctcagccaccttttccaatcccatgaggttgggatgataatgcctaacatgatttttggattgaggattcagagaattaaagatacatcatgcttggcacatgcaacatattgattgtgaattgtgcgttaagtactatgctttgtttaaagattcagagctaaaaggagttggtccttaaagagcttatctagtgcagtagctttccaagacttgaccgccatctataataagaaatacactttatatcataacccaatagaggcacccacacgtaactaaaacaaatatttcacaaaataagacttgcccttactgtgtgagaaattctgatattttctattaaccttcaaaaatgctggtggtaaccacctagttagttgattttgtagcttgctaatggcttgagaatgatctagtaggaatagacatgtaaacagacaagtatgatagaagggcacggctgctgggatgggatacactactgaggacagtggggttacaagagaaggggtgattaattcttcttgagggtgttggaagactagaaagaatttttagagtaggtaattatttaaaaatgaatggtcatttgctgtaagatacaaaagataaggaagggaattccacgcagaaggaataccatgaagacatggcgatgggtgagaacatgatatgttttgtgaccctagaaatgcagaacaacraaacttgggggataatggggagaggtgacctcaatgaatagtagcctcattctccctttcagcttcaaaattggatggtttctgggaatggggtcccctgcctttgttgagccttggtcatctttgggtactatgttcctaagctccagctcctactgcatttagcaccccatagacagagctgtcagtcccctgggtactccttaccagacaccctccctaatagcctatgaatattttcctggaaggttccttggcatagattcctgttctccatcagtattgcccacaactttctttaaagggcgggggcgggtcttcctatgttgcccaggctggccttaaactcttgggctcaagccgtcctcccacttcaacttcctgactagctgggaccacaggcacacagcagcatgctccgcaaaattgctctcaactttctttcctcctctaaaccctctttgttcattttgtgggactacttttcttcacattcctcaatagcagtgatgatgtgaatagtccttcataaggctgggtgcgtagtggcttacacctgtaatcccagcgctttaggaggccaaggtgggtggatcacttgacttcagaagttcaagaccaggccagccaacatcccgtctctactaaaaaaatacaaaaattggccaggtgcagtggtgcacacctgtaatcccagctactcggaggctgaggcacaagaatacttggactggggaggtggaggctgcagtgagtggagatcgtgcactgcactccagcctgagcgacagagcaagactctgtctcaaaataaataactgaatgaatgaatgagtagttcttcatagctacaaagtgttttcacatatattccatgtaagccttacaggaaccacaggtaggtggattttttttggttttttttggagatggagtttcactcttgttgcaggctggagtgcaatcacagctcaccacaacctccatctcccaggttcaagtgattctcctgcctcagtctcccaagtagctgggattacaggcgtgtgcaatcatgcccagctaatttttgtatttttagtagagacagggtttctccatgttggtcaggctggtctcgaactccccacctgaagtgatccgcccacctcggcctcccaaagtgctgggattacagctgtgagccaccgcggccagccggtggattttaaaaataacatttccacacaaatacagggcagacccatcatctgcaactataaaaccttttaatcttgtataaattcaagacaagtgtaacagcttggatcacacaccagtagaaattttgggactatattctgctgtctgatttccagtgtcacactcttttccacctcatcattttccctctcagttatactaggaagtcactcaacagaaatgctcacaaattcccagtgccaaaagccgctgaaagccctttattgaggtcaaaaaataatgattgcagttggataatcccatctagttaaaaaaaaaayggctgccaaagatggcttttctttagatagcacttactgtacttagggcatgagggtgagccaggtcccaaggctttctcctccaaagagggttattccttccttaatccatgagattgttcagtatggtagaccagaaagctaaaaggaaatcccagggccaaatcacatgggaatgcatgcaaaaggagcaacagccatggtctttacgctcacatggtggagctctattaagagctacagtttttgaactctgaaaacagggatgactcaacacratccatgcccttgagtagctagctcagtctagaaggggaaatatgacacagcatttaaagcgtcacgtatcaaagcctacggcctaacactaagatggaaggttattaaagttcaatatgggtaccaaagagagaagagaagggtggttcaagaaaggtaatgttgtgcccagtgtagattgtctaagacacacagccatgcaatggcagatctaggatttgagcccatctgttcatctccacagattgtccactaatggctcttttaactgtactctggataacaaataactgtagtgtttgctaaaatgcagattccagattctcagtaggtcttagatgggcccaggaatctgctatttcaggaagctcccaggtgattctgaaacagatggtttgaggacaacactttaagaaataccagaatagatgatgctcaattttcttgaggttctaagattctaaaattcttctgcttttatagttatctaccctttgctagcattttagctcaatgtgttacgtaaggatgggattcctattttcaaggagttcacttacactcagggaccctaggaacatttaaaggataattttattgtcataatctgcccttaacaaaattaacaaaatgaccctcaaaatttgctgattcagccattcctagcaatgaaaggaggaacctggctacctaccagacttcttatttctggtgtacttggttcttggtgacctctaggcaggcagcaccccagcagggctggactgtgtgtgctccctggaaggctgacatttccggagtgtgaatgctggcagtaagacatcggaagcatcttcctctttgagtgtgccaactcttggccaaagatagctctagaaattgtaagaactttgagagcagattctgtttgtcctatagaaaactcccatcagcatattgcctctacatccagctagaatgtgtcagatttcacatgttcattcatagtctcaaccactcttttttcccccctctctttttatctttttccagttttttgtttgttttatctcttcatcacggtgaatggggttcttacagcttagagttgtcttgtttgtgtgtactcatgctcttgaaggaaggggctacattgtccacagtgcttgggtaaattagatcatattccaccctgggatcacagaacagtttactccttttgactcaggaggaggtcagaatcacttccccacagataaatccatagaaacagaaagtagattgatggttaccaggggctggggagagaagggaatgggacatgactgcttaaagtttatggagttttattttggggtaatgaaatgtcttggaattagataaaagtgatggtggtacaacactatacagtactacatgccactggcgtggggggcaatcactcccccaagacaatgtcacaggcataggaaagcagagttatatatatttctttcctagcatagttatcaaaattttaagagtttttatgggaataagtgcaaagatttctagagttgaaaacagaactagaaagaaaaacattgcctccctcgcacacatacccaccccaaacatataacctctatcagctgcagtcctgtcctcaacatttcaaaatccatctcttcttctttgtctttactgtataggtgttgttcaggactcatcctcccctagactctgtaatccctgcctccaggctcactgcatgctttttgactccgtctccattttagttaccaacatgatttttttttttttttttttttgtctgagacagagtctcgctgtctcgcccaggctggagtgcaatggcaccatcttggctcactgaaacctccgcctcccaggtccaagtgattcttccacctcagcctcccgagtagctgggattataggcacccaccatcatgcccacctaatttttgtacttttgtagagagggggtttcaccatgttggccaggctggtctctaactcctgacctcagatgatccacctgcctcagcctcccaaagtgctgggattttaggcgtgagccactgcacctgacctccaacatgatcttaatgcaggtctttccaacatgttgcttccctgctttcaccttgacaatgattcctagggccaaaagaatgagatctgaacttttaacatgtcccaagacgcttttcaatatctagtcctctcctctccagcctctttgactgctccgccttagatatactgagcttcctgcagctcctggatgtgctgtactccctttctcctgtacctttgcacacactattccctttgcctataacatcctagcattcactgcctggttaactcctccttatccttcaaagctaagatcaaatagacaacctttaggagaagccttctaaggcctgcttcccactccccttcagtctgggttaaatgccacattctctgtgcttcctcaacacccttgcttccctccatcataatccttaatatgctgtattgtggtcatctgtttacctggctgtctaactcattggcctataaactccttgagggtaaaagactgtcttatatatattcatcttcatatttttggagtttaacacatagcaggaatccaataagtatttattgattgcattcattcattttccaaaaaaagagtaatttataaaattcaaagaattggagaaacggaattgaaaacaaatgttctgcgcatcgtaacttagatctcttctctgtgcttagggtatagtttttcttgtttgttggaactgtatttattgtccagtgtgtcctttcacacagcagagatctgtggagtaggattgtgggctggcagtgggtttatcccacagacctaagacagctacttaatttgtatagacccttcccagcctgggcctctgggttttccttctgggtggagatcatcttctgtaggaaatggaactgcttcaagccaagaagcttttacttttactaggtctttttgtgtcctgctgttcaaatattaggaagactgaaccctgtttcggtcttgacagtattacgtttcgtgatcccaaaaaaaagtgtttgtgtaacctcaagtcatgctgaaagtgaaatacagcttaaagtgggattctgctggacctgactcaacttttcacctcaccgcttggctccgtgcaggcagtatttgagtatgtggttccccctcaagtctgtaggagttgtattgtcaataaagtccaaggccagagtgcttgctttctagtaagtagagagaatttttgaaattcaacgacaaacatttattaagcccttattgtgtacagggctcaaagctaagtgctttgggtgattcagggtgattagggataggattccatcttcaagaagcctcccatctaggaagaaaggtcgataagcatagttttggacacacgggagagcatggctttctctgggcccagtaattactttggtatccagatcattagagaacggaatgccttctattgaactatgtaacagtcacaggtttagatcttctcaagttattattgcctttaatcttcatatgattcctatcctgcagttaggaaatggaaaccctaggatatagtgactgtgagctcagaaaattaggttgggagataagccagtagattgaggtggtagattcttcaagatcttgaaggggggaaggtgggggggggggacgggggagctgttcccagctatatttgcccttggcagatgggatggattctgggagaaagctctaagaaattaggcctgtacgacttattttcatgaatctagctgctaagctggaataagtgaagttaaaagtagtgatgggccaggcacggtggctcacacctgtaatcccagttctttggaaggctgaggcaggcggatcatgaggtcaggagttccagaccagcctggtcagcatggtgaaaccccgtctctactaaaaatataaaaattagccaggcatagtggcacgtgcctgtaatcccagctactcaggaggctgaggcaggagaatcccttgaacctgggtggcaggggttgcagtgagctgagatcgtgccactgcactccagcctgggtgacagaatgagactccgtcttaaaaaaaaaaaaagaaagtagtgatggggagggattgatcaaaacctcttcctctgagacaaagtgaaggataaaggggaggataattttgagctacagatgaggacattgttgtctgcacctctcagatgataacatcattttagtacaaaaagaagtaaggccactgggggagataagggaaaatgtggagctggggctggggctgggcctggggcggagaagagttgaaaagtttaattatcttctcattgaactttaatcgagtctgtttccttatactggggacacttgaaaacagtttcccaaaccaactacaaagaattttctggcaggggagcctagagcctactggcaggttgtgcacagatcttttctttcctgatcctcaagtttgactctgactaggagacaaatcttttggtaccatggttttcactgttcaaacctcctgacaaaagaaagggagaaaagacttaactttttcctttgcaaagtggtacatcaatagcactcaaactgtgaatgtattaagatgttacacttctcggctaatatttcattttcttgtagtagcatagaaatagcctagctttttttttttaacaacaaaataatacttattatatgttttggtaggtaatatatgcaatgggtacaaaattcaaaaggtacaacaggttttacagtgaccagtaaatgtctgtttcacctttgccttctagccacccagttcccttctcttgaggtaacgagcatcaccaatttcttgctgtgatttttatagcactttcttgattgccgtgttgctacagaagggacactgtgaaaatgagtttaacaaataattcaagtccctactgtggccaggccctggatcgccagagccttagttttggtaaaatcttattaagaacttcattttcttgcctataatgtggccagagtgaaaccacagtgctgtcattagtagtgagcacattaccatctgcaggacaaagactcatcaattcagaaggctgttgggtgtagaaactttgatagtgttttagtcgctattttgaaatccagccaagtgtttcctattaaattacatgactgatagctgccgcttatggttacttagtaaaaactcctgttgctaaatggctcaaatggatgtctgtgtgtttattttgccatctaatacaaagcataaatttytcttactccagtagctcatcaaacccttgaatctttcatcataagcacattgaggcaggaactatgcctgtgccatcctcacacctttgcaagtrgcactcaataaatgtttctcaagtattgttcagactcagtgaggtcacatccccaggaggaaaaaggacgctgggaatgagtgatacgagatttgtcattaaccgttcctccacgtttagttgccaactttctcagcaacgagaacctggtttcttgacccccgtcaaatggttgatatcactaagttttcaggaaaaagtagttaccactgcctgacttcagctcttgctgataggagttcatgttggctgatctttttcggttacaccctggattcctttgtgaggaaagggaaagtagtgtgaattaatgactatcactaattatgacctgcttcctttgttgaggaacttatctttcattgctattcgtttgccttgagaaataaggaagtatgggttgcagatatgggcaatggactgagagtccttagaagtggattctactgaaccagtgttgtgcaacctgggacatgtcactgccttttcccgggtctcagtttccctatctgtacaataaaccttgatgatatgatctctgttgtccttccctattcaaagagttatgatttggggccccttttcctgaagtctgcgctcctctgaccttccttttccctctgtacccagacccccgatgtcagttactgacttcgatctctgatttgtgcttctaggttttcttcgtgtctgacctcttcaagactaagacgacgctctccctgcctgcccctgctatccggaaggaaatcctttcacctgtggacattattgacaggaacaatcaccacaacatgatgtaggtgcyacccacctcctgagctgtttttgtaaaatgactgctgacagcaagttcttgctgctctccaatctcatcagacagtagaatgtagggaaaaacttttgcccgactgatttttaaaaargaaaaaaaaaatgttttactatgtggccttccaaaataggtagtgtttgcctatgtggaaacaacagcaaactaacaccaagtgccagagtcctggatgtgcaattggtttaagtgttcatgttctagtgaacacagcttgttcaggaacaaacactaaaacgatttgagtagaggctgctggtcaccttttgtgacctgaggaatcccaggcctgtgagaaaagcaaaaattcacattgcagcacatgatgccagaaatagcactgaatcaagaaaatagccattgcggagctgccctcttgagtctttctgtccatcccattctattctgtactgtgacttyagttcaggaagttttgttttgtgttttaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcatcctgtgatgttgaaatgtcarttgcaggatgctgatgttgtgcacgtcaatcaccgggcacttgcatactcttagaaacagttcgacttcggttactgccttctcccttgaaatccttgctgcgtgcccaccaggatttcctgtgagggcccgggaatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggttacccttcaggatgacagagctgagggtctttgtaggagttgctcttgctgtgtaaagcactattgtcttggggttgagccctagggcagttcttggtaggttctgctgggcagaacatatgggttaaatctcggtagagagttttcctcatcctctatccgtaagtgtccttccatgcaaggtcccactctaggtgatagacagggaccccttctactgaacctttgaggaaaggaggaaggaagaaatgcgtttagatcttggatgcagacctttcaaagggttaaatgtaaccatatggatcaaccacatgcacatccttactacagaatccgtcctttcatttcaacttatagcaagctatgatttttatatataaatattatataaataatgtataaaacattaaaagttaactatgtaagatattatttctgaaacaatttagctatatccactatgattataaactgtgtctcgacctgtgttatttacattagctgcttaaaaaagcattgagttaattttttwaaatatcaactaaaatatcatagttctgtggtagacattgttttataatgaaataactgcaactagagaaaactgtataaaaacattaaattgtcagtatttttgtaaggttccattttgtaaagagaataatattcaaagacttttgtagcatacaaagtgaaaacttgtatctgcgaaactatacttgtattaaatgtgctttttaaataaaagctcgtaacacaactaattaaggacttgcaagcctggagtgtttgagagatgtttgtctcaggtgtgtgggtaggagaaggaagcatcgcgggctggcctctttgagtgggcttgcctcatctcagcgcaccaactcctgatttttttcagtgggaaatgtggtggtcatagggtagataccgatgtctgccctgctctttcatctctgaaagcctgtttgcagaatgaggccctggctctaccctcatctcaggctcttctaaagagcttttgtattctaaagaggatttttccatcagagaggtaggagctgtaggaaccccgarggcagataagcagccctcactctagataaggtatgctgggggagcttactgagggaatcctgtacacagcccacatcaaaggaaggctgagaatggcctgtggctcctgcttcccttccttgtgtttctccaacctggaagaaaaggggaagctagaaattcacatttattgagcacctgtgtgccagggatttctgcctatttgttctgtctgatcttcacagcagttattttgagaaagaaagaatactaaagaatgcaaagatgaaatgattagtctaagatcctagagcattaaattgtaggataggtcttatattaatttgctatagcggctataacaaattaccacaaacgtaaaacagcatagatgtattgtcttacaatcttggaggctctaggcaagaagctgtttccttgccttttctgtttttagaggccacccactttccctggcttgtggccctcttcatgttcacatggaggaagcaacattgggtagagtcctcaccctgccatctctttggttctcctcttctgccacccctttcacatgtaaaggccctccttgctgattacacagacctgctcataatctaggataatcacctatattaaagtcagttcactggcaaacttaattcaatctgctgccttaattcctctttgccatggaacatatattcacagatgccagggatctaagacatggccatatttcgggaaccattattcagagtaccagagttcaccctctggccctcaaaagattcacatccatcccaaatgcaaaacagatcaccctatccccacatcccctaaagacctaggatatggcagtatcaagtcaaaatcctaaatcttaacaacttaaacaccccaaatctcatcatctaaactaacccattcaaattaggtaaaaaggaggctccatgtttaatccaccctggaatacattgctctctatgaacctgtgaaaattaagaaacaagttatctgctccctaaattcactggtgaaacaggcatagaataacagttatagacattcctatttaaaaagggagagaagccaggcgtgatgtttcactcctgtaatcccagcactttgggaggccgaggcaggcggaccacgagttcaggagattgagatcatcctggctaacatggtgaaaccccatctctactaaaaatacaaaaaaattagccgggcgtggtggtgggcgcctatagtcccagctacttgggaggctgaggcaggagaatggcgtgaacccgggagggggagcttgcagttagccgagatcccgccactgcactccagcctgggcgacagagtgagactgtctcaaaaaaaaaaaaaaaggagagagagagagaaatagacggaaaaaagaagtcatcagtccccagcaacttcaaaatccagcagggaccaggcatgatggctcactcatgcctgtaatcccagcactttgggaggccgaggcaggcagatcacttgaggtcaggagttcaagaccagcctggccaacgtggtgaaatctcatctactaaaaatacaaaagattagctgggtgtggtggcacactcctgtaatcccagctactctggaggctgaggcaggagaatcacttgaacccaggaggcagaggttgcactgagccgagattgcaccactgcactccagcctgggcagtggagtgagactctgtctaaaaaaaaaaaaaggaaagaaaaatccagccagggatgctccatttggcttcaaggcctggaaatagacccaagtggctcatgtctggtttcttgccaccaaggtcagcctgctctttgctgctggacaatgcagtcccctccagcccctggaatagctcagcaatttcacagcatttttatataagtggtgatgtccgtttgagccccaaaatgtagctagtaagatccttaaggccagaggccaaattttcacttcaaatctgaagaaccagtgtccagaggggcagaacaactcttgttggtgggggtaggagagggaaggcacccagggagtggagggactggtgagaccagagcccaagcctcctgatccgagtaccccagtctttccattttatcttccaacagtacttgacaaaccaaacttgagaagtagccccgtttcatgcggacttaaggaaacaatggagctgcgtggtattgtgaggagcagcatgatgtggagaaggaaacaaggacctggggactcagacccaggttgcagtcttggctctgacacttcctggctatgtgatgtgactttggacacgtttcttaacctctctgagccttgggttattgctcgttaaagatgagatttacaagatctgtttttatacctctttgctcatggcagtctgtgagccttgacttgcttctttaaatggggttcacggactaacaacatttgtatccctggggagcttggtagaaatatagacctaggagaacccctgccccaccccaacctacagaatcagaatcttcctttgggtaggatccccaggtgatctacatgcacaataaggtttgagaaatacccccactctttgctcattaaacctgcagactctgttcaggtgtgcttcccccaagccacactcctccggggcttggctsggagcatgctgggtgcagacatcggtaacctcttagcttaatgtaccaaaattgcatgcataaagatctgtatcaagactgtcagattctcaggggcagaagcaagtcttatcctctgcaaatcctgcatgtctgcctggcactgaatagttcccggcaattttgaaccaattaatcatcacccgggtcaaaaagtcacatgattcttggtaaccatccaattaaacaggctgcagggacatagagaattgcaaaacattgaccctgtccttaggaattaatgaggacttaaatttcctctgaggtagagatggaaaaaaacaaaaactttaacagctagaaatctgcataagattcctgccagttagaataaattcgtacattcattcgttgattccaaagtatttccaaagaactgtttatgtgcaaaatcctgacgcaggtactttcatgcagtctgcttcatttaaatcttcaaaaaccactgttaaagtagataggattggggggaaatgaagagaagttggttgataggtaaaaaaatacaattgatagaaggagtaagttctaatattggatagtatgttagagaaattgtagttaacaataatttattgtgtatttcaaaataactagaagagaagaattgcaatgttcccaacataaagaaaagataaatgttttagatgatggatatccccattaccctgatttgatcattgtatatcacacacatgtatcaaagtatcacatgtactccaaatgtttgtacaactatgatatatcaataaaaaaatacaaaataaaaaatgtagctatgaatagtctcattttactgagtgagaaactgaagctgttaagaatcttgtttcagttcacacatctaatatgggatagatctgggattctgatctaaatgacttcaattatccattgactaatatttattartcacttcctgtgtaccaggcactggtaaacaccagaagtaaaacagtagataaaatgggatgccagcttcgaggagcttatagtctaaagacgaatacaaacagtcaaattacaaatatgtaattaagaaatgggatgagtgttctgaagaaagaatgcaggaggagctatgagagctctcagcaggaggacctgctattgaggagggcttccctgagacccacctagagctaaagtctggttagggcactgacccaacaaaatgaatgaaaagagcccggcctttcaggagccgagagcctagaatgtaggtctagtaaataatgagtaaataatcccagtagtgtgatggggaggaggggcctttatgaagtgctgtgacatggaaggaatcagaaagacctggacctggccgggcacaatggctcatgcctgtaatcccagcactttgggaggcccaggcgggcggatcacgaggtcaggagatcgagaccatcctggctaacacggtgaaacctcgtctctactaaaaatacaaaaaattagccaggcatgatggcgggcgcctgtagtcccagctactggggaggctgaggtaggagaatggcgtgaacctaggaggcggagcttgcagtgagccgaaatcgcaccactgcactccagcctggacaacagaacaagatactgtctcaaaaaaaaaaaaaaagaaaagaaaagaaagacctggatctgctccctaccctgtgaccctgtgtaagcatcccttctagaacatctgactctgacaagaaatgtcaagtttgtttgtttgtttttgcataaacccctctgatatggtttggctgtgtccccacccaaatctcatcttgaattcccacgtgttgtgggaggaagccggtgggaagtgattgaattataggggcgggtctttcctgcactgttctcgtggtagtgaatacgtctcacgagatcagatggttttaaaaaggggagtttccctgtacaagccctgttctcttgtctgctgccatgtgagatgttcctttcacctttcgccatgattgtgaggcctccccagacatgtggaactgtaagtcccataaacctctttcttttataaattgtcccatctcagataggtctttatcagcagcatgaaaatgggctaatacagtaaattggcaccagtagagtggggtgctgctgatccaggcctcctgcttttttatttttttgagacagattcttgctctgtcacccaggctggagtacagtggtgcaatctcatctcactgccacttccacctcccaggttcaagcaattctcctgcctcagcctccctagtagctgagattacaggcacgtgccaccacgcccagctaattttttgtattttaatagagacaggatttcaccatgttggccaggctggtctcgaactcgtgacctcaggtgatccacccacctcagcctctctaagtcttctaaaagaaaacaacaaatgagtgaattatcagagataaatattagtatcagggaggctttggtggtattcttttgattctcaaactgtgtaaataataagaacaagagagacaacctatttttaaaacttcataacaggatatacaagtgggagataaacatataaaagcatgctcaactttttagtcatgggaaaatgcaaattaaaattacaatgaaatatcattgcatatctatgatattcttgtctaaagtcaaaaaacagaaaacaaaaaacagcgagtggtaccaagtgttggtgtggatgtgaaacaactggaactctcattcactgctgctgggcatgtacacttgtactatcacttcggaaaacctttccagtatttactaaagccaataatacacacacgctattctccagaaatttcactcctaaaatacatatccaacagaaggaaatatgtgtgcacaacaagacatgtacatgagtgctcatgacaatactgtcccaaactggaagaaacccaagtccccattcacaactgagcaccaattaaataatggaattaaatattcacttgaagaaatactatttag

SEQ ID NO: 12371 - DNA, 43633 bp, Homo sapiens
tctatatatatataaaagtatcattaacctcactttacataggagaaaactaaatttaagtaatttgcgtaagattatactactagtatatggcagagctgaggtgtttttaataaggaaatattgtttttggctagagttagaaaaaaaatttttttttgagacggagtctcacttttgcccaggctggagtgcagtggtgcaatcttggctcactgcaacctccgcctcccgggttcaagcaattctgctgcctcagcctcctgggtagctgggattacaggcaatttatattatatataaattatgttatatataaattatgttatatataaattatatatgattatgtatatttatatatttgtatgtaaatataattataaaatgtatatatatgtgtgtgtatatacacatatacaaatacatatatatacatacatacatatacatatatagcttttgagaacttccatggtaaacattaccttacttctggggttctcaaccatgggcaattttgcacatgcccatccccctacttagaaggaggtgttacttccatctagtgggtagaggctagagatactgctactcattctatgatgcacaagccaatcctcacacaaaagttatatgacccaaaatgtcaataggttcagaaattcttagttttacgtaataaaataataaataaataactccatcatggccatgaccatgtccatcttgttcaccatggtatttacaccacatagcacagtatgtgacatgtcaatggcacttaatatgtatttattcaatgaatgaatcaataagtttaaagtataataccaaattctatttttttaagatggagtcttgctctgtcgcccaggctggaatacagcggcgtgatctcggctcactacaatctccgcctcctggttcaagggattctcctgcctcagcctcctgagtagctgggattacaggtgtgcacctccacaccctgctaattactgtagttttagtagatatagggtttcaccatactgacgaggctggtctcaaactcctgacctcaagtgatctgcccatgttggcctcctaaagtgctgggattagaggtgtgagacaccgtgcttggccccaaattcttaaccttctactgtttaatgatacatgtagggggaaaggtaaatgttcctatcttctgttatgacaccaagtgagaaaaggttttgactgcattacctggaatccctccttagcacattaagtaatctccttgtagaaggtatggagctgcctctcttggatatacttatttttcagtgggattcctgtataaaaatgagtagtcttatatgctgcagtgtgaattacagtgttagaggagaggccagtagaaagaactgtgaagatgtaaaatatggaaaactaattttgtctgagagggctggggaaggtttttatggagaagccattctgcagctagatcttttgggatggagcacatgtaaagggggcatatgatgcaaggcagggattaacataagatgcacttggaaagggagacagacagaggcaggctgggtaaggccaacacgaagctagtagtcagactgaaaactcccatgagggacaagggaaaacctgcatagagacagtaacaatgtagatgaaaaggagcattcacactgtctatgacaatgcaaaggtagaagtactggtaaaataaaaactggcttaaaaatgacaatcaggagacttagcaccatacttacccccatttcggttctggctcttgatttttcgatagtcattgtacaaaggttccaagtacttgtagcaatcaattgcagtgcctgtcagcctcatgtaaagtgcccccagcatgcggacatacctgagagacagatgacagtgaaacaacaggccatcctagaagttcctgagttttacaactagctgttctcatgacagtagtggataaacatgttcttctctttggcaggtaagaaagctgcaattgtggaggtagaatgcagcagaagaaagacagctaaaatatggagacctgagttcaagttcccatgctaccatttatggctgtgggaacatcatacatattgatcaactttcaaatatatcatcagtaaaactagaataaaacctatttacctcacaggattactctaagaatcaaaagaaatactgaattttattttattttttaaggcagagtcttgctctgttgcccaggctgcagtgcagtggcacgatcttggctcactgcaacctccgcctcctgggatcaagcaattctcatgcctcagcctccatgtagcgaggattacaggcgcccgccaccatgcccagctaatttttgtatttttatttatgtatttatttatttcttgagacagaatcttgctctgttgcccaggctggagtgcagtggcacgatctcaattcactgcagcctccacctcctgggttcaagcgattctcctgcctcagcctcccaagtagctgggattataggcatgtgccaacacacccagcctaatttttgtatttttagtagggaccggttttgccatgttggccaggctagtctcaaactcctgacctcaggtgatctgcctgccttggcctcccaaagtgctgggattacaggtgttagcaaccatgcctggcatatttttgtatttttagtagagacggggtttccccatgttggccaggctggtcttgaactcctgacctcaagcaatccacctgccttggcctcccaaagtgctgggattacaggtgtgagccaccacacctggccatatattgaattttaaaacagaaagaagatatatttaataacaatacaagaacaagtacacataaacatgactgctggttttggaaaaaagtaagtcatctgggttcaaattctgactccgtaatttactaagtctgtgacactactggtcaaatcatgtgttttctcaatccttgtaaaacggagataatgctacctaatttatggcttggtatataaacaagaaatgcattgaaagtgctaagtatagcacagagcacacagtaagtgcctaacaaaagttaggtattttctagctgttaatgctttattagagtcgttccagccaggggcggtggctcacgcctctaatcccagcactttgggaggcgaggcaggtgggtcaccgggtcaggagatcgggaccatcctggctaacgcggtgaaatgccgtctctagtaaaaatacaaaaaattagccgggtgtagtggtgggcgcctgtagtcccagctacttgggaggctgaggcaggagaatggcatgaacccaggaggccgagcttgcagtgagccgagactgcgccactgcactccagcctgggcaacagagcgagactctgtctcaaacaaaaaaaagagttgttcctcttccctttttcctatatctaactacttaaatttcctcttgggtaactaggaggcttttgaaagtcatagtttctttgtacgagaagcagaatactgtagcaaagaatatgaactctgaagccagatttgccacttactagctgtttgaacttgggcaaaattaattaatctctgtgcctcagtttcctctcctgtagaatagggattaaaagtttagaaggttgttgtgaaagtgaaatgaattattatatgcaaagcccttacagcatggcacataagaagctattatgtctgtctcctatacttgtttgtgatttcctcgagaatcggtaatacggtaataagctgacattttctaggtgtttaccatgcagcaagtgctgtgttcagagatctgcatgcattacgttctttcactcttatattatagtcaccattttacagataagcaaagtttagaaaattaagtaacctctccaatgtcatagttaatgggcaacagaatctggatgtgaacccagatcttacacctcttaaccaccaccttttgttgtttgattttcacccctgagcgtccagtgcctaccaacatatcaggcactcacttttgcttaatatgtatttagtgaatctgtgaaatcctttttcagggaaaaattaccaaaactgagaaagtaaagtagaagattaatacaatcagaacagataaaatacaaacttggcagggtgtggtggctcatgcctgtaatcccagcactctgggaggcccggggggggaggggattacctgaagtctggagttcgagaccagcctggccaacatggtgaaaccccatctctactaaaaatacaaaaattagccaggcgtgatggcacatgcctgtaatcccagctactcgggaggctgagacaggagaatcacttgaacccaggaaatgggggttgcagtgggccgagatcgcaccactgcactccagcctgggcaacacagagagactctgtttccaaaacaaaaaacaaacaaaaaatacaaactcaagggctcaaaagcaaaaatctggagtggaactctctagaaatgagatacattgtgtacacccctcttaaccaaagcccaattctaaaccgccaaaattaaacctcttatattagctagtgaacattgcactcacttgaaatcttcatttttgataaactctacaatgatatccttctcgggttgaatttgaagcatcttcaaggttaaacacagaaagggtgttggttttatgttgccaccatagacrccacccacaaaccttaactccatggctttatcgactacaagttcagctaaaaaacaaaaacaatacagtaacatattagggctaagctcttcctagttggagtggagttagttcaagctttggttctcctaaatatacatcaacagtgtaatattaggagaacgaatgtgtattaataacagtaacgacaacagctaatatacattgagaatggataataaaataggtaccctgctaagcttttcatattatctcacttaaccttttttaacaagtcatgaagaaagttctagcaatgttcttatttccaggtaaggaaaatgagggctaagaaaggtaaagtgacttgctcaaggtccacagattgtcacaggacatggatttaaagccacaattcaaatcggaagattacctggaagacttctctgaagcactgatatttataaatactggaaccggcccagatctaagaatagtaagatcatgaatttggtttcaggcatattaacgttaggtccttaaagaccttcaacagattgtgtcaaagtgttatatccggatccctgagcttaacactgttgcaacccagcctgctatcattaaatacggaataactcacaacacccaactgagacagccttcagaatatgaccttaccagattcatctgtgcctctaatactcaacacaagacgaggcacttagcaggcactcaaaatttttctgaatgatcgacatactccgttccagtaccacccccagaggccagtcgctagtcctacccgcgctcggtcaggagaaatgggccacaagggggctgagaggcgctccgcgcgcttccacttacctgtaagtccaaagcactcctctttccagtacttggactcatagattcgcgttcgaatgatcttctccaccagatattgagggttggtgccatggatgctgtgcgcatccttcactgtacggttagccattttagaatgccttcaattctatttccgtcggatcctttaatgcctcacatccaggttcagaaaaagcacctagaggaatggagaaaggtggaagaagtttcactaaacagcttaggcgaccatcttgaagccggaaacaccgtagtgtaaagggcttccgctccccgcgtcgcctatcgaatcaatgatggcggctgcatgttagcggatgtacgtcatgcgcccctcttaggtgtacggartgggcggggcgagctagttggygtcgcaacgaagggacggtctgggggcggggccacgccgattggcgcgaagttttcttttctccttccaccttcttttcatttctagtgagacacacgctttggtcctggctttcggcccgtagttgtagaaggagccctgctggtgcaggttagaggtgccgcatcccccggagctctcgaagtggaggcggtaggaaacggagggcttgcggctagccggaggaagctttggagccgggtgagtgtggcgtccagcgggctgcgagggactcgggggagggcgcatcggaacctctgaaactgaggacgttctctgtagactcagtcattgattcttttagctgacatgtaccaagcgcctgttcagtgccaggcactgttctgaactgttaagagcgttcctctgttccacactccgattcctaaaaggcttcccgcgctgcagggaactgagtttgcaggggggaaggcggaagccaacagcctagaagcaggagcattcctgccctccgcaccctgatgctcagtgatgactttccctccatctgcatttgtaaagcactctacttgtttcgttctttgagctatagtgtaggaaccactacagggaaggcggagcagaggttattaccccattttacggacgtaaattgcgcccagggagggacgtgtcttaggtcgcttttcgtgactaagcagtctgggctcctacccagatctttttttcagatgagctcctaactgctgggctgtctgtcattcaccttcttttcagaagagaagtctggtggcccccttcctacttctcttttctaaccccggaattgaagagtcttctgctgtgacagttggaaaaggcattcttatcctgatctatttgtgaaactgcaatgattatatacgattctagttgtctgtaacacatgaataatagtaccctcgtctctgctgtgttaggtgggctggaaatgccaaaggagtttccaatatgacagaatggtttaagtccctttgcaacagtttttaactttaatggagggcaatatgtggactttaggaggtttgtgaatctgccgaaattgaatgcaaaattttgcttgaattatgttagttccatagtattcatcaaatgatacttaataaataaaaccactgtaccttacaaataaatgcaagggattaaggtagtgggaaagtggatttaccattttgcattttttcacttaatcttccattatcctaaaatagtgcctggcacacgatgggtacttaataaatattggttgaataaacggaagattctattttctccattttgtgggtaagcaaattgaggcccaatccacaatgttcagtcagtggctgggaagcctgatttattgtaataagtacaccaaaagcaagctctcagttacatattaacattatccagtttcacacagtgtgttgtaaggtgaagtagttaagagcacagtaattgcagtctggcttttccgggtttgagttaaggctgtgccatcctgtataagataggataagttatcaccttgaagtgataataacatctacttttcttttttttattttgagacagagttctgctctgtcacccagactagagtgcagtgttgcgatctcggctcactgcagcctccacctcccgggttcaagtgatttgcctgccaccatgcccacctgatttttgtatttttagtagagacggggtttcaccatgttggccaggctggtcccgaactcctgacctcaggtgatccacccacctcagcctctcaaaatgctgggattacaggcgtgagccactgcgcccagcctttgtatttctgttttatccttgtgtgcattttataagcgtcatgaagacatttacaacccctgtatcactgtcttttaatttcactttgttagatrttttacacctattgttctgccttattcctagtatttctaaatgttacagtttcatttcttaggaattgacctttctgttttcctggatggaaagagatacggcatagtacaagatggacacagatgatactaaattgcctgtgtgtaatcttcgtagaccatgacttcaaataaaatgttttcttagtctaaaatgtatgggagtgtagcaggggcagaaaataagtctgatctcatttgaagggagggactgactatgtcttagaatccatcagataaataccaaatatttatcatggtaactcagagtttggactcttccacagaagccatggcacactaccccacaaggctgaagaccagaaaaacttattcatgggttggcagscccttgttggatcgaaaactgcactaccaaacctataggtgagtgatggggtcctttggttgtcctggaaatacagcttctcaagctaaacagtcaacttgtatctagcctgttctaattactacagattgaccatgaatgaacaggagattagaactgattgtaaggagggttttgtttgatgcaagaagatggtgggataaatatagcagttagtgatggagcaaaattatggcaggctcataaaattttgtatgtaggataatgtcatgtctatttaaggtgagttctatataacttttgatgaaaacgagatgatagatgtttttactatgtctttcccagccctggagatctctgacaatttgacattgttactgggcagcttgacagccttgggaaacatttgttgtgggaagcatttgttgttctttgtcaataactgagaggaattagggttcctaataagacctttggattcattactcagctaaaacaattcattcaacccattttgcctattcttaaatataactgggcgaattggtttcccagtaggagagttggtcagcagaaagaaatcaggattggagagccctctcctttgtgcccaggggatctgaagagcttgacccactttaagttatttcctaatgtgcttctctgttacttcctagagaaatgtgtgtgaaaacagaaggttgttccaccgagattcacatccagattggacagtttgtgttgattgaaggggatgatgatgaaaacccgtatgttgctaaattgcttgagttgttcgaagatggtgagtttgggactggaataataaaccattccttgtcatgaatgattgggaggtggggagattgtggattcttttgttcacagcagtgtgcagggcacattagactgaggtgggatcacgtaagaactagctgcgtcttcttccatctaaaaaatttctttactcaccaaagcagtattgagtaaaacggaactggaaggctcaataatttaactttttcattattttggggagtaagcaaggctattaaggcagaattgggggggatggagagaatggatgaatttgggggaaagggagaaggaaaaaacaggtaatttgtactatcatagagatgtgtcctttagttttggcatgaaggttagtaatatattttgcaagtgctacttcgttacaagtgaagaggtaagttggatttggaaggtgtagcaattggggtttcagtcagggaaaacaaaaacacttaagatattttacccagaggaacttgtgtgttaatgttggaaaggctagaagaaaaggtgacatttaccagagatgagtaagtgcaggaagccacggctgcccctaggctggaggaacaaaagggaaggtggcatcaaccagagcctacaagcccacatcgaaagccttagctgatttgctgaccttctaaccctctgcaaaacaagaggagagcacagaaatgtgggagtggggcacagctccacaaggaggattaggaagatagcaatttgaaactatctaaaactgcctcgttcaagagacagaagaagggcatggtcattaggtaatcctgtggtagtctgtatgcccaagagaaggaactgatagactgagtggataaagatgttttatattactatagtcccccttatccgtggtttcaccttctgcgatttcagttacctgacaacaaccatagtccaaaaatattaaatggaaaattacagaaaaaaacaagtcataagctttaaattgtgtgccattgtgagtaatgtggtgaaatctcacgctgtcccacctgaaatgtgagtcatccctttgtccagtgtatccgtgctgtacagtatgtgtgtgtaggaaaaatcatagcatatacagggttagtggcagcatctgcaggttcaagcatctactggtcttggcgcgtaccctcagcagataaggggagagtactgcacatagataaggaggattttggacatactttctctttgacatacttagaagtatggagaaaaacctcatcaaactaatgtccagtagaggcagcacatcagaatcatgggcttcggtgtatagattctagaatcctctcttggtgctccattggatgactttagtctttctctgaagaaagctaagcagggaagagaggatgatgatgaggcactaatgagtgttctttcggttggagctattgctggtacggagtgatactaatcgtatgctgtaataataaagctgaagattgcaagcatttgccagaagtcatctcagtggttgatgctgtaattcttgtgtgtgtgtgtgtgtgtgtgtgtgtgtgtgtgacagtgacagaatcttgctgtgtcacccagactggagtgcagtggcacaatctcagctcatgcagcctcaacctcctgggttcaagcagttctcctgcctcagcctcccaagtagctgggatgacaggcacctgccaccatgcccagctaattttctttttctttcttttttttttttttttttttgagacagagtctcgctgtgtcgcccagtctggagtgcagtggcgccatctcggctcactgcaagctctgcctcccgggttcaagccattctcttgcctcagcctcccgagtagctgagactacaggcacccgccaccatgcccagctaattttttgtatttttagtagagacggggtttcaccgtgttagccaggatggtcttgagctcctgacctcatgatccgcccgcctcagcctcccaaagtgctgggattacaggcgtgagccgccgcacctggacaattttttgtatttttagcagagatgaggtctcaccatgttgggcaggctggtctccaactcctgacctcaagtgatccgcctgccttggcctcccagagtactgtgattacagacgtgagccactgcacccagcctgatgctataattcttgctaggatttttgttttgctgctgtttgatgctgtctttatagtcactgatttttatttgttcgttgcctgtgtttagagtagctcctctcagaggcctttttgtcattcctttgccggctgatagcaccattaggaaatggagcaatcccagaagagcgggtgtgtgggctggaattagattgctgcagttggtcatgtgacctttgacaaactctttaaggtcccccgtcacttgatttctttgcctgaaaagggggatagctgtagtacctaccttgtagggttattagaaggattaaggatcggccaggtgtggtggctcatgcctgtaatcccagcactttggtaggccgaggcaggcggatcacgaggtcaggagattgagaccgtcctggctaacacggtgaaaccccgtctctactaaaaatacaaaaaaataattagctgggcgtgatggcgggcgcctgtaatcccagctaattgggaggctgaggcaggagaatggtgtgaacctgggaggcggagcttgcagtgagccaagatcaaaccactgcactccagtccaggtgacagagtgagactccgtctcaaaaaaataaaataaaataaaagataacacatgttgggccaggcatggtggctcatgcctgtaatcccagcactttgagaggccaaggcgggcggatcacttgaggtcaagagtttgagaccagcctggccaacatggtgaaaccctatctctactaaaaatataaaaattagccaggcgtggtggcacaggcctgtggtcccagctactcgggaggttgagccaggagaatctcctgaaccagggaggcagaggttgcagtgagccgagatcacgccactgcactccagcctgggggacagagcaagactccgtcacaaaaaaaaaaaaaattttggcgggaggtggtggctcatgcctgtaattccagcactttgggaggccaaggtaggcagatcacgtgaggtcacgagtttgagaccagcctggccaacgtggtgagacctcgtttctactgaaaatacaaaaattagccaggtaggatggcaggtgcctgtaatctcagctactcaggaggctgaggcagcagaatcactttaacccaggaggcagaggttgcagtgagccaagatggggccactgcactccagcctgggtgacagagactctgtctcaaaaaacaaaaaacaaaaccacacatgtcaagggttaagcacagtgtctggcacataggaattgctcagtaaagtgtccttgagttgtcttaacctttccctttccaccaaattctttctagactctgatcctcctcctaagaaacgtgctcgagtacagtggtttgtccgattctgtgaagtccctgcctgtaaacggcatttgttgggccggaagcctggtgcacaggaaatattctggtatgattacccggcctgtgacagcaacattaatgcggagaccatcattggccttgttcgggtaggtgatgccaccatccttggttctaccttgaagcttatttctgtctgcctcctgaacttcatgaccccagaaatattaccggctctaataccccatagggaatgcattatttcctgtcatcttctgtgcttgcctgtctgtttcatctcaacagatatttattgagagcacgtatcatgtgttaggagcctcctacaagaggtgacatttgggttgtgacctgagggatgagcaggaattagcagatgtatctcagggggatgttatatttagctatgactgtggcatgcataaagcattgtgaggctgaatatgctggcttaaacgaggactgcaccttgagtaaatcagtacaaagagtgctagttgctacagacaaatttgtatgacaggatttcttaataaatcaggtgctaatgagcggctggtttgcaggctgaagtaagtcactggttatgagtttttcctgaagtgacttcaggctccccagcatgggattaggttgtgatgtgaggtgtggttgtatgctgattatgtggttcattgagcgttagggtagagactctcgtctggcatgattatcttaatttatctttgagttaaatgagtgaaggagagaaagctaaaggagtgtgaggcagatgcaaaagttgaggcagcaggatgagtataygcggagaggcacagggcttggagcatctgggcaggagcacagtggtgggaatagcaggactgtgacaagacctcttcaaggagtattgcgcactctgtaggtaaaatgaggccagatcttagaaggcattgaaaaattagtttaagtaatttggtcttgctacagtgggagccattattggctgttgagcaggcgagcatgtttagataagtttgtggggaaacttggcataggcgaacagaatggactggaaaagaaagcaatggtagggtataagaatatcagctaggaggaatctgtgaaaataacccaggagtgagaggatgcatatttgaactagggtgataataataggaattgagagatgaacaataaacatttttaaaatgaaatgaaaggaataatttatttcactgatgtctttaaagtgattaatgataaaatgagtaaatactcagtaaatattcattattatgtgtttttctagcaatatgctatgccatgtctatgcgtctttagattggaaaggtaacattttaggtacagatgtggacttcaatgtttttaattgtagctctgatggaatactccttggctctcttggggctcatctcttcctacttatctatacttcctaaattcaggtgatacctttagccccaaaggatgtggtaccgacgaatctgaaaaatgagaagacactctttgtgaaactatcctggaatgagaagaaattcaggccactttcctcagaactatttgcggagttgaataaaccacamgagagtgcagccaagtgccagaaacccrtgagagccaagagtaagagtgcagagagcccttcttggaccccagcagaacatgtggccaaaaggattgaatcaaggcactccgcctccaaatctcgccaaactcctacccatcctcttaccccaagagccagaaagaggctggagcttggcagtaagttgtggaatggatcaccgtgggcaatactggggctaaagggttatgtgataaaaatgataatttatgggaaagtattgagttagtgatcacagtgcactatagcctggaactcaagtgatcatgctcaagcaatccttctgcctcagcctccccagtagctgggactacaagggtacatcactgcacttggctccattttctgggtttttttgtttttgttttttgagacagagtcttgctgtgtcacccaggttggaatgcaatggcacaatcacgacttattgtaggcttgacctcttgggctcaaatgatcctccttcctcagtctcccaagtagctgggactacaagtgtgtaccactatgcctggctaattttattttaattttttgtagcaagagggtcttgccatgttgcccaggctggtctcaaagtcctgggctcaagtgatccacccgccttggcctcccaaagtgctgggattacaggcatgagccaccatgcccaactatcaaagtttgtgtttaattttaggacttctccctttttttatttaattttttaaatatgtgaaacattaatataattcgagtcaaaactacttaaatgtacccagaaaagcactactcctttccttgtcctccaaccctgcttactccaccttctatatgttaattaattgtttccctttctggtttatctttcctatgtttcgttttggaaaaatcagcagatacatatacatatatgtatacctatatgcagacacacatatatttttatttttcgttttcttaccaaaagggtagtatactggatatattcttttccaacttgctttttccccttacaatgtatctgaaactcaccccacagcctttctgagagctcatcctcatcttgttgtagtcattcatccttttttgaattttttgtgtaggtgtcaacttcaagtataagttacttgtattcttgatagctctatagtacagtatgtgttttaggagctgaatataaatgtataaaacatttagaaaatgcagcacaaatattaactaatctgtaatatcaccttcagaaattaaggggctgactgggcatggtggctcacacctgtagtcccaacacttttggaggccgaggcgggtggatcaactgaggtcaggcatttgagaccaacctggtcaacatggtgaaaccccgtctctactaaaaatgcaaaaaattagccaggtgtggcagcacatacctgtaatcccagctactcgggaggctgaggcaggagaatctcttgaacctgggaggcacaggtggcagtgagctgagatcacgctattgcactccagtctgagcaacagagcaagactctgtctcagaaaaaaagaaagaaagaaacaagggagtttttcttttttttttctttaggtcctcatatgtcccctcttcttcctctttcaactctgttgaaattttacctttctttcaaggtatgtctcaaaagccatctttatgagcactcaggtgcttctggacacttatttcactttatgtaatataataggcagtcatgtgtatcatctgttagactagagtgttttttgtgttggaaccaggattgagcctcattcagcttttgtttaacctcagcccctggcacacgcctgcctttttaactgctcagttggtatctgcaaatgagcagctggggtccttggtgctgtggtcctcgtgatgagggagcaattccagacagttttgtgtattcacagaaccagtggattgtccccaggaaccccacttctctctattggcagatataatctgggttaagaaaaatcttggcctcattgttacttgatagcatctctagtataaatctcttcaaatgtcattgagttagggttgaaggcatgcgatgtcacccctgattgagacccactgttctgataggttatttcagggaaacctgttagagatgagaaaacactccatttatctgcaaaagctgacttaaaagttgacttatggttctaactaggaaaatcactcctaaaatttaggtgagagatgaaaaattattagagctacctgggctggagaaagcaagcctggaatgattaaaaatatagataattcctgttttacatataactcagtggctgaatttggctgtgatgagattgtgggtttgtatattgttaggtaaaaaatttrcacattgtgatgatttctcttagacttaggtaaccctcagatgtcccagcagacttcatgtgcctccttggattctccaggaagaataaaacggaaagtggccttctcggagatcacctcaccttctaagagatctcagcctgataaacttcaaaccttgtctccagctctgaaagccccagagaaaaccagagagactggactctcttatactgaggatgacaagaaggcttcacctgaacatcgcataatcctgagaacccgaattgcagcttcgaaaaccatagacattagagaggagagaacacttacccctatcagtgggggacagagatcttcagtggtgccatccgtgattctgaaaccagaaaacatcaaaaagaggtgaccagggacattacccacagagcaaattgaaatccttcacatcacgtgaagtatgtgagtcatagtcaaaaaagttagaacagtagttgaaaaacctatgtcacagaagtaytggggagctttcttaaaatacagatttytaggcctcttmccacacctagtgagtcagactccaagcactggccctaggaatctgtatttggaaatgctcttcagatggttccagtataccgagctgttatttggggatcattgctatagaagataacttcccaaacctgcattgctatccagtttgggatttcattagttcctgtggctttttgccacactttaacagtcattttttaaagcagtttttcattgttgttgttgtttcattttatttcaatagtttttggggaacaggtggtcttcggttacatgggtaagttcttaagtggtgatttctgaggttttggtgcacctgtcacctgaccagtgtacattgtaccctatatgtagtcttttatccctcacccaccttccacccttccccgagtccccaaagtcccttatatcattcttatgcctttgcatcctcatagcttagctcccacttataagtgagaacatatgatatttggttttccatttccaagtcacttcacttagaataatggtctcatctccatccaagttgctggaagtgccattatttcattgttttatggctgagtagtattccatggtaaatatgtaccacattttctttatccactcattggttgatgggtatttaggctggttccatatttttgcaattgcaaattgtactgctataaacatgcgtgtgcatgtgtcttttttttaatataatgacttcttttcctttgggtagatacccaggagtgggattgctgaatcaaatggtggatctacttttagttatttaaggagtctccacactgttttctatagtggttgtacaagtttacattcccaccagcagtgtagaagtgttcccttttctggctgggcgcggtggctcactcctgtaatcctagcactttgggaggccgaggcgggcggatcacaaggtcaggagatcaagaccatcctggctaacacagtgaaaccctatctctactaaaacataaaaaattagccgggcttggtggtgggcgcctgtggtcccagctacttgggaggctgaggcaggagaatgctgtgaacctgggaggcggagtttgcagtgagcggaggtcgcgccactgcactccagcctgggcgacagcgagactccatctcaaaaaaaaaaaagaagtgttcccttttcaccacatccacaccaacatctattattttttgattttttaaattatggccattctaacaggaataaggtggtatttcattgtggttttaatttgcatttccctgataattagtgctgttgaatattttttcatatgtttgctggctgtttctgtatcttcttttgtgaattgtctattcatgtcctttgcctactttttttttttaccttttgtttttttttttgagcgggagtcttgctctgttgcccaggctagagtgcagtggtgcgatcttggctcactacaacctttgcctcctgggttcaagcaattctcctgcctcaacctcctgagtagctgggactataggcactcaccaccacgcccgactaatttttgtattttagtagaggtgggatttcaccatgttggctaggctagtctcgaactcctgatctcaagtgatccacccatctcagcctcccagagtgctgggattataggcgtgagccaccgcacccagctctttgcccactttttgatgggattatttgtttttttcttgctgatttgtttgagttccttgtagattctgggtattagtcctctgttggatgcatagtttgcaaatattttctcccactctgtgggttgtctgctgattatttcttttgctgtgcagaagctttttagtatcattaggtcccatttatttattgttgtttttgttgcatttgcttttggggttctaagtcatgaattctttgcctaacaatgtctagaagactttttccaatgttatcatctagatttttttttttttttttttgagatggagtctcactctgtctgacgcccaggctggagtgcagtggcatgatctcagctcactgcaacctctgcctcccgggttcaagcaattcttctgcctcagcctcctgagtagctgggactaccagcgcgagccactacacctggctaatttttgtatttttagtagagacggggtttcaccatattggccaggctggtctcgaactcctgaccttgtgatccacctgcctcagcctcccaaagtactgggattacaggcgtgagccactgcgcctgcccgttatcttctagattttttatggtttcaggttttagatttaagtctctgatccatcttgagttgatttttgtataagatgagagatgaggatccagtttctttcttcttctttttttttttttttttctttttttggagacagagttttgctgttgttgtccaggctggagtgcaatggcacgatctcggattactgcaacctccrcctcccgggttcaagcgattctcctgcctcagcctcccgagtagctgagattacaggcacctgccaccatacccagctaattttttgtatttttagtagagacagggtttcactgtgttggccaggctgatctcaaactcctgacctcaggtgatccacccacctcggcttcccatttttgtatttttagtagagacagggtttcaccatgttggccaggctgatctcaaactccagaccttaggtggtccacccacgtcggcctcccaaagtgctgggattacaggcgtgagccaccatggccggccccagtttcattcttctacatgtggcttgccaattattccagcactatttgttgaacagggtgtccttttcccactttatgtttttgtttgctttgtcgaacatcagtcggctataagtatttggctttatttctgggttctccgttctgttccattggtctacgtgcctatttttataccagtactatgctgttttggtaactatatccttgaagttatagtttgaagtcaggtaatgtgatgcctccagatttttctttttgcttagtattgctttgtctatgcgggctttcttttttggtccatatgaattttagtattgttttttctagttctgtgaagaatgatgatagtattttgatgggaattgcactgaatatgttgaatctgtagattgcttttgcattgtggtcatttacacaatattgattctacccatccatgagcatgggatgtgtttccatttgtttgtgtcatctgtgatttctatcagcaatgtatcagatctaggacctttttggatgagtcttcagggttttctaggtatatgatcatatcattggtgcacattaacagtttgacatgctcttttttaattcggatgccctttatttctttctcttttctgattgctctggctaggactcattttttaactggagactattctcaaatacaaactgtacaaaaagataagacatttagaacaaactttgctgtacaaataaaaatgcaacaagccagaagttacaatttgtagtatttgctacctagaaacttcagcacctgttccataataggttgctcagtaaatgctttatattgaatatatagctgcatttctgctaaccttgagcctgtgtggataataaattcatgcatgcatcagaaacaaaaaaggacaagcacctctccctgggagtagcatattttggtctctagttggggagttggtgagtctaatttaaataaggttaaggcagactttgaactctgggtttgagtcaagcttcarttataactttttagttataattttttgccaactttttagcagaaagaaagttttactcttttcaaagtatatataaaaagactgggagccaatcaggccacttgactatcttctagtgccttttrtacactctggtatccaaaactgcttcycgtgacctcgctgtggtttcttgcagggatgcaaaagaagcaaaagcccagaatgaagygacctctactccccatcgtatccgcagaaagagttctgtcttgactatgaatcggattaggcagcagcttcggtaagactactccttggcaggcagagaaayattgctgccatctctgatatctataatcttatctcctaatgcctcttatactgtttatttgccaatccattgaaattgaccttttacctagcatgtctggaattatgttaagtttcaaataattgtcttagtctgaaggggcaagaaatacttcctgggcttaggtgactcccatccctaatcatcatgtccagcaagactgttggtgggatggggtgcctaagagcatgaacttggattctgacagatctggatttgaacctgggctttgtcatttaccatctgtgtaaccttgggaaggcaaaattacctttctaagcctgaaattcctcatctacaaaatataataatatacatgtcataaagttgttgaggggtttaatgagataatataaataatgctcctaacagagtgtctcggtagcaagcacccatgtcacctggtcacaggagggaccctgcaatacttgtaatccacactaatgttatagagttcttcttatttagacttgaacactgagtatcaaaaaatatgtccctaccattcaggtttctaggtaatagtaaaagtgaccaagaagagaaagagattctgccagcagcagagatttcagactctagcagtgacgaagaagaggcttccacaccgccccttccaaggagagcacccagaactgtgtccakgaacctgcgatcttccttgaagtcatccttacataccctcacgraggtgccaaagaagagtgtaaggttcttctaggtttacttcccattgaagcatccctctcttagtttaaaagttacaaatgctgaagtcacagattagtaacagctggaatctgaggacagatctgttatattcaatgctattctttgtggaatattcatggagaaggggacctaagtgaacactaggactgaaaatgaatctagtagagagtgatttttgaggtaagtcccttttacggtacagaatcagatggccaagagctgaacttcctgagggaagtaagtacaagacccactcctctttgcatttcccacggagcactggcagagtgggtatcgcatgtacggccaccgagctgtggtgttagttttgttgtcccacttgatacacctgagaaaccgggagtgctacttacatattggtaacaaatcatgtcacagcaagatggaaggaggagatcaatgaacatcttttctgcttcctgtggaactttagcagaacactgaaaaggtattcagatcaggatcttctcatgttcgaatgtgcttgagaaatgtttgaattaaagttaaattgacagagcatcttattctttggaacacagttgagaaatcttaattagaagactttctaaagctgatgtccatttttccgtatgaagatgtgatttggcttgggttgaaatcaaagaaaaatctcggctgggcatggtggctcatgcgtgtaatcccagcactttggaggccgaggtgggtggatcacttgaggtcaggaattcaagaccagcctggccaacaatggtgaaaccctgtctctgcttaaaatacaaaaattagccaggcatggtggcaggtgcctgtaatcccagctactctggaggctgaggcgggagaatcacttgaacctgcgaggcagaggtttcagtgagctgagatcgcaccatagcactctagcctgggcgacagagtgagactctatctcaagaaaaaagaaaagtctctagggaaaggaatccagtagatcagtagtccccagcccctttggcaccagggacccccttcgtggaagacaaactttctacggatggcaggggctggggggatggtttcaggatgaaattgttctaccctagatcaccaggcattggattctcataaggagtgtgcaacctagatcccttgcacacacagttcgcaataggatttgcactcctatgagaatctaatgcctctgctcctctagcagaaggcagagctcaggtggtaatgctcaccccacccaccactcacctcctgctgtgtcctggttcctaacaggcctctggtttgattgtgtctcctggcccccacccaaaagtagggatatagggtgtagggtaccttcagcataataaaaaagggcagaagcccatcaggtttcttgataccttctcagcaaggccttgtcaacacttttctgttttctccaaaattaataaatgtaaggcctttttgtttttttttgagacacgctcttgctctgtctcttgcccaggctggagtgcagtggtgcaatctcaactcactgtagcctcaacctcctgggctcaagcgatccttccacctcagcctcccaagtagctgggactacaggagtgtgccatcatgcctagctaatttagagggggctttcacctctgtgttgcccaggctgtcctcaaactcctgagtttaagcagtcctcccttcttggcctttctaagttttgggattacaggcgtgagtcaccgcaccagcctgtaaagccttttaaacagtttaagtgctttctgcctcgggaggaaatggagagattgttctctctctagccaggctgaaaacagagggtgggtggagtgaaatgccccatagaagggaatgctttgtagaaacgccatgaagatgagggaagcagcagcaggcttgttctagcaagccatgagcaaggaagaagatagagggctgttagactacactaagcggtgacctgggggtttggagtggaaaaatctgccaaggtttctccaggtcccgcaccgtgggccatggaagtcctgggctgatgcttggccatatcttcaaataagcccagggaaagatctaatgaatcaaacctagtttatgcctcctcttctcttctgtatttgggcagagtagttagggtgtcttaaacatttcttgtctttcaagataatattttacttttaaatagtatttcatccaaacttaattctttcctcagactgatattgttataaatcctgatactatacatacattagaaaaaagaaaccatatttggacgatgaacaaagtttatgcaatgtgaggtgagagagggagagtcatggtcctttatccaggaaggaactaagaggaattcaccacctctcttccttttatcagatcagcacaaatcacatttgctggtgtgtcctggatggtgttttgctttttccttgtgaaatatgttctttgttttcaatacagctcaagcctagaaygccacgttrtgccgctcctcagatccgtagtcgaagcctggctgcccaggagccagccagtgtgctggaggaagcccgactgaggtactgctgctgttgattccccttcagagaggcaggaaccatggggcctctgctttcattcacataaaattagcagtcactggtctacctaataaaggtagatacactgtgtgtctatacttttacctatctaggtaaagtgagtgtatgtttagaaaaaagaaacctctcaggcagcatctgggttagccagtgtggacaggccctgggaggactggccttcccgtctactgccatcatttccgcagggatggaagatgattagtcaggacagtgcctctttgttttgatgccctttagaaccatatggagactttcatataagtctggatcctgtcagaaatcaagcaaaatctgaatctcctgtgggatgaggtccacccatgtgatttgggtggagaaacggaggccaaggattatgaggccaaatggagggatttgagaatgaagggattctctagcatttgaaattgagttttcaggtagaaacatagacaagaaaccataatcattttccattgattaatgagtagatggttggggaatgttcstaaagtcttscttttctcccgtttaccaccaatggtaggctgcatgtttctgctgtacctgagtctcttccctgtcgggaacaggaattccaagacatctacaattttgtggaaagcaaactccttgaccataccggagggtgagtcatgtgaggcaggcagggtagtttggggaataaggcccytgctagyggaatgccttgggtgttacagttcagccatacaggctttctccagtatcagcagactagaccaaatcgttgctgaagcccaaagcttctgaaacatttgttgccaaagtaatcctatagtaacagaaattttgcctttcagaaagaatgaaactggccttcattgagtaggcagtttgcatatagcattatgcaaactgtggaatgaatgattctatataagcaggtcctactctgaccagcttccaaggatggtccctactgcccccacctccacatttcaagggtctcggyccttccctcagtatacattcccacactcctaactgattatarcktgtagtggctggctgagacctaccccacgggttttcctctcttgctctaggtgcatgtacatctccggtgtccctgggacagggaagactgccactgttcatgaagtgatacgctgcctgcagcaggcagcccaagccaatgatgttcstccctttcartacattgaggtcaatggcatgaagctgacggagccccaccaagtctatgtgcaaatcttgcaggtaagcagagctgtttaggctttttggaaaatgctgtttcttcgtgacacatgaaaaaggaaagagttacttaattttgcgtgtattgcatgttcatgatataccaggcattgtcctttctgtagaggtagcaagggcaaggaagacagaattcttaccctaagagacttcaaagtctaggagctggataatgattacaagccaggaagccagtacttacccacatggtgaaaactgtgagctyacaggtagcagtgtggcaacatggaaaaggggtccgtggcaggccagaggttaagccttgctctttgtccatgggctgttattttggagcaggtaacatccagttatagaattctgtaatagtgattttaagggggcttctggcccagcctgtgactcatttgcatttcaaactcatataccttctttatcttctctttcggtgccttctcttgtccttccaagtaaaggttaagactagattgggaggcagaatataggataccgaagtcctcaggttaaatgcctccctccatttgcagatttaactttaagcccaagggagtaagacccttacagttcctcacaactgtgtttctcctaatgcagaagctaacaggccaaaaagcaacagccaaccatgcggcagaactgctggcaaagcaattctgcacccgagggtcacctcaggaaaccaccgtcctgcttgtggatgaggtgaggtgcccatgggcggacaggagaagaaacagggctgtacytcaggagcaagtgctggatgggagggaggaaagtcctggctcccttctccattcatatgagcccattttctggtgctgagaggcgtgtgtcaatggattgttttggtgctatgacttgggaaacatgcagctaaagcagtggttataggtcttcattttgaagcaccagctcagtctctgtgattgactctgcacctctctcctttgccctggcagctcgaccttctgtggactcacaaacaagacataatgtacaatctctttgactggcccactcataaggaggcccggcttgtggtcctggcaattgccaacacaatggacctgccagagcgaatcatgatgaaccgggtgtccagccgactggtaggttctagggcagttcccatgctgttcttgcagatctgtaagcttggccaagaagttctgcaaaaatggtccaggtgtggtggctcacgcctgtaaaccccgcactttgggaggccaaggcgggcggatcacttgaggtcaggagttcaagaccagcctggccaacacagtgaaaccccgtctctactaaaaatacaaaaattagccaggctaatttttacttaggaagctgaggcaggagaattgcttgaactccggaggcagagtttgcattgagttgagatygtgccactgcactccagtctggcaacgaagcaagagtccatcccaaaaaaaaaaaagttctgcaaaaatgaatactaaaataaattgggatgttaagaaatgtgatttctgcaatgcttgtagtttctatgttggaatatgtaaccattgcatgattttctgcaaacatcatatcttggtgttctgctgctcgtggacttttaaactgcaccaaaccatggaggtttaattatttaaaaaaaaaatgttttaggctgggcacagtggctcacgcctgtaatcccagcactttgggakgccaaggcaggtggatcacctgaggtcaggagttcgagaccagcctgaccaacatggagaaaccccatctctactaaacagacaaaaattagccaggtgtggtgacgcatgcctgtaatcccagctactcgggaggctgaggcaggagaatctcttgaacccgggaggcggaggttgcggtgagccaggatcacgccactgcactccagcctgggcaacaagtgtgaaactctgtctcaaaaaaaaaaaaaaaaaaaaaaaagttttagcacttataacctgccaggcagtgttaggtgcttggaataatgcaataaaccaggcagatgcaatgtctgccctcacaggccttgcagttcagcaggaagcgcaatgagaaatcatgaagagcctggtaagtgaagccaagtgcagtgacaatgtatagcatagatctgaagatcctctcacccacttcaattaaagcacctcagcttttatctacttccaaatgattctgatagaatcaaaggtccttaggccgggcgtggtggctcatgcctataatcccagtttaggccgggcgtggttgctcacgcctgtaatcccagcactttgggaggccgaggcaggtggatcccraggtcaggagatcgagaccatcctggctaacacggtgaaactctgtccctactaaaaatacaaaaaaattagctgggcgtggtggtgggcaccagtagtcccagctacttgggaggctgaggcaggagaatgacgtgaacccaggaggcggagcttgcagtgagccgagatcatgccactgcacggtagcctgggcaacagagcaagactccgtctcaaagaaaaaaaaagaatcaaaggtccttaaatgaaatgaaaaaatagttcaaaaactactgccctacaggacaccactggtcattgtcagtaaaggcagtggtagtctaggtatgaaatgtgtaatttgttatatgggacctgggaattgggtttgggggcccaagggtgactttccacctggataatcactgggcartcaaccaacttattcctctgtcattttggctccccagggtcttaccaggatgtgcttccagccctatacatatagccagctgcagcagatcctaaggtcccggctcaagcatctaaaggcctttgaagatgatgccatccagctggtagccaggaaggtaagtcaccagctgcacccataaatcagtcagcacatctttgctgagtacctgctsggtatgaggccctatgctggtgctctgaggttggagagaaatttagaaagtcgtgtaaaaatatcaaaaaagacaagattatgagaaattccttagccttgttattttatgattagagggccctaaatattgtgggtttatatgcaaactaatatgaattcattcagggagcaagcagttttgcatgatgaaagggacaatatagtcaggtagacaaacctggtttgaattctggctttaacgcttagtaggcatgcagaaagttataggaaagttacttaaaaatttcctgagcctcagttttcttctctgaagaagaatgagagcacttccctcatagggtcattgtgaaaatataacaatatcatgtctattacatgcccagcaaggcacactctccaggctagatatgaggtattagatgcccctctcctccaagtctaataggagaatgctccctgagagttcaccacagactagtctccccggctgctgaggaacaaagtgggttaaatgtctgcctcaagcagaaagaaagaaagaaaaaccgtacatccacaagtatttcagcatgtaaaataattataaacttatttctagtttcctcttgccgacacactcttcaccctgaatggctgtagcagcagcacatgactgtgactcctgcttggaactagctactgtattagggactggggtaagaggtgagccaattgtgtgcctgtctccaggctttgctttccaggagagagatcctcaaagttatcatctaggcattttatgggtagagtttttcacttttgctattatgctatctatctagactatctaagaggctttttcttttctttgaatgatcctttttttatgccacccttttttttttttttgaaacagcatctcactcggtcgcccaggctggagtgcagtggygtgatctcagctcactgcaacctccgccttctaggttcaagagattctcctgcctcagcctcctgagtagctgggattacaggcgtgtgccaccatgcccagctaatttttgtattttagtagagatggggttttgccatgttggccaggctggtcttgaactcctgacctcaggtgatccacccaccttggcctcccaaagtgctgggattacaggagcaagccactgcgctcggccaatgccatcctatttatttgaaattgtcctttcccgttttcctccaagatgcttctgtcagttgattttggtctctatcttgcatcgttagagactttccacagttgtcttggttgtcctctcaggtgtaagggtggagattaaacagctggctctgaacatgtgagtggggcttattcactatgagatttgctgtgggatgatctgagtgggccagtatcactgtctttcctcctttcccatgggaatagtcagatttctcagtatgcttcccctgtcctgtctggagggcagtgttctgggaatgaggggctggtgtcaggtacagaagaggtcttccagtttggcatgcatatagtaatcatctatttttggtaagggacacctcttctacaataatgcctagcattcctaggaccagagactttttgctaaactttgcttgagaataaatttcctttgttttttttgttttttgttttgagacggagtctcactctgtcgccaggctggagtgcgatggtgcaatttcggcttaccgcaacctccacctcccttgttcaagccattctcctgcctcagcctcccaagtagctgggactataggtgcacaccaccacacccagctaatttttgtatttttagtagagacagggtttaaccatgttggccaggctggtctcaatctcttgacctcctgatccacccacctcagcctcccaaagtgctgggattacagccaataaaacttttatttataaaaacagatggtgagccacactttgttgtttcctgatctaaggcatctttagtttcttaacgtcctcaactttttttaactttcaaccacaaccaaatattctctacttttggctgggtgcggtggctcacgcctgtaatcccagcactttgggaggctgaggcaggtggatcacaaggtcaagagatcgagaccatcctggctaacagggtgaaaccctgtctctactaaaaatacaaaaaattagccgggcgtggtggcacgagcctgtattcccagctactagggaggctgaggcaggagaatcgcttgaacctgggaggctgaggttgcagtgagccgagatcgcaccgctgcactccagcctgggagacagagcgagactccgtttcagaaaaaaaaaaaaaaaaaataccctactttagctaaacaacccccctttacctctttccagcaccactaactcctgagcattttgaggatttttaatgtaacttagatttgttcttggattcctcaatataggtttaggatttggctttctccagtccactacactaaccgctactcttccatgtctttctaacttgcagaattattattattataatttttttttttgagacggtttctcgctctgtcgcccaggctggagtgcagtggcacaatctcggctcactgcaacctccacctcttgggttcatgccattctcctgcctcagcctcccgagtagctgggactacaggtgcccgccaacatgcccagctaattttttgtattttcagtagatacggggtttcactgtgttagccaggatggtctcaatctcctgacctcgtgatctgcttgccttggtctcccaaagtgctgggattacaggcgtgagccaccgcgcctggcactaacttgcaaaattatatttttaaatcttctcctgatgcttcccttccttttagagtcttggggtgggttgttgttgtcattgttttttgagacagtcttgctctgtgacccaggctggagtgcagcagcacaatcttggctcactgcaacctccgcctcccaggttcaagcaattctcctgcctcagcctcctgagtagctgggactacaggcaggcacccgccaccatgcccagctaagttttgtatttttagtagaggcggagttttaccatgttgtccaggctggtcttgaactcctgacctcaagtgatctgcctgccttggcctcccaaagttaaaggattacaggtgtgagccactgcacctggccagagttttggtgttttgtttgttttttttttttgagagggagtctcactctgttgcccaggctggagtgcagtggcacgatctcagctcactgcaacctctgcctcgtgggttcaagcaattctcctgcctcagtctcctgagtagcaggactacaggcatgtgccaccacgcccagctaattttttgtatttttagtagagacggggtttcaccatgttagccaggatggtctctatctcctgacctcgtgatctgcctgctgcagcctcctaaagtgctgggattacaggcgtgagccaccgcgccccgccccagcccggtttttttaacaaagattcagaagacatccaatttggatgctgctcttcctcaaatctcttgcccatagtttcaaagccctctctatttctttacatatgacgaagcgaatctgttttatattctatatcctatagttatgatacctgaagtctttaggggtctgattctgataaccattgattctgctggttcccatgcatatgtggcttggttttcttatttttttgtcttgatttttattttattttactatatgcatggaattcagcatgctcctttatttgagagttaattggggcctgggttgaagttgaattcatttagaatttgtttttttttttttttttttttgcttctaggggcactaccaactgttaccatttttaaaataaaattctccacttgagaattgtaggaaatacaacataaatttgggctccaaatccaagcaagggcttatggttgtaaaaactcgagagtgtctgggtagggtggctcatgcctataatcccagcactttgggaggccaaggtgagaggatcacttgagcccaggagtttgagaccagcctgggcaacatattaaaaccccgtctctacaaaaaatttaaaaattagcccaatgcgatggcatgtgcctgtagtcccagctacttgggaagctgaggtgggaggattgcttgagccgaggaggtggaggctgcagtgagtcatgatcatgccactgcactccagcctgggtgacagagcaagaccctctctcaaacaaaaaaaccaacaaaaagtcggctgggcgcagtgggtcacacctgtaatcccagcactttgggagggtgaaaccccatctctactaaaaatacaaaaaattagccaggtgtggtggcagatgcctttaatctcagctattcgggaggctgaggcaggagaatcgcttgaaccccacaggtggaggttgcagtaagctgagatcccaccactgcactccagcctgggcatcaagagtgaaactctgtctcaaaaataaataaataaataaaacccaagttttttgtgtgtgcccacatccacctagcaccaaggtcaagtaggccgtttttcctgccatccgttctgcgtgatgggtctcactcaccctgtactgaggctgaagtggaggtcaagtttcaggtgcctgcaggatgtcctgttaggttccatgttggctgggccttagcttcttcttgtgtctcccttgtcccagcagcagcccgaagggatgcatagggttgccaagtgtcactgatacccttggggtcagactggtttaggtgtttccttaccccccagagttcccctttcactttgtcttgaggcccttgagtccctgctattcaccacacaaagtgcctcttcaccaggctgtacaggtggtaatgggaggggaggagaactgacgaagcaggaagggctacaggacayccttaccagttcaatactggggattagaggaagggaaaaatgtaagccgatagtcatgtttgtgtcctgggttacttggaaagtgatttttttttttagatggactctagactggagtgcagtggcgtgatcttggctcactgcaacctccacctcccaggttcaagtgactctcctgcctcagcctccccagtagctgagattacaggcatgtgccaccatgcccggctgatttttgtatttttagtagagatagggtttcaccatgttggtcaggctggtcttaaacttctgacctcaagtgatccacctgcctgggcctcccaaagtgctaggattacaggtgtgacccaccgcgccccagaccctggctaatttttgtgtttttagtagagatggggtttcgccatgttggccaggctggtctcaaactcctgacctcaggtgatccgcctgcctcggcctcccaaagttctgggattataggtgtgagccaccgcgtccagccccttcctacattcttgattctggtcctcttagccattgaccaagccgaccccaaattcaccacgtgctgtaaggggtgcctggctatggctttatctccagataggctccacctcaccctcttgtctttggctggctgcttctgggggcacacgtctgtctctatgcaaggagtgagaactctgtttgcagatgcttcaatagtgatcttgaaccaagcgtctctgattttagacttcatttcctgaatagtaaagctgagaatttctgtgttgtccactgtggagttaactgtaaaaccaagacagaggtttggactagaggattagagtcccatgcacaatgtaataattcatttctattcttcctccaggttccctgccagggctaagtacttaactttacgcttatgtccattgccagcactaccaagaatctcttggttcttctgggctaaggtggcctcaggaataaaatattccctcttgtaggtagcagcactgtctggagatgcacgacggtgcctggacatctgcaggcgtgccacagagatctgtgagttctcccagcagaagcctgactcmcctggcctggtcaccatagcccactcaatggaagctgtggatgagatgttttcatcatcatacatcacggccatcaagtaagatgctccacttcctgagccttcctggaaggctgtagaaacatgtttccctttctaagcttttactcattcaacctgcacttattaataacacagttatgtttcatagggacattatctagtcagggaaacagaaatataaccctaggataatagaatatttgccacttattgagctatattataggtgtttagggcataaaagtgctatgataggaacaaaaaaaaaaggaagcagctgcttctctcacactgattgatgtgctcagctcatgaaatgagggcacaggtatttatgagtgaccagtgtatttccggatgtagttgctatgtttcctcacttccacagtgacattttctgtatcagtttgagagtttgggggtcagggagatccttgccacataatataggagaaattatttcccgggttttctcttttctaaagacacagaaaagttttctttggctttcctctgggctggggttacagccactgacaaaaactyacatcccctcgtttcctttaagaaattcctctgttctggaacagagcttcctgagagccatcctcgcagagttccgtcgatcaggactggaggaagccacgtttcaacaggtgatctcctcctcttttcaaatccttctagattttggacttacgcttttaaaatacatggaaatttccatgaatgtgtgacactctattttgtgccacctagagtatgtgaaagaataccagaccggcacctattttaatgtgacattttgtagagctgcatgagaagagacctttagcgactggtttctgcatgttagattgaaggcctgtgtgccagacactgttcaaagaatgaggaacaagacaaagttactccctgattacagcttatgttgtagtggagtcaaggctttcagaatgaggccatatttgagaacaaatcacagatcaatccaatccctgcatgggcatagttcaattagatcaagtgagagggatcagtagggcatgtgctttgttagtttacttaagactctagtaattggctgccttggaagatgaattgttaaaggtgtttatgagtgtgtacctgagagtgtgtatgtttgtgtatgtatgttttagacatctttatttaactaaaataagtcaggaaaacattttcctttcagctacttatttattgggttggttgtaaattcttgtttaaaattttagctactcgtcatgttttgcccattactgttctcctcctagagtctgagatagctcttctgcagagagtgactttcattttagtttgtaaacatttcctgaacatctgcagtgtgccattaactgtgatgaatccttgaaccccaagctgatttggttaacatccctgttcctgacaaactcccagtcttggggctgggacggggatagactcatagatatttagaatggaaagtgaccagaaatgctccagatttagctgacccagtagagaacgttagggtaggaatctatgtttccagctatcctcctgcctccctttatttctttattcaattttctctctaggcctttgtgcttttccaagggtcatgccttggcatttgctcactgtacctgataaggaaagtggccttgtagcaaaatttgacttgaattttgacagtctcaattatgaaactctcagcccctggagacaagactatttgtatcaccagtgagagttactagtcattttatatccattaactcacaagggatgtacagtgtattttatagataaaattgaagctcaaaagagtgcagtaacttggccaggtctacatatttaggtaaatggtagcaccaggattcgggcctgctgttttctgattccaaggctagcattccattctgcctctgcattttgtgtaccactggggcaccaactgatgccttctggagtgtttgatatcctgggggccatgtgtctgattttcccaaatgaagaaagaaaggaacagaaaaagccccaggattgtatttcctcttaacctttgccttgctatttgtgtctagatatatagtcaacatgtggcactgtgcagaatggagggactgccgtaccccaccaygtcagagaccatggccgtgtgttctcacctgggctcctgtcgcctcctgcttgtggagcccagcaggaacgatctgctccttcgggtgcggctcaacgtcagccaggatgatgtgctgtatgcgctgaaagacgagtaaaggggcttcacaagttaaaagactggggtcttgctgggttttgttttttgagacagggtcttgctctgtcgcccaggctggagtgcagtggcacgatcatggctcactgcagccttgacttctcaggcttaggtgaccccccaacctcatcctcccaggtggctgaaactacaggcacrtgccaccrtgcccrgctgattttttgtagagacagggcttcaccrtgttgcyaagctagtctacaaagcatctgattttggaagtacatggaattgttgtaacaaagtatattgaatggaaatggctctcatgtattttggaattttccattaaataatttgctttttcctgagtgtttgtgaagttattacattataatcattacaaacatctgattatgaaaccaaactgtccttcctacaatagtccttccatgtgacttttatttctgttactaggcctgccatttatttaatgctaacatatataaaatataagtacacgatttacttgtatctatataaaatagttctgggagagtatgcaaaaaactggttacactgattacctctggaaagaatcagatggaaagaatcagatggccagggttaggggttagaggaggacttttcactgtatgtcattatctgtcttaagtttcaaataatataaataaaatttaggccaggggcggtggctcacacctgtaatcccagcactttgggaggccgaggcaggtggatcaggagatcgagaccatcctggctaacacggtgaaaccctgtctctactaaaaatacaaaaaaattagccagttgtggtggcgggcgcctgtagtccagctactcgggaggctgaggcaggagagtggcatgaacccgggaggcggagcttgcagtgagctgagatcgcgccactgcactccagcctgagcgacagagtgaaactccgtctcaaaaataaataaataaataaataaataaaatatagtttataaaaaaggaactactggaaataatataaatcataagtaatctctagccacaaatagctagaaagtgtaatttttacaaaggtaccatttaccataaaaacaaaacaaacctttaaatacaaaagatttatatgtcacagaaaatataaggtacttagaaataaattgatttaaatatttatttatttatttattttttccctctgtcaccaaggctggaatgcagtaatggatcatagctcactccagccttaacctcctgggttcaagtaatcctgcctcagcctcctaagtagctgggattccaggtgtgggccaccatgtccgtctcctaggaataagtctaataaagagatgcaagtaatctctagatagaaatcaattccaatcaaaatcttggcaaggtttcttgtatgactttgcagttaattctaatatttatatggaaaccaacaacaggcaatgaacatctaaaacctcatgaagtactgaggctgggcgtgggtggctcatgccggtaatcccaacactttgggaggccaaggcgggtggatcacctgaggtcaggagttcgagaccagcctgatcaatatggtgaaatctcgtttctactaaaaatgcaaaaattagtctggcgtggtggtgtcacctgtagtcccagctacttgggagtcaggagaattgcttgaacccacccaggaggcagaggttgcagtgagctgagatcacaccattgcactccagcctgggcgacagagcaagactccgtctgaaaaaaataaataaaacctaatatgaggtactgaaaaaaaacagccccacccgtgtactagtcctgtcagaaatgcttgtcctaaatttactgatgagaaaattatcagacaaatctaaatttagggagaaactctgcaaagcagctgttcaactcattgaaaatactaatatcacaagaaaaaaaacacaaaacatggaggaactattctacaccaaaggagaatagagacatgagagctaaatgcactatataaaccttgactgggtcctggatttaggaaatataaacaattataaacattattaactatgtattagacagaagtattttgtaagtgttaaattccccgagcgtgataaatttgtgattatgtaggagaatgctgttcttaggagattcataatgaaatatttataagtgatgtattatgtctgcaactcattctcaaatcatttagcaaaaatatgtatttctatattcacatatgtatttataattacatataatggattgaggatcaatatcaatatttttaaaactgcaatgaaaaagaaaaaatgagccaggcacagtggttcatacctgtaatcccagcattttgggaggccaaggcaggtagatcacctgaggtcaggaattcgagaccagctcggccaacatggtgaagccccatctctactaaaaatacaaaaattagccaggggtgatggtgtgcacctgtaatctcagctacaggggtgctgaggcaaaagaattgcttgaacccaggaggcagaggttgcagtgagccaagattgtgccactgcattccagcctgggcaacagagcaagactgtctcagaaaaaaaaaagaaggaaaaagaaaaaaatgggtaaataacaaataagtcatccaaagaagaaacacgaatgaccaagaaaatggaaacagtaaaagaggcatgcaaaccaaaaccatttcacatctattagaaaacctttctatggttacacagaacaactgggaccccaataccctgctgatggaggtggaatgacttttgaagattatttggtgaatcttagcctaggaaatgcaagaaattgtatgagccagtgtattagtctgtcctcgcgctatgaagaaatacctgagactgcgtaatttataaagaaaagaggtttaattgactcacagttccacatggctggggagccctcaggaaacttaaaatcatggtgaaaggcacctcttcacagggcagcaggagagagaatgagtgccagcaggggaaatgccagatgcttataaaaccatcagatctcgtgagaactcactcctatcacaagaacagcatgaaggaaaccatgattcaattacctcccacaagatgcctcccaggacacatggggattatgggattactattcaagatgagatttgggtgggaacacagagccaaaccatatcagccagtgtgatggttaatagagcatgcagacagcctattgtgggactatatatatatatacacatatatatatatacacacatatatatacacacacacacacatatatatatacacacacacacacacatatatatatatatatatcctattagttctgttcctctagagaaacctgactaatgcagccagcaattccattcctaagtatatgctctagagaaattcacatacgtacaccaagagtcatatacaaaaagttcatagcactctataatggtaagccattgggaaagtgacttattttcatgctatggaatcataacagaaatgaaaatcagctaactagatacagtatacatgtcaatttgagtgaagcttacaaacagggttgagtagaaaaaggttgaagaattacactgtatgtaaccaatgatataatttttaaaagctggcaaaaaaaatactatgtattgcttaaggatacctacacagaaatagaaatgctcaggaataataaacactaaatttaggataatgggtacatctttgggaaagggaggtgttgcaatatgggagatgtacaggtagctccaactatgtttgtttttcttttttcacaaaaatcagatagttttatgttgtaaaaacattagttatttgtcaaaggttatgttcttccgtcttcatctgtcaccagctgtcagcatctcctttaaatatcggttttttcttcataatgacacctgcatgtggctcgttggctgtccagatatggtttacaacctaaatgtataacactgtcaaacaagagctccattgttgtttcacatgcctgaacatgctaagttagtcctagtgttttctgtacttctcggcagatcttggagaggcaatactggaatttctcatcacagtcattcttgcttttgccacagttctcatagcacctgtcgtgttagttgcaacactttgtcagggaagggataccaatgttaagatgaacgccaaacagtggagagccacatccattcggtggggagggtttataaccataacgtgggaaaggcttagatccgtcactgcatttatactggcagagaccgtcctcgcctcccaggaggtccaaggcggcgttcaggtacgtgtctatcttatgaacgccgttccggatggtcttcagggtggccctccagtcggtggtctaggcctgctccaggcacctgataacagcggccatgaggaggagcaggagggtgagcgcggggcgcgggagaagggccaaccgcgcagcgccgggctctacgggtccccgagccgcggcggggggcgcgtccccaaagagcccccgggaagcgctaggcagcggcgcgggccccggggttgcagccgccagctccataaccacgcctccttcccggctggcaggcagggcctcgctggctttacgtgaaccgcctcggggaggcagcgcggtcgcggggacgcgcccgctcacctgcttttttttttcccttaaactggtaatagatgtccatgtagttaattcacacaacaaggaactattgagtgcctactatgtaccatgcactgctgtagacacgagacacttggagaagcaataaaaaaatttctccttctggagcttgcattctagtaaatgttaaatattgtgtatctttgtttatatcttaaatgtttcattataaaaatttttaaataattttaaaaggaatgagaaatatggatgtgaaatctcaatttaaatatggtaatgggcagggcatggtggctcacgcctgtaatcccagcactttgggaggctgatgtgggttgatcccctgagctcaggagtttgagatcagcctgggcacatagcaaaaacatgtttctacaaaaaaaaaaaaaaaaatgctgggcatggtggcacgtgcctgtggtcccagctactcaagaggctgaggtgagaggattgcttgagcctgggaggtgcaggttgcagtgagtggagatcgcaccactgcactctagcctgggtgacagaatgagatcctgtctcaaaaaaaaaaaaaagaaaaaaagtaagcaatcaggagatggaaaagccctttgtccaagtaaactgggagatcgctaactagaaaacataatttaaaagttcaaggcataggcaggagaggagatggcaatgttttagacagaagaaactaatccagcagtttaactttaaaatacattttaaaactttttttcctttctcttgggtttcaagatacaaccttgaagcaaactgcaaaagccttttcccttagctgtaaaatagaccccatatccctccctttctcactgtatatactcccttcacatttatcttactgtatgctagtatttaattatctgccttctgagaagttccaagggctaatcttgagacagacaaaccaagcctggagacacagctgcaaaattccaaagattacttcaaggtggctagtcaacagcggggccattgtggagatgagaccagcccacgctccaggtaggctgggacccaagatagccaccagaacaagacacacagacgttgtactctgtacaattcttgcatgcttcccatatcaaattttccttttaagccgttctctttccccccaaaatcgaagtggttactttagatgggaatctggccacttccccattactccgctctcggtttttttgtttgttttagtttgagacagggtctcaccttgtcacccgggttggagtgcagttgacagctcattgcagcttggacctccggggccacagcgattctcctgcctcggcctctcagtaggtaggactacaggcacgcaccaccacacccggctaatatttgtaattttttgtagagacagggtttcgccatgttgcccaggctggtctcggactcctgagctcaatctcttgttaactggactctgcaagccgcagggagaaacgtgctttccttagaaaactagactagagcatatttactgatgctaaagaggttggttttgtatttccctgggcaaataattctctctgagcctccgtttcttctagagatgatgtccatcttgcaggattgagaactggtataagc

SEQ ID NO: 12372 - DNA, 26205 bp, Homo sapiens
tgcctcctcctcctcacagctacagagggccggagctggagatgtggtctctgggagtcactctgtacacgctggtctttgaggagaaccccttctgtgagctggaggagaccrtggaggctgccatacacccgccatacctggtgtccaaaggtgagcgtgagctgcaagtggtagacagtcgacactgtccttagagaccagccacttttttttcccatttcctcattcctcagtgtatctctgtccatatcaacagtctcatttgtttcttttctattcatcaaataatttgcatatgactttaaaacatcttgataatttagtttttgttaatgttcctctttggatcttagaggccctcttgtgagaaacacacttgcagtcaggacagggaggctccaagtggccctgttgacttggtgcctacatggttaaaggaactggggcccgaatccagatgcaaggctgggggcttctctcagcttgtgctggcatcccctcacctgtcatgttaaccctgcgttattcacagctctgcattgccagagcccctgagaatagagcagttaggaacctctgcaccacctggattttggttgagtgggatggcatcttgaactccaagctttcatttcagaggcaatgaatgtttcctgcagcttctgtccaagcacagctgggccctgcactagaggttcctgggccgccacctgcycagtcagaggctctgcgggggggtggtgagcacccaggaatctgagatgtgctccacttcatcccaatctggacctaccatctgtgttctttgtgtccccagaactcatgagccttgtgtctgggctgctgcagccagtccctgagagacgcaccaccttggagaagctggtgacagacccgtgggtaacacagcctgtgaatcttgctgactatacatgggaagaggtgtktcgagtaaacaagccaggtgaggcttctcagcatccctccaccccacatgacttcacttggaataacgaggtccccaggctgccttcctaggtcaaaaggaggaaaaggaggctctctcccccatgctgtcttggacacaaatgtcagggcctatagctgacctgtcacctgtgagagggggtttgattctgtcccgaggcctctggacaccactggggttcagggtgtggctttggaccttggagggtgggcaggtgtcatgggagctcctggcagaaggggtcggaaccctcaaagatggtttgaggaatgcagctggtgatggtctgactgggccgaaggggaggatgaggccacagatgctgagagtgattctctagcagccggcggggccgagggctcttcagacaaggctctggccacagagccaaaaccactgctcagagcatttggaccaagctgcggttgatggccctgggcttagatccccaccttggcaggatctgtacttccgggacattgccagttggatttctgagggcctcaccttaggcttttgttctaggacttcttcaagtgagaagcaaagtattttagaaccttaagttgttagcacgtgatacagttaccttcttgtttcttcagaaagtggagttctgtccgctgcgagcctggagatggggaacaggagcctgagtgatgtggcccaggctcaggagctttgtgggggccccgttccaggcgaggctcctaatggccaaggctgtttgcatcccggggatccccgtctgctgaccagctaaacaccaatttcttcctgcttttctccacttggtttggaaaatcacacagttttcaggctccatctgtttggagaaaatacattctgaagcatccccaattcaccttctaaaaactcatgtgcaggtttgataaacaccagaacagaagacagtgatgctgtattattttagatttattacatagatttggaattcacttttttcatgacctagaaaaaaacattccagtgttcaactgttttatattattaaagggcttttaatttgtgaacttctgaaggcatgagtgttttctctttctacttttgtatatgtgcatgttttgtttcctctgacttggtatatgctcatctgagtgacggatatgtgaaatttgtagaactggttagtcaaatggccagactatttcattaatttatttcctcaaatgcttttcaaattaaagcacctttgttagtaaacagttatcctgacttggatgttgtgaactgttcccgtgtgctaagtgtgagaaatacctggtttcctcatttttccatgtgtgcaccccacttgccacagttggagagaagtctagccttggccattctggggttccttttacaagcaggccctgccaggggtgggcctagggctctgaagcttgctccatctggtaagacgggggagggtggcttcctcagggacctcccttctgtctgtagcaagactctgctgtcaaacacgtggctggctcactgccagcagtccccaaatatcccatggccagccagctcccacctctgtccacatgaggggcttcctggcccagcccccacctctggtctgtgtgaggggctccagccctgtattcctccgagctgctcaggttccagggtgtttgtcagatactcaactggctgcttccctcccttagactccagtccatccccctcagacagacttggctaggtcaagtacttaggattgttttatttcatgtctgtgttagagaggagggaatagctagaggtgagagcagaacctttcatttttttcccctgctgagacagtaggaaaaaaaccaaaaacctaaacccctacccttttcccacatgtcatcacttgcagacggtttttccacattctgagactcctgcccagaaccctctggaagctgcctgggagccaggctgcctcctgcgtggttctgagctatttctagtggttatttaggaggcactcaactgttttgggatgatcagagttaattttagtcccatctagtaggatatgggctattgccatccctttcttcagaaagtgctgcctgagcctcgctgccaccacaagtgactgatggagttggtgggggaggaccctcctctatcagggacattcaaggtacaagggttttacaggtgtgtattaaagtcagtgatgttcactcttcagaattcaaagagttttctgatgttttaagaacccctaccttgtagtgtttatggtgcttataacacagaggatgttatagaatggkgtttgtttgtttgtttatttatttagagacagagtcttatactgtcgcctgggctggagtgcaatggtgcgatctcagctcactgcaacctccgcctcccaggttcaagcaattctgcctcagcctcccaagtagctgggattacaggtgcccaccaccacgcctggctaaatttttgtatttttagtagagacgaggtttcactatgttggccaggctggtctcaaactcctgacctcatgatccgcccgcctcggcctcccaaaatgttgggattacaggcatgagccactgcgttcggccacaatggtgtttgcagacaggtgtttaatgggttgagaatgcatagtctgagctttctaagaactgttacttctttataagaaaaaataattaaagctcatctgacttcatggcagtggaaggtctggtattttgcaaacgttctttgcagaaagaacccagagaggaaagttctgaggctgaggctgacaatttttccactccatttttttttttttttttaagatggaatcttgctctgtcacccaggctggagtgcaatggtgcaatctcggctcactgcaacctccgttccctgggttcaagcaattctcctgcctcagcctcccgagtagctgggattacaagtgtgcgttatcacgttacctggctaatttttgtatttttagtagaggcagggtttcactatattggccaggctggtctcgaactcctgacctcaggtgatccacccatctcagcctctcaaagtgctgggattacaagcatgagccaccgtgcccaacccactgcatatttttaaagtatggttcgagagagcaaagttttcacacaagactgaaggtgatgtcaaattttttttttttttttttgagaagtactttcgcttttgttgcccaggctgcagtacaatggcgtgatcttggctcactgcaacctccgcctcccaggttcaagtgattctcctgcctcagcctcctgagtagctgacactacaggtgcccaccaccatgcctggctaatttttgtatttttagtagagatggggtttcaccatgttttccaggctggtctcaaacccctgacctcaggtgatctgcccacctcggcctcccaaagtgctgggattacaggcgtgagccaccacacccgggctcatgtcaatttttcatagtaatccccatgtcccagctgtcattttatttctagagctagacaaactgttcaggttccttgattctttccagggagttggggtggctcatgggattttcttaggcttttggtgtagcattaacacaatttattgtgagatgttgacagttgagtattttgagaagaaaattacattataaaaaacaacaaaggcaaccaattttttttttccttttgttttttgagacaaggtcttgctctgttacgcaggctggagtgcagtggtgcaatcatggctcactgcagcctcaacctcctggactcaagtgatcctcccacttcaggctcctgagtagctgggactacaggtgcacgccactactcccggctaattttttattttttgtagagacaggattttcctatgttgctcaggttggtcttgaactcctgagcccaggcaatcccccccacctcagcctctcacagtgctgggattacaggcgtgggccactgcactctgccaaagcaaccaattctttagttctacacggattagaaccttccttttctttgacataatccttttgtcaaaagacagttttacataaattgtttggcaccccactccatgcctggcgcaaagcagatatgtaaatgtgtgcccatgcaagaatcaaatcctttatgtcagtccagaatgaagtagataaaacaagaaatgcttataaattaaggctttggtggcaggatttaggcagctgagaaagcacacctttttattcttcacaagcatcaccttgtgaaagatgcctacgctcttaggtcgagagaggaaatttaagaatgaatacacattgggctaaaactttactatatttcatcctaagagggaaccagacctcgaagttgggaaggctcttgcttataaagggaaatgtgccgtaattcctgtcattttacttgggtcttttaaaaacggcaaattctcatcttccactggctgagagtaaaaagaaagaaaagcggtaaagacttctttttgtgcgtaggtggccccggtgttcacgctgaatacagatttttacacaataaaatcttaaatatctctacatggaacggaatccatttttcctgcctcgggaaggatttctgcgctctcgggtgaagttcccgaagcaaggaaccagttcccctctacctgtactcttgagaggaattctcaggtcatctgaaacacaagtatgggccaggacgacccattcgttcacgcggcccagagctctgcgaaacgggacacggcagtgcaacgggaacaaccggacaccgaggcccccgaaggctgaggccgcggcagaggcggcggcacggtgacgggcgcgactccggccttccggctttctaaggggcggccccgggacacctgagccccgcggggccgtgaacgctcagcacagctccgggccggaatcacgatccaccacaccgcgctggcgctgggaacggcgtcggtgacggaccgggggccggaagtgaaggacgggggaggaccgytgcttccggcgccgtawctgctgccatcttctccgcgctatggctgcgttcggccgtcaggtaagctcgagctgggcgcgcgggcttctccgggtcgcaggcgggcgggcagcgacgcagaggaaccgcggccgccgagtgtttcacggccaggtcgtggagccctcccggaggtccgtgcacgctgacctggttttggcatcctggacccgtggctctgctcaattattgtgggatatagagttgacatttttttttttttgagacaaagtctcgctctgtctccaggctggagtgcaatggcgcgatctcggctcactgcaacctccgcctcccgggttcaagcaattctactgcttcagcctcccaagtagctgggattacaggcgcccgccaccatgcctggctaatttttgtatttttagtagagacggggtttcaccgtgttggccagtctggtctgtaacttctggcctcaggtgatccacccgcctcgaactcccaaagtgctgggattacaggcgtgagccaccgcgcccggcctgagttgactgttgaacaagagtttgaacttcacaaggaagataacatgtacttttcattaagaggaagcggaatcagcatagaggtctttaggcttgagcccagttccacgggccgcgcccgctgaccccagcgactgccaggtgttcctggcggagggagcatctggacaggggaggctggagagcagccagagcttgggcttggcagggtggccccagggcgacaatcgatgacgctggagaaggggttgggaccgatgtgaaggttttagagcaggggttccccaacccccggtaccgtcccttgcctattaggaaccaggctgcacagcaggaggtgagcggcaagtgagccagccagactgtatttacagccgctcccttcgctggcattaccgcctgagctccgcctcctgtcagaccagccgccttagattctcactggagcgcgaaccctattgtgaactgcgcctttgaggggtccaggttgcgctccttatgagaatctgatgcccgatgatctgtcactgtttcccatcaaccccagatggcacctcctggttgtaggaaaacaagctcagggctcccagtgattctacattatggtgagttgtataattatttcatcttatattacaacgtgaaaataacagaaataaagtgcacaacaaatgtaatatgcttgaatcatcctgaaacccctcaccagtctgtggaaaaattgtcttccatgaagccagtccctggtgccaaaaacgttgaagactgctggcttagagtgcctggatgatttgtgcatagtttgttaagcaccagcctgaaccactgaagacttttgaggtcaactggaattgtgtatgcaagttgactaattactgtgacccttgaacaacacaggggttaggggcaccagaccgcccccacaccagttgaaaatcagtgtataacgtttgactcctccaaaactcaactactaatagcctactcatgactggaagccttaccgacaacataaacagttaacacatatcttgtatatatatatattgcattctgtattcttaaagtaagctagagaaaagaaaacgttattcagaaaatcataagggcaaaaccccgtctctacaaaaaatacaaaaattagcagggtgtagtgtgcacctgtagtcccagctactcagaaggctgaggtgggaggattacctcagcctggggaagtcaaggctgcagtgagccatgattgcaccactgcactccagcctgggcaacagagtgagacccccgtctcaaaaaacaaaaagaaaatcctaagagaaaatgtatttactattcattaagaggaagtagatcctcataaggtctttaggctgaagaggaggtgaaggagagtttggtcttggtgtctcaagggtggcagaggcggaagaaaatccacatataagtggatccaagcagttcaaacccttgttgttcaagggccaactctgtatcccacaagattcttctcgtggaatgaatttaagaacatgaatctggaaagtagtctgaggtccagacttttctggcacacatgaccaggtggcctagaaatagtttttccctcttcctccatgtcccygctcccatccttaaagctgcaaaagctaacaatattgtacctgcttgactcccatctctgtggccttgaaataccctgttctttgtgagcttccttctctgtaggcttaagttcagataggattttgcagattgcttataaaaattgtatgtttgtgtggaaccaaggcagtaagtactctggctcagaagtcttatggtgtccattacactggaatagtgaggaattaattgtcttttggtcctgtgtcttacaggtccttgattggcaccgcctgatccccctcacctgggcctgtatggctaggcagactcctcatcttggagaacagagaaggacgacagcttctttgttgcgcaaactgactrcagcctccaatggaggggtcattgaggagttatcttgtgttagatccaataactatgtgcaggaaccagagtgcaggaggaatcttgttcagtgcctccttgagaagcaggggactcctgtggtacaagggtccttggagctagagagggtcatgagttccctcctggacatgggtttcagcaatgcccatattaatgaattgctcagtgtayggcgaggtgccagtcttcaacagttgctggacatcatttcagaatttattctcttgggtctgaatccagagcctgtgtgtgtggtcttgaagaaaagtccccagttattgaaactgcctattatgcaaatgaggaagcgctccagttacctgcaaaagcttgggcttggagaaggtacaagaagttgcagattttggctgggtgcggtggctcatgcctgtaatcccagatctttgggaggccgaggcaggcagatcacttgaggtcaggggttcaagatcagcctggccaacatggtgaaaccctgactcaactaaaaatagaaaaattagctgggcttggtggcacgcacctgtaattccagctacttgggaggctgagrcatgaaaatcgcttgaacccaggaggcggaggttgcagtgagctgagatggcgccactgcactccagcctgggtgacagcaaggctgtctcaaaaaaaaaaaaaaagattttatatagtgtgacaggagccagaggtggggaaagagcagcctaaggtgagatggattaggggaggtttctgagtatgtcagtgttcctggagaggactgtataatttggcttggaggtgaggaataggagtggctttctgtgcagaatacattttgagagggaaggaggaggagttaagactagaagaaaaaattgagtgccagggcagagactcttgtctgccttgttcaccgtgggatcttcagcacctagtgcagtggtgggcatatggtatgtgttcagtgggttgatgctgataatgtgatgttgataaatatgtgtacatatagcatttgatgtttaaatcaacatgaaatggtcttagtgctctgtctctgtgatgtgatgtcaaaccaacatctcttgtaaagacttagattctagtcgagtgtttagatttactctggaacatgagagatctggccaggttcctgggatactcgtggagtggccttcccttctatttatcccccactcctgcccccaacaatattcacatctcaaggatgctcaaagttccttgaatctctttaagggccttctggaggagttgggggtctccaaggacccttacccactttgaccagaggagttccactaytatttctttgcattattgactcttcctggtaagatgttttttgaggcagtggtagaaggtttaggatccaccatttcacagcatctctacaggcctccttctctagaagataagaaaaaggtagccttgtatatttttcttaacagattcttacmgtgtaatctaaaagtctaaatatattatgtgtggtggtgattaattagcaaactcagcacagccttaagaaatgaagataaacctaaactgaaattcctcacatattaagataatcactaactcaaatgttaggaaaattttaattaacagtttaaatagttgactttaagtttcccattactgaattttgctcagctatccctaggaaggcctggaatagtcccagtttacaccagttagtgcggttttaatagggcctctttcactcaaggtgccctggcttggagaagatatatggtgaccctggtaaccaggacgtcagcattggtgttgtgtgtcctcatgattactattattgttattactgttatgatgacgatggtgatggaactccttttcattgagttcagcttgagaatgttagttgtgaatgcttcaatgactattttattatagaaggaaacatcaacccaaaccagcaatatggaggaaactactctcccatattactctctgatctttccagtaaatgcctgggaaattcttttccaagtgaggagggcaagaggagacccaaaatacaaagttggcacctttcaggtgggaggccagaataaagcaggaatatagggagggaaggatggtgagtctgaggagtgtcaggaagtcagtggggagatgtatcatttccatggtgcttctgggaagatagatctgaaattgccacttgctctgtggaaggagaggatccttgtttgtttttaaatgtggacttaaattgggtgcagctagctccttgagtttctggagtatcctgaaattatatgcttgccttttttgaatgttctgcagggaaattaaagagggtgctttactgttgccctgaaattttcaccaygcgccagcaggacattaacgacactgtyaggcttctcaaggagaagtgccttttcacggtacagcaagtcaccaagattttgcacagttgcccctctgttcttcgagaggacctgggtcaactggaatacaagtttcaggtgagaatgactgatagcgtgattagcgtagtttcaggtgagaatgactggtaatgggattagcgtagtttcaggtgagaatgactggtaccgtgattagtgtagtaacagcaagtttctcaggtttttcaaatgtagtgaaggtcagttatatggataagaagcctcggacacctcatatttgagtggaggaagtgaaagactagattctctgcatacatcagccaaagagaaatctttaatttctttactacagatcaaacctattcttcaacttttctgccattaataatgaatgatccagtcctattcttagagtctaagtggggactctgaaatagctaattttaaaatagctgaaaccttcctgtccttagaatctattttgcatgttgattttgaaaatgtaattttaacagttgtccgattttttggtaataattatgacaacttaggtcgaatttctagatgttttctgaatgttttgcctattctttccatattcatccttttccttccccatttaaagaaaaataccacctcttccttctgccccttctccctcctgccccttttccctcccacccctttatttcctgctccatgtttctcaggatgaatttgaaagtgttttgaaactgctggctgtcacacaaatgtcagtatcctagactgggtattcgctgttgtcaattaggcaattctttttgaatccttttgtacaacttaagtttttatggtttatagaatgataggtttcaatactctgtatctgggactcctaagtgtgtttgtgtcttccagtatgcatacttcaggatgggaattaagcatccagacattgtaaagagtgagtacttgcagtattcactaaccaagattaagcagagacacatttacctggagcgcctgggacggtaccaaacccctgataagaaggggcagacacagatccctaacccattgctcaaggacattctcagagtttcagaagctgagtttttggccaggacagcctgtacttctgttgaggagtttcaagtttttaagaagctcctggctcgggaggaggaggagtctgagagcagcacatctgatgacaaaagggcaagtstggatgaggatgaggatgacgatgatgaggaggacaatgatgaggatgacaatgatgaggatgacgatgatgaggacgacgacgaggcggaggacaatgatgaggatgaggacgacgacgaggaggaatagctgtgatggaaggactagagcgaaagggcccagagatatcaaggaagcttttcattctcttaaagcttttgggtcctttacttgaatcttctcaagttattttttattctaaaactggtctcttgatgaaaaaaattataagtcacctgagaggcagacagatcaaaccaaacaggaaacaggaaatgcatgtttgatctgttgtcacgtgtctgtggggagggccctgtcccatcctgaataagatacttatgttgagctattcamatcaaggggactcaatatatcaacaattgkttttatttttttctcttttgaatatgttggtgataattccgtgacagttggaagatggggttcattcttccggttcaggaatcactatgtatttccttcttgtgataaaaataaaattacgagaaggcaatgtgaggttttagtacatcatagcactttattttatgaaaacatgtagcagattttccacaaaaatgcttatttttaatccaaaagtatattgcttcataatggtattcagtgcacagcagagtaaaagaagttaattcatgatgtactggttaattttgcatggcttcttaaggccagcaaaatgctggcagttttctttatctttgtgaagaacaggcccttcctgtttggggaagttggcttttatgtcagctcttggccagtggtcacttccaagcctggtgtctccggccctgtagtctgtagtgccagactgtgctggcctggagagtgctggggcaggtggaggccagggaatggtcccatacagttatctcccctgccctggttacagacagcttcgagaaccagaggagaagagcatagggtcatggagcaggtgggctgaagccagggccacagggagcaatccgtgaccccccaaggtgggtgtgggggggggggggggcgtgtcaccttagggaactcaatgagtccgaagaacaatttgaaatgttgggaaaagagaagaggaatttgatgtcagccggggtgatccctgagatagaggcctgtctctgatggcatgagctctaagagggtcctggaggattggtacatcctagaacattccagttagccctcttttaggggaaactggcataggattgatgcagaaggcatttttgatgatgggaccaaaattcaagtctccttggtagcattctaggatcaactagatcctaggatctggtagattgtaggattctagtgggtagaggccaggggtgctgtraaacatcctgcagtgcacaggatggtcccacaagagaggatgatccggcccagaatgtcagtgctgagcctgagaaactcatctaaggcctggtccacaacagtaatgtgactgttcactcgtgacaacttcagatggtaaatggacttaggatcgtattattttatttaaaagaaaaataaggagctggtttttcagccgggttcctttcccctatgcactggaatacccctggtaggtgtgagctgcatgcaattgtggggattcagcactgaaatctaggtgcttttgttttctccagcagcctcgtcttacagcgtgactgcaaagaaaaagacttttgttttgcaaaagaaaagcagctcggtgactccgtccwcatcgccacagttgagtcagatggcagtggcagtcctttgccagtggaaggagttcctgctaaggggaggtgcrggaggtgagctgatacctgagtggggcccttgcctgttgggttctctactggaggacagtgggcacagcaaagattcccttacttgtacctggcagcccacaygcaatggggaaaagggagagtttgtctttattgccttgcttggccataggcaaaactgtttggaaatgagacatttcactgtgccagtgttttcattttctcttccattgtggcatcccggtcactgccaccctccctagaacctaggctgttgttgtacccagtcggaggactaagtagaatcctcagtctgcacttggttagatgatcagtccatcccggtttcattagcagatgggtaattcagcaactcaggattgcttctttcattttgatacagaaatctttatgctcctgacagttttctgattctattattactaatttccttgggtggactttgagtattttcaaggaagccatttgagtttttaaaagaagccacatgggaaaagctgtggtggcctctttggaatgtttcaagaacgaactgtaattcctgagcaccaggaagtctttttacttgatatttaatgtggaaaacatcccaatgggcaagtcctgtgacagcacttgggactcaggagccagttcttgttgacacaaggcttctaagctaacactggagcatattagcatttgctgtgtggcaccaagcttgggactcaggagccagttcttgttgacacaaggcttctaagctaacactggagcatattagcatttgctgtgtggcaccaagcttgggactcaggagccagttcttgttgacacaaggcttctaagctaacactggagcatattagcatttgctgtgtggctgaggggcttgaggtcctagtagggagtagaaagtttcctagtaggattcacctacttttccagtgataycactcgatcttagcatctgctagtaatgctgtagcttacatggacaaacagtgacaggtcccagggcggcaggaagtccgcagtacgcgtttgtgaacgtggtttctctcagttcacccagtgacccttygctgagctcgagacccttcattgagctccaccttctgctctcaagtgggtctggagcctggggaacagctcgggagtacaggtgaaacttckcgaattgcctgttccttctttctgaaaatgacaaattgcagaatacacagacacatgcacatgaaattttaataaagataaaaagcctaaaatatactctaactcttcaaaaaacayttttatgaaagaggaaaggaaggaggccctctttgtggctggaatgctggctctgagcagagtcagggtgacgcggcagggcgctggctttccagctgggtcagyggtcgtgaggctcaacacgagaggaggtggggtggctgctttggttgtaacattagcagggggaagacagctgcttagaagcatggtgggaagcagatgtggtgaagtgccgtactgttctgcttacaaagatggggatgtctaagatcgtgtttactacctgatagcctaaaacagtatcacttgagtcatggactaaaaggaaccttaaacattgtccagcccagcccaggtgtccatctctgttgcactgagacttgtaaggcgtccttgctgcttcgtggcagtgtgccttagctttccaagcaggggtctgaatagctttttccatgaaaattcaggggtctttctttgatacccttgtgacttgtcattcaggggatggcttccactgtttaaggctgaagcctaggtgatctcatagaacagggttcaccaaataaggcccatgggccaatttggccaccacctgttattgtaaataagtttttattggaacatagccgcagccattcaatgacatgcctgtggctgtgtctgcgctactgtagccacagggacctctggtctgcaaagctgaaaacgtttaccgtctgacccttgatagagaaaggctgccagtcgcgccgttgtctaaaaaagtctgaactccaccttagtgttaactagtccataggatggctcgtcgacctgcacgagcgtcataaacacgctggaggaccagagcaggggcggctgtgtctgcaacccggctttccttctgacatcacctggtctctgcccttcagcccctgcccccgtctctgttttggaagtggtccatcacagttccttctcaatttgttgggcctcgaagggagaattctttctctggctttggagtctaagaacaggtttctgcatactgcagaagcgtggctgactgacagcctcactgattccggggaatggcgagctgtcatctcatccgcagagacacagactacaccttcaggaactgcagcttgggtgagggcacaggctgcttaaacgcatcgcaggactcacaggtggttggtcccagaggggtctctcagggtgggctggtgtgtgcacaggcctggccatctgtcctctagaggcctgaggagagaggtcacagaggggactgactccagctaggaccttttctcagggtgtcctttttcatccagtttttagacctcatcttcctgggtgttagaaactcgtgaggttggtggagtgtaacaagaacgtcttaaatcctttgaagaaaaaacaaagtgaagcatgaggagaatgacaggcattcccactcctctttaaatgggctgcttcctgcttctcttagtggccctcagggcctctgtcacccagaggaccccacgttcttagagcaccaggattctaccatatggcagtgcacacggggaggaccccgcgttcttagagcaccaggattctaccatatggcagtgcacacggggaggggcagcctccaccgactacatccccatctttaggaacatgtgggctcagcattgcaacttttaaatgtgaaatcacagcctgttcctcttccctgccctcctccttccggtaacgactctgggtcttttctccaagggcacagctgtgtcaggttgctctgggttgaaatgaattctcgtgttgttcttggatgggtgtctgggtgcgtgtgtttctgtttcctgcttttttgtgtgttgtctccattatttcaagaataggtattcwataagtcagtatttgataattagttgggggtttctgatttgtttttatgggagtggatgtgctaggcaagcatttaaaaagatacattaatatttcaggtgacttaccaccgtataaatatctcaaacccaaattatgtttgtggattcttaatcctagtacagttaggcactgcacgatgaaggaccgcgcgcatgacagtggtcccatgagattacagtggagctgaggtcatagccatcgtacagaattcttttttcttttttttttttttttgagacagagggtcttgctcagttgcctaagctgtagtatagtggcgcaatctcagcccactgcaacctctgccttccaagttcaagtgattttcctgactcagcctcttcagtagctgagattacaggtgcccaccaccatgtctgactaatttttgtatttttagtagagacagggtttcatcatgttggccaggctggtctcgaactcctggcctcaagtgatccgccggcctcggcctcccaaagtgctagaataattctttttgtgtttgtggtgatgctggtgtatacaaacctactgcactgccctgtgtatagaagtctagcacatacaattatgtagagtacataatacttgatgataatttgtgatgttactggtttacgtatttactatactcttcatcattattttagagtgtactccttctacttatgaaaaaaagttaactataaaatggcctcaggcaggtccttcaggaggtttccagaagaaggcatcattgtcacaggaggtggcagctccatgtgtgttactgggacacgatgtggaagtggaagaaggtgacatggatgatcctgcccctgtgtaggcataagccaatgtgtgtgtttgtgtcttagtttttaacaaaagttaaatagtaaaaaacaattaaaaattttaaaaacagagaaaagcactaaggacagaaaacaattttgaacatccgtacagtgtgtttgtattttaagctgttattaaaaagagttaaaaagtaaaaattaaaaatgtataaagtaaaaaagttacagtaagctaaggttaatttcttattgcaggactaatttattattgtgcaactgccagtcctgcgcattccagctacgctaagcgccctgcccaggtataccattttttatcttttatatctatttttactgtaggttttctacgtttagatacacacacacttggcactgtgttacgaccgcctacagtattcagtaacacgctgtggtgtgtagcccgggagcatgggctctgccacacagcctaggtgcgcagtacgcggtgccatctaggtttgttctaagtatgcgctatgatgttcgcccagatgaaattgcctcacaaagcatttctcagaatgcatctccattgttaagtgatgctcggctgtaggaaattgcttacaagcctggagtgtgcttagtgtgtgtgtctttggagggtgaggtgggagcgggaagtgattccctcgagtcaacaggaagtgaatgctgccggctactctcttatggagagactttccacatccgaagaggcagatgcatgcactctgtcatggccaactcagagctcaagttcctgccatgtgcggagctccggcccagacctttcccccaagggggtgtggacactcttcctttggtgtgtgtgagcctatatctgaaaagctgttttgcttctgtttgtttttaaaggttcctgaatgacatttctcctttatttttttaggcacgtaacaaaacatagrcctgttttgaagtggcttgtyacccaagggtgcctcactcatctgcgccaccaggaagatgaactgtgagggctcctataaggggcaggaagagcaaagctgtcctaggccaaccagagattcatctttcatgcagtgacatgttgataaaaaatgatggtcagtatgaaactggtaacaggttgtagatggctttctatggtatatcccagtctcttgcaaacgattgtgaagaatgccagtgttgtttaagattcggcagtttgtgtggggaggtgggggcaggatggggtttggttgccaaaagagtttgggaaatgctggcttaaacaaaggcgagaggaagttcctttcacgtcaggatttatgaatgcctatgagcccagtgtcagtgacgactttctagcggcggtcttcaacactttctaaatattaagcgatcaaggcccctgccccacttttagttccaacagaatgccgttcacaagatctgggaggcactctctcagccctctcctggagcccccggaatttctcagcagcccaggccctcccgctgcccgtggcccctcctcccaggtgccaggtggtcttccagcctctccaagggcccacccccctgcctcttcctcccactgcagctgatctaggggtttcttggccacatttcccttgagagagagtgggatttgccctatccacagagagcctcatttccacctgaaggtgtatttgtcagtggctagaccaggttcatgtctgtttccccttggggacttctgaaccttcctgcccgggagtctgtaacacagcagcacaggaccgcgcttcctttwgcagtgctgagtaagcaggcagcggcactctgagatcccggggctgggcagtcgccccccacttcccagcagctctgtggtagtggggcgggagcagcagggacgtaccttaagatttctccagtgtctgactcttactttgtttcctgaaataattagagaaaagtcgtttaatgaaaaagagactgtgtaccttgaattctacagctacctcagtccaggctgcctgctgagatcctgtctttagctcacatacattccacggtgggggacaccattagtccagacaccgctgtggagattagcattttagtttgtgtgcgcccgcctggcttgaggcagtagtttaggaatgacaaggctagaaacctggctggctgtgagtcagagagagagaggatggacgtgggagaaagcaagcaaaagctaccctagggaagagccggtgacgtgcacaggccgagcagcacggctggtgagctgcaggctgcggccttgcccggacacttggtaatgccaaacaagtacgtgtggctactcattggtctatgaggacgatgacaggcttcgactctgtggtttctaaagcatataatattctcacgtacttctttcagcaaacgccaaacagtagtaattcttgtaactaccttgaaccctttgtggaaagaacctgggtgtgagtgaataaaaagtaaagagcgacgcgctatatcggccattaaatactcggggctgtccgtaacaccctgtgcttcccaattgtagcaccatgttctgtgtgaatatgcataaccagagtgaccccccccagcacccagcatgcccggctgtgcccctctgggtatgctcacatgcacatatatggacatacagtttcgtagcagaacgtggctgcccaggggctgcctatctgggcgagtagaccgcctggctcagcccacaggcctgcagcatcccatagcaccccgcccttgccccatcaccctgtgggctacatgcaggacacggcatgggcctgctccccagaggcacctgtttggggtcttcttgaggcttgtgctttcacagctctctttgaagcagatgtcttggtgaactcggtagactcttttatacctgttgtcacaagaaagctttgtaaaaccagacagtgaagcaaaatgttgccaactgcttaacctaggctatgtgaacccacagtaaacctgaaggtgtttgagggaaaaactgctattttctgaatgaaacgtgacctcctattgatgtattaaaatgtctaacataaaggtcatgtgatttgtaataaatttattgtggtacagtaatatgcataaaataaacccattttaatgtgcattctgatgagcactgacaaaggatatggtactaaaaataaaatgtgaaatgtcaaagacatgtcagtgctagaggcagccacctggccggaggcctggggaaggtatggcctcgcttttctgtttttctgggtatttcacagagaagtttgaggagtgttggggattcgggattcggatgtaggcattgtagaacaggagacccgatttcatctcctgcctcttccatttattaaccaggctactttgagcaagtctcttcaagttttaagcctcggttgcaggtaaaaatgggacctactcataccatctctcttacaagtttgtagataataatggatgggaaggcgttttgtcttttgttaaagttctcaaatgtcagagctgtttaaaagggaaatccaaggagttcagcaggcaaagctccaactcatatgctaagtctcatagaacctttaggatcgaaaacctgtggtaagacttccatttctggacatgaaagagtaacagaatctggaattaacctcccaatgtgaacaaccagagaactggacaaaatatagtaagtaactgtatgtcagatgttagaaaacagacaacacgagactgtaatccctgagagaggagaaacagatgagatgagtcctgtggtcagcctggaattcagcctagagaagtttttggatggcatcacagagaaaggggatccaagcagtggtcacactgagttgaggaaacagagattgaagttggggagacagaggcagctggaatttgtggggcagagtactgaagaggagggaactatgcagaggaggaactccagaatctgtgtagggtccccttgggcctgtggttggaaataaagctgtgcatgcatagggtgaatccccacaaggcaaagaagaactactgaggagttgaacgatttccagagccagagtagagagatcttgtttattaggccatccatagaaaccccagacagggccaggtgcggtggctcactcctgtaataccagcactttgggaggccaaggcgggccgatcacttgaggtcaggagtttgaggccagcctggccaacatggtgaaaccctgtctctactaaaatacaaaaattagctgggcatggtggtgagtgcctgtaatcccagctacttgggagtctgaggcaggagaatagcttgaacccaggagggcggaggttgtagtgagctgagatcgctccactgcactccagcctgggcgacagagcaagacactgtctcaaaaaaaaaaaaaaaaaaaaaaaagaaaccgcagaaaggccatgccatagaactagggcaaaattaaccccagaataaaggctactccaaagccacctaaaacaagcctcagaaggatcaaactatactcagataatgccttgcagagaaaaaacattcttgaaaagaaaacaaacaaacaaacaaatccagcgtcagtaacataaaacttacaatgcccagcatccaataaaaaactataagacattcaagaatcatttgaataatcaaaaaagtgacccataacctagagaaaaataatcaaatagaataagacccagacatgagagtgatgacagaaatagcagatgaggaccttaaaatatctattataaatttgttccacatgttcagtgagctaaaggaaaatataaagataatgaagatagaaattggagcatctaagaaacaactaaatgaaacttctggagatgataaaacacagtattaataaaacttttgttgaacaggattaatggtagatgctgcagaagaaaagatcaatgaccttgagtgcatagcaatagaatctgtccaaaatgaaaagactgaaaaagttgagaagagctgcagtgacctgtgggacaatatcagtctaatacacgcataactggagtcccagaagtagaagaaatggagggacaggaaaaatatatgaagaaataatggcaaaaattttacgaagtttgacaaaattaaaacccagaaatacaagaagcttaaactccagagaatcaaaacgtagccataccgagaagcacatcataattaaattgtccaaaaacagtcataaagggaaaacataaaaggggcaggaagacacattccatacagtgtaacacaggtaagaatgactgcagtcttcttgtctggaactatgcaagccagaagacaaagccatgacaacttttaagtcatgaaagaaaaaaatataactgtcaatcaagaagtctatattcagcaaatatattcttcaaaaatgaaggtgaaaaaaaaatagtttcagacaaaagcagagagaattcatctcctgcagacctgtgctataggagatgttagagttaagttcttatggcaaagagaaatgataccagatggaatcctagatctacaaaaaggaatgaagagtgctggagtcggcaggcagatgtacaataaatacaaaatactttactttcaatatctaaaacaagataatttttgagtgcaaaaataacgtatagtgcagttcacagcatatgtggaaggaaaaagtctgataataattcaaaggatgggagggaagtggaagcttgatgtcagccgctgccatggatactgaagttgtctactagtgattaaaggtatgcggcgtgaagttgaagatgtgtatggtaaatcctagacactgctggccgggcacagtcactcacgcctgtaatcccagcactttgggagggcaaggtgggtggatcacctgaggtcatgagtttgagaccagcctggccaacatggtgaaaccctgtctctacgtaaactttgtctctactaaaaatacaaaaattagcagggtgtggtggcaggcgcctgtaatcccagctactcggggggctgaggcaggagaattgcttgaacccaggaggcagaggttgcgatgagccaagatcgcaccatcgcactccagcctgggggacaagagggagactttgtctcaaaaaaaaaaaaaaaaaaatcctagacgctgccatcatattgaactcgtacaatagtaattaagggtacattgtgttaaggtgaagatgtgtatggcaaatcccagagcaacctctaaacaataaacctaagaagtataaccagtaagcccatagtggagacaaaatggaatcctaaaaagtaatccaaaattaggcaggaaaaaagaaaaaaggaacaaaaagcaggtgggaaaaatagaaaacaaatagtaatatggcagtttaaatccaaccacatcagccattatgtggaaggtagtaaatggtctaaatactccaataaaaaccagactgtcagactagatatccagcaagacccacctctatgttaaatactagaaagtcacttgaaatatgcagataggttaaaagtgaaaggatagaatgctttcaggaagtgaagggtcttcttgttggatacttggtggtcaccagcaggcactggtgtaactaagcacagcgggaagatggcagatactgtggattcggactctcactgcatagaatccgaattcagtgggctgtcaacacggcttcccaaatcccaacacagattagtatctcatatgtgttcctgctacatattacacctggcttcatgtccaagctctaatgaagcttctacccttgcccgtctacatcccattctccacagagcatccaaagtagtgtaatcgaacatgtcactcttctgctcagaacccttcagtagctcctccccatttcatgccggacaaacaccagagtccttctgtgggtctccatggccccgagggttccctgtccctcacctctcaccactctccacttctcccccaacatgccagggacactcctgacttggggccctggtaactgtcctctggctctggaatgtccatccctcctccatgtctgttcagcatcgccctccccaggaggctgccctcttgctgcaccagccctgcccatccccagcaggctctcctggtctcgtcctgtcatctcgtcctttttccctttgcactcaccacctgccacaccacacaccacactctcactgctgtctgttgtctgtcccctcatctgcaatgaacgggtcctgaaggcagggctttggtctgctctgttctgatgtgtgctgagtatctagaacagtgcccggcacacagcaggtactcagtaagtcatctgttgactaaatggacagtgcccggcacacagcaggtgctcagtaagtcatctgttgactaaatggactgtgtgaccgacagagtcatagagtgttagcaagaaaggacctaagagatgggctgggcatctctccctccacagcccattttggagatggggggcctaaggccacatcatgagttaatggcagaactggggccggcattctcatgagctgtttgtttttccagggggctctgaggaagagaagagaggaaggtcacatcagttggctctgccatccagtggggactgggctgatgtgtgggaaggaaggyctgggggcctggggaccaggagcctgcgttcttctcagcccctgctcctgagctgcatggacttggggcagttattcggtttttctgcctcagctgcctaatttgtgacatggagggaatcgatggtcaaagcaagtcccttctgtgactgcagccatcrtccctcctcagggttagctgggtagctttgagacagcactttgaggagtcaagaacacacgacaaatgcggtaaggcggaggacagaaaccaacttacacgtggtgacagacgcctccctcccagactggaaaggmctttgtctcggagaacagccttgtgcaggggcgggacacctttatacaggctgcgacaaagaagggcagtggctcaccaggtgctcctgacggctcctcctgcccctcttgagaggccttgcccaagggagagggcccgggggtccttaggctggcttcctccaaggcgggatggtgggagagggcccgggggtctgcagctggcttcct
